United States Patent 12,569,549 (FLAVIVIRUS VACCINE) - sequence listing, part 72

SEQ ID NO: 24653 - RNA, 9879 nt, synthetic construct
  misc_feature 1..9879: note = derived and/or modified CDS sequence (opt11) from DENV-1__HQ891315__SS-prME
  source 1..9879: mol_type = other RNA
tcagtgaccatgctgctcatgcttatgcctacagcgctggccttccacctcacaacaagaggcggggagccccacatgatcgtgagcaagcaggagcggggcaagagcctgctcttcaagaccagcgccggggtgaacatgtgcaccttgatcgccatggacctgggcgagctgtgcgaagacactatgacctacaagtgcccccggatcacagaggcagagcccgatgatgtagactgctggtgcaacgcaaccgatacgtgggttacctacgggacctgctcccagaccggcgaacaccggagagataagcgatccgttgccctcgcgccccatgtaggactggggctggagactcgcaccgagacctggatgtcttccgagggcgcctggaagcagattcaacgggtagaaacctgggctctgcgccaccccgggtttacagtcatcgccctgttccttgctcacgcaatcggcaccagcatcacacagaagggaatcatcttcatcctcctaatgctggtgaccccctccatggccatgagatgcgtcggcatcggctcgcgcgacttcgtcgagggcttaagcggcgccacgtgggtggatgtcgtgttagagcatgggagctgtgtgaccaccatggccaaggacaagcccaccctggacattgagttgctgaagacggaggtcaccaaccctgccgtgctcagaaaattatgcattgaggcgaaaatctcgaacaccaccacggacagtagatgtcccacccaaggcgaagccactctggtggaggagcaggacgccaacttcgtctgccgtcgcacgttcgtggaccggggctgggggaacggatgtggtctgttcggcaaggggtccttactgacgtgcgccaagttcaagtgcgtcacaaaactggagggaaagatcgtccagtacgagaacctcaagtacagcgtgatagtgaccgtacacactggcgaccaacaccaggtcggtaacgagtccaccgagcatggcaccacagcaaccatcacgccccaggcccccaccaccgagatacagctgaccgattacggggccctgaccctcgactgcagccccagaacgggcttagacttcaacgagatggtcctgctcaccatgaaggagaagtcttggctggtacacaagcagtggttcctagacctcccactgccatggaccagcggggccagtacgtcccaggagacctggaacagacaggacctcctcgtgacctttaaaactgcccatgcgaagaagcaggaggtggtggtgctgggcagccaggagggcgccatgcacaccgccctaaccggggccaccgagatccaaacctccggcacaacgactatattcgccgggcaccttaagtgccgtctgaagatggataagctgacactcaagggcatgtcttacgtcatgtgcactggtagtttcaagctggagaaagaggtggcggaaacgcaacacggcaccgtcctcgttcagatcaagtacgagggtacggacgccccttgtaagatcccctttagcacccaagacgagaaaggggtaacgcagaacggcagactgatcaccgccaacccgatcgtgaccgataaggagaagcccgtcaacattgaggccgagccccctttcggggaatcctacatcgtgatcggcgcgggcgagaaggccctcaagttaagctggttcaagaaggggtccagcatcggcaagatgtttgaggccaccgctcgcggggcacggaggatggcgatcttaggcgacaccgcctgggactttggctccatcggcggcgtgtttacctccgtcgggaagctcgtgcaccagatcttcggcacggcgtacggggtgttattctcgggcgtctcatggaccatgaagattgggatcggcgtactgctcacttggctgggtctgaactcccgcagcacctccttatcgatgacgtgcattgccgttgggctggtcacgctgtacctcggggtgatggtgcaagcggactccgggtgtgtaatcaattggaagggcagggaactgaagtgcgggtctggcatcttcgtgacgaatgaggtgcacacctggaccgagcagtataagttccaggcggacagcccaaagaggctgtctgccgccatcggcaaggcgtgggaagagggagtctgcggcattcggtctgccacccgcctcgaaaacatcatgtggaagcagatctccaatgagctcaaccatattttgctcgaaaacgacatgaaattcaccgtggtagtaggggacgtggcgggcattctggcacaggggaaaaagatgatacggccacagcccatggaacataagtatagctggaaaaactggggcaaggccaaaatcatcggcgccgacgtgcagaactccacgttcatcatcgacggacccaataccccggagtgttcagacgaccagcgcgcgtggaacatttgggaggtcgaagactacggcttcgggatattcaccaccaacatttggctgaagctccgggactcctacacgcaggtgtgcgaccaccgcctgatgagcgccgcaattaaggactccaaggctgtgcatgcagacatgggctattggatcgagagcgaaaagaacgagacctggaagctggcacgcgcttcctttatcgaggttaagacctgcatatggccaaagtcccataccctctggtccaacggcgtgctcgaaagcgaaatgatcatccccaagatctacgggggccccataagccagcacaactaccgcccggggtacttcacgcagacagccggcccctggcacttagggaagctcgagctggactttgacctgtgcgagggcacaactgtggttgtcgacgagcactgcgggaaccgggggcccagcctccgcacgaccaccgttaccggcaagataatacacgagtggtgctgtcggtcctgcacgctgccccccttacgctttagaggggaggacggctgctggtacgggatggagatccgcccggttaaggagaaggaggagaatctcgttaagagcatcgtgagcgctggcagcggggaggtggacagcttctccctgggtctgttatgcatcagcattatgatcgaggaggtaatgcggtcccgctggagccggaaaatgctgatgaccgggacacttgccgtgttcttcctactgatcatgggccaactgacctggaacgacctcatccgcctctgcatcatggtaggcgcgaatgcctccgaccgcatgggcatgggcacgacctacctcgccctcatggccacgttcaagatgcggccgatgttcgccgtgggtctgctgttccgcaggctcacctctcgagaggtgctgctgctcacgatcggcctgtccctagtcgcaagcgtagaactcccgaatagtctagaggagctcggcgacggcctcgcgatgggcatcatgatcctgaagctgctcactgacttccagtcccaccaattgtgggccaccctgctctccatgaccttcatcaaaaccaccttcagcctacactatgcctggaagaccatggcgatggtactgagtatcgtgagcctctttcccctgtgtctgtccaccacgtcacagaagaccacctggctccctgtgcttttgggctcactcggatgcaaacccctgaccatgttcctgatcgccgagaacaagatctggggccggaaaagttggccgctgaacgagggaatcatggccgtcggcatcgtgagcatcctattgtctagcctcctgaagaatgacgtgccgttagccggacccctcatcgctggcggcatgctgatcgcttgctacgtcatttccggcagttccgccgacttaagcctagagaaggccgcagaagtgagttgggaggaggaagcggaacactcaggcgcgtcccacaacatcctggtggaggtccaggacgacgggacgatgaagatcaaggacgaggagcgggacgacacccttaccatcctcctgaaggccaccctactcgccgttagcggcgtctatcccctgtccatcccggccaccctgttcgtctggtacttctggcagaagaaaaagcagcggagcggggtgctctgggatacgccaagcccgcccaaggtagagcgcgctgtgttagatgacggcatctaccggatcatgcagcgaggcctgctggggcggtcacaggtaggggtaggcgtcttccaggagaatgtcttccacaccatgtggcatgtgacccgcggcgcggtcttgatgtaccagggcaaacggctggagccgtcctgggccagcgtgaagaaagacctgatctcctacggcggcggatggcggcttcagggtagctggaacacaggggaggaagtacaagtcatcgccgtggagcccggcaagaaccccaaaaacgtgcagacggcccccgggacatttaagactccggagggcgaggtcggagccatcgcgctggacttcaagcccggcacctccggcagccccatcgtgaaccgggaggggaaaatcgtgggcctgtacggcaacggggtggtcacgaccagcggaacctatgtttccgcgatcgcccaggccaaggcgagccaagaggggcccctccccgagatagaagacgaggtcttccgcaagcggaacctcaccatcatggacctgcaccctggatccgggaaaacgcgccggtaccttcccgccatcgtgcgggaggccatcaagaggaagatgagaaccctgatcctggccccgaccagggtcgtcgccagcgagatggcggaggccctcaagggcatgcctatcaggtaccagactacggccgtgaagtctgagcacaccggcaaggagatcgttgacctgatgtgccatgcgaccttcaccatgcgcctgctctcccctgtccgggtacccaactataacatgatcatcatggacgaagcccacttcacggacccgagcagcatagcggcgcgcggatacatctccacccgggtgggcatgggagaggcagcagctattttcatgacggcaacgccgcccggcagcgtagaggccttcccacagtctaacgccgtgatacaggatgaggagagagacatccctgagcgaagctggaactccgggtacgagtggatcacggacttccccggcaagactgtgtggttcgtcccctcaatcaaagccgggaacgacatagcaaattgcctacgcaagaacgggaagcgggtgatccagctatcccgcaagacctttgacacagagtaccagaaaacgaagaataacgactgggactacgttgtcactaccgacatcagcgagatgggcgcgaactttcgggccgaccgcgtgatcgacccccggcgctgcctcaaaccggtgatcctgaaggatgggcccgagcgggtcatccttgccggccccatgccagtaacagtcgcatccgcggctcagcggcgaggacgcatcggccggaatcataacaaagagggcgaccagtacatctacatggggcagcctctcaacaatgacgaggaccacgcccattggacggaagccaagatgttattggataacatcaacactcccgaaggcatcatccccgccttgttcgaacccgagcgcgagaagtccgcggccatcgacggggaataccgcctgcggggtgaagcacgtaagaccttcgttgaactgatgcggcgcggggatctcccggtgtggctgtcctacaaggtcgcaagcgagggtttccagtacagtgaccggcgctggtgctttgatggcgagaggaataaccaggtgctggaggagaatatggatgtggagatttggactaaagaaggcgagcgcaagaagctccgcccccgctggctggacgcgcggacatactccgaccccctggcgctccgcgaattcaaggagtttgccgccgggaggcgcagcgtctcgggggacctgatcctggaaatcggcaagctcccccagcacctcacccagcgggcccagaatgcgctggacaacctcgtgatgctgcacaacagcgagcaggggggtcgcgcttaccggcacgccatggaggagctgccggacaccatcgagaccctcatgctcctagccctcatcgccgtcctgacgggcggggttacgctgttcttcctctccggcaaggggctgggcaagacctctatcggccttctctgcgtgatggcgtccagcgcactgctgtggatggcctccgtggaaccccactggatcgcagcgagcatcattctcgagttcttcctcatggtcctgctcatcccagagcctgaccgccagcggaccccgcaggacaaccaactggcgtacgtggtgattgggctactattcatgatcctgactgttgccgcaaacgaaatgggtctgctcgagacgaccaagaaggatctggggatcggtcacgtggccgtggagaaccaccaccacgctgcgatgctggacgtcgacctacacccggctagtgcatggaccctgtatgcagtcgcgaccacaatcatcacccccatgatgcgccacaccatagagaacaccacggccaatatctcactgaccgccatagccaaccaggctgctatccttatggggctggacaagggttggccgatctccaagatggacatcggggtgcccctgctcgctctggggtgctacagccaggtgaaccccctgacactcaccgcggccgtgctgatgcttgtggcgcactacgcgataatcggccccgggctccaggccaaagcgactcgggaggcccagaagcgtaccgccgcgggcatcatgaagaatccgacaatcgacggtatcgtcgccattgacctagaccccgtcgtgtacgacgccaagttcgaaaagcaactgggccagattatgctcctgatcctgtgcacctcccagatactcctgatgcgcacaacgtgggccttgtgcgagagcatcaccctcgccaccgggcccttgacgaccctgtgggaggggtcacccggcaagttctggaataccaccatcgcggtgtctatggccaacatcttccggggatcctacctagccggcgccggactcgcattcagcctgatgaagtcccttggcggcgggcgccgggggactggggcccagggcgaaaccttaggcgagaagtggaaacgccaactcaaccagctatccaagtctgagttcaacacctacaaacggtcaggtatcatggaggtcgatcgcagcgaggccaaggagggcctgaagcgcggagagaccactaagcatgcagtgtcccgcggtaccgcaaagctgcggtggttcgttgagagaaacctcgtcaagccggaagggaaggtgatcgacctgggctgtggcagaggcggatggtcctactactgcgcggggcttaagaaggtaaccgaggtcaagggttacaccaagggcggacccggccacgaggagcccatccccatggccacatatggatggaacctcgtaaaactacactccggcaaggacgtcttcttcatcccgcccgaaaagtgcgacacactgctttgcgacatcggggagagctcccccaaccccacgatcgaagaagggcgaaccctccgggtgctgaagatggtggagccgtggttacgcgggaaccagttctgtatcaagattctaaacccttacatgccctcggtagtggagacgctggaacagatgcagcggaagcacggcggcatgctggtccgcaaccccctctctcgtaactccacccatgaaatgtactgggtatcctgcgggactggtaacatcgtgtcggccgtaaacatgacgtcccgtatgctgctgaaccggttcaccatggcacatcgcaagccgacgtacgagcgggacgttgatctcggagccggcacccggcacgtggcagtagagcccgaggtcgcgaacctggacatcataggtcaacgcatcgagaatatcaagcacgagcacaagagcacgtggcactacgatgaggacaatccctacaagacgtgggcgtaccacggctcctacgaagtgaaacccagcggctccgccagcagtatggtgaacggggtcgtgaagctcctcacgaagccctgggacgtcattccaatggtgacacagatcgccatgaccgacaccacgcccttcggccagcagcgggtgttcaaggagaaggtggacacccggacccccaaggcgaagcggggaaccgcccagatcatggaggtgacggcgcgttggctatggtcctttctaagtcgcaacaagaagccccgcatctgtacccgggaggaattcaccagaaaggtgaggtccaatgccgcgatcggcgccgtcttcgtggacgagaaccagtggaactctgctaaagaggctgtggaggacgatcgattctgggacttggtccaccgggagcgcgagctgcacaagcagggcaaatgcgcgacctgcgtgtacaacatgatggggaagcgggaaaagaagctgggagagtttgggaaggcgaagggctccagagctatatggtacatgtggttaggggcccggttccttgagttcgaggcccttggcttcatgaacgaagaccactggttcagccgcgaaaactccctcagcggagtcgaaggggaaggcctgcataagctgggctacatcctccgagatatctccaagatccctggcgggaacatgtacgccgacgatacggcgggttgggacacccgcatcaccgaagacgacttgcagaacgaggctaagatcaccgacatcatggagcccgaacatgccctgctcgcgaaatcgatcttcaagctgacgtaccagaacaaagtcgtgcgggtgcagcggccggctaagaacggaacggtaatggacgtgatctcccgacgggaccagcgcgggagcggccaggtggggacgtacggcctaaacactttcacaaacatggaggcgcagctgatccggcagatggagtccgaagaaatattcagcccgaatgagctggaaacgccgaacctcgcagagcgcgtcctagactggctggagaagtacggcgtcgagcgacttaagcgcatggccatctccggtgatgattgcgtggttaagcctatcgatgaccggtttgccaccgccctgaccgcgctaaacgacatgggaaaggtgcgcaaggatatcccgcagtgggaacccagcaagggttggaacgactggcagcaggtccccttctgctcccaccacttccaccagttaatcatgaaggacggccgtgagatcgtcgtgccctgccgcaaccaggacgaactcgtgggccgggcacgcgtcagtcagggagccggatggagcctgcgggagacggcctgccttgggaagtcctacgcgcagatgtggcaattgatgtacttccaccgccgggacctgcggttagccgccaatgccatctgtagcgcagtccctgtggactgggtccccacctcccggaccacctggtctatccacgctcaccaccagtggatgacgaccgaggacatgctctccgtgtggaatcgcgtctggatcgaggagaacccctggatggaagacaagacccgggtctcgtcctgggaagacgtgccctacctgggaaagcgggaggaccaatggtgcggctcgctgatcggtctcaccgcccgcgctacttgggccaccaacatacaggtggcaatcaaccaggttcggagactgatcgggaacgaaaactactcggattacatgaccagcatgaagcggttcaagaacgagtccgagccggagggcgcgctgtggtga

SEQ ID NO: 24654 - RNA, 9879 nt, synthetic construct
  misc_feature 1..9879: note = derived and/or modified CDS sequence (opt11) from DENV-1__HQ891316__SS-prME
  source 1..9879: mol_type = other RNA
agcgtgaccatgctgctcatgctgatgccgaccgccttagcctttcacctcacgactcggggcggggagccccatatgatagtgagcaagcaagagcgaggtaagagcctgctgttcaagacgagcgccggggtgaacatgtgcaccctcatcgcgatggacctgggtgaactgtgcgaggacacaatgacctacaagtgcccacgaatcaccgaagccgagcccgacgacgtggactgctggtgcaacgccaccgacacgtgggtaacctacgggacctgcagccagaccggcgagcaccggcgcgacaaacggtccgtggcccttgcccctcacgtgggcttagggcttgagacgcgcaccgaaacctggatgagcagtgagggagcctggaagcagatccaacgggttgagacctgggccttacgtcatcccgggttcacggtgattgccctgtttctggcgcacgccatcggcacctcaatcacccagaaggggatcatctttatcttactgatgctggtgacgccctccatggcaatgcggtgcgtcggcatcggcagccgcgacttcgttgaggggctctccggagcgacatgggtcgacgtcgtgctggagcatgggagctgcgtgaccaccatggcaaaagataagcccacactggatatagagctcttgaagacggaggttaccaaccctgcggtactgcggaaactctgcatcgaggccaagatatccaacaccaccacggacagccgctgccccacccagggcgaggccaccctggtggaggagcaggacgccaacttcgtctgcagacgcaccttcgtagaccggggatgggggaacggctgcgggctgttcggcaagggatccctcctaacgtgtgccaagttcaagtgcgtgaccaagctggagggcaaaatagtccagtacgagaacctcaaatacagcgtaatagtgaccgtccacaccggcgaccaacatcaggtggggaacgagagtacggagcacggcaccaccgcgaccatcacaccgcaggcccccacgaccgaaatccagctgaccgactacggggccctgaccctcgactgcagcccccgcacaggcctggacttcaacgagatggtcctgcttaccatgaaggagaagtcctggctggtgcacaagcagtggtttctggacctcccgctgccgtggaccagcggggctagcacctcccaggagacgtggaaccggcaagacctgctcgtgacttttaagaccgcccacgcgaagaagcaggaggtcgtagtgctgggcagccaagagggcgccatgcacaccgccctgacaggggccacggagatccagacctccgggaccaccaccatattcgcggggcacctcaagtgccgcctgaagatggacaagcttacgctcaagggtatgagctacgtcatgtgcactgggtcctttaagctggagaaggaagtggcggaaacgcagcacggcaccgtgctggtccagattaagtacgagggcaccgacgccccctgcaagatccccttcagcacccaggacgagaagggggtaacgcagaatggccggctgataaccgccaacccgatcgtgaccgacaaggagaagcccgtgaacatcgaagcagagccccccttcggggagtcttacatagtgatcggagcgggcgagaaagccctcaagctgtcttggttcaagaaggggtcgagcatcggcaagatgtttgaggccaccgccaggggggccagacgcatggcgatcctgggcgacacggcctgggactttgggagtatcgggggcgttttcacctcagtcgggaagctcgtgcatcagatctttggtaccgcctacggagtgctgttctccggcgtcagctggaccatgaaaatcggcatcggcgtcttgctaacctggctgggcctcaattcccgcagcaccagtcttagcatgacctgtatcgccgtggggctggtcaccctatacttaggcgtgatggttcaggccgactccggctgcgtcatcaactggaagggacgggagctgaagtgcggcagcggcatcttcgtgacgaacgaggtccacacctggaccgagcaatacaagttccaggctgacagccccaagcgcttatccgccgccatcggcaaggcgtgggaggagggggtatgtgggatccggagcgccaccagactggagaacatcatgtggaagcagatctccaacgagctgaaccacatcctgctcgagaacgatatgaagtttacagtggtggtgggggacgtggcgggtatcctggcccaggggaagaaaatgatccggccccagcccatggagcacaagtacagctggaagaactggggcaaggcaaagatcatcggcgccgacgtccagaattccacgttcattatagacgggcccaacaccccggagtgcagcgacgaccagcgcgcgtggaacatttgggaagtggaggattacggatttggaatatttaccaccaacatctggctgaaactccgggactcctacacccaggtgtgcgaccaccgcctaatgagcgcagccatcaaggactccaaggccgtgcacgccgatatgggctattggatcgagtctgagaagaatgagacttggaagctggcgcgggcctccttcatcgaggtcaagacctgtatctggccgaagtcccacaccctctggagcaacggcgtgctggaaagcgagatgatcatccccaagatctacggcgggccaatctcgcagcacaactaccgcccagggtacttcacgcaaaccgcgggcccctggcacttggggaagcttgagctggactttgatctgtgtgaagggaccaccgtggtcgtggacgagcactgcggcaaccgagggcccagcctcaggacgacaactgtgaccggcaaaatcatccatgagtggtgctgcaggtcctgcaccctcccgcctctgcgtttccgcggggaggacggctgctggtacggtatggagatacgccccgtaaaggaaaaggaggagaacctcgtcaagagcatggtgagcgcgggttccggcgaggtggatagcttctccttagggctgctctgcatcagcatcatgatagaggaggtaatgcggtcgcgctggtcaagaaaaatgctgatgacgggcaccctggcggtgttcttcctactgatcatggggcagctgacctggaacgacctcatacgcctgtgcatcatggtcggggcgaacgcctccgacagaatggggatgggcacgacctacctagctctcatggccacctttaagatgcggcccatgttcgccgttggcctccttttccgccggctgaccagccgggaggtgctgctgttaactatcggtctgtccctggtcgcgagcgtagaactcccgaactcactggaggagctgggcgacgggctcgctatgggcatcatgatactgaagttgctcaccgacttccagagccaccagctgtgggcaaccctactctccatgacattcataaagacgacctttagtctacactacgcctggaagacaatggcgatggtcctgtcaatcgtaagcctcttccccctttgcctgtccaccaccagccagaaaaccacctggctacccgtgctgctgggctccctagggtgcaaacccctgaccatgttcctgatagccgagaacaagatctggggccgtaaatcatggccgcttaacgagggcattatggccgtcggcatcgtgagcattctgctatcctcgctcttgaaaaacgacgtgccgctggccgggcctctcatcgccggcggcatgctgattgcgtgctacgtcatcagtgggagctccgccgacctgagcctcgagaaggccgccgaggtgtcctgggaggaggaagcggagcacagcggagcgtcccacaacatactggttgaggtccaggacgatgggacgatgaagatcaaagacgaagagcgcgacgacaccctgaccatcctcctcaaggccaccctactcgctgtaagcggcgtgtaccccctttccatcccagccaccctgttcgtctggtatttctggcagaaaaagaagcagagaagcggggtgctctgggatacgccgagcccgcccaaggtagagcgcgccgtcctggacgacggcatataccggattatgcagcgcggcctgctggggcggagccaggttggcgttggggtcttccaggaaaacgtcttccacaccatgtggcacgtgacccgcggtgcagtcttaatgtaccagggcaagcgtctggagccgtcctgggccagcgttaagaaggacctgatctcctacgggggcgggtggcgcctgcaaggcagctggaacacaggggaagaggtgcaggtcatcgccgtggagcccgggaagaatccaaaaaatgtgcagacggcccccgggaccttcaaaaccccggagggggaggtcggtgcgatcgctctggacttcaaacccgggacctccggcagccccatcgttaaccgagaggggaagatcgtgggcctctacggcaacggtgtcgtaacgaccagcggcacctacgtgtccgccatcgcccaggccaaagcatcacaggaggggccgctcccggagatcgaagatgaggtcttccgcaagcgtaacctgaccatcatggacctacatcccggctccgggaagacacgtcggtacctaccagccatcgtgcgcgaggcaatcaagaggaagatgcgcaccctgatactggccccgacccgagtggttgccagcgagatggcagaggccctcaagggcatgccgatcaggtaccagaccacggccgtgaaatccgagcacaccgggaaggaaatcgtggacctgatgtgtcacgccaccttcaccatgcggttactcagcccggtcagggttcccaactacaacatgatcatcatggacgaggcccacttcacagacccgtctagtatcgcggcccgagggtatatcagtacgcgggtcggcatgggtgaggcagcggccatcttcatgacagcgacgccgcccggctcagtcgaggcgttcccccagtccaacgccgtgatccaggacgaggagcgcgacatcccggagcggagctggaacagtgggtacgagtggatcacggacttccccggcaagaccgtgtggttcgtcccaagcattaaagccggaaatgacatagccaattgtttacggaagaacgggaagcgagtgatccagctgtcccgcaagaccttcgacaccgagtaccagaagacgaagaataacgattgggactacgtggtcaccaccgacatctccgagatgggcgccaacttccgggccgaccgtgtgatcgatccccggcggtgcttaaaaccggtgatccttaaagacgggcccgagcgggtcatactggccggtcccatgcccgtaaccgtcgcctccgcggcacagcgtcggggccgcatcggacggaaccacaacaaggagggagaccagtacatatacatggggcagccgctcaacaacgacgaggaccatgcccattggacggaggccaagatgctgctggataacatcaacacccccgagggcattatccccgccctcttcgagcccgagagagaaaagagtgctgctatagatggggaataccgcctgcgtggcgaagcccgcaagaccttcgtagaactgatgaggcgcggggacctcccggtttggctgtcctacaaagtcgccagcgaaggcttccagtacagcgaccgccgctggtgcttcgacggtgaacgtaacaaccaggtgctggaagagaacatggacgtggagatctggaccaaggagggggagaggaagaagctcaggccaagatggcttgacgcgcgcacgtactccgaccccttagcactccgcgagttcaaggagttcgcagccggtcggcgcagcgtctctggcgatctgatcctcgagatcggaaagttaccccaacacctgacccagcgggcacagaacgcactggacaatctcgtgatgctgcataacagcgagcagggcgggagggcttaccggcacgctatggaggagttgccggacacgatcgagacattaatgctcctcgccctcatcgccgttcttaccggaggggtcactctgttctttctctccggcaaggggctgggcaagactagcatcggactgctttgcgtgatggcgtccagcgcgctcctgtggatggcctccgtcgagccccactggattgcagcgtcgatcatcctcgagttcttcctgatggtcctactcatccccgagcccgaccggcaacggaccccgcaagacaaccagcttgcatacgtagtaatcgggctcctgttcatgatcctgaccgtcgccgccaacgagatgggtcttctagagacgaccaagaaggacctgggtatcggtcacgtggccgtcgagaatcaccatcacgcagcgatgctggatgtagacctccacccggcctccgcctggactctttacgccgtcgccaccacgatcatcacccccatgatgagacacaccatcgagaacaccacggctaacatcagcctgaccgccatcgcaaaccaggccgcgatccttatggggctggacaagggatggccgatctcgaagatggacatcggcgtccccctgctcgccctggggtgctattcacaggtcaaccccctgactctcaccgccgcggtgcttatgctggttgcgcattacgcgatcattggccccgggctccaagccaaggcgactcgggaggcacagaagcgcaccgctgcgggcatcatgaagaatccgaccatcgacgggatcgtcgccatcgacctcgaccccgtggtttacgacgccaagttcgagaagcagttgggccagattatgctcctgattctatgcacctcccaaatactcctgatgcgcacgacatgggcgttgtgtgagagcataacattggccaccggccccctcacgaccctgtgggaggggtctccgggcaagttctggaacacgacgatcgcggtcagcatggccaacatcttccgggggtcctacctcgcgggagctgggctggcgttctcgttaatgaagtccctcgggggcgggagacggggcacaggagcccagggcgagaccctgggtgagaagtggaagcgccagctcaaccagctctctaaaagcgagttcaatacctacaagcggtccgggatcatggaggtggaccgctctgaggccaaggagggcctgaaacgcggggagactactaagcacgcggtgtcccgaggcaccgcaaagctacggtggttcgtcgagcgaaacctcgtgaagccagaggggaaggtgatcgacctgggctgcggcagaggcgggtggagctattactgcgcgggcctgaagaaggtcaccgaggtgaaggggtacaccaagggcggccccggacacgaggagcctatcccgatggctacctacgggtggaacttggtgaaactccactccggtaaggacgtcttcttcatcccgccagagaagtgcgatacccttctgtgcgacatcggtgagagctcacccaaccccactatcgaggagggccgcaccctccgggtgctcaagatggttgagccgtggttgcgcggaaaccagttctgcatcaagatactcaacccgtacatgccctccgtagtggagacgctggagcagatgcaacggaagcacggcgggatgttggtgcgcaaccccctctcccggaacagcacccacgaaatgtactgggtctcctgcggaacgggcaacatcgtctcggccgtgaacatgaccagtcgcatgctgttgaaccggttcacaatggcacacagaaaacccacgtacgaacgcgacgtcgatctcggggccggtacccgacacgtcgcggtagagcctgaagtcgccaacctggatataatcggccagcgcatcgagaatatcaaacacgagcacaaatccacctggcactacgacgaggacaacccttacaagacctgggcttatcacgggtcgtacgaggtgaagccctcgggctcagccagcagcatggtgaacggggtcgtgaagctgctcactaagccgtgggacgtcattcctatggtgacacaaatcgccatgaccgataccacgcccttcggccagcaacgggtattcaaggagaaggtcgacacccgcacccccaaggcgaagcgggggaccgcccagattatggaggtgactgcccgctggttatggtcctttttaagccggaacaaaaagcctcgtatatgcacccgtgaggagttcacccgcaaggtgcggtccaacgccgctatcggcgccgtttttgtggacgagaatcagtggaactccgctaaggaggcggtggaagacgatcggttctgggacctcgtacaccgggagcgcgagctgcacaagcagggcaagtgcgccacgtgcgtatacaatatgatggggaagcgggagaagaagctgggggaatttgggaaggcgaaggggtcgagggccatctggtacatgtggctcggggcccggttcctggaattcgaagcccttggctttatgaacgaagaccattggttcagccgcgaaaactctctaagcggcgtggagggggaaggcctacacaagctcgggtatatcctccgtgacatctccaagatccccggcgggaacatgtacgccgacgacacggcgggctgggacacccgcatcaccgaggatgacctgcagaacgaggcgaagatcaccgacatcatggagcccgagcacgccctgctcgccaagagcatctttaagctgacctaccaaaacaaggttgtgagagtccaaaggccggccaagaatggcacggtcatggacgtgatctcccgccgggatcagcgcgggtcaggccaggtcggtacgtacggtttgaacacctttacaaacatggaggcgcagctcatccgacagatggagtccgaggagatcttttctcctaacgaactggagaccccgaatctggccgaacgcgtcctcgactggctggagaagtacggggtagagcggctgaagcgcatggccatctccggggacgactgcgttgtaaagccaattgacgaccggttcgccaccgccctgaccgcccttaacgacatgggcaaggtgcgcaaggacatcccgcagtgggagcctagcaaggggtggaacgactggcagcaggtcccgttctgctcccaccacttccaccagcttatcatgaaggacggccgcgagatagtcgtcccctgcaggaaccaggatgagcttgtggggagggcccgcgtcagccagggagccggctggagcctgcgtgagactgcttgcctggggaagtcctacgcccagatgtggcagctcatgtatttccaccgcagggatctgcgccttgccgccaatgccatctgcagcgccgtgccggtggattgggtccccacatccagaacaacctggagcatccatgcccaccaccagtggatgacgaccgaggacatgctttccgtgtggaaccgcgtgtggatcgaggagaacccctggatggaggacaagacccgggtcagcagttgggaggacgtgccctacctgggcaagcgcgaggaccagtggtgcggcagcctaatcggcctcacagcccgcgccacgtgggccactaatatccaggtggccataaaccaggtccggcgcttaatcgggaatgaaaactactccgactacatgaccagcatgaagcggttcaagaacgagtccgagccggagggcgcgttatggtga

SEQ ID NO: 24655 - RNA, 9879 nt, synthetic construct
  misc_feature 1..9879: note = derived and/or modified CDS sequence (opt11) from DENV-1__JN054256__SS-prME
  source 1..9879: mol_type = other RNA
agcgtaaccatgctgttaatgctgatgcccacagccctggccttccatctcacgacccgggagggcgagccacacatgatcgtgtcaaagcaggagcggggaaaaagcttactttttaagactagtgccggcgtgaacatgtgcaccttaatagccatggacctgggagagctgtgcgaagacaccatgacctacaagtgcccacggatcaccgaggcggagcccgacgacgtggactgctggtgcaacgccaccgatacgtgggttacgtacggtacgtgcagccagaccggggagcatcgtagagacaaacggagtgtcgcgctcgcgccccacgtgggcctgggcctggagacccgcacggagacctggatgtcctccgagggggcatggaagcagatccagcgagtcgagacctgggcgctccgccaccccggcttcacggtgattgctttattcctggcgcacgccattgggaccagcataacccagaagggcatcatcttcatcctcctgatgctagtaaccccatccatggccatgcggtgtgtcggcatcggctcccgcgacttcgtcgagggtttgagcggggccacgtgggtggacgtcgtgctggagcacggcagctgcgtaacaaccatggccaaggacaagcccaccttagacatcgagctactgaagacggaggtcaccaaccccgcggtgctgcgcaaactctgtatcgaggctaagatttccaacactaccacggacagcagatgccccacccagggagaggctacattggtcgaggagcaggacgccaacttcgtctgtaggcgcaccttcgtggatcggggttggggcaacgggtgcggcctgttcgggaagggctccttattaacgtgtgccaagtttaagtgcgtgaccaagctggaggggaagatcgtccagtacgagaacctcaagtacagcgtgattgtgacagtccatactggcgaccagcaccaagtgggcaacgagtccacggagcacgggaccaccgcgaccatcacgccgcaggccccaaccaccgaaattcagctgaccgattacggcgctctgaccctcgactgcagcccacgcacggggctggactttaccgagatggtcctcctcaccatgaaggagaagtcctggctggttcacaagcagtggttcctggacttgccgcttccctggacctccggagcgtccacttcccaggagacctggaaccggcaggacctgcttgtgaccttcaaaacggcacacgctaaaaagcaggaggtcgtggtattggggagccaagagggcgccatgcacacggcgctgactggcgccaccgagattcaaacctccgggacgaccaccatattcgcaggccacctcaagtgtcgccttaagatggacaagctgacactcaagggaatgagctatgtcatgtgtactggctccttcaagctggagaaggaagtggcggaaacccagcacgggaccgtgctggtccaaatcaaatacgagggcaccgacgccccctgcaagatccccttctctacgcaagacgagaagggcgtgactcagaacggccggctaatcaccgccaatcctatcgtgaccgataaggagaaaccagttaacatcgaggccgagccgcccttcggcgagtcctacattgtgatcggcgcgggcgagaaggcattaaagctgtcttggttcaagaaggggtccagcattgggaaaatgttcgaagcgacagcccgcggcgcccggcgaatggcgatcctgggggacactgcctgggacttcggatccattgggggagtgtttacctctgtcggcaagcttgttcatcagatctttgggaccgcctacggcgtattgttcagcggggtcagctggactatgaagatcggcatcggtgtgctgctcacctggctgggcctgaattccaggtcaaccagcctctcaatgacctgcattgccgtgggcctggtcacactatatctcggggtgatggtgcaggccgacagcggttgcgttataaactggaaagggcgggaactcaagtgcggctcggggatctttgtcaccaacgaggtccacacctggaccgagcagtacaagttccaggccgacagcccgaagcgtctgtccgcagccatcggcaaagcctgggaggagggcgtctgcggcatccggagcgccacccgcctggagaacatcatgtggaagcagatctccaatgagcttaaccatatcctgctcgaaaatgatatgaagctaacggtggtggtcggcgacgtagcgggcattctggcccagggcaagaagatgatccggccccagcccatggagcacaagtacagctggaagaactgggggaaagctaagatcatcggggccgatgtacaaaactccaccttcataatcgacggcccgaacaccccggagtgcagcgatgaccagcgcgcatggaacatttgggaggtcgaggactatggcttcggcatcttcaccacaaacatctggcttaagttgcgggactcctatacccaggtgtgtgaccaccgcttaatgtcggccgccatcaaggactccaaggccgtgcacgccgacatgggttattggatcgaaagcgagaagaatgaaacatggaagctcgcgcgcgcgtccttcatcgaggtcaagacctgcatctggcccaaaagccacaccctgtggtccaacggcgtgctggagagcgagatgatcatccccaagatctacggcgggcccatctcccaacacaattaccgccccggctatttcacccagaccgcggggccctggcacctcggtaagctggagctggattttgacctctgcgaggggaccacggtggtcgtcgacgagcactgtggcaaccggggcccctcgttgcgcaccaccaccgtgacaggaaagatcattcacgagtggtgctgcagatcatgcaccctgccgcccctccgcttccggggcgaggacggttgctggtatggcatggagatccgtcccgtcaaggagaaggaggagaacctggtgaaatccatggtgagcgccgggtccggcgaagtcgacagcttctccctgggcctcctttgcattagcattatgatcgaggaggttatgcggtcccgctggagccggaagatgctgatgacggggaccctcgccgtgttcttcctgctgatcatgggccagctcacatggaacgacctcatccgcctgtgcatcatggtaggggcgaacgcctcagaccgcatgggtatggggacgacttacctcgccctgatggccaccttcaagatgcggcccatgttcgccgtgggccttctgttccgccggctgacgagccgcgaggttctgctcctgaccatcggcctgtcgttggtcgccagcgtggagctcccgaattccctagaggagctcggggacggtctcgcaatggggatcatgatcctgaagctcttaatcgacttccagagccaccagttatgggccacgctccttagtatgaccttcataaagacgaccttctcactgcactacgcgtggaaaactatggctatggtcttatccattgtgagcttattccccctgtgcctctccaccacaagccagaagaccacctggctgcccgtgctcctcggctccctgggctgcaagcccctaactatgttcttaatcgccgagaacaagatctgggggcgcaagtcatggccgttgaacgagggcatcatggccgttgggatcgtgtcgattttactatccagcctgctgaagaatgacgtgccgctcgccggccccctgatcgccgggggcatgctgatcgcgtgctacgtcatcagtggctcttccgccgacctcagcttggaaaaggccgcggaggtgtcctgggaggaggaggccgagcactctggggcatcacacaacatactggtggaggtgcaagacgatggcactatgaaaatcaaggacgaggagcgagacgacacgctcaccatactgctcaaggcaaccctcctggccgtgagcggggtgtaccccctaagcatcccggctacgctcttcgtctggtatttctggcagaagaaaaaacagcggagcggtgtgctgtgggacacgcctagcccccccaaagttgaacgcgccgtcctggacgacgggatctatcggataatgcagcgcggcttgctcggccgaagccaggtgggagtgggcgtcttccaggagaacgttttccataccatgtggcatgtgacccgcggcgctgtcctgatgtaccagggcaagcggttagagccctcctgggcttcggtgaagaaggatctcatctcctacgggggaggctggcggttgcaagggagctggaatacaggtgaggaggttcaggtcattgcagtggagcctgggaagaaccccaagaatgtgcaaacagccccgggcaccttcaagacccccgagggggaggttggcgccatcgcgcttgacttcaagcctggcacctccgggtcgcccattgtgaaccgggagggtaagatcgttggtctctacggcaacggcgtcgtgacgaccagcggcacctacgtgtccgctatcgcccaggcaaaggctagccaggagggcccgctgccggagatcgaggacgaggtcttccgcaaacggaacctgactatcatggacctccaccctgggtctggtaagactcgccggtacctgcccgccatcgtgcgcgaggccatcaagcggaagatgcgcaccctgattttggccccgacacgcgtggtcgccagcgagatggcggaagccctgaaggggatgcccatccggtaccaaaccacggccgtgaaatccgagcacaccggtaaggagattgtggacctgatgtgccatgcaactttcaccatgcgccttctgagccccgtccgggtgcccaactacaacatgatcatcatggacgaggcccacttcacggatccctccagcatagccgcacggggctatatctcaacccgggtggggatgggcgaggccgctgccatcttcatgacggcgacgccgcccggaagcgtagaggccttccctcagtccaacgccgttatccaggacgaggagcgagatatcccggagcgaagttggaactccggctacgagtggatcactgacttccccgggaagaccgtgtggttcgtccccagcatcaaggccggcaacgacatcgcgaactgcttgcgcaaaaacggcaagagagtgatacaattaagccgcaagacattcgacaccgagtaccagaagactaaaaacaacgactgggactacgtggtcaccaccgacatttcggagatgggggccaacttccgagccgaccgcgtaattgacccccggcgctgcctgaaacctgtgatccttaaggacggaccagagcgggtcatcctggccgggccaatgcccgttaccgtcgcatccgcagcacagcgccggggccgcatcgggcggaaccacaacaaggagggcgaccaatacatctatatgggccagccgctgaacaacgacgaggaccacgcgcactggacggaggccaagatgctgctcgataacatcaacacccccgaaggaatcatccccgccctgtttgagccggagagggagaaatccgcggccatcgacggtgagtaccgcctgcgcggggaggcccgcaagaccttcgtggaactcatgcggcgcggcgacctgccggtttggctgtcctataaggtcgcgtccgaggggttccagtacagcgatcggaggtggtgcttcgacggcgagaggaacaaccaggtactcgaggaaaacatggacgtcgagatctggactaaggagggcgagcgcaaaaagttacggccccggtggctggacgcccggacgtactccgaccccctcgccttgcgcgagtttaaggagtttgccgctgggcggcgctcggtctccggggatctgatcctagagatcggcaagctgccccagcacttaactcagcgggcccagaacgctcttgataacctggtcatgttacataacagcgagcagggcggccgcgcgtaccggcatgccatggaggagctccctgacaccatcgagaccttgatgctgctcgccctcatcgccgtgctgaccggcggggtaaccctgttcttcctgtccgggaaaggactggggaagacctcaataggcctcctgtgcgtaatggcgtcctcggccctgctctggatggcctccgtcgagccccattggatcgccgccagcatcatcctggagttcttcctgatggtcttactgatccccgaacccgaccggcagcggaccccgcaggacaaccagctagcctacgtggtgatagggctccttttcatgatcctgaccgtcgccgccaacgaaatggggctcctggagacaaccaaaaaggacctgggcatcggccatgtggccgtggagaaccaccaccacgcagcgatgctcgacgtagacctccaccccgcctctgcatggaccctgtatgccgtggccaccacgatcatcacccccatgatgcgccacacaatcgagaataccacggcgaacatcagcctcacggctattgccaaccaggccgcgatattaatgggcctggacaaggggtggcctatctcaaagatggacatcggcgttcccttactggcgctcggctgctacagccaagtgaacccccttacgctgaccgccgccgttctgatgttggtagcccactacgcgatcattggtcccggcctgcaggccaaggccactcgtgaggcacagaaacgcaccgccgcgggaatcatgaagaacccgacaatcgacgggatcgtggccatcgacctggatcccgtggtgtacgacgcgaagtttgagaagcagctcggccagatcatgctgctgatcttatgcacctcacagatcttgctgatgcgcacgacctgggccctgtgcgagtcaatcaccctggccaccggccctctgacgaccctctgggagggttccccgggcaaattttggaacaccaccatcgccgtcagcatggccaacatctttcggggctcctacctggccggggcaggcctggcattcagcctcatgaagtccctgggcggcgggcggcgggggactggcgcccagggggagacgctgggcgagaagtggaagcgccagctgaaccaattatccaagagcgagttcaacacctacaaacgaagtgggatcatggaggttgaccggagtgaggcgaaggaagggctaaaacggggcgagaccacaaagcatgccgtctcccgcggtacggccaagctccgttggttcgtcgagcgcaacctggtgaagccggagggcaaggtgatcgatttagggtgtggccggggcggctggtcgtactactgcgctggtctgaaaaaggtcaccgaggtgaaggggtacactaaaggcgggcctggccacgaggaacccatccccatggccacgtacggctggaacctcgtgaagctgcactccggcaaggacgtcttctttatcccgcctgaaaagtgtgacacactgctctgtgacatcggcgaaagctcccccaaccccaccatagaggagggtcgcaccctgcgggtgctcaaaatggtggagccgtggctccgcggcaaccagttttgcatcaagatcttaaacccctacatgccctctgtcgttgagacgctggagcagatgcagcggaaacacggaggcatgctcgtacgcaacccgctgtcaagaaacagcacccacgagatgtactgggtctcctgcggcacaggaaacatcgtgagcgcggtgaacatgacctccaggatgctgctaaaccggttcactatggcccacagaaaaccgacatacgagcgagacgttgacctgggcgccggcacccgacatgtagcggtggagcccgaggtcgctaacctggatataatcggccaacgcatagaaaacattaagcacgaacacaagagcacctggcactacgacgaggacaatccctacaagacgtgggcctaccacggttcctacgaggtgaagccatctgggtccgcctcaagcatggtgaacggcgtcgtgaaactcctcacgaagccgtgggacgtcattcccatggtcacccagatcgccatgaccgacacaacaccattcggacagcagcgcgtgttcaaagagaaggtcgacacccgcacacccaaggccaagcggggtactgctcagatcatggaagtcacagctcgctggctgtggagcttcctctcgcggaacaagaagccgcgcatctgcacccgggaggaatttacccgcaaggttagatccaacgccgcgatcggggccgtcttcgttgacgagaaccagtggaacagtgccaaggaggccgtggaggatgaccgcttctgggacctggtccatagagagcgcgagctgcataagcagggaaagtgcgcgacctgtgtctacaacatgatgggcaagcgggagaagaagttgggtgagttcggcaaagcgaagggtagccgcgcgatctggtacatgtggctgggtgcccgtttcctggagttcgaggcactcgggttcatgaatgaggatcactggtttagccgcgagaactccctgagcggtgtggagggcgaagggctgcacaagttgggttacatcctgcgggatatatccaagattcccgggggcaacatgtacgccgacgacacggcagggtgggacacgagaataacagaggacgacctgcagaatgaggccaaaatcaccgacattatggagcccgaacacgccttactggcaaagagcatctttaagcttacttaccagaacaaggtcgtgcgggtacagaggcctgcgaagaacggcaccgtcatggacgtgatttcgaggagggaccagcgcggtagcggccaggtgggcacctatggtctcaacaccttcacgaacatggaggcccagctcatccgacagatggagtcagaggaaatcttcagccccaacgagctcgagacccctaacctcgccgaacgcgtcctggactggctggagaagtacggtgtggaacgtcttaagcgcatggccatctccggtgacgattgcgtggtgaaacccatcgacgaccggttcgccaccgccctgaccgccctgaacgacatggggaaggtgcggaaggacatcccgcagtgggagccatcgaaaggatggaacgactggcagcaggtgccgttctgctcccaccacttccatcagctcatcatgaaggatggacgggagatcgtcgtgccctgccgcaaccaggacgagctggtgggccgggcccgcgtcagccagggagccggatggagccttcgggagactgcgtgtctcggcaaaagttacgctcagatgtggcagctgatgtacttccaccgacgggatctgaggctcgcagcaaacgccatctgcagcgccgtgccggtggattgggtccccacttcccgcactacctggagcatccacgcgcaccaccagtggatgacgacggaggatatgttaagcgtgtggaaccgagtgtggatagaggagaacccctggatggaggacaaaacccgggttagctcctgggaagacgtgccatatcttgggaagagggaggatcagtggtgtggaagcctcatagggttgacagccagggccacatgggccaccaacatccaggtggcgatcaatcaggtccggcgcctgattggcaacgagaactactccgactatatgacctcgatgaagcggttcaagaacgagtccgaaccggagggagcgctgtggtga

SEQ ID NO: 24656 - RNA, 9879 nt, synthetic construct
  misc_feature 1..9879: note = derived and/or modified CDS sequence (opt11) from DENV-1__JN054255__SS-prME
  source 1..9879: mol_type = other RNA
agcgtgacgatgctgctcatgctgatgcccaccgctctagctttccatctcaccacccggggcggtgagccccacatgattgtcagcaagcaagagcggggcaagagcttactgttcaagaccagcgcgggggtaaacatgtgtacactcatcgcgatggatttgggcgagctgtgtgaggacaccatgacctacaagtgcccccgcatcaccgaggccgaacccgacgacgtggattgctggtgcaacgctaccgacacctgggtcacctacgggacttgtagccaaaccggcgagcaccggagggacaagcggtctgtcgctctcgcgccccacgtggggcttggtctggagacgagaaccgagacctggatgagcagtgagggtgcctggaaacagatacagcgggtcgagacctgggccttacgccaccccgggttcactgtaatcgccctattcctcgcacacgcgatcggcaccagcatcactcagaaggggatcatcttcatcctcctgatgctggtaaccccctccatggctatgcgttgcgtcggcatcggcagccgcgacttcgtggagggcctcagcggcgccacgtgggtggacgttgtcctagagcacggtagctgcgtgacaaccatggccaaggacaagccaacactggacatcgagctcctgaagacggaggtcactaatcccgcggtgctgaggaaactctgcattgaggctaaaatctccaatacgaccaccgacagccgctgcccgacccagggcgaggccacactggtggaggagcaggacgccaacttcgtctgccgacgcaccttcgttgaccgggggtgggggaacggttgcgggttatttggaaagggatccctcctgacgtgtgccaagttcaagtgtgttaccaagctggagggcaagatcgtccagtacgagaacctcaagtatagcgtgattgtgacggttcatacaggcgaccagcaccaagtggggaacgaatccaccgaacacggtaccaccgcgacgatcacaccccaggcccctacgaccgagatacaactgactgactatggggcccttaccctcgactgcagcccccgcacgggcctggacttcaacgagatggtcctgctcaccatgaaggagaagagttggctggtccacaagcagtggttcctggatctccctctcccctggaccagcggcgcctctacttcacaggaaacgtggaatagacaggatctgctcgtaactttcaagaccgcccacgcgaagaaacaggaggtcgtggtgctgggcagccaggaaggggccatgcacaccgccctgacgggggcaaccgagatccagatgtccggcactaccacgatcttcgctgggcatctcaagtgcaggctgaagatggacaagctcaccctcaagggcatgtcctatgtaatgtgcacgggttccttcaagctggagaaggaagtggcggagacgcaacacgggacagttcttgtccagatcaagtacgagggcaccgatgccccatgcaagatccccttcagcacccaggacgaaaagggggtcacccagaacggcagactgatcacggccaacccaatcgtcaccgacaaggagaagcccgtcaatatcgaggccgaaccgccctttggcgagagttacatcgtgatcggcgcgggcgagaaggcgctaaagctgagctggttcaagaagggatcctctataggcaaaatgttcgaagccaccgcccgcggggcccgtcgtatggcgatcctgggcgacacagcctgggattttggatccattggcggcgttttcacatcagttgggaaactcgtgcaccaaatcttcggcaccgcctacggggtattattctccggcgtatcttggacaatgaagatcgggataggcgtgctgctcacgtggttgggcctgaactcccgctcgacgtccctcagcatgacctgcatagcagtagggctggtcaccttgtacttgggcgtgatggtgcaggccgactccgggtgcgtcatcaactggaaaggccgggagctgaagtgtgggtcgggtatcttcgtcaccaacgaggtgcacacgtggacggagcaatacaagtttcaggcggacagcccgaagcgcctgtcagccgccatcggcaaggcatgggaggaaggcgtctgtggcatacgaagtgcaacacgcctcgagaatatcatgtggaaacagatctccaatgagctgaaccacatactgctcgagaacgacatgaaattcactgtggtggtgggggacgtagcgggcatactggcccaggggaagaagatgatccggccgcagcctatggagcacaaatacagctggaagaactggggtaaagccaagatcataggcgccgacgttcagaatagtacctttatcatcgatgggcccaacactccggagtgcagcgatgaccagagagcctggaacatatgggaggtcgaggactatggcttcgggatattcaccacaaacatctggctgaagctccgggactcgtacacccaggtatgcgaccaccgtctgatgtctgcagccatcaaggactccaaggccgtgcacgcggacatgggatactggatcgagtcggagaagaacgagacttggaagctggcgcgggcttccttcatcgaggtcaaaacctgtatatggccaaagagccacaccctctggtccaacggggtgctggagagcgagatgatcatccccaagatctacggcggccctatctcccagcacaactataggccgggttactttactcagacggccggtccatggcacctggggaagctcgagttggatttcgatctgtgtgagggcacaactgtcgtcgtggacgagcactgcgggaaccgggggcccagcttacgcacgactaccgtgacgggtaagatcatccacgagtggtgttgcaggtcctgcaccttgccgcccctgcgtttccgcggggaggacggctgctggtacgggatggagatccgacccgtcaaggagaaggaagagaacctcgtcaagagcatggtgtccgccggaagcggcgaggtggacagtttttccctggggctgctatgcatcagcatcatgatcgaggaggtgatgcggtcccgttggagccgtaagatgctgatgacgggtacactggccgtgtttttcctcttaatcatgggccaacttacctggaacgacctcatccgcttatgtataatggtcggtgcgaacgcctccgacaggatgggaatgggcaccacgtacctggccctcatggccaccttcaaaatgcgtccgatgttcgcagtagggctgcttttccgccggcttaccagccgcgaggtgctattactgaccataggtctatccttggttgcgtccgtggagctcccgaactccctggaggagctgggagacggcctggcaatgggcatcatgatcctgaaactgctcacggatttccagagccatcagctgtgggcaaccctcttatccatgaccttcatcaagaccacgttcagcctgcattacgcctggaagaccatggcgatggtcctgtccatcgtgtcgttatttcccctgtgcttaagtaccaccagccagaagactacctggctcccggttctgctgggctcccttggatgtaagcccctgaccatgttcctgatcgccgagaacaagatctggggccggaagtcctggccgctcaacgagggtataatggcagtcggcattgtgagcatcctgctgtctagcttactgaagaacgacgtgcctctggcggggcccctcatagccggcggcatgctgatcgcatgctacgttatctcagggtcatccgcagacctgagtcttgagaaggccgctgaggtctcctgggaagaggaggccgagcactctggcgcgtcccataatatcttggtagaggtacaagatgatgggaccatgaaaatcaaggacgaggaacgcgatgacacactcaccatcctcctgaaggccaccctgctagccgtgagcggtgtgtatcccctgtccatcccggccaccctattcgtctggtacttctggcaaaagaagaaacagcggagcggtgtgctctgggacacccccagcccgccaaaagtagagaaagccgtcctggacgatggcatttacagaatcatgcagcggggcctactggggcgatcccaagtgggagtgggagtgttccaggagaacgtctttcacacgatgtggcacgtcacccgaggtgccgtcctcatgtaccaagggaagcgcctggagccttcctgggccagcgtgaagaaggacctgatctcgtacggcgggggatggcgtctccaagggtcatggaacaccggggaagaggtgcaggtcatcgcggtagagcccggcaagaatcccaagaacgtgcagactgcacccgggacgttcaagacacctgagggcgaagtaggcgccatagctctggatttcaagcccgggacaagtggtagccccattgtgaaccgggaggggaaaatcgtaggcctgtatggcaacggggttgttaccacttcgggtacctacgtgtccggtatcgctcaggcgaaggcctcacaggagggccccctcccggagatcgaggatgaagtgttccggaagcgaaacctgacaattatggacctgcaccccgggtccgggaagacccggcgttacctccccgccatcgtgagggaggccatcaagcggaagatgcggacgctgattctggccccgacccgtgtggtggccagcgagatggccgaggcgcttaagggcatgcctataaggtaccaaacgaccgccgtaaagtccgaacatacgggtaaggagatcgtggatttgatgtgtcatgccacctttacgatgcggctgctctccccagtacgtgtgccaaactataacatgattatcatggacgaggcccacttcaccgacccgtcctcaatcgccgcgcggggctatatctccacgcgcgtcgggatgggcgaggccgccgccatcttcatgacggccacgccgccagggagcgtggaagccttccctcagtccaacgccgtgatccaggacgaggagcgggatatcccagagagaagctggaactccggctatgaatggatcactgacttccccggcaagactgtgtggtttgttcccagcattaaggccgggaacgacatagccaactgcctgagaaagaacgggaagcgcgtgatccagttgtcccggaagacctttgacaccgagtatcagaagacgaagaataacgactgggactacgtggtcacgaccgatatctcggagatgggggcgaacttccgcgcggatcgtgtgattgaccccagacggtgtctcaagccggttatactgaaggacggcccggagagagttattttggcagggccgatgcccgtgaccgtcgcctccgccgcacagcggcggggccggatcggccggaaccacaacaaggagggtgatcagtacatctacatgggccagccgctcaacaacgacgaaaaccacgcccactggaccgaggctaagatgctgctggataacatcaacacgcccgaggggataatccccgctctgttcgagcccgaacgagagaaaagtgccgcaatcgacggcgagtaccgcctgcgcggggaggcacggaagacctttgtggaactcatgcgccggggggacttgcctgtgtggctgtcctacaaggtagccagtgagggatttcagtacagcgacagacgatggtgcttcgacggggaacggaataatcaggtgctggaggagaacatggacgtggagatctggacaaaggagggtgagcgaaagaagctgcgccccagatggctggacgcccgcacctattccgatcccctggccctcagagagtttaaggagttcgcggcggggcgccggagcgtctccggtgatctgattctcgaaatcggtaagctcccccagcacctgacgcagcgcgctcagaatgccctcgacaacttagtgatgctacacaacagcgagcaaggcggtcgggcgtaccgccacgccatggaggagctgccggataccatagagacattgatgttgctggcgctcatcgccgtgctaacggggggcgtcacgctattctttttatccgggaaaggcctgggcaagaccagcattgggctgctctgcgtgatggcctcttcagccctgttgtggatggcctccgttgagccccactggatagccgcgagcataatactcgagttcttcctgatggtcctgctcatcccagagcccgatcggcagcgtacaccgcaggacaaccagctggcctacgtagtgatcggcctcctcttcatgatcctgaccgttgctgccaacgagatggggttgcttgagaccacgaaaaaggacctgggaattggacacgtggctgtggagaaccatcaccacgccgctatgcttgacatcgacctacaccccgcgtcggcatggaccctctacgccgtcgccaccaccataataacacccatgatgaggcatacaatcgagaacacgaccgctaacataagcctgacggcgatcgccaaccaagccgccatcttgatgggcttggacaagggctggccgatttcgaaaatggacattggtgttcccctgctcgccctgggctgctatagccaggtaaatcccctgaccctcaccgccgcagttctgatgcttgttgcccactatgctatcatcggacccggcttacaggccaaggctactcgcgaggcccaaaagcggaccgctgctgggatcatgaaaaaccctaccattgacggaatcgttgcaatcgaccttgacccggtggtctacgatgccaagtttgagaaacaactgggccagatcatgctgctgatcctgtgcacctcccaaatcctgctgatgcgcactacatgggccctgtgtgagtcgatcaccctcgccaccgggcccctgactacgctgtgggagggcagcccagggaagttctggaacaccaccatagcggtaagcatggcgaacatcttcagggggtcctacctcgcgggggctggactagccttttcactgatgaagtccctcggcgggggacggcgcgggaccggtgcccagggtgagacactgggtgagaagtggaaacggcaactgaaccagctctccaagagcgagtttaacacctacaagcgctccggaataatggaggtggaccgtagcgaggccaaggaggggttgaagcgcggcgagactaccaagcacgctgtttccagagggacagccaaactgcgctggttcgttgagaggaacctcgtcaaacctgaggggaaggtgatcgacctgggctgcgggcgcggcgggtggtcctactactgcgccggcctaaagaaggtgaccgaggttaagggatacactaaggggggccccgggcacgaggagccgatccctatggcgacctacggctggaatctagtgaagctccactctgggaaggacgtgttttttatcccgcccgagaagtgcgacacgctgctgtgcgacataggcgagagctcaccaaatcccaccatcgaggaggggcgaacgttgcgcgtcctgaagatggtagagccatggctgcggggaaaccagttttgcatcaaaatcctaaacccttacatgcccagcgtagtcgagacactggagcagatgcagcgcaagcacggcgggatgctcgtgcggaacccgctctcccgcaactcaacgcacgagatgtactgggtgtcctgcggaaccgggaacattgtcagcgcagtaaacatgacctccagaatgttactgaatcgcttcacaatggcccaccgcaaacctacgtacgaaagggacgttgacctcggcgcaggcacgcgacacgtagcggtggaacccgaggtggcgaacctggacatcatcggccaacgcatcgagaacataaaacatgagcacaagagcacctggcattatgacgaggacaatccctataagacctgggcataccacgggtcctacgaggtaaagcccagcgggagtgcgagcagcatggtgaacggcatggtaaagctattaaccaaaccttgggacgttatcccgatggtgacccagatcgccatgaccgacaccacccccttcgggcagcagcgcgtcttcaaggagaaggtggacacgcggacccccaaggccaagcgcgggacggcgcagatcatggaggtgaccgccaggtggctgtggagctttttgagccgcaacaagaagccgcggatttgcacgcgcgaagagttcacccggaaagtccggtccaacgccgcgatcggcgcggtgttcgtggacgagaaccagtggaatagcgccaaggaagccgtcgaagacgatcgcttctgggacttggtgcacagggagcgggagttacacaagcaaggaaagtgcgcgacttgcgtgtacaatatgatggggaagcgggagaaaaaactgggcgagttcggcaaggccaaagggtccagagcgatatggtacatgtggctcggcgccaggttccttgagttcgaggcacttggtttcatgaacgaggatcactggttcagccgggagaattccctctcaggggtcgagggtgaggggctgcacaagctgggctacatcctccgcgacatatctaagataccgggtggcaacatgtacgctgacgacacagcgggctgggatacacggatcaccgaggacgacctgcagaacgaggcgaagatcaccgacatcatggagcccgagcacgccctgttggccaagtccatcttcaaactgacctaccagaacaaggttgtacgcgtccagaggccgtctaaaaacgggacagtgatggacgttatcagcagacgcgaccagcggggttccggccaggtcggcacctatggcttgaacacctttaccaacatggaagcccagctaatccgccagatggagagcgaggagatcttctcccccaacgagctggagacaccaaatcttgcaaagcgggtgttagactggctcgagaagtacggggtggaacggctgaaacggatggcgatcagcggagacgactgtgtcgtgaagccgatcgacgaccgcttcgccaccgccctcacagccctgaacgacatggggaaggtgcggaaggacatcccgcagtgggaaccctccaaaggatggaacgattggcagcaagttcccttctgcagccatcactttcaccaactgatcatgaaggacggccgcgagatcgtcgtcccctgccgaaatcaggatgagcttgtgggtcgtgcccgggtgagccagggcgcgggttggagcctgcgtgagaccgcctgcctgggcaagagctacgcgcaaatgtggcagctcatgtactttcaccggcgtgacctgcggcttgcagcgaacgccatctgctccgccgtgccggtcgactgggtgcccacaagccgaaccacctggtctatccacgcccaccaccaatggatgaccacggaggacatgctcagcgtgtggaacagagtctggatcgaggagaacccctggatggaggacaaaacccgcgtgtccagctgggaggacgtgccctacctgggtaagcgcgaagaccagtggtgtggcagcttaatcgggctcaccgctcgcgcgacgtgggccacgaacatacaagtcgccatcaaccaggtgcgccggctgatcgggaacgagaactacagcgactacatgacctccatgaagcgcttcaagaacgagagcgagccggagggcgccctgtggtaa

SEQ ID NO: 24657 - RNA, 9879 nt, synthetic construct
  misc_feature 1..9879: note = derived and/or modified CDS sequence (opt11) from DENV-1__KP406801__SS-prME
  source 1..9879: mol_type = other RNA
agcgtgaccatgttgctcatgctgctgccaaccgccctcgccttccacctgaccactcgcggcggtgagccccacatgatcgtcagcaagcaggagcggggcaagagtcttctgtttaagacgtccgcgggggtgaacatgtgcaccctgatcgccatggacctgggcgaactctgcgaggacaccatgacctacaagtgcccccgcatcaccgaggctgaacccgacgacgtggactgctggtgcaacgccaccgacacgtgggtgacctacgggacctgcagccagaccggcgagcaccggcgcgacaagcgatccgtggccctggcgccccacgtgggcctggggctcgagacccgtaccgagacctggatgagctccgagggcgcctggcggcagatccagaaggtcgagacctgggccctgaggcaccctggtttcactgtgatcgctctgttcctcgcgcacaccatcggtaccagcatcacccagaaggggatcatattcattctgctgatgctcgttacgccctccatggcgatgcggtgcgtcggcatcggcaaccgtgatttcgtggagggactgagcggcgccacctgggtagatgtagtcctggagcacgggtcctgtgtgaccacaatggcaaagaacaagcccacactcgacatcgagctgctgaagaccgaggtcactaaccccgccgtcctccggaaactgtgcatcgaggccaaaatcagcaacactacgaccgactcccgctgccctacccagggcgaggcaaccctggttgaggagcaggacgccaacttcgtctgccggcgaacgttcgtggaccggggctgggggaatggatgcggactcttcggcaaggggagccttctgacctgcgccaagttcaagtgcgtgaccaagctcgagggcaagatcgtccagtacgagaacctcaagtactccgtgatcgtgaccgtccacacgggcgaccagcatcaggtgggcaatgagaccaccgagcatggcacgatcgccaccatcacgccccaggcgcccaccagcgaaatccagctgaccgattacggggccctcacgctggactgtagcccccggacgggtctggacttcaacgagatggtcctccttaccatgaaggaaaagtcctggttagtgcacaagcagtggttcctcgacttaccgctgccctggacctccggtgccagtaccagccaggagacgtggaatcgccaggacctcctggtgaccttcaagaccgcccacgccaagaagcaggaggtcgtggtgctgggctcccaggagggcgcgatgcacaccgccctcgccggggccacggaaatccagatgagcggcaccaccaccatcttcgccggacacctgaagtgccgcctgaagatggacaagctcacgctgaagggcgtcagctacgtgatgtgcaccgggagctttaagctggagaaggaggtggcggaaacccagcacggcaccgtcctggtccaggtgaagtatgagggaacggacgcaccctgcaaaatccctttctccatccaggacgaaaagggcgtcacccagaacggccggctcatcaccgccaacccgatcgccaccgacaaggagaagcccgtgaacatagagacggagccgcccttcggggagagctatatcgtgataggcgcgggagagaaggccctgaagctctcctggttcaaaaaggggtcatctatcggcaagatgttcgaggcaacggcgcggggggcccggcgcatggcgatcctcggcgacaccgcctgggactttgggtccatcggcggcgtcttcacgtccgtggggaagctggtccaccaggtcttcggcacggcctacggagtactgttctcaggcgtatcctggaccatgaagatcgggataggcatcctcctgacctggctggggctcaacagccgctccacctcgctgtcgatgacgtgcatcgcagtagggatggtcaccctgtacctcggcgtgatggtccaggccgacagcggatgcgtgatcaattggaagggccgggaactgaagtgcgggtccggcatattcgttaccaacgaggtacacacctggacggagcaatacaagttccaggcggacagcccgaagcgtctgtcggccgccatcggtaaagcctgggaggagggggtgtgcggtatcagatccgccaccagactcgaaaacatcatgtggaagcagatctccaacgagctaaaccacatcctgctagagaatgacatgaagttcaccgtggtcgtgggggacgcgaacggcatcctgacccaagggaagaagatgatccggccccagcctatggagcacaagtactcctggaaatcctggggcaaggcgaagatcatcggcgcggacacccagaacacgaccttcatcatcgacggccccgacaccccggagtgccccgacgaccagcgcgcttggaacatatgggaggtggaagactacggcttcgggatctttaccacgaacatctggctgaagctcagagactcctatacccagatgtgcgaccaccgcctgatgagcgcggccatcaaggactccaaggccgtccacgccgacatgggctactggatcgagagcgagaagaacgagacctggaaactggcccgggcgtccttcatcgaagtgaagacctgcatctggcccagaagccacactctctggtcaaacggcgtgctggagagtgagatgatcatccccaagatatacgggggcccgatctcccagcacaactaccggcccggatacttcacccagactgccggcccctggcacttgggcaagctcgagctggacttcgacctgtgcgagggcaccacggtcgtggtagacgagcactgcggcaaccgcgggccgagcctccgtaccaccacagtcacgggcaagatcatccacgagtggtgctgccgatcctgcaccctgccgcccctgcggttcaagggggaggacggctgctggtacgggatggagatccgccccgtaaaagagaaggaggagaatctcgtgcggtcaatggttagtgccggaagtggcgaggtggacagcttctctctggggttgctctgtgtgagcatcatgatcgaggaggtcatgcgctcccggtggagccgcaagatgttgatgaccggcaccttggcggtgttcttcctcctgatcatggggcagcttacgtggaacgacctaatccgactgtgcatcatggtgggcgccaacgtttccgaccgcatggggatgggcaccacatacctggcgctcatggccaccttcaagatgcgtccaatgttcgccgtcggcctgctgtttaggcgcctcacgagccgggaggtgctgctgctcaccattgggctgtccctggtagcgagcgtggagctccccaactccctggaggagctgggcgacgggctcgccatgggcatcatgatgctaaaactgctcacggacttccagagccatcaactgtggaccacgctgctctccctgacattcatcaagacgaccctgagcctcgactatgcgtggaagacgatcgccatggtcctgtccatcgtgagcctgttccctctctgcctgtccaccaccagccagaagaccacgtggctgcccgtgctgctgggctctttcgggtgtaagccgctgaccatgttccttatcaccgagaacaagatttggggccgcagaagctggcccctgaacgaagggatcatggccgtcggcatcgtgtctatccttctctctagcttactgaagaacgacgtgcccctcgccgggccactgatcgcgggcggcatgctaatcgcctgctacgtcatctccgggagctccgccgacctcagcctggagaaagccgccgaggtgtcctgggaggaggaggcggagcacagcggtgcctcccacaacatcctggtggaggtccaggacgacgggaccatgaaaatcaaagacgaggagcgcgatgacaccctcaccatcctgctgaaggcgaccctcctcgccgtgagcggcgtgtacccgatgtccatccctgcaaccctgttcgtgtggtacttttggcagaagaagaagcagcggagcggggtgctctgggacacccctagcccgcccgaggtggagcgtgcggtcctggacgacggcatctacaggatcttgcaacgcggcttactcgggcggagccaggtgggcgtgggggtcttccaggacggcgtgttccacacgatgtggcacgtgacccgcggggccgtcctgatgtaccagggcaagcggctggagccctcctgggccagtgtgaagaaggacctcatcagctatggaggggggtggcggttccaggggtcgtggaacaccggcgaggaagtgcaggtcatcgccgttgagcccgggaagaaccccaagaacgtgcagaccacgcccggcacctttaagaccccggagggcgaagtgggggccatcgcgcttgatttcaagcccggaacctccgggagccccatcgtgaaccgggagggcaagatcgtgggcctgtacgggaacggcgtcgtgacgaccagtggaacatacgtaagcgccatagcccaggccaaagcaagccaggagggcccgctccccgaaatcgaggacgaggtcttcaagaagcgcaacttgaccatcatggacttacaccccgggtccggcaaaacacggcgctacctccccgcgatcgtgcgggaggccatcaagaggaagctacgcaccctgatccttgcgcccacccgggtcgtcgcctccgagatggcggaggccctgaagggcatgcccatccgctaccagaccacggccgttaagtccgaacacaccgggcgggagatcgtggacctgatgtgccacgccacatttaccatgcgcctcctcagccccgtccgggtgcctaactacaacatgataatcatggatgaggcccatttcaccgaccccgcgtctatcgccgcccgcggctacatctccactcgggtcgggatgggtgaggccgccgcgatcttcatgacagccacgccgcccgggtccgtcgaggcgttcccgcagtccaacgccgtgattcaggacgaggagcgcgacatccccgagcgctcctggaatagcggctacgactggatcacggacttccccggcaagaccgtgtggtttgtcccctcgatcaagtcagggaacgacatcgccaactgcttacgcaagaacggcaagcgggtgattcaactctcccgcaagaccttcgacaccgagtatcagaagacgaagaacaacgactgggactacgttgtcaccaccgacatcagcgagatgggagcgaactttcgggccgaccgcgtcatcgacccgcggcgatgcctgaagcccgtgatcctgaaggacggcccggagagagtgatcctcgccgggcccatgccggtgaccgtggcctccgcggcccagcgccggggccgtatcggccgcaaccagaacaaggagggggaccagtacatctacatgggacagcccctgaacaacgacgaggatcacgcccattggacggaggccaagatgctgctagacaatatcaacacccccgaggggatcattcccgcactgttcgagccggagcgggagaaatccgctgccatcgatggggagtaccgcctgcgcggggaggccaggaagaccttcgtagagttaatgcggcgcggcgacctgcccgtgtggttgtcctacaaggtcgcaagtgagggcttccagtactcggaccggcgctggtgcttcgacggggaaagaaacaaccaggtgctcgaggaaaacatggacgtcgagatctggaccaaggagggcgaacgtaaaaagctgcggccccggtggctggacgctcggacgtacagcgaccccctcgcgctgcgcgagttcaaggaattcgccgccgggcggcgcagcgtatccggcgacctgatcctggaaatcggcaagttaccgcagcacctgactctacgggcccagaatgccctggacaacctggtgatgttacacaacagcgagcagggcgggaaagcgtaccgccacgctatggaggagctgcccgacaccatcgagaccctgatgctcctggcgctgatcgccgtgctcactgggggcgtcacgctgttctttctgtccgggaagggcctcggcaaaacaagcatcggcctgttgtgtgttatggcgtccagcgtgctcctgtggatggcttctgtcgagccacactggatcgccgccagcatcatcctggagttctttctcatggttctgttaatccccgagccggaccggcagcgcacgccccaggacaaccagctcgcctacgtggtcatcggcctgctgttcatgatcctcacagtggctgccaacgagatggggttactggagactaccaagaaggacctcggtatcgggcacgtggtcgccgagaaccaccaccacgccaccatgctggacatcgacctgcatcccgcatctgcgtggaccctctacgccgtggcaactaccatcatcacccccatgatgcggcacaccatcgagaatacgaccgccaatatcagcctgaccgccatcgcgaaccaagccgcaattctgatgggcctcgacaagggctggcccatctccaagatggacattggcgttcccctgctggccctcggctgctactcccaggtcaacccactgactctgacagccgcggtcctcatgctggtagcccactacgctatcatcgggccgggcctgcaggccaaggctacccgcgaggcacagaagcgcaccgccgccggaatcatgaagaaccccaccgtcgacggcatcgtggcgattgacctcgacccagtggtctacgacgcgaagttcgagaaacagctgggccagatcatgctgctcatcctgtgcacgtcccaaatcctgctcatgaggaccacctgggccctgtgcgagtctatcaccctggccacgggtcccctcaccaccctctgggagggttccccggggaagttctggaacaccactatcgccgtgagcatggcaaatatattccgcggctcctacctggcgggcgcgggtctcgccttcagcctgatgaagtcgctcggcggcggccgccgcgggaccggcgcccagggcgagaccctcggggagaagtggaagagacagctgaaccagctgtcaaagagcgaattcaacacctacaagcgctccggcatcatggaggtggaccggtccgaggctaaggaggggctcaagcgcggcgagacgaccaagcacgcggtctcccgggggacagccaagctgcgctggttcgtggagcggaatctggttcgccccgagggcaaggtcatcgacctgggatgcgggagaggagggtggagctactactgcgccggcctcaagaaagtgaccgaggtgaaggggtacacgaagggcggccccgggcacgaggagcccatcccgatggccacctacggctggaacctggtcaagctgtactccgggaaggacgtgttcttcacaccgcccgagaagtgcgacaccctcctgtgtgacatcggcgagtcctcccccaacccgaccatcgaggaggggcgcacgctgcgggtgctcaagatggtcgagccctggctgcgcggcaaccagttctgcatcaagatcctgaacccctatatgcccagcgttgtggaaaccctcgagcagatgcagcggaagcacggcgggatgctggtccgcaacccgctgtcccggaacagcacccatgaaatgtactgggtgtcctgcggcaccgggaacatagtcagcgcggtcaacatgacgtcccgcatgctcctgaatcgcttcaccatggcccaccgcaagcccacctacgagcgcgacgtcgacctcggcgccggcactcggcacgttgccgtcgagcccgagatcgccaacttggacatcatcgggcagcgcattgagaacatcaagaacgagcacaagagcacgtggcactacgacgaggacaacccttacaagacctgggcgtaccacggctcctacgaggtgaagccgagcgggagcgccagctccatggtgaacggcgtggtccggctgctgaccaaaccctgggacgtcatccccatggtgacccagattgctatgacggacaccacccccttcgggcagcagcgcgtgttcaaagagaaggtcgacaccagaacgccgaggccaaagcggggcaccgcccagatcatggaggtgaccgccaagtggctctggggattccttagcagaaataagaagccccggatctgtacccgcgaggagttcacgcggaaggtgcgcagcaacgcggccatcggagccgtattcgtggacgaaaaccagtggaactccgccaaggaggccgtggaggacgagaagttctgggacctggtccaccgggagcgcgagctccacaagcagggcaagtgcgcgacctgcgtttacaacatgatggggaagcgggagaaaaaactgggcgagttcggaaaagcaaaggggagcagagccatctggtatatgtggctgggcgcccggttcctcgaattcgaggcgctgggtttcatgaacgaggaccactggttctcccgcgagaacagcctgtccggcgtggagggggaaggcctccacaagctggggtacatcctgcgggacatctcgaagatcccgggcggcaacatgtacgccgacgacaccgccgggtgggacacccgcatcacggaggatgacctacagaacgaggccaagatcaccgacatcatggagcccgagcacgccctgctggcgacctccatcttcaagctaacataccagaacaaggtcgtgcgggtgcagcggcccgccaagtcaggcacggtcatggacgtgatctcccgccgggaccagcgcgggagcggccaggtgggcacctacgggctgaacaccttcaccaacatggaggtccagctgatacgacagatggagtccgagggcatcttctccccctcagagctcgagaacagcaacctggccgagcgcgtgctggattggcttgagaagcacggggtggagcggctgaagcgcatggccatctccggcgacgactgcgtcgtgaaaccgactgacgacagattcgccactgcgctgaccgccctcaacgatatgggcaaggttcgcaaagatatcccccaatgggagcctagtaagggctggaacgactggcagcaggtccctttctgcagccaccacttccaccagctgatcatgaaggacgggcgggagatagtggtgccgtgccgcaaccaggacgagctggtcgggagagcccgcgtgagccagggcgccgggtggagcctccgggagaccgcctgcctgggtaagtcctacgcgcagatgtggcagctgatgtacttccaccgcagggacctccggctggcagccaacgccatctgctcggccgtgccagtcgattgggtgcctacgtctcggaccacttggagcatccacgcgcaccaccagtggatgaccaccgaggacatgctgtccgtgtggaatcgcgtctggatcgaggagaacccatggatggaggacaaaacgcacgttagctcctgggaggacgttccgtaccttgggaagcgcgaagaccagtggtgtggctcgctgattggcctgaccgcccgggccacgtgggccaccaacatccaggtcgccatcaaccaggtacgccggctcataggtaacgagaactatctggactacatgacatccatgaagagattcaagaacgagagcgaccccgagggcgccctgtggtga

SEQ ID NO: 24658 - RNA, 9879 nt, synthetic construct
  misc_feature 1..9879: note = derived and/or modified CDS sequence (opt11) from DENV-1__KP406802__SS-prME
  source 1..9879: mol_type = other RNA
tctgtgaccatgctgctcatgctgatgcccaccgccttggcatttcatctcaccacccgcggcggggagccccatatgatcgtgagcaagcaggagcggggcaagagcttgctgttcaagaccagcgcgggcatcaatatgtgcaccctcatagcgatggacctgggcgagctgtgcgaggacacactcacctacaagtgcccacgcatcaccgaggccgagcccgacgacgtggactgctggtgcaacgcgaccgatacctgggtgacctacgggacgtgcagccagacaggcgagcacagacgcgataaacgcagcgtggctctggcgccgcacgttggcctggggctcgagacccgcaccgaaacttggatgtcgtccgagggcgcctggaagcagatacagagggtggagacctgggcactgcgccaccccgggttcacggtcatcgccctgttcctcgcgcacgctataggcacctcgatcacccagaaagggatcatctttatcctgctgatgctcgtgaccccttctatggccatgagatgtgtgggcatcggttcccgcgacttcgttgaggggctttccggggcaacgtgggtggacgtggttttagagcatgggagctgtgtaaccaccatggccaaagacaagcctaccctcgacatcgagctgctgaagacggaagtgaccaatcctgcggtgctccggaaactatgcatcgaggccaagatatcgaacacaacgacggactccaggtgcccgacccagggcgaagccaccttggtcgaggaacaggacgccaactttgtatgccggcgcaccttcgtcgaccgcggctgggggaacgggtgcggactcttcggcaagggttctctgatcacgtgcgctaagttcaagtgcgtgaccaagctggagggcaagatcgtgcagtacgaaaaccttaagtacagcgtcattgtgaccgtgcacaccggcgaccagcaccaggtcggaaacgagtcgacggagcacggaaccaccgctaccatcacgccccaggcccccacgacggagatacagttaaccgactatggggccctgacattagactgcagcccccgcacgggcctggacttcaacgaaatggtgctcctcaccatgaaggagaagagttggctcgttcacaagcagtggttcttggacctccccctaccctggaccagcggagccagtacctcccaggaaatctggaaccggcaggatctgctcgtgacgtttaagaccgcccacgctaagaagcaggaggtagttgtgttgggcagccaggagggcgccatgcacaccgcccttaccggggccaccgagatccagacctccggcaccaccacgattttcgccggacacctcaagtgccgccttaagatggacaaacttaccctcaagggcatgagctatgtgatgtgcaccggaagtttcaagctcgagaaggaggttgcggagacccagcacggcactgtattggtgcagatcaagtatgagggcaccgacgcgccctgcaagatcccctttagtacccaggacgaaaagggggtcacccagaacggccgtctaatcaccgccaacccgatcgtcaccgacaaggagaagcccgtaaacatcgaggccgaaccgcccttcggagaatcttacatcgtcatcggtgcgggtgagaaggcccttaagctgagctggttcaagaaggggtccagcatcggcaagatgtttgaggcgaccgcccgcggggcacgtaggatggcaatcctgggagacaccgcctgggacttcgggtctatcgggggcgtgttcacgagcgtcggaaagctcgtccaccagatcttcggcacggcctacggtgttctgttctccggcgtttcctggaccatgaagatcggaatcggcgtcctgctgacttggctcgggctgaactcccgctccacttccctcagcatgacgtgcatcgcagttgggctggtcaccctgtacctcggcgtgatggtgcaagccgattccggttgcgtgatcaactggaaaggccgggagctcaagtgcgggagcggcatcttcgtcacgaatgaggtgcacacgtggacggagcagtacaagttccaggccgactcaccgaagcgcctcagtgccgccatcggcaaggcctgggaggagggggtgtgcggcattcggagcgccacccggcttgagaatatcatgtggaagcagatttccaatgagctgaaccacatcctgctcgagaacgacatgaaattcaccgtcgtggtcggagacgtcgcgggcatcctggctcaggggaagaagatgatacggccccagccaatggaacacaagtactcctggaagtcctggggcaaagccaagatcatcggcgcggacgttcaaaacaccacctttatcatagacgggcccaacacaccggaatgccccgacgaccagcgtgcgtggaacatctgggaggtggaggactacggattcggaatcttcaccaccaacatctggctcaaactccgggacagctatacccaggtgtgcgaccacaggctgatgtctgccgccatcaaagacagcaaggccgtgcacgccgatatgggctattggattgagtcggagaagaatgagacgtggaagctggcgcgggccagcttcatcgaggtgaagacctgcatctggccgaagtcccatacgctctggagcaacggagtcctggagtccgagatgattatacctaagatctacgggggcccaatcagccagcacaactaccggcctggttactttacccagacagccggcccttggcacctggggaagctcgagctcgactttgacctatgtgagggcaccaccgtggtggtcgacgagcactgcggcaaccgcgggccgtccctccgcacgaccaccgtaaccggaaagatcatacacgagtggtgctgccgaagctgcacactgcctcccttgcgcttccgcggggaggacggatgctggtacgggatggagatccgccccgtgaaggagaaagaggagaacctcgtcaaatccatggtgagcgccggcagcggcgaggtggacagttttagcctagggctgctctgcataagcataatgatcgaggaggtaatgcggagcagatggtcccggaaaatgctgatgactggcaccctggcagtcttctttcttctgatcatggggcagctgacctggaacgacctcatccgtctgtgcatcatggtgggggctaatgcaagcgatcgcatggggatggggacgacctacctcgccctgatggccaccttcaagatgcggccgatgttcgccgtcggtctgttgttcaggcggctaacttcccgcgaggttttactgctcactatcggcttaagcctggtggcgtccgtcgagctgcccaacagcctggaggagctgggcgacggactcgccatgggcatcatgatcttaaagttattgaccgacttccagtcccaccagctatgggccacgctgttgtcgctgaccttcatcaagacgaccttttccctgcattacgcatggaagacgatggccatggtgctcagcatcgtgtccttattccccctctgcttgagcacaacgtcacagaaaacaacctggcttcccgtcttgctcggtagcttgggttgcaagcctctgaccatgttcctaattgccgagaacaagatttggggccgtaagtcctggccgttaaacgagggaatcatggcggtaggcatcgtcagcatcttgctcagctcactgttgaagaacgacgtgccccttgccgggcctctgatcgccggcggcatgctgatcgcttgctacgtgatcagcgggtcctcggccgacttgtccctggagaaggccgccgaggtctcatgggaagaggaggccgagcactccggtgcttcacataacatcctggtggaggtgcaagacgatggcacgatgaagatcaaagacgaggaacgagacgacacactcacaatcttgctgaaggcgacactgctggcggtctccggcgtgtacccgctgagcatcccagcaaccctcttcgtgtggtacttctggcaaaagaaaaagcagcggtccggggtcctttgggacacaccctctccgcccgaggtggagagagcggtgttagacgacggtatctaccggatcatgcagcgcggtctgctcggacggagtcaagtcggtgtgggggttttccaggagaacgtcttccacaccatgtggcacgttacccgcggcgcggtgctgatgtaccaggggaagcggctggagcccagctgggcctccgtgaagaaggatctcatcagctacggcggcgggtggcgcctgcagggctcctggaacacgggggaggaagtacaggtgatcgcagtcgaacccggtaaaaaccccaagaacgtgcagaccgcgcccggaacctttaagaccccagagggcgaggtgggggccatagcgctggacttcaagcccgggaccagcggctccccgatcgtcaacagagaggggaagatcgttggcctttacggcaacggcgtggttacgacctctggcacgtacgtgagcgccatcgcccaggccaaggcgtcccaggaggggccgctacctgagatcgaggacgaggtcttccgcaagcggaacctaacaatcatggacttgcacccaggcagcgggaagacgcgccggtacctgccggccatcgtcagggaagccatcaaaagaaaactgcgcacattaattctagcccccacccgcgtggttgcctccgagatggcggaggcactaaagggcatgcccattcggtaccaaaccaccgcagtaaagagcgagcacaccggaaaagagatcgtcgacctcatgtgccacgccaccttcaccatgcgtctgttatcccccgtgcgggtcccgaactacaacatgatcatcatggatgaggcccatttcacggaccccagctccatcgcggcccgcgggtacataagcactcgggttggcatgggggaggccgccgccatcttcatgaccgccacgccgcccggcagcgtggaggcattcccgcagagcaacgctgtaatacaggacgaggagcgagacatcccggagcggtcctggaacagcggatacgagtggatcacggacttccccggcaagaccgtgtggttcgtgccctccatcaagagcggcaatgacatcgcgaactgcttacggaaaaacgggaagcgggtcattcagctttcgaggaagaccttcgataccgagtaccaaaagacgaagaataatgattgggactacgtggtcactaccgacataagcgagatgggtgcgaacttcagagccgaccgggtcatcgacccgcggcgctgcctgaagcccgtgatcctcaaggacggacccgaaagagtcattctagccggccccatgcccgtcactgtcgcctccgcagctcagcgaaggggacgcgtcggccggaaccacaacaaggagggcgaccagtacatctacatggggcagcccctgaataacgacgaggaccacgcgcactggacggaggccaaaatgcttctggacaacataaacacccccgaaggcatcatcccggcactgttcgaaccggaacgcgagaaatccgccgcgattgacggggagtaccgcctccggggcgaagcaagaaagactttcgtcgaactgatgcgtagaggggatctgcccgtgtggctctcatataaggttgccagcgagggcttccagtacagcgacaggcgttggtgcttcgacggcgagcggaacaaccaggtgctggaggagaacatggacgtggaaatatggacaaaggagggggagcgcaagaagctgcggccccgctggctcgacgcccggacgtactccgaccctctggctctccgtgaatttaaggagttcgcggctggacgcagaagcgtctctggggacttaattctggagatcggcaaactgccgcagcacctcacccagagagcccagaacgcgctggacaacctggtgatgctccacaacagcgagcagggcgggcgggcgtaccggcacgctatggaggagctgcccgacaccattgagactctgatgcttcttgccctgatcgccgtgctcaccggcggggtcaccctgttcttcctgtctgggcgcggtcttggcaagacaagcattggcctcctctgcgtgatggcctcgagcgtgctcctgtggatggcgtccgtcgagccccactggatcgccgccagcatcatcctggagttcttcctcatggtgctgctcatcccggagccggatcggcagcgcacaccgcaggataaccagctcgcctacgtagtcatcggattgcttttcatgatcctcaccgtggccgcgaacgagatgggcctgctggagacgaccaagaaggacctcgggataggccacgtggcagtagagaatcatcaccatgccgcgatgctggatgtggacctgcaccccgcctccgcctggaccctctacgccgtggccaccacgataatcaccccgatgatgcgccacaccatcgagaacaccacggccaacatcagcctgaccgctattgcgaaccaggccgccatcctgatggggctcgataagggctggcccatctccaagatggacatcggcgtccccctgctggctttaggatgctacagccaagttaaccccctgaccctcactgcggccgtgctcatgctcgtcgcccactacgcgatcattggcccggggctgcaagccaaggcgacgcgcgaagcacagaagcgaaccgccgccggtattatgaagaatccaaccgtggacgggattgtggcgatcgaccttgaccccgtagtttacgacgcgaagttcgagaaacaactgggccagatcatgctcctcatcctctgcacatctcagatcctgctcatgcgcacgacgtgggccctgtgtgagagcatcacgctagcgactggccccctcacgaccctgtgggaggggtctccgggaaagttttggaacacaactatcgcggtgagcatggccaacatcttccgcgggtcctacctggcgggggcggggctcgccttcagcctgatgaagtcattaggcggcgggagacgtgggacgggggcccagggcgagaccttgggggagaagtggaagcggcagctgaaccagctatctaagagcgagttcaacacctacaagcgctccgggatcatggaggtcgaccgtagcgaggcgaaggaaggcttaaagcgcggggagaccacgaagcacgccgtgagccggggaaccgctaagctgcgctggttcgtggagcggaacctggttaaacccgaggggaaagtgatcgacttgggctgcgggagagggggctggagctactactgcgcggggctcaagaaggtgacagaggttaagggctacacgaagggcggaccaggccatgaggaacccatccccatggccacgtatggctggaatctggtaaaactgcactccggcaaggacgtcttctttataccgcctgagaagtgcgacaccctactgtgcgacatcggagagtcatcccccaacccgaccatcgaggagggccgcacactacgcgtgctcaagatggttgagccctggctgcgggggaaccagttctgtataaagattcttaacccatatatgccctcggtggttgagacgcttgagcagatgcagaggaagcacggcggcatgctggtgcgtaacccgctgtcccgcaatagtacccacgagatgtactgggtatcctgtggaaccggcaacatcgtcagcgctgtgaatatgacctccagaatgctgctgaatcgcttcaccatggcccaccgcaaaccaacatacgaacgtgacgtggacctgggggccggcacccgtcacgtggccgtggagcccgaggtggccaacctcgacattatcggccagcggattgagaacataaagcacgagcacaagagcacctggcactacgatgaagacaacccatacaaaacctgggcgtaccacgggtcctatgaggtcaagccgtcaggctccgccagcagcatggtgaacggggtcgtcaagctgctgacgaagccctgggatgtgatccccatggtcacccagatcgccatgaccgacaccacgccattcggccagcaacgcgtgttcaaggagaaggtggacacccggaccccgaaggccaagcgcgggacaacccagatcatggaggtcacggcccggtggctttgggggttcctttcccgcaacaagaagcctcggatctgtacccgcgaagagttcacccggaaggtgcgcagcaacgcggccatcggcgctgtgtttgtcgatgagaaccagtggaactccgcaaaggaggccgtagaggatgagcggttctgggacctggtgcaccgcgagcgggagctccacaagcaaggtaagtgcgccacgtgcgtctacaacatgatgggcaagcgcgagaagaagctgggggagttcggcaaggccaagggcagccgggccatctggtatatgtggctgggcgcgcgattcctcgagttcgaggcgctgggcttcatgaatgaggaccactggttttccagagagaacagtttgtccggggtggagggagaggggctccacaaacttggctacatcttacgggatattagcaagatcccagggggaaacatgtacgccgacgacacagccggctgggacaccaggatcaccgaagacgacctccagaacgaggccaagattacagacattatggagcccgagcacgcccttttagccaaggccatcttcaagctgacttaccagaacaaggtcgttcgcgtgcagcgccccgccaaaaacgggacggtcatggatgtcattagtaggcgtgaccagcggggcagcggccaagtggggacgtacggcctgaacacgtttaccaacatggaggcccagctgatccgccagatggagtctgagggcatctttagcccctccgagctcgagacccccaacctggccgagcgggtcctggactggctcgagaagtacggcgtggagcgcttaaagagaatggcgatcagcggggacgactgcgtagttaagccgattgacgatcgtttcgcaacggccctgacggccctcaacgatatgggcaaggtaaggaaggacatcccgcagtgggagccctcgaaagggtggaacgattggcagcaggtccccttctgctcccaccacttccaccagttgatcatgaaagacgggcgcgagattgtggtcccgtgccgcaatcaggacgagctggttggtcgcgctagagtctcccagggggctggctggagcctgcgcgagaccgcgtgtttaggaaagagctacgcccagatgtggcagctgatgtacttccaccggcgcgatctccggctggcggcgaatgcaatctgctccgccgtccccgtggactgggtgcccacaagccgcaccacgtggtccattcatgcccaccatcagtggatgaccaccgaagacatgctttcggtctggaatcgggtctggatcgaggagaacccctggatggaggacaagacgcacatttccagctgggaggacgtgccgtacttaggcaaacgcgaggaccagtggtgcgggtccctgattggcctgacggcccgcgccacatgggccacgaacatccaggtggcaatcaaccaggtgcgacggctaattggtaacgaaaactacctggactacatgacgagcatgaagcggttcaagaacgagtccgacccggaaggggccctgtggtga

SEQ ID NO: 24659 - RNA, 9879 nt, synthetic construct
  misc_feature 1..9879: note = derived and/or modified CDS sequence (opt11) from DENV-1__KP406803__SS-prME
  source 1..9879: mol_type = other RNA
tcggtgacgatgctgctcatgctgctgccaaccgccttagccttccacctgacaacccgaggaggggagccccacatgatcgtcagtaagcaggagcgtggtaagtctctgctgttcaagaccagtgccggggtcaatatgtgcaccttaatcgccatggacctgggagagctctgcgaagacactatgacttataagtgcccccgcattactgaaacagaacccgatgacgtggactgctggtgcaacgccaccgagacttgggtgacctacgggacctgcagccagaccggagagcaccggcgcgacaagcgctccgtggccctcgcgccgcacgtcggcctgggtttggaaaccaggaccgagacctggatgtcgtccgagggggcctggcggcagatccagaaggtggagacgtgggccctacgccaccccggtttcacagtgatcgccctgttcctcgcgcatgcgatcggcaccagcatcacgcaaaagggcatcatcttcatcctgctgatgctcgttactccctccatggccatgcggtgcgtgggcataggcaaccgagatttcgtcgaagggctgagcggcgccacttgggtggatgtcgttcttgagcacggttcctgcgtgaccacgatggccaaggataaacccacgcttgacatcgagctgctgaagaccgaggttactaaccccgcagtgctccggaaattgtgcatcgaggcgaagattagcaataccacgaccgacagtcgttgtcccacccagggggaagcgaccttggtggaggaacaggacacgaacttcgtgtgcagacgcactttcgtcgacagaggctggggaaacggttgcggtctgtttggcaaggggagcctgatcacgtgcgccaagttcaagtgtgtgaccaaacttgaaggcaagattgtccagtacgagaatctaaaatactcggtaatagtaacagtccacacgggcgaccagcaccaggttggaaacgagacaacggagcacggcaccaccgctaccatcactccccaagcccccacctcagagatccaactcactgactacggggcgctgaccctcgactgtagcccccggaccggcttggatttcaacgaaatggtcctgcttaccatgaaggagaagtcctggctggtgcataagcagtggtttctggacctcccgttgccctggacgtctggggctagcaccagccaagagacctggaaccgccaggatttactcgtgaccttcaaaacggcccatgcgaagaagcaagaagtcgtagtgctgggctcacaggagggcgcgatgcacaccgcccttaccggggccaccgaaatccagacctcggggacgaccacaatctttgccgggcacttaaagtgccgcctcaaaatggacaagctgacactaaagggtgtgagctatgtcatgtgcaccgggagcttcaagttggagaaagaagtggccgaaacccaacatggcacggtcctagtccaggttaagtatgagggtacggacgctccatgcaagatccccttctccagccaggatgaaaaaggggtcacgcaaaatggccggcttattaccgcgaacccgatcgtgaccgacaaagaaaagcctgttaacatcgaggccgagcccccattcggggagtcctacctcgtcgtgggcgccggcgagaaagcccttaaactttcgtggtttaagaaggggtcctcgatcggtaaaatgtttgaggcgacagcgcgtggggcccggcgcatggctatcctcggcgacaccgcctgggatttcgggtccatcggcggggtattcacaagcgtaggtaagctgattcaccagatattcggcaccgcctacggggtgctgttctccggcgtgagctggacgatgaaaatcggaatcggcattctcttaacctggctgggccttaactcccgcagcacatccctgagtatgacctgcattgctgtcggtatggtgacactgtatcttggcgtgatggtccaggcagactccgggtgcgtgatcaactggaaaggtagggagctgaagtgcggcagcggcatctttgttaccaacgaagtacacacatggactgagcaatacaagttccaggcggacagcccgaagagactgtccgccgcgatcgggaaggcctgggaggaaggggtgtgcggcatccgaagtgcaacccgcctagagaacatcatgtggaagcaaatctccaatgaactgaaccatatcctgctcgagaacgacatgaagtttacggtagtcgtaggagatgtgaacggcatcctggcccaggggaaaaagatgatacggccccagcctatggagcacaagtatagctggaaaagctggggtaaggcgaaggtgattggggcggacgttcagaacatcacctttatcatcgacgggcccaacactccagagtgccctgacgatcagcgcgcatggaacatatgggaggtggaagactacggtttcggtatattcaccacgaatatctggctcaagctgcgggacagctacacacaggtgtgcgaccatcgcctcatgtcagccgcgattaaggatagcaaggcggtgcacgcagacatgggctattggatcgagtcggagaaaaatgaaacatggaagctgaccagagccagcttcatcgaagtgaaaacgtgcgtttggcctaaatctcacaccttgtggagcaacggtgtgctagaaagtgagatgattattcccaagatctacggaggaccgatcagccagcacaactaccgccccgggtatttcacacagacggccggaccctggcacttaggaaaactcgaactggacttcggcctctgtgagggcacgaccgtggtcgtggatgagcattgcggcaatcgagggccatccctcagaaccaccaccgttaccgggaagatcattcacgagtggtgctgcagaagttgcacactgcccccattacgcttcaaaggtgaggatgggtgttggtatggtatggagatcaggcccgttaaggagaaagaggaaaacctcgtgaaatccatggtatcggctggcagcggggaggtcgacagcttctcactgggcctgctgtgcatatctatcatgatcgaggaggtcatgcgaagccgttggagtcgaaagatgctgatgaccggcactctggcggtattccttttgctgatcatggggcagctcacatggaacgacctcatccggctgtgcattatggtcggggcgaatgccagcgacaagatgggcatgggtacgacctatcttgctctgatggccacgttccgaatgcggcctatgttcgcggtgggtctcctcttccggcgcctcacctcccgagaggtccttctgctgaccgtgggcctatcgctcgtggcgtccgtcgagctgcccaatagtctggaggagctcggcgacggcttagccatgggcatcatgatgctgaagctcttaaccgacttccagtcccatcagctttgggccgctctgttgagcctaaccttcgtgaagacgaccttctcactccattatgcgtggaagaccatggcaatgattctgagcatagtctctctgtttcccctctgcctgagcacgacgtcccagaagaccacttggttgccagtcctcctcggctccctgggctgcaagcctctcacgatgtttttgataaccgagaacaagatctggggacggaagtcctggccccttaacgaaggaataatggctgtggggatcgtaagcattctcctgagctcgctgctcaaaaatgacgtcccgctggccggcccactgatcgccggcgggatgctaattgcctgctatgtgatcagcggctcctcagccgacttgtccctggaaaaagcggccgaggtgagctgggaggaggaggcggaacactccggtgcctcacacaacattcttgtcgaggtgcaagacgatggcacgatgaagatcaaggatgaggagcgggacgacactttgaccatcctgctcaaggctacgctcctggccatctcaggggtgtacccgatgtcaattcctgcgaccctcttcgtctggtatttctggcagaagaagaagcaacgctccggcgtcctttgggacacccccagcccgcccgaggtcgagcgggcggttctggacgacgggatctatagaatcctccaaagagggcttctgggaaaatcccaggtcggagtgggcgtcttccaggagggcgttttccacaccatgtggcatgtgacgcgcggagcagttctgatgtaccagggcaagcggctcgaaccgtcttgggcctccgtaaagaaggacctgatctcgtacgggggcgggtggagattccaaggctcctggaacacgggggaggaggtgcaggtcatcgccgtggagcccggcaagaatccgaagaacgtccagacggctccgggtaccttcaagacgccagagggggaggtcggagcgatcgccctggattttaagcccggaaccagcggctcccccatcgtgaaccgggagggtaagatagttggtttatacggcaatggggtcgtcacgacaagcgggacgtacgtgagcgccatcgcgcaagcaaaggcgtcccaagagggaccgttgcccgagatcgaggacgaggtcttccgcaagaggaacttgactatcatggatttacaccccggttctggaaaaacacgccggtacctgccggccatcgtgcgcgaggccattaaaaggaaactgagaactctcgtgctggccccaacgcgggtggtggcgagtgaaatggctgaggccctgaaggggatccccatccgctaccaaaccaccgctgtcaaatctgaacacaccggcaaggaaatcgtcgaccttatgtgccacgcaaccttcaccatgaggttactatccccagtgcgggtgccgaactacaacatgatcatcatggacgaggcgcacttcaccgaccccgccagcattgccgcgcgcgggtacatctctacgagagtcggcatgggtgaggctgcggccatcttcatgacggccacgccaccaggtagtatggaggcgttcccgcagtccaacgctgcgatccaggacgaggagcgggacatccccgagcggagctggaactccggctacgactggattacagacttcccggggaagaccgtgtggttcgtgccctcaatcaagtcgggtaatgacatcgccaattgtcttcggaagaacggaaagcgagtcgtccagttatcccgcaagacattcgacacagagtaccagaagaccaagaacaacgactgggactatgtggttaccacggatatctccgagatgggggccaacttccgggcagaccgcgtgatcgacccgcggcggtgcttaaagccggtcatcttaaaggacgggcccgagagagtgatactggcgggaccgatgccggttaccgtagcgagcgccgcccaacgccggggccggatcgggcggaaccagaataaggaaggcgaccagtacatttacatgggacagcccctaaacaacgacgaggaccacgcacactggaccgaggccaagatgttactggacaacatcaacacacctgagggcatcatacccgctctgttcgagccggaacgagagaagtccgccgccatagacggggagtatcggctccgtggggaagcacgcaagacgttcgtggagctaatgcgacgcggtgacctgccggtgtggctaagctataaggtagcatccgaaggctttcagtacagcgacaggagatggtgcttcgatggcgagcggaacaaccaggtcctggaggagaacatggatgtcgaaatatggaccaaggagggcgagcggaagaagctgcggcccagatggctcgacgcccgtacctacagcgatcccctggccctacgcgagttcaaggaatttgcggccgggcggcgctccgtctccggcgaccttatcctggagatcgggaagctgccgcagcacctcacccagagggcccagaacgcgctggacaacctggtcatgcttcacaattccgagcaaggcgggaaggcctaccgccatgccatggaggagctgcccgacacgattgagaccctgatgctacttgctctcatcgccgtgctgaccggcggagtcaccctgttctttctcagcggccggggccttggcaagacctccatcgggctgctgtgcgtgatggcatcctcagctttgctctggatggccagcgtcgagcctcactggatagcggccagcatcatattggagttctttttgatggtattgctgatcccagaaccggaccgccagcggacgccccaggacaaccaactcgcctacgtcgtaatcgggctgctgttcatgatactaaccgtcgccgccaacgagatgggccttctcgaaaccaccaagaaggacttaggcattggccacgtggcggcagaaagccaccaccacgcggcaatgctggacgtcgacctgcatcctgcgtcagcgtggaccttatatgccgtcgcaaccaccatcatcaccccgatgatgcgccacacgatcgagaacaccaccgccaacatcagcctaaccgccatcgcgaaccaagccgcaatccttatgggcctcgacaaggggtggcccatttccaaaatggacatcggcgtacccctgcttgccctcggatgctacagccaggttaacccgctgactctgaccgctgccgtcctcatgctggtggcccactatgccattatcggcccggggttacaggcaaaggcgacacgggaggcccaaaagcgcacagccgcaggcatcatgaagaaccccacggttgacggtatcgtagccattgatctcgacccggtggtgtacgacgccaagttcgaaaaacagctaggtcaaattatgctgctcatcctgtgcacctcccagatcttgttaatgcgtacgacgtgggccctgtgcgagtcgatcactctcgccacgggcccgctcaccaccctatgggagggatcccccggcaagttctggaacacgaccatcgctgtcagcatggccaacatattccgtggctcttacctcgcgggcgccggcctcgccttttcgttaatgaagtccttaggcggcggacgccggggcaccggcgcccagggggagaccctcggcgagaagtggaagcgccagctcaaccagctcagtaagagcgagttcaatacttacaaacgttccggaatcatcgaggtggatcgtagtgaggcgaaggaaggtctcaagagaggtgaaaccaccaagcatgccgtgtcgcgcggcaccgcaaaactgcggtggtttgtcgagagaaacctggttaagcccgaggggaaggtcatcgacctggggtgcggccgcggcgggtggagctactactgcgcggggctcaaaaaggtcacggaagtgaaggggtatacgaagggcgggcctgggcacgaggaacccatcccgatggccacctacggttggaacctggtgaagctgtattccggcaaggacgtgttctttacgccacctgagaagtgtgatacgcttctgtgcgacatcggtgaaagttccccgaatccaactatagaggaggggcgcacccttcgggtgctccggatggtagagccgtggctgcggggcaaccagttttgcatcaaggtcttgaacccctacatgccttccgtggtcgagaccctcgagcagatgcagcgcaagcacggcgggatgctggtccgcaatccgctctcacgcaactcgacccacgagatgtattgggtgtcctgcgggaccggcaatatcgtgagcgcggtcaacatgacttcgcgtatgttgctgaaccgcttcaccatggctcaccgtaaacccacctacgagcgcgatgtggacttgggcgccgggacgcggcatgtggcagtagaacccgaggtagccaatctcgacatcatcggccaacgtatcgagaacatcaagaacgaacacaagagcacctggcactacgacgaggacaacccatacaagacttgggcgtatcacgggtcttatgaggtcaagccaagcggcagcgcatccagcatggtgaacggtgtggtaagactgctgaccaaaccctgggacgtcattccaatggtgacgcaaattgccatgaccgacaccaccccctttgggcagcagcgggtcttcaaggagaaggtggacacgcgaacgccgaaagctaagcggggcactgcgcagatcatggaagtgaccgctcgctggctatgggggttcctgtcccggaacaagaagcccaggatatgcacgcgggaagagttcacccggaaggtccggagcaacgctgcaattggggctgtgttcgtagacgagaatcaatggaacagtgcgaaggaagcggtcgaggatgagcgcttttgggatctggtgcaccgcgagcgcgaactccacaaacaagggaagtgcgccacgtgcgtatacaacatgatgggcaagcgagagaagaagctaggggaatttggcaaggccaagggctcccgcgcgatctggtacatgtggctgggtgcaagatttctcgagttcgaggccctgggattcatgaacgaggaccactggttctcccgcgaaaactcattatcaggggtcgaaggcgagggactccacaagctcggttacatcctgcgggacattagcaagatccccggtgggaacatgtacgcagatgataccgctggctgggacacgcgcataaccgaggacgacctccagaacgaggccaagatcacggacatcatggagcccgaacatgcactgctggccacgtccatcttcaagctcacgtatcaaaataaggtggtgcgggttcagagacccgccaagaacgggacggtaatggacgtgatttcacgtcgggatcaacgcggctccggccaagtcggcacctacggcctgaatactttcaccaacatggaggcccagctgatccgccaaatggagagcgaagggatcttcctcccctccgagctggagacccctaacctggctgagcgcgtgcttgactggctcgagaagtacggcatcgagcgcctgaagcgcatggcgatcagcggggacgattgcgtggtcaagccaatcgacgaccgctttgctaccgctctaacggctctgaacgatatggggaaggtgagaaaggacatcccgcagtgggaaccatccaagggctggaacgactggcagcaggttcccttctgcagtcaccatttccaccagctgataatgaaggacgggagggagatcgttgtgccttgccgcaaccaggacgagctcgtgggacgggcccgggtttcccagggggcgggctggagcctgcgggagacggcttgccttgggaaatcatatgcccaaatgtggcagctcatgtatttccatcggcgtgacctaaggttagccgcgaacgctatttgctcggccgtccccgtcgactgggtcccgacctctcgaaccacctggtccatccacgcccaccaccagtggatgacgacagaggatatgctaagcgtgtggaaccgcgtctggatcgaagaaaacccctggatggaggacaagacccatgtctcctcttgggaggacgtgccatacctaggcaagcgggaggaccagtggtgcgggtccctgatcggcctcaccgcccgcgccacctgggccacgaacatccaagtggctattaaccaagtgcgccggctcataggtaacgagaactatctggattacatgacaagcatgaaacgcttcaagaatgagagtgaccctgaaggggccctctggtga

SEQ ID NO: 24660 - RNA, 9879 nt, synthetic construct
  misc_feature 1..9879: note = derived and/or modified CDS sequence (opt11) from DENV-1__KJ438293__SS-prME
  source 1..9879: mol_type = other RNA
tctgtgaccatgttgctcatgctgatgcccaccgccctggccttccatctcacaactagaggaggtgagccacacatgatcgtcagcaagcaggagcgcgggaagagtctgctgttcaagaccagcgcaggggtgaacatgtgcaccctcatcgccatggacttaggcgagctgtgcgaagatacgatgacctacaagtgcccacggataaccgaggctgagcccgacgacgttgactgctggtgcaacgccaccgacacctgggttacctatgggacctgtagccagaccggcgagcatcgaagggacaagcggtctgtggccttggccccgcatgtgggccttgggctggagacccgcaccgaaacctggatgagctccgagggggcctggaaacaaatccaacgggttgaaacatgggccctccgtcaccccggcttcacggtgattgccttgttcttagcccacgccatcggcacgagcatcacccagaagggtatcattttcatactcctaatgctggtgacaccttcgatggccatgaggtgcgtcggcatcggctcacgcgactttgtagaggggctatcgggcgccacgtgggtggatgtcgtgctggagcacggttcctgcgtgaccaccatggctaaggataaaccaaccctggacattgagctgcttaaaactgaggtcacaaacccagcgatcctgagaaagctctgcatagaggccaagatctccaacaccaccacggacagccgctgtcccacgcagggggaggccacacttgtggaggagcaggacgcgaacttcgtgtgcaggcgcacattcgtggacagaggttgggggaacggatgcgggctgttcggcaaggggtccttgatgacatgcgccaagttcaagtgcgtgactaagctggagggcaagatcgtccagtatgagaacctgaagtacagcgtcatcgtcactgtgcatactggcgatcagcaccaagtcggaaacgagagtacggagcacggcaccacggctacaatcacgccacaggcccccacgacagaaatccaactaaccgactacggggccctgactctggactgtagcccccgaactggcctcgacttcaacgagatggttctgctgacgatgaaggagaagtcctggctcgtccacaagcagtggttcttggatctaccactgccctggaccagcggtgccagcacctcccaggagacttggaaccggcaggacctgctggtgactttcaagaccgcccacgcgaagaagcaagaggttgtcgtgctcggtagccaggagggggctatgcacaccgccctgacaggggccactgagatccagacctcaggcaccacgacaatcttcgcaggtcacctcaagtgtcgcctcaagatggacaagctgaccctgaagggcatgagctacgtgatgtgtaccgggtcctttaagctcgaaaaagaggttgccgagacgcagcacgggacagtcctcgtccagatcaaatacgagggcaccgacgccccctgcaagatcccgttcagcacccaggatgagaagggggtcacgcaaaatggccgactcatcaccgccaacccgatcgtgacagacaaggagaagccggtgaacatcgaggccgagccgccctttggggaatcctacatcgtcatcggcgcgggcgagaaggccctaaaaatcagctggtttaagaaagggtcctccatcggcaagatgtttgaggccaccgcccgcggggcccggcgcatggcgatcctgggcgacacggcctgggacttcgggtccatcggcggcgtcttcacctccgtggggaagctggtccatcaaatcttcggcaccgcctacggggtgctattttcgggagtgagctggactatgaagattgggatcggcgtcctcttaacatggctgggcctcaactcccgcagcacctcactgagcatgacctgcatcgctgtcgggttggttaccctctatttaggcgtcatggtgcaggctgacagtgggtgtgtgatcaactggaagggtcgggagctaaagtgcgggagcggaatcttcgtgacgaacgaggtgcacacctggaccgagcagtacaagttccaggcagactctccgaagcgcctctcggctgcgattggcaaagcgtgggaggaaggcgtgtgcggtatccggagcgccactcgcctggaaaacatcatgtggaagcagatctccaacgagctgaaccacatcctcctagagaacgacatgaaatttaccgtcgtggtgggcgacgtcgcgggcatactggcccaagggaagaagatgatccggccccagcccatggagtacaagtacagctggaagtcctggggaaaggcgaagatcataggagccgacgtccagaacacgaccttcataatcgacgggcccaacaccccggagtgccctgacgaccagcgtgcgtggaacatctgggaggtggaagactacggctttggtatcttcacgaccaatatctggctgaagcttagggacagctacacccaggtgtgcgaccaccgactgatgtccgcggccatcaaggactcgaaggccgtgcatgccgacatgggctactggatcgagtctgaaaagaatgaaacctggaagctcgcgcgggccagcttcattgaggtgaagacgtgcatctggccgaagtcgcacacgctttggagcaacggcgtcctggagtcagagatgatcattcccaagatctacggcggaccgatctcgcagcataattaccgccccgggtacttcacccaaaccgccggcccctggcacctcggaaagctggagctagacttcgacctctgcgagggcacaacggtggttgttgatgagcactgcggcaaccgggggccgtcgctgagaactaccacggtgacgggaaaaatcatccacgagtggtgctgccgcagctgtacactgccgcccctgcgcttccgcggtgaagacggctgctggtacgggatggagatcaggcccgtgaaggagaaggaagagaacctggtcaagtccatggtgagcgcgggaagcggcgaggttgactcctttagcctggggctcctgtgcatctccatcatgatcgaggaggtaatgcgcagccgctggtcgcggaagatgctgatgaccggcacactcgccgtgttcttcctgttaataatgggacaactcacgtggaatgacctaatacgcttatgtatcatggtgggagcgaacgctagcgatcgcatggggatgggcaccacgtacctcgcgctgatggcgacatttaaaatgcggccgatgttcgctgtaggcctcctgttcaggagactgacgtcacgagaagtgctgctcctgactatcggcctgagcttggtggcgtccgttgagctgcccaactcgttagaggagctcggggacgggctggccatgggcatcatgatcctgaagctcctaaccggctttcaatcccaccagttatgggccaccctcctcagcctgacattcataaagacaaccttttcactccactacgcctggaagaccatggcgatggtgctgagcatcgtctccctgttccccctctgcctcagcacgacctcacaaaagaccacctggctgcccgtgctcctgggcagcctggggtgcaagccactcacgatgtttctgataacagagaataaaatctgggggcggaaatcatggcccttaaacgagggtatcatggccgtgggcattgtctctattctcctgagctccttgctcaagaacgacgtgccgctggccggccccctgatcgctggcgggatgctcatagcctgctacgtcatctctggctcatcagcggacctgtccctggagaaggccgccgaggtcagttgggaggaggaggccgagcacagcggggccagtcataacatcctagttgaggtgcaggacgatggcaccatgaagattaaggacgaggagcgagatgacactttaaccatacttctcaaagcgacgttactggccgtctccggggtgtacccactcagcatcccggccacactgtttgtgtggtacttctggcagaagaaaaagcagcggtccggcgttctgtgggacaccccttcacctcccgaggtggagcgcgccgttctcgacgatggcatataccgaatcatgcagcgcggcctgctgggaaggtcccaggttggagtgggagtgtttcaagagaatgtatttcacaccatgtggcacgtgacgcgcggggcggtgctcatgtatcagggcaagcggctcgagcccagctgggcaagcgtcaagaaggacctgatcagctacggcgggggatggcgcttgcaagggtcctggaacactggcgaagaggtccaagtaatagctgtggaacccggaaagaacccgaagaacgtgcaaaccgcccccggcacctttaagacgcccgagggcgaagtaggagcgatcgccctcgacttcaaacccggcaccagcggttcccccatcgtcaacagggagggcaagatcgtaggcctctacgggaacggcgtggttaccactagcggtacgtacgtcagtgcgatagcccaggccaaagcttcacaggaaggtccgctgcccgagattgaggacgaggtgtttcggaagaggaacctcaccatcatggatctacaccctgggtcaggtaaaacccggcggtaccttcccgcaattgttcgggaagccattaaacgcaagctccgcacccttatactcgcccccaccagggtggtggcttccgagatggcggaggctcttaagggtatgccgatccggtaccaaaccaccgcggtcaaaagcgagcacaccgggaaagagatcgttgacctcatgtgccacgccacgttcaccatgcgcctgctctcccccgtgcgggtccctaactacaatatgatcatcatggacgaggcccactttaccgacccaagcagcatcgctgcgcgcggttacataagcacccgggtggggatgggcgaggcggccgccatctttatgacggcgacaccgcccggctcagtggaggcctttccccagagtaacgccgtaattcaggatgaggaacgcgacattcccgagcgctcctggaacagcggatacgactggatcaccgatttccccggaaagaccgtctggttcgtacctagtatcaagagcgggaacgacatcgccaattgcctgcggaagaatggcaagcgggttattcagctgtcccggaagacattcgacaccgagtaccagaagaccaaaaacaacgattgggattatgtagtcactaccgacatcagcgagatgggggccaattttcgggcggaccgcgtcatagacccgcggcgttgcctcaagcccgtgatccttaaggacggccctgagcgggtggtcctggcagggccaatgccggtgaccgtcgcctccgccgcgcagcgtaggggtcgcatcggccgaaaccacaacaaggaaggggaccagtacatctatatgggccaaccgctcaataacgacgaggaccacgcgcattggacagaggccaagatgctgctggacaacatcaacacccctgagggtatcatccctgctctctttgagcccgaacgcgaaaagtcagcagccatcgatggcgaataccgcttgcgaggggaggcgcgcaagacgttcgtcgagctgatgagacgcggcgacctaccggtgtggctctcctataaggtggccagcgagggctttcagtactctgatcggagatggtgcttcgacggggaacggaacaaccaggtgctggaggagaacatggacgtggagatctggaccaaggagggcgagcgcaagaaattgaggccccgctggctggacgcgcggacctactccgacccactggccttgagagaattcaaagaatttgccgcgggtagaagaagcgtttcaggcgacctcatcttagaaatcgggaagcttccgcagcacctgacccagcgtgctcaaaacgccctggacaacctggtgatgctccacaactctgagcaggggggtagggcctatcggcatgcgatggaggagctacccgatacgatcgagaccctcatgctattagctctcatcgccgtcttgaccgggggagtcacactgttcttcctctccgggcgcggtctgggcaaaacgagcatcgggctattatgcgtgatggcctccagcgtcctgctgtggatagcctccgtcgaacctcactggatagcggccagcatcattctcgagttcttcctgatggtgctgctcatccccgagcctgaccggcagcgtacgccccaggacaaccagctggcctacgtggtcataggcctcctctttatgatcctaaccgtggcggcaaatgagatgggcctgctcgagacgaccaagaaggacttaggcattggacatgtggcggtcgagaatcaccaccatgccgccatcctggacgtggacctccaccccgcctctgcctggacgctgtacgctgtggcgaccaccatcatcacccccatgatgcggcatacgatcgaaaacacaaccgccaacattagtctgaccgctatcgccaaccaggccgccatcctgatggggttggacaagggatggcccatttccaagatggacatcggggtccccctgctcgctctgggctgctacagccaggttaacccgctgacactcaccgccgcggtactgatgttagtagcacactacgccatcatcgggccgggcctccaggccaaggcgacacgcgaggcacaaaagcggaccgcggccgggatcatgaagaacccgacggtggacggaatcgtggccatcgacctagacccagtcgtgtacgacgcgaagtttgagaagcagcttggccaaatcatgctcttgattctgtgtacctcccaaatcctcctgatgcgtaccacctgggcgctgtgcgagagcatcacgctagccaccgggcccctcaccaccctgtgggagggttcccctgggaagttctggaacacaaccatcgccgtgagcatggccaacatctttcgtggctcctacctcgccggcgcgggcctggcttttagcctgatgaaatccctcggcggggggcggcgcggaaccggcgcccagggagaaaccctgggggagaagtggaagcgacaactgaatcaactctccaagagcgagttcaatacgtataagaggtccggcatcatggaggtcgacagatcggaggccaaggagggtctaaagcgcggagaaaccactaagcacgcggtgtcgcgggggaccgcaaaactgaggtggttcgtggagcggaatctcgtcaaacccgagggtaaggtcatcgacctgggctgcgggcgcggggggtggtcttactattgcgccggcctcaaaaaggtaacggaggtcaaagggtacaccaagggcggccctggacatgaggagcccataccgatggctacatatggctggaacctggtgaaactctacagtgggaaggacgttttcttcatcccgcccgaaaagtgcgacacactgctgtgcgacatcggcgagagctccccaaacccgacgatcgaggaggggcggaccctccgcgtcctgaagatggtggagccctggttacgtgggaatcaattctgtatcaagatcctcaatccctacatgccctctgtggtcgagaccctggaacagatgcagcgcaagcacggcggaatgttagtgcgcaaccctttatcacgcaatagcacacacgagatgtactggatcagttgtggcaccgggaacatcgtcagcgccgtcaacatgacctctcggatgctgctgaatcgcttcaccatggcgcatcgaaaacccacatacgagcgagacgtcgacctcggcgcaggcacccgccacgtggccgtcgagcccgaggttgctaacctggacattatcgggcagcgaatcgagaacatcaagcacgagcacaagagcacctggcattacgatgaggacaacccttacaagacgtgggcataccacggctcctacgaggtgaagccttcggggtcagcaagcagcatggtcaacggcgtggtgaagctgcttaccaagccctgggatgtgatccccatggtgacccagatagccatgaccgacaccacaccgttcgggcagcagcgcgtcttcaaggaaaaggtcgacacccggacgccgaaagccaagcgcggcaccgcccaaatcatggaggtgaccgcccgatggttgtggggctttctgtcgcgcaacaagaagccccggatttgcacacgggaggagttcacgcggaaggttagaagcaacgctgccatcggggccgtattcgttgatgagaaccaatggaactccgccaaagaggcggtcgaagacgaacgtttctgggacctcgtgcatcgcgagcgggaactgcacaaacagggtaagtgtgcgacctgcgtgtataacatgatgggaaagcgcgagaaaaaattgggcgagtttgggaaggcaaagggtagcagagctatctggtacatgtggctcggggcccgtttcctggagtttgaagcgctgggattcatgaacgaggaccattggttctcccgggaaaacagcctctccggagtggagggggagggacttcataagttagggtatattctgagggatatctccaaaataccaggcggtaacatgtacgccgacgacaccgcgggttgggacacccggatcacagaggacgacctgcagaacgaggcgaagatcacggacatcatggagccggagcacgccctactcgctaaagccattttcaagctgacctatcagaacaaggtggtgcgggttcagcgccctgctaagaacggcaccgtgatggatgtgatttcccggcgcgaccaacgagggtccggccaggtaggcacgtacgggctgaacactttcaccaacatggaggcccagctcatccgtcagatggagtccgagggcatcttcagcccctccgagctggagacccccaacctcgcggagcgggtgctcgattggctggagaagtacggggtcgagcgcctgaagcggatggcgatcagcggagacgactgtgtcgtaaagcccatcgacgatcggttcgccacggcgttaacagcgctgaacgacatggggaaggtgcggaaggatataccacagtgggagccctcaaagggctggaacgactggcagcaagtccccttctgcagccaccatttccaccaactcatcatgaaggatggtcgcgagatcgtcgttccatgccgcaaccaagacgagctcgtcgggcgagcccgggtcagtcagggcgcgggctggagcctgcgcgagaccgcctgcctgggcaagagttatgcccagatgtggcagctgatgtatttccaccggagagacctgcggctggcagcgaacgctatctgctccgccgtgccagtggactgggtgcccacaagccgtacgacctggtccatccacgcccaccaccagtggatgacaactgaggacatgctcagcgtttggaaccgggtgtggatcgaggagaacccctggatggaggacaagacgcacatctccagctgggaggacgtgccgtacctggggaagagggaggaccagtggtgtggctccctgatcggacttaccgcacgcgcaacctgggccaccaacatccaggtggccatcaaccaggttcggcgcctgatcggcaatgaaaactaccttgactacatgaccagcatgaagcggtttaagaatgagagtgaccccgagggtgctctctggtga

SEQ ID NO: 24661 - RNA, 9879 nt, synthetic construct
  misc_feature 1..9879: note = derived and/or modified CDS sequence (opt11) from DENV-1__KJ438296__SS-prME
  source 1..9879: mol_type = other RNA
agcgtcaccatgcttctcatgctgatgcccaccgccttagccttccacctcacgacccggggcggggaaccgcacatgatggtgagcaagcaggagcgaggcaaaagcttactcttcaagacatctgccggtgtgaacatgtgcaccctcatagccatggatctcggcgagttatgcgaggacaccatgacctacaagtgcccccgtatcacagaggcggagcccgatgatgtcgactgctggtgtaacgccacagacacctgggtgacctacgggacgtgctcacagactggcgagcatagacgcgacaagcgatccgttgccctcgcaccccacgtgggcctcgggttagagactcgaaccgagacctggatgagctctgagggggcctggaaacagatccagcgggttgagacctgggccctccgccaccccggcttcacggtgatagccctgttcctggcgcatgccatcggcacctcaataacccagaagggcatcatcttcatcctcctgatgctggtgaccccatccatggcgatgcggtgcgtaggcatcggcagccgcgacttcgtggaggggctctccggtgccacttgggtagacgtcgtgctggagcatggtagctgcgtgactacaatggccaaagacaagccgaccctggacatcgagctcctgaagacggaggtcaccaaccccgcggtactgcggaagctttgcattgaggccaagatctccaataccaccacggatagccgctgcccgacccagggcgaggccacgctggtagaggagcaagacgccaactttgtctgcagacgcactttcgtggatcgggggtgggggaatggctgcgggttgttcggcaaagggtccttgatcacgtgcgcaaaattcaagtgcgtgacaaagctggagggaaagatcgttcagtatgagaatctgaagtatagcgtgatcgtgaccgtccacacaggggaccagcaccaggtgggaaacgagtccacggagcacgggacgaccgcgactatcacgccccaggcgccaacgacggagatccaactgaccgactacggggctttgaccctggactgctcccctcgcacgggcttagacttcaacgagatggtcctgctgaccatgaaggagaagtcctggttggtgcacaaacagtggttcctggatctccccctaccctggacgagcggggccagcacctcccaagagacgtggaacaggcaggatttgttagtgacttttaagaccgcccacgcgaagaaacaggaagtggttgttctcggtagccaggagggcgccatgcatacggccctcaccggagccaccgagatacagacctccggcaccacgacgatcttcgctgggcacctgaagtgcaggctcaagatggacaagctgactctgaagggcatgagctacgtcatgtgcactggctccttcaagctcgagaaagaagtggcggagacgcagcacggtaccgtgctggtacagatcaagtacgaaggcaccgacgccccttgcaagatcccgttcagtactcaggacgagaagggtgtgacacagaacggtagactgatcaccgccaatccgatcgtgaccgacaaggaaaagcccgttaatattgaagccgagccgccctttggggagtcctacatcgttatcggcgcgggagagaaggccttgaaactcagctggtttaaaaagggttccagcatcggcaaaatgttcgaggccaccgcccgcggagcgcggcgcatggcgatactcggcgacaccgcctgggattttgggtccatcggcggcgtcttcacctcggtcggcaagctggtgcaccagattttcggcacagcctacggggtgctgttttccggcgtctcatggaccatgaagatcgggatcggcgtgctgcttacgtggctcggcctgaactcccggagcacgtccctgtctatgacctgcatcgccgtggggctcgtgaccctttacctgggcgtgatggtgcaggccgactccgggtgcgtaattaactggaagggccgcgagctcaagtgcgggagcggcatcttcgtaacgaacgaagtgcacacttggaccgagcagtataagttccaggcagacagccctaagcgcctgagtgcggccatcgggaaggcctgggaggagggggtctgcgggatacggagcgccactcgcctggagaacatcatgtggaagcagatatcgaacgagctcaaccatatcctcctggagaacgatatgaagtttaccgtggttgtaggggacgtcgcgggcatcttagcccaggggaagaagatgatccggccccagcccatggagtacaagtacagctggaagtcatgggggaaggccaagatcatcggtgccgacgtgcagaacacgaccttcatcatcgacgggccgaacacccctgaatgcccggacgatcagcgagcgtggaacatctgggaggttgaggactacgggttcggaatattcaccacgaacatctggctgaagctgcgggacagctacacccaagtgtgcgaccaccgcctgatgtccgccgctatcaaggattcaaaggcggtgcatgccgacatgggctactggatcgagtccgagaagaacgagacctggaagctggcgcgggccagcttcatcgaggtcaagacttgtatctggcccaagtcccacacgctgtggagcaacggcgtgctcgagtcggagatgatcatccccaagatctacgggggcccaatcagccaacacaactatcggccaggatatttcacacagaccgccggcccctggcacctggggaagctggagctcgacttcgacctttgtgagggaaccacggtggtcgtggacgagcactgtggcaaccgggggccgtcccttcgcacgaccaccgtaacgggaaaaataatccacgagtggtgctgccggtcgtgcacgctgccccccctccgcttccgcggggaggacggctgctggtacggtatggagatccgccccgtcaaagagaaggaggagaacctcgtgaagtccatggtgagcgctgggagcggtgaggtcgactccttcagcctcggtcttttatgcatctccatcatgatcgaagaggtgatgcggagccgctggtcccggaaaatgcttatgattgggaccctggcggtgttcttccttctcatcatggggcagttaacctggaatgacctgatccggctatgcattatggtcggcgcgaacgctagcgatcggatggggatgggaacgacctacctagccctcatggccaccttcaagatgcggccgatgttcgccgtgggcctcctgttccgccggctgacctcccgcgaggtactccttcttacgatcgggctgagcttggtcgcatccgccgaactgcccaacagcctagaggagctgggcgacgggttggcgatggggataatgatcctcaagctactgaccgacttccagtcccaccagctgtgggccactttgctgagcctcaccttcatcaagacgaccttctcccttcactacgcgtggaaaactatggccatggtgctatcaatcgtatccctcatacccctatgcctgtctaccacctcccaaaaaaccacctggctgcccgtgctgttgggaagcctcgggtgcaagccgctgacaatgttcctgatcgccgagaacaagatttggggccggaagtcatggcccctcaacgaggggatcatggcagttggcatcgtcagcatcctgctgagctccctcttgaagaacgacgtgcccctggccgggcccctcatcgcgggcggcatgctgatcgcttgctacgtcatcagtgggtcctctgcagacctgtccctcgagaaggccgccgaggtcagctgggaagaggaggcggagcacagtggcgcgagccacaacatacttgtggaggttcaagacgacgggacgatgaagatcaaggacgaggagcgcgacgacacactgaccatcctcctgaaggccaccctgctcgccgtctccggcgttttcccgctgagcatccccgccaccctgttcgtgtggtacttctggcagaagaagaagcagcggtccggggtactctgggacacgccaagcccgccagaggtagagcgcgcagtcctggacgacggcatctacagaatcatgcagcgcggcctgctgggtcggtcccaggtcggtgtgggggtcttccaggagaacgtcttccacaccatgtggcacgttacccgcggcgcggtgctcatgtaccaagggaagcggctggagcctagctgggcttcggtcaagaaagacttaattagctatggaggtggctggcgcctccagggatcctggaacacgggagaagaagtacaggtgatcgcagtcgaaccgggcaagaaccccaagaacgtccagacagcccccgggaccttcaagacccctgagggggaagtgggcgcgatagccctggacttcaagcccgggaccagcggcagtcccatcgtaaaccgggaagggaaaatagtggggctgtacggaaacggggtggtcacgaccagcggcacgtacgtatcggccatcgcccaggcgaaggcttcccaggaagggccgctccccgagatcgaggacgaggtgttccgcaagcggaacctgaccataatggacctgcaccccggttccgggaaaacgcgccggtacctgccggctatcgtccgcgaggccatcaagcggaagttacgcaccctgatcctcgcccccacgcgcgtagtggcttccgaaatggccgaggccctgaagggcatgcccatccggtaccagaccacggccgtcaaaagcgagcacaccggcaaagagatcgtggacttgatgtgccacgcaaccttcaccatgcgtctcttgtccccagtgcgggtaccgaactacaacatgataatcatggatgaggcgcacttcacggaccccagctcgatcgcagcccgggggtatatcagcactcgggtcggcatgggcgaggccgccgccatcttcatgaccgccacgccgcccggctccgtggaggccttcccacagagcaatgcggtcatccaggacgaagagcgcgacatcccggagcggtcctggaactcgggttacgagtggatcacggacttccctggcaagaccgtgtggttcgtgccctccatcaaaagcggcaacgacatagcgaactgcctgcgtaagaacggaaagagagtcatccagctttcccgcaagaccttcgacaccgagtaccagaagaccaagaacaacgattgggactacgtggtgacaaccgacatcagcgagatgggcgctaactttcgggccgaccgcgtgatagacccacgacgctgcctgaaacccgttatcctaaaggacggacccgaacgggtgatcctcgcaggccctatgcccgtcaccgtggccagtgcggctcagagaagggggcgcatcggccggaaccacaataaggagggcgaccaatacatctacatgggacagcctttaaacaacgacgaggaccacgctcattggacggaggccaagatgttattagacaacatcaacacgcccgagggaatcatccctgccctcttcgaaccagagcgcgagaaatccgcggccatcgacggggagtaccgactacggggcgaggcccgcaagacattcgtcgaactcatgcggcgcggggacctgccagtttggttgtcctacaaggtggcctctgaaggatttcagtacagcgaccggaggtggtgcttcgacggcgaacggaacaaccaggtcctcgaggaaaacatggacgtagagatttggaccaaggaaggggagcgtaagaagctacgcccacgctggttagacgcccggacgtactccgaccccctcgcgctgcgcgagttcaaggagtttgccgccggccggaggagcgtatccggggacctgatcctcgagataggcaagctgccccaacacctgacccagcgggcccagaatgctctcgataaccttgttatgctgcacaactcagagcaaggcgggagagcctaccgtcatgctatggaggagctgcctgacactatagagaccctgatgctactagctctgatcgccgtgctcacgggaggggttaccctcttcttcctgtccggccgcgggctgggcaagacctccatcggcctcttatgcgtcatggcttcaagcgtgctgttatggatggcttccgtggaaccgcactggatcgccgcctccatcatcctggaattcttccttatggtcctccttatccccgagccggaccggcaacgcacccctcaggataaccagctggcctacgtggtaatagggctcttatttatgatcctgaccgtagcggccaacgaaatgggtctcctagaaaccacaaaaaaagacttagggatcgggcacgtggctgtggagaaccaccaccacgccgcgatgctcgacgtcgacctgcaccccgcgagtgcctggactctgtacgccgtagccaccacgatcatcacccccatgatgcgccacaccatcgagaacactacggctaacatcagcctcacagcgatcgccaaccaggctgccattctgatggggttagacaaggggtggcccatatccaagatggacatcggcgtcccgctactggccctggggtgttacagccaggtcaaccccctcaccctgacggccgccgtgctgatgctcgtagcgcactacgccatcatcggcccggggttacaagcgaaggccaccagagaggcccagaagcgcaccgccgccggcatcatgaagaaccccaccgtagacgggatcgtggcaatcgacctggaccccgtggtctacgacgccaagttcgagaagcagctcggccagattatgcttctgatcctttgcactagtcaaattctgctaatgcggacgacctgggctctctgcgagagcattaccctagccaccggcccactgacgaccctctgggaggggtcccccggaaagttctggaacaccaccatcgccgtgtcaatggctaacatcttcagggggagctacctggccggtgccggcctggccttctcgttgatgaagtcgctcggcggagggaggcgcgggacgggggctcaaggcgagaccctgggcgagaagtggaagcggcgattgaaccagctatccaaaagcgagttcaacacctacaagcgctccgggatcatggaggtcgaccgcagcgaggctaaggagggcctgaagcgcggggaaaccaccaagcacgccgtctcccgcggcaccgcgaagctccggtggttcgtggagcgcaacctggtgaagcccgagggcaaggtgatcgatctgggctgcgggcgcggaggctggagctattactgcgccgggcttaagaaagtgaccgaggtgaagggatacacaaaaggcggtccgggccatgaggaaccaatcccgatggcgacctacgggtggaatctcgtcaaattacactccggcaaagacgtattcttcatcccccccgagaagtgtgacaccctgctgtgcgacatcggcgaatcatcccccaaccctaccatcgaagaaggcaggacgctgcgggtgttgaagatggtcgaaccctggctccgcgggaaccaattctgcatcaagatcctgaacccctatatgcccagcgtagtcgagacgctagaacagatgcagcggaagcatggcggcatgctcgtccgcaacccgctgtccagaaacagcacccacgaaatgtattgggtgtcctgcgggaccggcaacatcgtgtcagccgtcaacatgacgtcccgcatgctgcttaatcgcttcaccatggcccacaggaagcccacttacgaacgcgacgtggacctgggtgccggcacgaggcatgtggcagtcgagcccgaggtggcgaatctggacatcatcggacagcgcatcgaaaacattaagcacgagcacaaatctacctggcattacgacgaagacaatccgtacaaaacatgggcttaccatggatcctacgaggtgaagccgagcggctcagcgtcttcgatggtcaacggggtagtcaaactcctgacaaaaccctgggacgtgatccccatggtgactcagatcgccatgaccgacacaacgcccttcgggcagcagcgggtcttcaaggagaaggtggacactcgcacccctaaggccaagcgggggacggcccaaattatggaggtgacggcacgctggctgtggggcttcctctcccggaacaagaagccccgcatctgcacgcgggaggaatttacccgcaaggtccgatcgaacgccgcgatcggcgcggtcttcatcgacgagaaccagtggaactccgcgaaggaggccgtcgaggacgagcgcttctgggacctggtccacagagagcgggagctgcacaagcaagggaagtgcgcgacctgcgtatacaatatgatgggcaagcgagagaaaaagctcggggagttcggcaaggccaaaggcagcagggcgatatggtacatgtggctgggggcccggttcctggagtttgaggccctgggcttcatgaatgaggaccactggttcagtagagagaatagcctgtccggcgtggaaggagaggggctgcacaaacttggctacattctgcgggacatcagcaagatccccggtggcaacatgtatgctgacgacacagccggctgggacacacgtatcactgaggacgacttgcagaacgaggctaagatcacagacataatggaaccagagcacgcactcctggccaaggccattttcaagctgacgtaccaaaacaaggtcgttcgcgtgcagcggccggccaaaaacgggaccgtcatggacgtgatctcccgtcgggatcagcgcggcagcggacaggtagggacctacggcctgaatacctttacgaacatggaggcccagttaatacggcagatggagtccgaagggatcttcagcccgtccgagctggaaacccccaacctcgccgaaagagtcctagactggctgggcaagtacggggttgagcggctcaagcgcatggcaatcagcggggacgactgcgtggtcaaaccgatcgacgacaggttcgccaccgcgctgaccgcgctcaacgatatgggaaaggtaaggaaggatatcccccaatgggagccctccaagggctggaatgactggcagcaggtccccttttgcagccaccacttccaccagctaatcatgaaggacggccgggaaatcgtcgtgccttgccgcaatcaggacgagctggtagggcgtgcccgagtctcccaaggcgcgggttggagcctacgggagacggcgtgcttgggcaagagctatgcacagatgtggcagttaatgtacttccaccgccgggacctgcgcctcgccgccaacgccatctgctccgcggtccccgtggattgggtccctacctcgcggaccacctggtccatccacgcgcaccaccagtggatgacgaccgaggatatgctgagcgtgtggaaccgtgtatggatcgaggagaacccctggatggaagacaagacccacatctccaactgggaggacgttccgtacctggggaagcgggaggaccaatggtgcggatctttgataggactgaccgctagagccacatgggccaccaacatccaagtggcgatcaaccaggtgcgcaggctcatagggaatgagaattacctcgactacatgacctcgatgaagcgcttcaagaacgagagcgaccctgagggcgctttgtggtag

SEQ ID NO: 24662 - RNA, 9879 nt, synthetic construct
  misc_feature 1..9879: note = derived and/or modified CDS sequence (opt11) from DENV-1__KC692495__SS-prME
  source 1..9879: mol_type = other RNA
agcgtaaccatgctcctcatgctgcttcctactgccctggcctttcacctgaccacccgcggcggggaaccccatatgatcgtttctaagcaggagcgggggaaatccttgttgtttaaaacgagcgctggggtaaacatgtgtaccctgattgctatggacctgggcgagctctgcgaggacaccatgacctacaagtgcccccggattaccgaggccgagcccgacgacgtggactgctggtgtaacgccacggatacctgggtcacttacgggacttgtagccagaccggcgagcaccggcgcgagaagcgaagcgttgccctggcgccccacgtggggctggggttagagacccgcaccgagacatggatgagcagcgagggcgcctggaagcaaatccagcgggtcgagacctgggcgctccgacaccccgggttcactgtgatagccttctttctggcgcacgctattggcaccagcatcacccagaagggtattatctttattctcctgatgctggtgaccccctccatggccatgcggtgcgtcggcatcggcaaccgcgacttcgtggaggggcttagcggcgccacatgggtcgacgtagtactggagcacgggtcctgtgtgaccactatggctaagaacaaacccacgctggacatcgagctccttaagacggaggtaaccaacccggcggtgcttaggaagctgtgcatcgaggccaagatctctaacaccaccactgactcccgctgccccacccagggcgaagccacgttagtggaggagcaggacgctaactttgtctgtcgccgcaccttcgtcgaccgagggtgggggaacggctgcgggctattcggaaagggtagcctcctgacgtgcgcgaagttcaagtgtgttaccaagctggagggtaagatcgtacaatacgagaacctcaagtactccgtgatcgttacggtccacaccggggaccagcaccaagtgggtaacgaaacgaccgagcacggcactatcgcgacgatcacaccccaggcccccactagcgaaatccagctgaccgactatggagccctgacgctagactgtagcccccgcaccggactggatttcaacgaaatggttctgttgacgatgaaggaaaaatcctggctggttcacaagcagtggtttctggatcttccgctgccctggacatccggggccagcaccagccaagaaacatggaaccggcaggacctgctggtgacgtttaagaccgctcacgctaagaaacaggaggtcgtggtgctaggctcccaggagggcgccatgcacaccgctctgactggggccacggagatccaaacctcaggaaccaccacgatctttgctggacacctcaaatgccgcctgaagatggacaaacttactctcaagggtatgtcgtacgtcatgtgcactgggagcttcaaactggagaaggaggtagcggagacccagcacggaacggtactcgtgcaggttaagtatgagggcaccgatgccccctgcaaaatccccttctccacccaggacgaaaagggggtgacccagaacggcaggctgatcacggcgaatcccatcgtaaccgacaaggagaagcccgtgaacatcgagaccgagccacccttcggggaatcatacatcgtggtcggcgccggcgagaaggcgctcaagctctcctggttcaagcgcgggagctcaatcggcaagatgttcgaggccacagcccgcggggcgaggcgcatggccatcctgggcgacaccgcgtgggatttcggatcgatcggtggtgtgtttacctccgtcggaaagctagtccaccaagtcttcggcaccgcctatggtgtgctgtttagcggcgtgtcctggaccatgaagatagggatcggcattctgcttacgtggctgggtctgaatagccgttccaccagcctctcgatgacatgtatcgctgtggggatggtgaccctgtacctaggcgtcatggtacaggccgacagcgggtgtgtgatcaactggaagggcagggagctcaagtgcggatcgggtattttcgtcacgaacgaagtacacacctggactgagcagtacaagttccaggccgacagccccaagcggttgagcgcggcgattggcaaggcctgggaagagggggtgtgtggcattagatcggccacccggctggagaacatcatgtggaagcagatcagcaacgagctcaaccacatcttgctggagaacgatatgaagttcaccgtagtggtaggagatgccaacggcatccttgcgcagggaaagaagatgatcaggcctcagccgatggaacataagtactcgtggaagtcttggggcaaggccaaaatcattggcgctgacatccagaacacaaccttcattattgacgggcccgacaccccggagtgtccagacggccagcgggcctggaatatctgggaagtcgaggactacgggtttggcgtatttaccactaacatctggctaaagctgcgcgattcctacacacagatgtgcgatcaccggctcatgagcgctgcgatcaaggactccaaggccgttcacgcagacatgggctactggatcgagagcgagaaaaacgaaacttggaaacttgctagggcgtccttcatcgaagttaagacctgcacgtggcccaagagccacactctgtggagcaacggtgtcctagaaagcgagatgatcattcccaaaatcttcggcgggccgatctcccagcacaactaccgtccgggatacttcacccagaccgccggcccctggcatcttggcaagctggagttggacttcgacctatgtgagggcacaaccgtggttgtggatgagcactgcggtaaccgcgggccgagtctgaggactaccacagtcaccgggaagatcatccacgagtggtgctgccgctcctgcaccttaccgcccctgcgctttaggggcgaagacgggtgctggtacggcatggagatccggcccgtcaaggagaaagaggaaaacctagtacgcagcatggtgtccgccggcagcggggaggttgacagcttctccctcggcatcctgtgcgttagcatcatgattgaggaagtgatgcggtcccgctggagtcgcaaaatgcttatgacggggacgctcgcagtcttcttactgctgataatgggccagcttacctggaacgacctgatccggctctgcatcatggtgggggccaacgcgagtgacaggatggggatggggacaacatacttggcccttatggcgacattcaaaatgcggcccatgttcgccgtggggctcttattccgccgcctgaccagcagggaggtcctcctgctcaccattggtttatccctagtggccagcgtagagctgcccaactccctggaggaacttggggacggactggcgatgggaatcatgatgctcaagctgttgaccgagttccagccccatcagctctggactacgttgctgagcctcactttcgtcaaaaccacgctgtccctggactacgcctggaagaccacggcaatggtactatcaatcgttagtctgttccctctatgtttaagtaccacgtcccagaagaccacatggctgcctgtgctgctcgggtcattcgggtgtaaacccctgaccatgtttttgatcaccgagaacaagatttggggccggaagagttggccactcaatgagggcataatggccatagggatagtaagcatcttgctatcctctctcctgaagaacgacgtccccctggcgggtccgctcattgctggtggcatgttgattgcctgttacgtgattagcggctccagcgccgatctgagccttgagaaagccgcagaggtgagctgggagcaagaggccgagcactccggagcgtcccataacatcctggtcgaagtccaggatgacgggaccatgaagataaaagatgaggagcgagacgacaccctgaccatactcctaaaggccacgctgttagccgtgtccggcgtctaccccatgagcatccccgcgacactgttcgtgtggtacttctggcagaagaagaagcagcggtcaggcgtgctgtgggataccccgagtccacccgaggtcgagcgcgccgtgctcgacgacggcatctaccggatacttcaacgcggcctgctgggccgatcccaggtgggggtcggcgttttccaggacggggttttccacacgatgtggcatgtaacgcgcggcgctgttctcatgtaccagggaaagcggcttgagcccagctgggcctccgtcaagaaggaccttatcagctacgggggagggtggcgtttccaaggcagctggaatacaggcgaggaggtacaggtgatagctgtggagcccggcaagaacccgaagaacgttcagaccacccccggcacgtttaaaacccccgagggggaggttggcgcgatcgccctcgatttcaagcccggcacgagcggctccccaatcgtgaaccgggagggcaagatagtcggtctctacgggaacggtgtggtgactaccagcggcacgtatgtgtccgccatcgcccaggctaaagcgtctcaggaaggcccgttgcctgagatagaggacgaagttttcaagaaacgcaacctcaccatcatggacctgcatccgggcagcggcaagactcgtcgctacctgcccgccatcgtgcgggaggccataaaacgaaaactccgcacccttattctggcccccacgcgggtagttgcttccgagatggccgaggcgctaaaagggatgccgatccgctaccagaccactgctgtcaagagcgagcacaccggaagagaaatagttgatctaatgtgtcacgcaacgttcaccatgcggctgctctccccggtgagagtgcccaactacaacatgataatcatggatgaggcgcacttcaccgaccccgccagtatagctgcccgtggctacatctccaccagggtcggcatgggggaggccgcggcgatcttcatgacagccactccacccggaagcgtagaggcctttcctcagtccaacgccgttattcaggacgaggagcgcgatatccccgagcggagctggaactccggctacgactggatcaccgacttccccgggaagactgtctggttcgtgcccagcatcaagtccggcaacgacatcgcgaactgcctgcgcaagaacgggaagagagtgatacagctgtctcgcaagacgttcgacactgagtaccagaaaacgaaaaataatgattgggactatgtcgttaccacggacatcagtgaaatgggtgctaacttccgggctgaccgcgtgattgaccccaggcgctgcctgaaaccggtcatcctgaaggacgggcccgagcgggtgatcctggccggcccgatgcccgtcaccgttgcttcagccgcacaaaggcgcggccgcattgggcgcaaccagaacaaggagggcgaccagtatgtgtacatggggcagcccctcaacaacgacgaagaccacgcccactggactgaggccaaaatgttactggataacatcaacacccccgagggcattatccccgccctctttgagcccgaacgggagaaatccgccgccatcgacggggagtaccgcctgcgtggcgaggcgcgcaagacgttcgtcgaacttatgcggcgcggcgatctcccggtgtggttgtcgtacaaagtggcctccgaggggttccaatatagcgaccggcgctggtgctttgatggagagcgcaacaaccaggtcctggaggagaacatggacgttgagatctggaccaaggagggggaacggaagaaactccgtccccgctggctggacgcgcggacatacagtgacccgctggctctccgggagttcaaggagttcgctgcagggcggcgaagcgtgagcggcgacctgatcctagagatagggaaactcccgcagcacctgacactgagagcccaaaacgcgctcgacaacttggtcatgttacacaactccgagcaaggcggcaaggcctatagacacgccatggaagaactccctgataccatcgagacactgatgctgttggcattaatcgcggtgctgacaggcggggtgaccctcttctttttgtcaggcaagggcctggggaagacctccataggcctcttatgcgtgactgcgtcatcggccctgctttggatggcgagcgtagaaccccattggatcgccgcctccatcatcctggagttcttcctgatggtgcttctgatccccgagcccgacaggcagaggacccctcaggataaccagctggcctatgtcgtgatcgggctcctgttcatgatccttacggtggccgccaacgagatgggcttgctcgagacgacgaagaaggatctgggtataggctacgtcgccgcggagaaccatcagcacgccaccatgttggacgtggacctgcacccggccagcgcctggaccctgtacgccgtggcgacgacagtgatcacccccatgatgcggcacaccatcgagaacaccacggccaacatctccctcaccgcgatcgcaaaccaggcagccatcctgatgggcttggataaggggtggcccatcagcaaaatggacatcggcgtccccctcctggccctgggttgctactcccaggtgaacccgctgacccttacagcagccgtactgatgctcgtagcgcattacgcaatcatcgggcccgggctgcaggccaaggccacccgcgaggcccagaagcgcaccgcggcgggcatcatgaaaaatcccaccgtcgacggtatcgtcgccatcgacctggaccctgtggtgtacgacgccaagttcgagaagcagttaggacagatcatgctactcatcctctgcaccagtcaaatactgcttatgaggacgacctgggcactctgcgagtccataacccttgctaccggcccgctgacaacgctgtgggagggcagcccaggcaagttttggaacaccacgatcgccgtctccatggccaacattttccgcgggtcttacctcgcaggggccggccttgcgttttccctaatgaagtccctagggggagggagacgcggaacgggtgcccagggcgagaccctgggcgagaagtggaagcgacagctcaaccagctgtccaagagcgagttcaatacctataagagatccggaatcatggaggtggaccggtcggaggccaaggagggcctgaaaagaggggaaaccacaaagcatgcagtgagcagggggaccgcgaagctcaggtggtttgttgagagaaacctggttaagcccgagggcaaggttatcgacttggggtgcggccgtgggggctggtcctactattgcgccggtctgaagaaggttaccgaggtgaagggctacacaaagggcgggccgggccacgaggagccgatccccatggccacgtacggctggaacctcgtgaagctgcactcagggaaggacgtctttttcatgccgcccgagaagtgcgacacgctgctgtgcgacattggagagtctagcccgaacccgactatcgaggaagggaggaccttacgcgtgctcaagatggtcgagccctggctccggggcaaccaattttgtatcaagatactgaacccctacatgccgtccgtcgtggagaccctggagcagatgcaacgcaaacatggcggcatgctcgtccggaaccctctatcccgcaactccacgcacgagatgtactgggtcagctgcgggaccggaaacatcgtgtccgccgtcaacatgacatcccggatgctgctaaaccgattcactatggcccaccgcaagcccacgtacgaacgggatgtagacctgggggcagggacccgccacgtagccgtggaacccgaggttgcgaatcttgacattatcggccaacggattgaaaacatcaagaacgagcataagtccacctggcattacgacgaggacaacccatataaaacctgggcctaccacgggagttacgaggtgaagcccagtgggagcgcctcctcaatggtaaacggcgtggtgcgcctcctgaccaagccctgggacgtcatccccatggtaacacagattgccatgaccgatacgaccccgttcggccaacagcgggtattcaaggaaaaggtcgacacccgcacgccccgggccaagaggggaaccacacaaataatggaggtaaccgccaaatggctctgggggttcttaagtcggaacaagaagccccgcatctgcacccgggaagagttcacccgcaaggtgcgtagcaacgctgctataggcgcagtatttgtagatgagaatcagtggaacagcgccaaggaggctgtagaggacgaacgtttctgggacctggtccaccgggagcgcgaattgcacaaacaggggaagtgcgccacgtgtgtgtacaacatgatgggcaagcgggaaaagaagctcggggagttcggaaaggcaaagggttcccgcgccatctggtatatgtggctgggggctcggttcttagagtttgaggccctgggcttcatgaacgaggatcactggttcagcagagagaactccctgtccggggtagagggcgagggtctgcacaagctcgggtacatcctgcgggatatctccaagataccgggcggaaacatgtatgccgatgacacggcgggctgggacacccggatcaccgaggacgatctgcagaatgaggccaagatcacggacataatggaaccagagcatgccctcctggccaccagcatcttcaaactgacctaccagaacaaggtcgtgcgcgtgcagcggcccgccaaaaacgggactgtcatggacgttatctcccgccgggaccagagagggagcggccaggtggggacgtatggtctcaacaccttcaccaacatggaggtccagctcatcaggcaaatggagtccgaagggatcttcctgccgagcgagctcgagacccccaacctggcggaacgcgcgctggactggctcgagaagcacggcgctgagcgtctgaaacgcatggccatttccggggacgactgcgtggtgaaacccatcgatgatcggttcgctacggccttaaccgccctgaacgacatgggaaaggtccgcaaagacattccgcagtgggagccctcgaagggctggaatgactggcaacaggtacccttctgtagccatcatttccaccagctgatcatgaaggatgggcgggagatcgtcgtcccatgccgcaaccaggacgagttggtgggccgggcgcgcgtgagccagggggcgggatggtctctccgtgagacagcctgcctgggcaagtcttacgcgcagatgtggcaactgatgtatttccaccgccgggacctcaggctggccgctaacgccatttgctccgcggtacccgtggactgggtgcccgccagccgtaccacctggagcatacacgcccaccaccagtggatgacgaccgaggatatgctgtccgtctggaaccgcgtatggatcgaggaaaacccgtggatggaggacaagacccacgtgagctcctgggaagaggttccctacctcggcaagcgcgaagaccaatggtgcggaagcctgatagggctgaccgcccgggctacgtgggcgaccaacatccaggtagccatcaaccaggtgcgtcggctcatcggcaacgagaactacctggactacatgacgtccatgaagcgcttcaaaaacgagagcgaccccgagggtgcactgtggtga

SEQ ID NO: 24663 - RNA, 9879 nt, synthetic construct
  misc_feature 1..9879: note = derived and/or modified CDS sequence (opt11) from DENV-1__KC692496__SS-prME
  source 1..9879: mol_type = other RNA
tcagtgacaatgctgcttatgctgctccccaccgccctcgccttccacctgacgacccgaggcggggagccccacatgatcgtgagcaagcaggagaggggcaagagcctcctgtttaagactagcgcgggggtgaatatgtgcaccctaatcgcaatggacctaggtgaactctgcgaggacaccatgacctacaagtgtccacggatcactgaggcggaacccgatgacgtcgattgctggtgtaatgccaccgacacgtgggtgacctacgggacttgcagccagacgggcgaacaccggcgcgagaagcggagcgtggctctggccccacacgtgggtctggggctcgaaacccgcaccgagacctggatgagcagtgagggggcctggcggcagatccagcgcgtcgagacctgggccctgcgtcaccccgggtttacggttatcgcgttcttcctagcacacgccatcggtacctcaatcacccagaaggggatcatctttatcctccttatgttagtgactccctccatggccatgaggtgcgtcggcatcggcaaccgggacttcgtcgaggggctctcgggcgccacgtgggtggacgtcgtgctcgagcacgggtcctgcgtgaccaccatggccaagaacaagcccaccctggacatcgagcttctgaagacggaggtcaccaacccagcggtcttacgcaagctctgcatcgaggccaagatcagcaacactacaacggactcccgatgcccgacccagggggaggccacccttgtggaggagcaggacgcaaacttcgtctgccgccggacctttgttgatcgcggctgggggaacggctgcggactcttcggaaagggtagcctcttaacgtgcgccaagttcaagtgtgtgaccaagctggagggcaagatcgtacagtacgagaacctcaagtacagtgtgatagtgacagtccacaccggggaccagcaccaggtggggaacgagacgaccgaacacggcaccatcgcgaccatcacgccccaggcgcccacgtcagaaatccagctgacagattacggggcactgaccctcgactgcagcccccggaccggcctggatttcaacgagatggtcctgttgacgatgaaagagaagtcttggctggtacacaagcagtggttcctggacctcccactgccttggacctctggggccagcaccagccaagagacctggaaccgccaagacctgctcgtgacgttcaagaccgcccacgcgaagaagcaggaggtcgttgtgctgggctcccaggagggcgcgatgcacaccgctttaaccggggccacggagatccagacctcggggaccaccacgatattcgccgggcacctcaagtgccggttgaagatggacaagctgaccctcaaaggcatgtcctacgtgatgtgcaccgggagcttcaagctggagaaggaggttgcggagacacagcacgggacggtgctggtccaggtgaagtatgagggcacggacgcgccctgcaagataccctttagcactcaggacgagaagggggtgactcagaacggcaggctaatcacggctaatccgatcgtcaccgacaaggagaagcccgttaacatcgagacggagccgcccttcggcgagtcatacattgtggtcggggccggcgagaaggcgctcaagctgtcctggttcaaacgagggagctccatcggcaagatgttcgaagccactgcgcgcggggcccggcggatggccatcctgggcgacacggcgtgggacttcgggagcatcggcggagtgttcacctccgtaggaaagctcgtccaccaggtgttcgggactgcttacggagtgctgttttcgggcgtgtcctggaccatgaagattgggatcggaatcctgctgacttggctgggcctgaatagccgctccaccagcctatccatgacctgcatcgctgttgggatggtgaccctgtacctgggagtgatggtgcaggctgacagcgggtgcgtgatcaactggaaaggacgggagttgaagtgtggttccggcatctttgtgacgaacgaagtgcacacttggaccgagcagtacaagttccaggccgactcgccgaagcgcctgagcgcggccatcggtaaggcttgggaagagggcgtgtgcggcattcggtccgccacccgcctggagaacatcatgtggaagcaaatctccaacgaactgaaccacatcctgttagagaacgatatgaaattcacggttgtagtaggggacgctaacggcatcctcgcgcaggggaagaagatgatccgaccccagcccatggagcataaatattcatggaaatcctgggggaaggcgaagatcatcggggctgatattcagaacactaccttcatcattgacgggcccgacacaccagagtgtcccgacggccagcgcgcctggaatatctgggaggtcgaggactacgggtttggtgtcttcaccacgaacatatggcttaaactgcgcgacagttacacccagatgtgcgaccaccgtttaatgagcgctgccataaaggactccaaggccgtgcacgccgacatgggctattggatcgaaagcgagaagaacgagacctggaagctggcccgtgcgtcattcatcgaggtcaagacatgcacgtggccaaaaagccacacactgtggagtaacggggtgctcgagtctgagatgatcatacccaagatattcggcgggcctatctcccaacacaactaccgccccggctacttcacccagaccgccgggccctggcacctgggtaagctggaattggacttcgatctgtgcgagggcacgaccgtggtcgtcgatgaacactgcgggaaccgggggccaagcctacgcactaccacggtgactggcaagattatccacgaatggtgctgccggtcctgcaccctgccgcccctgcgcttccgaggcgaggatgggtgctggtatgggatggagatccgcccggttaaagaaaaagaagaaaacttggttcggagcatggtgtccgccggcagcggggaggtcgacagcttctcccttggtatcctgtgcgtctcaataatgatcgaggaggtgatgagatcccgatggagccggaagatgctgatgaccggcacgctcgccgtcttcctgctgctcatcatgggccaactgacctggaatgacctgattcgcctctgcataatggttggagccaacgcgtcggaccgaatgggcatgggcacaacctacttagccctgatggcaacgttcaagatgcgccccatgttcgccgtggggctcctcttccggcgcctgaccagccgggaggtactcctgctcaccatcggcctcagcttagttgccagcgtcgagctgcccaactccctcgaggagctgggggacggcctggcgatgggcataatgatgctcaagctgctgaccgaatttcaaccccaccagctgtggacaaccctgctgagcctgacctttgtaaagacaacgctgtccctggactacgcgtggaagacgaccgccatggtgctcagcattgtctccctgttccccctgtgccttagcaccacatcccagaagaccacctggctgccggtgctgctcgggagcttcgggtgcaagcccttaacaatgttcctcatcaccgagaacaaaatctgggggcgcaagtcctggccccttaatgaggggatcatggccatcgggatcgtgagcatactgctgtccagcttgctgaagaatgacgttcctctggccggccccttgctcgccggcggcatgttgatcgcctgctacgtgatcagcggctcgagcgccgacctttccctcgaaaaagccgccgaggtgagctgggaacaggaggccgagcattccggggcgagccataacatcctggtcgaagtgcaagacgatggcacaatgaagatcaaagatgaggaacgggacgacacgctcactatcctgctgaaggcaaccctcctggccgtgtccggggtctaccccatgagcatcccagcgacgctattcgtgtggtacttctggcagaagaaaaagcagcgttcgggcgtgctctgggacacacccagcccgcccgaagttgagcgggctgtgctggacgacgggatataccgcattttacagcgggggctgctcgggcgctcacaggtcggagtcggcgtgtttcaagacggcgtattccacaccatgtggcacgttacccggggtgccgtgctgatgtaccagggtaagcgtctggaacccagttgggcctctgtgaagaaggacctgatctcctacggaggagggtggcggtttcaggggtcctggaacactggggaagaggtccaggtgatcgccgtggagcccggtaagaacccgaagaacgtgcagaccacccccggcaccttcaagacgcccgagggggaggtgggcgcgatcgccctagactttaaacccgggacgagcggctctcccatcgtgaaccgcgaaggaaagatcgtgggcctttacggcaacggggtggtgaccacatcaggcacgtacgtcagtgccattgcacaggccaaggcgtcgcaggaagggcccctcccagagatcgaggacgaggtgttcaagaagcggaacttgacaatcatggatctacacccgggctcaggcaagacccgccggtacctccctgctatagttcgcgaagccatcaagcggaagctgcggaccctgatattggcccctacccgcgtcgtggcgtccgagatggccgaggctctgaaggggatgcccatccggtaccagacaaccgctgtcaagagcgagcacaccggtcgcgagatcgtcgaccttatgtgccacgccacgttcaccatgcggctgctctcaccggtgagggtgccaaactacaacatgatcataatggacgaggcgcacttcactgaccccgccagcatcgctgccaggggctacatatccacccgcgtcggcatgggagaggccgccgccatcttcatgacggccacccctcctggtagcgtggaggccttcccccagtccaacgctgtgatccaggacgaagaacgggatattcccgagcgcagctggaactccggctatgactggatcaccgactttcccgggaaaaccgtctggttcgtgcccagcattaagtccggcaacgatatcgcgaactgtctgcgcaaaaatgggaagagggtaatccaactcagccgcaagacgttcgacaccgagtaccagaagaccaagaacaacgactgggattatgtcgtgactacggatatttccgagatgggcgctaatttccgggccgaccgggtgattgacccccgccgatgcctgaaacccgtcatcttaaaggacggacccgagagggtgatcctcgcgggcccgatgccggtcaccgtggcgagcgccgcccagaggcgcggccgcatcggccggaaccagaacaaggaaggagaccagtacgtgtacatgggacaaccgctgaacaacgacgaggaccacgcccactggaccgaagccaagatgctgctcgacaacatcaacacccctgagggcatcatccctgcgctgtttgagcccgagcgggagaagtccgcggccatcgacggggagtataggctccgcggcgaggcccggaaaacgttcgtcgagctgatgcgccggggtgacctccccgtgtggctgagctacaaggttgcctccgaggggttccagtactcggacaggcgatggtgctttgatggcgagcgcaataaccaggtcctcgaggagaacatggacgtggagatctggaccaaggagggggagcggaagaagctccgaccccggtggctggatgcgcgcacttactccgacccgctcgcgctacgggagttcaaggagttcgccgccggcaggcgaagcgtgtcaggcgacctgatcctcgaaatcgggaagctgccacagcatttaaccctccgggcccaaaacgcactggacaacctggtcatgctacacaattccgaacaagggggtaaggcttaccgccatgcaatggaagagttgccggacaccatagaaacgctgatgttgctggcccttatcgcagtgctcaccggcggggtgaccctgtttttcctgagcggcaaaggattggggaagacgtccatcggtctcctctgcgtcacggcaagctcagccttactgtggatggcctcggtggagccacactggatagccgcatcaatcatcctggaatttttcctcatggtgctgctgatcccagagcccgacagacagcgtacgccccaggataaccagctcgcatacgtggtgatcggcctactcttcatgatcctcaccgtggccgccaacgagatgggtttactggagactacgaagaaggatctggggatcggctatgtagcagctgaaaaccaccagcatgccacgatgctggacgtcgatctacatccggccagcgcctggacactctacgccgtggcgaccacagtcatcacccccatgatgcgccacaccatcgagaatacaacggccaacatatccttgacggcgatagcaaaccaggccgcgatcctgatgggcctcgacaagggttggcccatctcgaagatggatatcggcgtgcccctgctggccctcgggtgctactcccaagtgaacccacttaccctgaccgccgctgtcctcatgctggtggcgcactacgctatcatcggcccgggtctccaagccaaggccacgcgcgaggcccaaaaacggaccgcggccggcattatgaagaacccgaccgtggacggcatcgttgcgatagatctcgaccccgtagtgtacgacgccaaattcgagaaacagctgggccagatcatgctgctgatcctatgcacaagccagatcctcttaatgcgcacgacctgggccctgtgcgaatccatcactctcgccaccggcccgctaacgaccctgtgggaggggagccccggcaaattctggaacaccactatcgctgtttccatggccaacatcttccggggcagctacctggccggggccggcttagccttcagcctgatgaaatccctcggtggcggtcgccgcgggacgggcgcccagggggaaactctcggagagaagtggaagcgtcagctgaaccagctgtctaagagcgagttcaacacctacaagcgaagcggtattatggaagtcgaccgatccgaggcaaaggaaggcctcaaacgcggggaaaccacgaagcatgccgtgagcagaggtaccgcgaagctacggtggttcgtagagcgcaacctcgtgaagccggaaggcaaggtgatcgatctggggtgcgggcgcgggggctggtcctactactgcgctggacttaagaaggtgacggaggtgaagggctacaccaagggaggacccggccacgaggagcccatccccatggccacctacgggtggaacctggttaagctgcacagcggcaaggacgtcttcttcatgcctcccgaaaagtgtgacacgctcctgtgcgacataggtgaatcaagcccgaaccccaccatcgaagagggacgcaccctgcgagtcctcaagatggtggaaccctggttgcgcggcaatcagttctgcatcaagattctgaacccctacatgccgtccgtcgtggagaccctcgaacagatgcagcggaagcacggagggatgctggtcaggaaccctctgagcagaaattccacgcacgagatgtactgggtcagctgcgggactggcaacatagtgtccgccgtgaacatgaccagccgcatgctactaaacagattcaccatggcccaccggaaaccgacgtacgagcgagacgtcgacctgggcgcggggacacggcacgtggccgtcgagcccgaggtcgccaacctcgacattatcgggcagcgtatcgaaaacatcaagaacgagcacaagtccacatggcattacgatgaggacaacccgtacaaaacctgggcttaccacgggagttatgaggtgaagccctccggcagcgcctccagcatggtcaacggggtggtgcgtcttctgacgaagccctgggacgtgattcccatggtaacacagattgcgatgactgacactaccccgttcgggcagcagcgcgtattcaaggagaaggttgacacccggacgccacgggccaagcggggcaccacgcagatcatggaggttaccgccaagtggctctgggggttcttaagccgaaacaaaaagccccggatatgtacccgcgaggagttcacccggaaggtccgctctaacgccgccatcggcgcggtcttcgtggacgagaaccagtggaactcagccaaggaggctgtggaggatgagcgcttttgggacttagtccacagagaacgggagctccacaagcaggggaagtgtgccacgtgcgtgtataacatgatgggtaaacgcgagaaaaagctaggggagttcggtaaggcgaaaggatcccgggccatctggtacatgtggctgggggccagattcctcgagttcgaggccctgggattcatgaacgaggaccactggttcagccgggagaactcgctgtccggcgttgagggagagggtttacacaaacttggctacatactgcgcgacatctccaagatcccgggtgggaacatgtacgctgacgacacagcgggatgggatacccgcatcacggaggacgacctccagaacgaggccaagatcacggatatcatggagcctgaacacgccctactggccaccagcatcttcaagttaacgtaccagaacaaggtggtgcgggtgcagaggcccgccaagaacgggaccgtcatggacgtgatatcccggcgggaccagcggggttccggccaggtggggacgtacggcctgaacaccttcaccaacatggaggtacagttaatccgccagatggagtccgaggggatctttctcccctccgagctggagaccccgaacctggcggagcgggccctcgactggctggagaaacacggcgccgaacgcctaaagagaatggctatttccggagacgactgcgttgtgaagcccattgacgaccgcttcgccacggcgctgaccgctctgaacgacatggggaaggtgcggaaggacatcccccagtgggagccctccaagggctggaacgattggcagcaggtccctttctgctcccaccactttcaccagttgatcatgaaagacgggcgtgaaatcgtagtcccctgccggaaccaggacgagctcgttggccgcgcccgggtctcgcagggtgccggctggtcactgcgcgagacagcgtgcttaggcaagagctacgctcaaatgtggcagctcatgtacttccatcgtcgggacctgcggttggcagccaatgccatctgttccgcggtccccgtggactgggtgcccgccagccgcaccacctggagcatccacgcgcatcaccagtggatgacgaccgaggacatgctctccgtctggaaccgcgtgtggatcgaggagaacccgtggatggaggacaagacccacgtgagctcctgggaggaggtcccctacctgggcaagcgggaggaccagtggtgcggcagcttgatcgggctcaccgcccgcgccacgtgggcgaccaatatacaggttgcaatcaaccaagttaggaggttaatcggaaacgagaactacctggactacatgacctccatgaagcggttcaagaacgagagcgaccccgaaggcgccctctggtga

SEQ ID NO: 24664 - RNA, 9879 nt, synthetic construct
  misc_feature 1..9879: note = derived and/or modified CDS sequence (opt11) from DENV-1__KC692497__SS-prME
  source 1..9879: mol_type = other RNA
agcgtgacaatgctgctcatgctgctgcccaccgccttagcctttcatcttaccacccgcggcggggagccacacatgatcgtgagcaagcaggagcggggcaaatcgctgttatttaagactagcgccggcgtgaacatgtgcaccctgatcgccatggacctgggcgagctatgcgaggacactatgacttacaaatgcccccgtattacagaggccgaacccgatgacgttgactgttggtgcaacgccacggatacatgggtgacctacgggacctgcagccaaaccggcgagcatcggcgcgagaaacggtccgtggctctggccccacatgtcggcctgggactcgagacccgcaccgagacctggatgagctccgagggcgcctggaaacagatacagcgggttgaaacctgggccctgcgccaccccgggttcacggtgatcgccttattcttggcgcatgccattggcaccagcatcacccagaagggtataatcttcatcttactgatgctcgtgaccccctccatggcgatgcggtgcgtcggcatcggcaatcgcgacttcgtggaagggctcagcggggcaacttgggtggatgtcgtcctggagcacgggtcctgcgttaccacaatggccaagaacaagcctaccctcgatattgaactgctgaaaacggaagtcaccaatcccgcagtgcttaggaagctgtgcatcgaggccaaaatctctaacaccaccactgactcccgctgccctacccaaggggaggccaccctggtggaagagcaagacgccaattttgtctgccggcgcaccttcgtggaccgtggctgggggaatgggtgcggcctcttcggcaagggaagcctgcttacgtgtgccaagttcaaatgcgtgaccaagctcgagggcaagatcgtccagtacgagaacctaaagtactccgtgatcgtaacggtacacaccggcgaccagcaccaagtgggtaacgagaccaccgagcacgggacaatcgcgaccatcacgccccaggcccccacgtcagagatccagttaaccgactatggtgccttaactttagactgctctcccagaaccggcctggatttcaacgagatggtcctcttgacgatgaaagagaagtcctggttagtgcacaagcagtggttcctcgacctgccgttaccgtggacctccggggcctccaccagccaggagacctggaaccggcaagacctcctggtgacgtttaagacggctcatgcgaagaagcaggaagttgtggtgctaggcagtcaggaaggcgccatgcacaccgccttgaccggggccacggaaattcagacctcaggcactacgaccatattcgccgggcatctgaagtgccgcctgaagatggacaagctgaccctgaagggcatgtcttacgtcatgtgcaccggctctttcaagctggaaaaggaggtggcggaaacccagcatggtacggtgctggttcaggtcaaatacgagggcaccgatgccccatgcaagatccccttttctacccaggacgagaagggtgtgacccagaacggccgtctcatcaccgccaaccccatcgtaacggacaaagagaagcccgtgaacatcgagaccgagccgccgttcggggaaagctacattgtggtgggcgccggcgagaaagcgctgaagttatcctggttcaagcgggggagctccataggaaagatgttcgaagcaaccgcccgcggagcccgccgtatggccatcttgggcgacacggcgtgggacttcggttctattggaggggtgtttacatccgtgggcaaattagtgcaccaagtgttcgggaccgcttatggggtgctatttagcggcgtttcgtggactatgaagatcggcatcgggattttgctgacttggctgggactgaacagcaggagcaccagcctgtctatgacctgtatcgcggtggggatggtgacactgtacctcggggtcatggtccaagccgactctggatgcgttatcaactggaagggtcgcgagttaaagtgcggctccggcatcttcgttacgaatgaagtgcatacatggaccgaacagtacaagttccaagcagattcacctaagcggctgtcagcggccatcggcaaagcttgggaggagggggtgtgtggcattcgctccgccacacggctcgagaacatcatgtggaagcagatatcaaatgagctgaaccacatactgcttgaaaacgatatgaaattcactgttgtggtgggggacgccaacggtatcctggcgcaagggaagaagatgatccgcccccaacccatggagcataagtattcctggaagtcctggggcaaggcaaagatcatcggcgccgatatccagaacacaactttcataatagacgggcccgacaccccagagtgcccggacggccagcgcgcctggaacatctgggaggtcgaagactacgggttcggcgtgtttactacgaacatctggctgaagctccgcgactcctacacccagatgtgcgaccatcgtttaatgtcagcggccatcaaggattcgaaggccgtgcacgccgatatgggctactggatcgagtcagagaagaacgagacctggaagctggcccgggcgtcctttatcgaagttaagacctgcacgtggcccaagagccacactctgtggagtaacggggtgctagagtcagaaatgataatacccaagatctttggcgggccgatctcccaacacaattaccggcccgggtacttcacccagaccgcgggcccctggcacctggggaaactcgaactggacttcgacttatgcgagggcacgaccgtggtcgtggacgagcactgcggtaaccgaggcccgtctctccggaccaccaccgtgacggggaagatcatccacgaatggtgttgccgctcctgcacactgccgccactgaggttccgcggggaggacgggtgctggtacggcatggagataaggccggtaaaggagaaggaggagaacctcgtgcgcagcatggtctcggctggaagcggagaggtcgacagcttctccctgggcattctgtgcgtcagcatcatgattgaggaggttatgcggtcccgctggagccgcaagatgctcatgaccgggacgctggcagttttcctgttactaattatgggacagctgacctggaacgacctcataagactatgcattatggtgggggccaatgctagcgaccgcatgggcaccggcaccacgtacttagccctcatggcgaccttcaagatgcgccccatgtttgccgtggggctcctgttccgccgtctcacttcacgagaggtcctgctgctcaccattggcttatcactggtggccagcgtcgaactacccaactccctggaggagctcggagatgggctcgcgatgggcatcatgatgcttaagctactcaccgagttccagccccaccagctctggaccaccctgcttagcctgaccttcgtgaagaccaccctatccctagactacgcatggaaaaccaccgccatggtgctgtcgatcgtatccctgtttccactctgcctaagcacgacatcccagaagaccacgtggctccctgtactcctggggagcttcgggtgcaaacccttaacgatgtttctcataacggagaacaagatctgggggcggaagtcctggcccctgaatgagggcatcatggcaatcgggatcgtgagcatcctcttgagttcattactgaagaacgacgtcccactcgcaggcccgcttatcgcaggcgggatgctgatcgcgtgctacgtcatctctggcagtagcgcagacctatccctggagaaggccgcggaggtgagctgggagcaggaggcagaacactccggggcaagccacaacattctggtagaggtacaggacgacggtacaatgaagattaaggacgaggagcgcgacgacactctcacgatcttactgaaggccacgctcctggcggtgtccggggtctatcccatgtctatacccgcgaccctgttcgtctggtacttctggcagaagaagaagcaacggtccggcgtgctctgggacacccctagcccacccgaggtcgagcgcgctgtgctggacgatggcatatatcggatcctgcagcgcgggctgctcggccggtcgcaggtgggggtaggcgtattccaagatggggtgtttcacaccatgtggcatgtcacgagaggcgccgtgttgatgtaccagggcaaacggctggagccaagttgggcttccgtgaagaaagacctcatctcttatggtggagggtggcgcttccagggctcatggaacacaggggaggaggtacaagtgatcgctgtcgagccaggcaagaacccgaagaacgtacagaccacccccggcacgttcaagacccccgagggtgaggtaggagcgatcgccttagatttcaagcccgggacaagcggctcccctatcgtgaaccgggaaggcaagatcgtcgggctgtacggcaatggagtggtgaccacgagcggcacctatgtgtccgccatcgcccaggccaaggcgagccaggaggggcccctccctgagatcgaggacgaagtgttcaagaagcgcaacctgaccatcatggacctgcacccaggaagcggcaagaccaggcgttacctgccagccatcgtaagagaggcgataaagcggaaattgcgcactctgatcctcgcccccacccgggtcgtggcgtccgagatggcggaggccctcaagggaatgccaatccgctaccagaccaccgccgtcaagagcgagcatacgggacgagagatcgtcgatctgatgtgtcacgccactttcactatgcgtctcctgtccccggttcgcgtacccaactacaacatgatcatcatggacgaggcgcacttcacagaccccgcatctatcgccgcacgcggctacatctccacccgggttggtatgggagaggccgcggccattttcatgacagcaactccgccaggaagcgtcgaggccttcccccagtccaacgcagtgatccaggatgaagagcgcgacatccccgagcggagctggaattccgggtacgactggatcaccgacttccccgggaagacggtctggttcgttccaagcatcaagtccggcaacgacattgcgaactgcctgcgcaagaacgggaaacgagtgatccagcttagccgcaagacctttgacaccgagtaccaaaagaccaagaataatgactgggactacgtcgttactaccgacatcagcgagatgggggctaatttccgtgcagaccgcgtgatagacccccggcgctgcctgaaacccgtcatccttaaggacggtcctgaacgcgttatattggccggccctatgcccgtcaccgttgcgagcgccgcgcaacgccggggccgcatcgggcgcaaccagaacaaggagggtgaccagtacgtttacatggggcagcctctcaacaacgacgaagatcacgcccactggacagaggcgaaaatgttgctcgacaacatcaatacgcccgagggcattatccctgcgctgtttgagcccgagcgggaaaagtcggccgccatcgacggggagtaccgcttgcggggagaggcccgcaagacctttgtcgagctcatgcggcgcggcgacctccccgtgtggctgagttacaaggtagcctccgagggtttccaatatagtgatcggaggtggtgctttgacggcgagcggaacaatcaggttctcgaagagaatatggacgtggagatctggaccaaagaaggagagcgcaagaagctgcggccgcggtggctggacgcgcggacgtactccgacccgctcgcattgcgcgagttcaaggagtttgctgccggtcggcggagcgtaagcggcgacctgatcctcgagatcgggaagctaccccagcacctgacgttacgggcccagaacgcgctagacaacctggtcatgctccacaattccgagcaaggcgggaaggcctaccgccatgccatggaagagttacctgacactatcgagactctgatgctcctggcgttaatagccgtgctcacgggcggggtaacgttattcttcctaagcggcaagggtttaggcaaaacgtccattggattgctgtgcgtcactgccagctccgccctcctgtggatggcaagcgtggagccccactggatcgcagcgtccatcattttggagtttttcctgatggtgctactgatccctgagcccgacaggcagcgcactccgcaagacaaccagctggcctatgtcgtgatagggctgctcttcatgatcctcaccgtggcagccaatgagatgggcctgttggagaccaccaagaaggacttgggtattggctacgttgccgccgagaatcaccagcacgcgaccatgctggacgtcgatctgcacccggcgagcgcctggaccctctacgccgtagccacgaccgtcatcacaccgatgatgagacacaccatcgagaacacgacggccaacatctccttgaccgcaatcgccaaccaagccgctatcctaatggggctcgataaggggtggccgatctcaaagatggacatcggcgtcccgctgctggccttggggtgctactcccaggtgaacccactgaccttaacggctgccgtgctcatgttagtggcgcactacgccatcattgggcccgggctgcaggccaaggctacccgcgaagcacagaagaggactgcggccggcatcatgaagaaccccaccgtggacggcatcgtcgccatcgatcttgatccagtggtgtacgacgccaagttcgagaaacaactggggcagatcatgcttctaatcctttgcactagtcagatcctgttaatgcggaccacttgggccctctgcgaatccatcaccctggccacgggcccgctcactaccttatgggagggtagcccggggaagttctggaacaccacaatagctgtctccatggccaatatcttccgcggcagctacctagccggggcaggactcgcgttctcactaatgaaatccctcgggggagggcggcggggtactggcgcccagggggagaccttaggagaaaaatggaaacggcagctgaaccagctgtccaagtctgagttcaacacctacaaacgctcagggatcatggaggtggaccggtctgaggccaaagagggactgaagcgcggggagacgaccaagcacgccgtgtcgcggggcaccgcaaaactgcgatggttcgtggagcgcaacctggtaaagcccgagggcaaggtcatcgacctggggtgcggccgcgggggatggtcctactactgcgccggactcaaaaaggtcaccgaggtgaagggatacaccaaaggagggcccggccacgaagagccgattcccatggctacgtacggctggaacttagttaagctgcacagcggcaaggatgtcttcttcatgccgcctgaaaagtgcgacaccctcctgtgcgacatcggggagtcatctccgaaccccaccatcgaggagggccggactctgcgcgtgttgaagatggtggagccttggttacgtggcaaccagttctgcatcaaaatcttaaacccctacatgccgagcgtcgtcgaaacgcttgaacagatgcaacgcaagcacggaggcatgctcgtgcgtaacccgctgagtcgtaactcaacccacgagatgtactgggtcagctgcgggacgggcaacatcgtgtccgccgtgaatatgaccagtcggatgctcctgaaccggttcactatggcgcaccgcaaacccacctacgagcgggacgtcgatctcggggcgggtacccggcatgttgccgttgagcccgaagtcgccaacctcgacgtgatcggccagcggatagagaacatcaagaacgagcataaatccacttggcactacgacgaggacaacccgtacaagacatgggcataccacgggagctacgaggtcaagccatcaggcagcgcctcaagcatggtgaacggagtggtacgcctgctgaccaagccctgggacgtgattcccatggtgacccagatcgcgatgacagacacgaccccatttggccagcagagagtctttaaggaaaaggtcgatacgcgtacgccacgggccaagcggggcacgacccagatcatggaggtgaccgctaagtggctctgggggttcctgtccaggaacaagaagccccgcatttgcacacgggaggagtttacccgtaaagttcggagcaacgccgccatcggtgccgtgttcgtggatgagaaccaatggaacagcgcgaaggaggccgtggaggacgaacgcttctgggatctcgtgcaccgggagcgcgagctccacaagcaggggaagtgcgcgacctgtgtgtacaacatgatgggcaagcgcgagaagaaactgggggagttcggcaaggctaaagggtccagagccatatggtacatgtggctgggcgcccggttcctcgagttcgaggccctcggcttcatgaacgaggaccattggttcagccgggagaactccctgtctggggtggaaggtgaggggctacacaagctgggttatatcctgcgggacatcagtaagattcccggcgggaacatgtacgccgatgacacagcggggtgggacacccgcatcacggaggacgacctccagaacgaggccaagatcaccgatatcatggagccggagcacgccctgttagccacgagcattttcaagctcacctaccagaataaggtggttcgcgtccaacggcccgccaaaaacgggacagtcatggatgttatctcccgccgggatcagaggggctcaggccaggtcggcacctacggcctgaacaccttcaccaatatggaggttcaactgatccggcagatggagtccgaggggatcttcctcccctcagagctggagacgccgaacctggcagagcgcgcgctggactggctagaaaaacacggcgcagagcggctgaaacgcatggccatcagtggggatgattgcgtggtcaagcccatcgacgaccggttcgcgaccgctctcaccgcccttaacgatatgggcaaggtgcgcaaagacatccctcagtgggagcccagtaagggctggaatgattggcagcaggttccgttctgctcccaccacttccaccagctgatcatgaaggacgggcgggagatagtcgtgccgtgccgtaaccaggacgaactcgtgggtcgagcacgcgtatcccagggtgccggctggagtctgcgcgaaaccgcctgcctaggcaagagctacgctcagatgtggcagcttatgtacttccaccgccgggacctgcgcctggccgccaacgccatctgttccgcggtgccagtagactgggtccccgccagccggaccacttggtctatccacgcgcaccaccaatggatgactaccgaggacatgctctccgtgtggaatcgcgtgtggattgaggaaaacccgtggatggaggacaagacgcatgtcagctcctgggaagaggtgccttatttgggaaagcgcgaagaccagtggtgcgggagcctgattggcctcacggctcgggctacctgggctaccaacatccaagtggcaatcaaccaggtccgcaggctcatcggcaacgagaactatctggactatatgacctccatgaagaggtttaagaacgagagcgatccagagggagctctgtggtaa

SEQ ID NO: 24665 - RNA, 9879 nt, synthetic construct
  misc_feature 1..9879: note = derived and/or modified CDS sequence (opt11) from DENV-1__KC692498__SS-prME
  source 1..9879: mol_type = other RNA
tctgtgaccatgctgctcatgctgctgcccaccgccctcgccttccacctgactacccgcggcggcgaaccgcacatgatcgtgagcaagcaggagaggggcaagtccctactcttcaagaccagcgcgggtgtgaacatgtgcaccctcatcgccatggacctgggcgagctgtgcgaggacaccatgacctacaagtgtccccgcataaccgaggcggagcctgacgacgtggactgctggtgcaacgccaccgatacctgggtgacctacggaacctgcagccagaccggcgagcatcggcgcgaaaagcggtccgtggccctggctccccacgtgggcctggggcttgagacgcgcaccgaaacttggatgagcagtgagggcgcctggaagcagattcagcgagtcgaaacgtgggctctgcgccaccccgggtttactgtgatcgccctgttcctcgcgcacgccatcggcaccagcatcacacagaaggggatcatcttcatcctgctgatgctcgtgaccccctccatggcaatgcggtgcgtcggcatcggaaaccgcgacttcgttgaggggttgtcgggcgctacgtgggtggacgttgtactggagcacggttcctgcgtgaccacaatggccaagaacaagcccaccctggacattgagctgctaaagacggaggtcaccaaccccgcggtgctccggaagctctgtatagaggccaagatttcaaacaccactactgacagcagatgcccaacccaaggcgaggcaaccctggtggaggagcaggacgccaacttcgtctgcaggaggaccttcgtggaccggggctggggaaacggctgtggcctgtttggtaagggttctctgctgacttgtgccaagttcaagtgcgtcaccaagttggagggcaagatcgttcagtacgagaacttaaagtactcggtaatagtaacagtccacaccggcgaccagcaccaggtggggaacgagactaccgagcatggcaccatcgccaccattactccgcaggcccccacatccgagatccagctgaccgactacggggctctgaccctggactgcagccccagaaccggcctcgacttcaacgagatggtgctgctaacaatgaaggaaaaatcctggctggtgcataagcagtggttcctagacctgccgctgccctggacctccggggccagcacctcacaggagacctggaaccggcaggacctactggtgacgttcaaaacggcccatgcgaagaagcaggaggtcgttgtgttaggctcacaggagggcgcaatgcacacagccctcacaggtgcaaccgagatacagacatcgggcaccacaacaatcttcgccgggcatctcaagtgcagactgaagatggacaagctaaccctaaagggcatgtcctatgtcatgtgcaccgggagctttaagctggagaaggaggttgcggagacacagcacggtacggtgctggttcaggttaagtacgagggcacagacgccccctgtaagatccccttctccacccaagacgagaaaggggtaacccagaacgggaggctcatcaccgcgaacccgatcgtcacggacaaagagaagcccgtgaacattgaaactgaacctcccttcggggagagctacatcgtggtcggcgccggcgagaaggcgcttaagctgtcatggttcaaacgcgggtcgtcgattggcaaaatgttcgaggccaccgcccgtggggctcgcagaatggccatcctcggcgatacagcatgggacttcgggagcatcggcggcgtgttcacatccgtggggaagctggtccaccaggtatttggcactgcgtacggggtactgttctcgggagtcagctggaccatgaagatcgggatcggcatcctcctgacgtggctgggcctcaatagccggtccaccagcctctccatgacctgcattgcagtgggcatggtgaccctgtacctcggcgtgatggtgcaggccgacagcgggtgtgtgatcaactggaagggccgcgaactgaagtgcgggtccggcatcttcgtcacgaacgaggtgcacacctggactgagcagtacaagttccaagccgacagcccgaaaaggctgtccgcggccatcggcaaggcctgggaagagggggtgtgcggcatccgctcggcaacacggctcgaaaacatcatgtggaagcagataagcaacgagctgaaccacatactgctcgagaacgacatgaaattcaccgtcgtggtaggggacgccaacggaatcctagcgcaggggaagaagatgatccgcccgcagcccatggagcacaaatattcctggaagtcctggggcaaggcaaagatcatcggcgccgacatccagaatacgacttttatcatcgacggtcccgacaccccggagtgtcctgacgggcagagggcctggaatatctgggaagtcgaggactacggcttcggcgtgtttaccaccaacatctggctgaagctccgcgactcctacacccagatgtgcgaccatcggctgatgagcgcggccatcaaggacagcaaggccgtgcacgccgacatgggctactggatcgagagcgagaagaacgagacctggaagctggcccgagcgtcctttatcgaggtaaagacctgcacgtggcctaagagccacaccctgtggtccaacggagtcttagagagcgagatgataatccctaaaattttcggcgggccgatttcccagcacaactaccgtccgggctactttacccagaccgccgggccctggcacctgggcaagctcgagctggactttgacctgtgcgagggcacgaccgtcgtcgttgacgagcactgcggtaatcgcggccctagcctccggaccaccacggtgaccggaaagatcatccacgagtggtgttgccgctcctgcaccttaccacccctgcggttccgcggcgaggacgggtgctggtatggcatggagataagacccgtcaaggaaaaggaggagaacctcgtgcgttcgatggtgtccgctggcagcggagaggtagacagcttttccctgggcatcctgtgcgtgtcgatcatgattgaggaggtgatgcgttcccgatggagccgcaagatgcttatgaccgggacactagccgtcttcctgctcctgatcatgggccagctgacatggaatgaccttataagactgtgtattatggtcggggctaatgcctccgaccgcatgggcaccggcaccacatacctcgccctcatggccaccttcaagatgcggcccatgttcgccgtggggcttctgttcaggcggttaaccagccgcgaggtcctgctgctcactattggccttagcctggtggccagcgtcgagttgcctaattccctggaggagttaggagacggcctcgcgatgggcatcatgatgctgaaacttctcacggagttccagccgcaccagctgtggaccaccctcctcagcttaacgttcgtgaagacgacgctgtccctcgactacgcctggaaaaccactgccatggtgctgagtatcgtcagcctgttccccctgtgtctaagcacgacaagtcagaagaccacatggctgcctgtgctcctggggagctttggttgcaaacccctgaccatgttcctcataacggagaacaagatttgggggcggaagtcctggcctctgaacgagggcatcatggccatcggaatcgtatctatactactatcctccctgctgaaaaatgacgtcccgctcgccggcccgttaatcgctggagggatgctgatcgcctgctatgtgatcagcggttccagcgcagacttatcccttgagaaggctgcggaggttagttgggaacaagaggcagagcactccggcgccagccacaacatcctggtcgaggttcaagatgacggcaccatgaagatcaaagacgaggagcgcgacgacactctaaccatcctactgaaggcgacgctcctggcggtgtccggggtctacccaatgagcatccctgcaacactgttcgtgtggtacttttggcagaagaagaaacagcggagtggcgtactctgggacacccccagcccgccagaggtcgagcgcgccgttctggacgacggtatataccggatcctgcagcgcgggctgctcggccggtcccaggtgggggtcggcgtgtttcaggacggcgtgttccacactatgtggcacgtaacgcgcggcgccgtgttaatgtatcagggcaagagactggagccctcgtgggcgtcagtgaaaaaggacctcatcagctatggaggcgggtggcgcttccaaggctcctggaatactggggaggaggttcaggtgatagctgtggagcccggcaagaatccgaagaacgtccagaccacgcccggcacgttcaaaacacccgagggggaggtgggcgcgatcgccctggacttcaagcccgggaccagcggctccccgatcgttaaccgggaaggcaagatagtcgggctgtacggcaacggggtcgttaccacgtcgggcacctacgtctccgctatcgctcaggcaaaggcgtctcaagagggtcccctccccgaaatcgaggacgaggttttcaagaagcgcaacctgaccatcatggatctccacccgggcagcgggaagacacgtcgctatctccccgcaatcgtgcgggaggccatcaagaggaagctccgcacacttatcctcgcgcccacccgggttgtggcgtccgagatggccgaggcgctgaagggtatgcccatccgctaccagactaccgccgtcaagagcgagcacacgggccgggaaatcgtggacctcatgtgccatgcgactttcaccatgcgccttctgtcccctgttcgggtgccgaactacaacatgatcataatggacgaagcacacttcaccgaccctgccagcatcgccgcacgcggatacatctccacccgggtcggcatgggggaggcggcggcgatcttcatgactgccacgccaccgggcagcgtcgaggccttcccacaatctaacgccgtgatccaagatgaggaacgcgacatccccgaacggagctggaactccggctacgactggatcaccgacttcagcggtaagactgtctggttcgtgccatcaatcaagagcgggaacgatatcgcgaactgtctgaggaagaacggtaagcgggtgatccagctctcccgcaagacctttgataccgagtaccagaagaccaagaacaacgactgggactacgtcgtgacgaccgacatcagcgagatgggcgccaacttccgggccgaccgcgtgatcgacccccggcgctgtttaaaacccgttatcctaaaggacggaccagagcgcgtcatattggccggccccatgccggtcaccgtagcgagtgctgcccagcgccggggcagaattgggcgcaatcagaacaaggagggcgaccagtacgtgtacatggggcagcccctgaacaacgacgaggaccacgcccactggaccgaggccaagatgctgcttgacaacatcaacacgcccgagggtatcatcccagcactgttcgagcccgagcgagaaaagtccgccgccatcgatggggaataccgcctgcggggcgaagccaggaagacgtttgtcgagctcatgcggcgtggagacctgccggtctggctatcctacaaggtcgcctcagaggggtttcagtactccgaccgtcgatggtgcttcgatggcgagcggaacaaccaggttctagaggagaatatggacgtggagatctggaccaaggaaggggagcgcaagaaacttagaccccgctggctggatgcccggacctactctgatcccctcgccctgagagagttcaaagagtttgcggccggccggcgctcggtttccggcgacctgattctcgagatcgggaaacttccacagcacctgacactccgggcccagaacgcgcttgacaacctggtcatgctacacaacagtgagcaaggcgggaaggcctaccgccatgcgatggaggaactgcccgacaccatcgagacactgatgctgctggccctcatcgcggtgctcacgggcggcgtgaccttgttcttcctgtccggtaagggcctcggtaagacgagcattgggctcctgtgcgtcaccgcctcaagcgccctcttatggatggcctccgtggagccccattggatcgccgcgagcatcatcctggagttcttcctcatggtgctactcatccccgagccggatcggcagcgcacgcctcaggacaaccagctagcctacgtcgtgatcgggctgctattcatgatcctcacggtggccgccaatgagatgggccttctggagacaaccaaaaaggacctcgggataggctacgtcgctgcggaaaaccaccaacacgccacaatgcttgacgtggacctgcaccctgcctcagcttggacgctctacgccgtcgcgacgaccgtaatcaccccgatgatgcggcatacgatcgagaacacgactgccaacataagccttaccgccatagccaatcaagccgctatcctgatgggcctcgataagggatggcccatctctaagatggacattggagtgccactgttggccctcggatgctacagccaggtgaaccccctgaccctcacggccgcggtcctcatgctggtagcgcactatgccatcatcggcccgggtctgcaagccaaggccacccgcgaggctcagaagcgcaccgctgccggcattatgaagaaccccaccgttgacggcatcgtcgcaatcgatttggaccccgtggtgtatgacgccaagttcgagaagcagctggggcagatcatgttgttaatcttatgcacgtcccagattctcctcatgcggaccacctgggcattatgcgagagcatcacacttgcgacgggccccctcaccacattgtgggagggcagtcccggcaagttctggaataccaccatcgccgtgagcatggccaacatcttccgcggctcttacctggccggggcgggcctcgcgttcagcctgatgaaatccctcgggggcgggcggcgggggaccggcgcccagggcgagacgctcggcgagaagtggaaacgccagctcaaccagctaagtaaatcagaatttaatacctacaagcggtccggtatcatggaggtagaccggtccgaggccaaggagggcctcaagcgtggagagacgaccaagcacgccgtgtccagagggaccgctaaattgcgttggttcgtcgagcggaacctggttaagcccgagggcaaagtgattgacctagggtgcggccgcggaggctggagctactactgcgccgggttaaagaaggttaccgaggtgaaagggtataccaagggcgggcccggccacgaggagccaatcccaatggccacgtacgggtggaacctcgtgaagctgcactccggcaaggacgtctttttcatgcctcccgagaagtgcgatactctcctttgtgatatcggggaaagctcccccaacccgaccatcgaggagggccggacactgcgcgtgctcaagatggttgaaccttggctgcgggggaaccagttctgcattaagattctgaacccctacatgcccagtgtcgtggagacactcgagcagatgcagcgcaagcacgggggcatgctagttcggaacccgctgtcccgcaactcgacgcacgagatgtactgggtgtcctgtggaaccggcaacatcgtgagcgctgttaacatgacctcccggatgctcctgaaccgcttcactatggcccaccgaaaaccaacatacgagcgggacgtcgatctgggtgcggggacccgacacgtggcagtggagcccgaggtcgccaatctcgacgtgatcggccagcggatcgagaacataaagaacgaacacaaatcgacttggcactacgacgaggacaacccctacaagacgtgggcctaccacgggtcctacgaagtcaagcctagcggctccgcctcgtcaatggtgaacggggtggtccgcctgctgaccaagccctgggacgtgatccccatggtgacccagatcgccatgaccgatacgaccccctttggccagcagcgggttttcaaggagaaggtggacacccgtaccccgcgcgccaaaaggggcacgacccaaatcatggaggtgaccgccaagtggctctgggggttcctcagccggaacaagaagccccgcatctgcacccgggaggagttcacgcgcaaggtccgcagcaacgccgccatcggggcggtgttcgtagacgagaaccaatggaactccgctaaggaggctgtcgaagatgagcgtttctgggacctcgtgcaccgggagcgcgagctccacaagcaggggaaatgcgcgacatgcgtgtataacatgatgggcaagcgcgagaagaagttgggggagttcggcaaggcaaagggtagccgcgccatctggtacatgtggctgggggcacggttcctcgagttcgaggccctgggtttcatgaacgaggatcactggttctcccgcgagaacagcctttcaggggtcgagggagaggggctccacaagctaggctacatcctacgggatattagcaaaatacccggcgggaacatgtatgcagacgacaccgcgggctgggacacccggatcacggaggacgacttacaaaacgaggccaagatcaccgatatcatggagccggaacacgctctgctggccacctctatcttcaaactgacgtaccagaacaaggtggtacgcgtccagcggcccgccaaaaacgggacggtgatggacgttatcagcaggcgggaccagcggggctcaggccaggtcgggacctacggcttaaataccttcaccaatatggaggtccagcttatccggcaaatggagagcgagggaatcttccttccctccgagctggagactcccaatttagctgagcgcgccctcgattggttggagaagcacggagccgaacggctaaagcgcatggccatcagcggtgacgactgcgttgtcaagccgatcgacgatcggttcgccacagcactcaccgccctgaatgacatgggcaaggttaggaaggacatccctcagtgggagcccagcaaaggctggaatgactggcagcaggtccccttttgcagccaccacttccaccagttaattatgaaagacgggcgcgagatcgtcgtgccgtgccgcaaccaggacgagctcgtgggtcgggcccgcgtcagtcagggggctggttggtctttacgagagaccgcctgcctggggaagtcatacgcgcagatgtggcaactcatgtatttccaccgccgggacctgcggctggcagccaacgcaatatgcagcgcggtgcccgtggactgggtaccggctagccggaccacgtggtccatccacgcccatcaccaatggatgaccaccgaagacatgctcagcgtgtggaaccgggtctggatcgaggagaacccctggatggaggacaagacccacgtctccagctgggaggaggtgccgtacctgggcaagcgcgaggaccaatggtgcggctccctgatcgggctcacggcccgcgccacctgggctactaacatccaggtggctatcaaccaggttcgccggctgataggcaacgaaaactacctggactacatgactagcatgaagcgcttcaaaaacgagtccgaccccgaaggtgctctctggtga

SEQ ID NO: 24666 - RNA, 9879 nt, synthetic construct
  misc_feature 1..9879: note = derived and/or modified CDS sequence (opt11) from DENV-1__KC692499__SS-prME
  source 1..9879: mol_type = other RNA
agcgtgaccatgcttctgatgctgttgcccaccgccctcgccttccacctgaccacccgcggcggggagccccatatgatagtgagcaagcaggagcggggcaagagcttgctgttcaagaccagcgccggggtcaacatgtgcaccctgatcgccatggatctcggcgagctctgtgaagacaccatgacctacaagtgcccccgtatcaccgaggccgaacccgacgacgttgactgttggtgcaacgccaccgacacctgggtgacctacgggacctgcagccaaactggtgaacaccggcgcgaaaagcggtccgtggccctggcgccccacgtgggcctggggctcgagacgcgcacggagacctggatgagctccgagggcgcctggaaacagattcagagagtggagacctgggccctgcgccatccagggttcaccgtgatagccttcttcctggcacacgccatcggcactagcataacccaaaaggggatcatcttcatcttgcttatgctggtgaccccctccatggccatgcggtgcgtcggcatcggcaatcgcgacttcgtggaggggctcagcggcgccacgtgggttgacgtcgtgctggaacacgggtcctgcgtgaccaccatggccaagaacaagcccactctggacattgagctcctgaagacggaggttacaaaccccgcggtgttacggaagctctgcatcgaggccaagatcagcaacaccaccaccgactcccgctgcccgacccagggcgaggccactctcgtcgaggagcaggacgtcaacttcgtttgccgtcgcacatttgtggaccggggctggggtaacggctgcggtctgtttggcaaggggagcctcctgacgtgcgccaagttcaagtgtgtcaccaagctggagggcaagatcgtacagtacgaaaacctcaagtactccgtgatcgtcaccgtgcacaccggcgaccaacaccaggttgggaacgagacgaccgagcacggcaccatcgccaccatcacgccccaagcgcccacgagcgagatccaactgaccgactacggtgccctgaccctcgactgcagcccccgaaccggtctggacttcaacgagatggtgctcctcaccatgaaggagaagtcctggctagtgcacaagcagtggttcttagacctcccgctgccctggacctccggggccagcaccagccaagagacctggaaccggcaggacctgctcgtgacgttcaagaccgcccacgcaaagaagcaggaggtcgtggtgctcggcagccaggagggcgcgatgcacaccgccctgaccggggcgacggagatccagaccagtggtacaacgacgatcttcgccggtcacctcaagtgccgcctgaagatggacaagctgaccctcaagggcatgtcctacgtgatgtgcaccggctcattcaagctggaaaaggaggtggccgaaacccagcatggcacggtcctggtccaggtgaagtacgagggcaccgacgcgccctgcaagatccccttcagtacacaggacgagaagggggtaacccagaacggccggctgattacggccaaccctattgtgaccgataaggagaagcccgtgaacatcgagaccgagccgccatttggggagagctacatcgtcgtgggcgccggcgagaaggccctcaagctgtcatggttcaagcgggggagctccatcggcaagatgttcgaagcgaccgcccgcggggcgcggcgtatggccatcctgggtgacacggcgtgggacttcggcagcataggcggcgtgttcacctccgtggggaaactcgtgcaccaggtcttcggcaccgcgtacggtgtcctgttcagcggggtgtcctggaccatgaagatcgggatcggcatcctgttgacgtggctgggcctgaacagccggtccacctctctctccatgacctgcatcgccgtggggatggtcaccctctacctgggggtgatggtgcaggccgacagcgggtgcgtcatcaactggaagggacgcgagctcaagtgcggctccggtatattcgtgacgaacgaagtgcacacctggaccgaacagtacaaattccaggcagacagtccgaagcggctgagcgccgccattggcaaggcctgggaggagggggtctgcggcatccgaagcgccacccggctggagaacatcatgtggaagcaaatcagcaacgaactgaaccacattctgctggagaacgacatgaagttcaccgttgtggtcggggacgccaacggaatcctcgcccaggggaagaagatgatccgcccccagcccatggaatacaagtattcctggaagtcctggggcaaggcgaagatcatcggcgccgatatccagaatacgaccttcatcatcgacgggcccgacaccccggagtgtcccgacggccagcgggcctggaacatctgggaggtggaggactacggtttcggcgtgttcaccacgaacatctggctgaaactgcgagactcctatacccagatgtgcgaccaccggctcatgagcgccgcgataaaggactccaaagccgtacacgccgacatgggctactggatcgagagcgagaagaacgagacctggaagctcgcccgcgcctccttcatcgaggtgaagacctgcacctggcccaagagccacaccctgtggtccaacggggtgctcgagagcgagatgatcatccccaagatcttcggcgggccaatctcacagcacaactaccggcccggctacttcacccagaccgcggggccttggcatctgggcaagctggagttagacttcgacctgtgtgagggcacgaccgtcgtggtcgacgagcactgcgggaaccgcggcccgagtctgcggaccaccacggtaaccgggaagataatacacgagtggtgctgccgctcctgcactctgccgccactgcggtttcgcggcgaagacggttgctggtatggcatggagatccggcccgtgaaggagaaggaggagaacctggtgcgcagcatggtctccgccggcagcggggaggtggacagcttctccctcggcatcctgtgcgtgagcatcatgatcgaggaggtaatgcggtcccgctggagccgcaagatgttaatgaccgggacgttagccgtcttcctgctgctcatcatgggccagttgacttggaacgacctgattcgtctctgcatcatggtgggggcgaatgcctccgaccgcatgggcatggggacgacctacctggccctgatggccacgttcaagatgcggccgatgttcgccgtcgggcttctgttccgccgactgaccagccgcgaagtgctcctgctgaccatcggtttatccctggtcgccagcgtggagctgcccaactccctcgaggagttgggagacggcctggccatgggcatcatgatgctcaagctgctgaccgagttccagccccaccagttatggacgaccttgctgagcctcaccttcgtaaaaaccacgctgtccctggactacgcgtggaaaaccaccgccatggtattgagcatcgtgtcgctgttcccactgtgcctcagcacgacgtcccagaagaccacctggctgcctgtgctgctcgggagtttcggctgcaagcccctgactatgttcctgatcaccgagaacaagatctgggggcggaagtcctggccgctcaacgagggcatcatggctatcgggatcgtctctatcctgctgtccagccttctgaagaacgacgtgcccctggccggcccgctcatcgcgggcgggatgctgatcgcctgctatgtgatcagcgggtcctcagcagatctgtcccttgagaaggccgccgaagtctcatgggagcaagaggccgagcacagtggtgccagccacaacatccttgttgaggtgcaggacgacggtacaatgaagatcaaggacgaggagagagatgacaccctgactatactcctgaaggccaccttgctcgctgtctccggtgtgtaccctatgagcatccccgccacgctgttcgtgtggtacttttggcagaagaagaagcagcggtccggcgtcctgtgggacaccccctccccccccgaggtggagcgcgcggtgctggacgacggcatctaccggatcctacaacgcgggttactgggtcggtcccaggtaggggtgggggtgttccaggacggggtcttccacacgatgtggcacgtgaccagaggcgccgtgctcatgtatcagggtaaacgcctggaaccctcgtgggcctccgtcaagaaggacctgataagctacgggggcgggtggcgcttccaaggctcctggaacacgggggaggaggtacaggtgatcgccgttgagcccggcaaaaacccgaagaacgtgcagactacccccggcaccttcaagacgcccgaaggggaggtgggcgcaatcgcgctcgacttcaagcccgggactagcggctccccgatagtcaaccgggagggcaagatcgtggggctatacggcaacggggtggtgaccaccagcggcacgtacgtgtctgcgatagcccaagccaaggccagccaggaggggccgcttcccgagatcgaggacgaggtgttcaagaagcgcaacctcaccatcatggacctgcacccgggctcggggaagacccggcgctacctgcctgcgatcgtcagggaggctatcaagcgcaagctccgcacactgatactggcccccacgcgggtcgtggcctccgagatggcggaggccctcaaggggatgcctatccgctaccagacaaccgccgtcaagagcgagcacacaggacgcgagatcgttgacctgatgtgccacgccacgttcaccatgcgcctcctctccccggtgcgggtccccaactacaacatgatcatcatggacgaggcgcacttcaccgaccccgcaagcatcgccgctcgcgggtacatatccacgcgggtaggcatgggggaggccgcggcgatcttcatgacggccacgccacccggcagcgtggaagcttttccccaaagcaacgccgtcatacaggacgaggagcgcgacatccccgagcggagctggaactccggttacgactggattgcggacttccccgggaagaccgtgtggttcgtgcccagcatcaaatccggcaacgacatcgcgaactgcctccgcaagaacgggaaaagggtcatccaactgagccgcaagaccttcgacacggagtaccagaagaccaagaataacgactgggattacgtggtgaccactgacatctccgagatgggcgccaacttccgggccgatagggtcatcgacccccggcgctgcctcaagcccgtgatcctgaaggatgggcccgagcgggtcatcctggccggcccgatgccagtcacggtggcatccgcagcccagcgccggggccgtatcgggcgcaaccaaaacaaggagggagaccagtacgtctacatgggtcagcctctcaacaacgacgaggaccacgcccactggaccgaggccaaaatgctgctggacaacatcaacacccccgagggcatcatcccggccctcttcgagcccgagagagaaaagtccgccgccattgacggggaataccgcctgcggggcgaggcccgcaagaccttcgtagagctgatgcggcgcggcgacctccccgtgtggctgagctacaaggtcgcctccgaggggttccaatacagcgatcggcgctggtgtttcgacggcgagcggaacaatcaggtgctggaggagaacatggacgtggagatctggactaaggagggggaacgaaagaagctccggccccgctggctggatgcgcggacctactccgacccgctggccctccgcgagttcaaggagttcgccgccggccgacgcagcgtcagcggcgacctgatcctggaaatcgggaaactcccccaacacttaaccctgcgcgcccaaaacgcgctcgataacctggtgatgctgcacaactccgagcaaggcgggaaggcctatcgacatgccatggaggagctccctgacaccatcgaaaccctgatgctgctcgccctgatagcggtgctgacgggcggggtcaccctcttcttcttaagcggcaagggcttggggaagacctcaattgggctcctatgtgtgacagccagctccgccttactctggatggccagcgtggagccccactggatcgccgcgtccatcatcctggagttcttcctgatggtgctcctaatcccggagcccgaccggcagaggacgccccaggataaccaactggcctacgtggtaatcggtttgctgttcatgatcctgactgtcgccgccaacgagatgggcctcctagagaccaccaagaaggatttggggatcggctacgtcgcagccgagaaccaccagcacgccacaatgctcgacgttgacctgcatccggccagcgcctggaccctttatgccgtcgcgaccacagtgatcacgcccatgatgcggcacaccatagaaaacaccaccgccaacatctccctcacggccatcgccaaccaggcggcgatcctgatgggcctggacaaggggtggcccatcagcaagatggacatcggcgtgcccctcctggcactggggtgttactcccaggtcaacccccttaccctgaccgccgccgtgcttatgctcgtggctcactacgcaatcatcggccccgggctgcaggccaaggccacccgcgaggcacagaagcgcactgcagccggcatcatgaagaaccccacagtcgatggcatcgtggccatcgacctggaccccgtggtctacgacgccaaattcgagaagcaactcgggcagataatgctgctgatcctctgcaccagccagatcctgctgatgcggactacgtgggccttatgcgagagcataaccctggctaccggcccactgacgacgctctgggaggggtcccccggcaagttctggaacaccaccatcgccgtgtccatggccaacatcttccgtggaagctacctggccggcgccggcctggcgttctccctgatgaagtccctcgggggcgggcggcgcgggacgggcgcccagggggagacgctgggcgagaagtggaagcggcagctcaaccagctgtccaagagcgagttcaacacgtacaagcgcagcggaatcatggaggtggaccggtccgaggcgaaggagggcctcaagcgcggggagaccaccaagcacgccgtcagccggggcacggcgaagctccgctggttcgtggagcggaacctggtgaagcccgagggcaaggtcatcgacctcggttgcggccgcgggggctggagttactactgtgccgggctgaaaaaggtgaccgaagtgaagggctacaccaagggcgggccgggccacgaggagccaatcccaatggccacttacgggtggaacttagtcaagctgcacagcggcaaggacgtgttcttcatgccgccagagaagtgcgacaccctgctctgcgacatcggggagagtagcccgaaccccacgatcgaagagggccggaccctgcgtgtgctgaaaatggtcgagccctggctccggggcaatcagttctgcatcaagatcctaaacccctacatgccgtccgtggtggagacactggagcagatgcagcgcaaacatggggggatgcttgtccggaacccactgagccgaaactccacccacgagatgtattgggtcagctgcgggacgggcaacatcgtgtccgctgtcaacatgacgagccgcatgctgctcaaccgcttcaccatggcccacaggaagcccacctacgagcgggacgtggacctgggggcagggacgcgccacgtggccgtcgaacccgaggtggcaaacctggacatcatcggccagcggatcgagaacattaaaaacgagcacaagtccacctggcactacgacgaggacaacccgtacaaaacctgggcctaccacggaagctatgaggtcaagccctccggctcagccagcagtatggtgaacggggtggtccgcctcctgaccaagccctgggacgtgatcccgatggtcacgcagatcgcgatgaccgacacgaccccgttcggccagcagcgggtcttcaaggagaaggtggacacgcgcacgccccgcgctaagcgcggcaccacgcagataatggaggtcacagccaagtggctgtggggtttcctctctcggaacaagaagccacgcatctgcacccgggaggagttcacccgtaaggtacggagcaacgccgccatcggcgcggtgttcgtagacgagaaccagtggaacagcgccaaggaagccgtcgaagacgagcgcttctgggacctggtgcatcgggagcgcgagctgcacaaacaggggaaatgcgcgacctgcgtgtacaacatgatgggcaaacgggagaagaagttaggggagtttggcaaggcgaaaggctccagagccatatggtacatgtggctgggcgcccggttcctggaattcgaggccttgggcttcatgaacgaggaccactggttcagtagggagaatagtctgagcggggtcgagggcgaggggctgcacaagctcggctacatcctgcgggacatcagtaagattccgggcgggaacatgtacgcagacgacacagcgggctgggacacccgcatcaccgaggacgacctgcagaacgaggccaaaataacagacatcatggagcccgagcacgcacttctggccacgagcatatttaagctgacctaccagaacaaggtcgtgcgcgtacagcggccggccaagaatgggaccgtcatggacgttatctctcgccgggaccagcgcggcagcggccaggtcgggacctacggcctcaacacgttcaccaacatggaggtacagctcatccggcagatggagtccgaggggatctttctgcccagcgagctcgagaccccgaacctggcggagagagccctggattggctcgagaagcacggcgccgagaggttaaagcgcatggccatctccggagacgactgtgtagtcaagcccatcgacgaccggttcgccaccgccctgaccgccctaaacgacatgggcaaggtgcgcaaggatatcccccagtgggagcccagcaaaggctggaacgactggcagcaggtcccgttctgctcccaccacttccaccaactgatcatgaaagacgggagagagatcgtggttccctgccgcaaccaggacgagttggtgggccgggcccgcgttagtcagggggccggttggtccctccgggagaccgcctgtctgggcaagagctacgcgcagatgtggcagctgatgtacttccaccggcgtgacttacgcctcgccgccaatgccatctgctccgcagtgcctgtggactgggtccccgccagccggaccacctggagcatacacgcccaccaccaatggatgaccacggaagacatgctgtccgtgtggaatcgcgtatggatcgaggaaaacccgtggatggaggacaagacccacgtcagctcctgggaggaagtgccctacctcggcaagcgcgaggaccagtggtgcggcagcctgatcgggctgactgcacgggccacgtgggcgacgaacatccaggtggccatcaaccaggtacgccggctcatcggcaacgagaactacctggactacatgacctcgatgaagcgcttcaagaacgagtcggaccccgagggggccctgtggtga

SEQ ID NO: 24667 - RNA, 9879 nt, synthetic construct
  misc_feature 1..9879: note = derived and/or modified CDS sequence (opt11) from DENV-1__KC692500__SS-prME
  source 1..9879: mol_type = other RNA
agcgtaaccatgctcttaatgctgctgccaaccgcgcttgccttccacttaaccacccgcggcggggaaccacacatgatcgtgagcaagcaagagcggggcaagtcgctcctcttcaagaccagcgcgggggtgaacatgtgtaccctgatagccatggacctgggcgagctctgcgaagacacgatgacatataagtgcccccgcatcaccgaggccgagcccgatgacgtagactgctggtgcaacgccaccgacacctgggtaacctacggcacatgcagccagaccggcgagcaccggcgcgaaaagcggtccgtggccctggcgccccacgtcggcctggggctcgagaccagaaccgaaacctggatgtcaagcgagggtgcctggaagcaaatccagcgggtcgagacctgggccttgcgtcacccggggttcacggtgatcgccttcttcctggcgcacgccatcggtaccagcatcacccagaaggggatcatcttcatcctcttaatgttagtgaccccctccatggccatgcggtgcgtcggcatcggcaatcgcgacttcgtggaggggctgagcggcgcaacgtgggttgacgtggtccttgagcatggttcttgcgtgaccaccatggccaagaacaagcctaccttagacatcgagctcctgaagacagaggtcacaaaccccgcggtgttgcggaagctctgcatcgaggccaagattagcaacaccaccacggactcccgctgcccgacccagggcgaagctaccctagtggaggagcaggacgccaacttcgtctgccggcgcaccttcgtagaccggggatgggggaatggctgcgggcttttcggcaaggggagtctcttaacgtgcgccaagttcaagtgcgtgacaaagctggagggtaagatcgtacagtacgagaacctcaagtattcagttatcgtgaccgtccacaccggcgaccaacaccaggtagggaacgagacgaccgaacacggcacaatcgcaaccatcacgccccaggcccccacaagcgagatacagttaaccgactacggggcgctgaccctcgactgtagtccccgtaccggcctggacttcaacgaaatggtcctgctcactatgaaggggaagtcgtggctggtgcacaagcaatggttcctggacttacctttgccctggacctccggcgcaagcaccagccaggagacatggaatcggcaagacctgctcgtgacgttcaagaccgcccacgcgaagaaacaggaggtcgtagtgctggggtcccaggagggtgcgatgcacaccgccctgacgggcgccacggagatccagactagcgggaccaccacgatatttgccggccacctcaaatgtcgcttgaagatggacaagctgaccctcaaggggatgtcctacgtcatgtgcaccggctctttcaagctggagaaggaggtggcggagacccagcacggcacggtgctggtccaggtgaagtacgaggggactgacgccccctgcaaaatcccgttttccacccaagatgaaaagggggttacccaaaacgggcggctgatcacggcaaaccctatcgttactgataaggagaaacccgtgaacatcgagaccgagccgcctttcggtgaaagctatatcgtggtcggggccggtgaaaaagcgctcaagctgtcctggttcaaacgcggtagctccatcgggaagatgtttgaagccaccgcccggggcgcccgccgcatggccatcctgggggacacggcgtgggacttcggctcaatcggcggggtcttcacctccgtgggcaaacttgtacaccaggtgttcgggaccgcatacggggtgctgttcagcggcgtctcctggaccatgaagattggcataggtatcttactcacctggctgggtctgaacagccggtccactagcctctccatgacctgcatcgccgtgggcatggtgaccctgtacctgggggtgatggtgcaggctgacagcggatgcgtgatcaactggaagggccgcgagctcaagtgcggatccggcatcttcgtcacgaacgaagtgcacacttggaccgagcagtacaaattccaagccgactctccgaagcggctgagcgcggccatagggaaggcctgggaggaaggggtgtgcgggatccgctccgccactcggcttgagaatatcatgtggaagcagatcagcaacgaactcaaccatatcctgcttgagaacgacatgaagttcactgtcgtggtgggcgacgccaacgggatcttagcgcagggcaagaagatgatacgcccccagcccatggagcacaaatactcctggaagtcctggggaaaagccaaaatcatcggggccgacatccagaatacgaccttcataatagacggccccgacacccctgagtgccccgacgggcagcgggcctggaacatctgggaggtcgaggactacggcttcggcgtgttcaccacgaacatctggctgaagctgagagactcctatacccagatgtgcgaccaccggctcatgtccgcggccatcaaggactccaaagcggtccacgccgacatggggtactggatcgagtctgagaagaatgagacctggaagctggcgcgcgcgtccttcatcgaggtcaagacatgcacgtggcccaagagccacaccctgtggtccaacggtgtattagagagcgagatgatcatccccaagatctttgggggcccaatctcccaacacaactaccggcccgggtacttcacccagaccgccggcccctggcacctgggcaagctagagctcgactttgacttatgcgaggggacgactgtggtcgtggatgagcattgcggcaaccgcgggcccagcttacggaccactacggtcaccggaaagatcatccacgagtggtgctgcagatcctgcaccctgccgcccctgcggttccgcggggaggacggttgctggtacggcatggaaatccggcccgtgaaggaaaaggaggagaacctggtccgcagcatggtgtccgccgggagtggcgaggtcgacagcttttccctcgggatcctgtgcgtctcaatcatgatcgaggaggtgatgagatcccgctggagccgcaagatgctaatgaccggcacgctggcagtcttcctgctgctcatcatggggcagctgacctggaacgacctgatccggttgtgcattatggtgggcgccaacgcctccgaccgcatgggcatggggaccacctacctggccctgatggccacgttcaagatgagaccgatgtttgccgtgggactcctgttccgccggcttacctcacgcgaggtcctcctgctgacaatcgggctctccctggtggcctcagtggagctgccaaacagtctcgaggaactgggagacggcctggccatggggatcatgatgctcaagctgctgactgagttccagccacaccagctctggacgaccctgttgagcctaacctttgtgaagacgacgctgtccctggactacgcgtggaaaaccaccgccatggtgctcagcatcgtctccctgttccccctgtgtctcagcaccacgagtcagaagaccacgtggctgccggtcctgcttggcagcttcgggtgcaaacctctgaccatgtttctgatcaccgagaacaagatctggggccgtaagtcctggcccctcaatgaagggatcatggccatcggcatcgtgagcatcctgctgagttccctcctgaagaacgacgtccccctggcgggcccgttaatcgccggtggcatgttgatcgcttgttacgtgatctccggatccagcgccgatttgtcgttggagaaggcggcggaagtgagctgggagcaggaggccgagcactccggcgccagccacaacatcttagtagaggtgcaggacgacgggacgatgaagatcaaagacgaggagcgcgacgacaccctgaccatcttactgaaggccacgctgctcgctgtgagcggcgtctaccccatgagcatccccgcgacgctgtttgtgtggtacttctggcagaagaagaagcagcgctcgggcgtgctgtgggacacacccagccctcccgaggtcgagagagccgtgctcgatgacgggatctaccgcatcctgcagcggggcctgcttgggcggagccaggtgggcgtaggggtgttccaggatggcgtcttccacaccatgtggcatgtcacgcgcggcgccgtgctcatgtaccaggggaagagactggagcccagctgggcttccgtgaagaaggatctgatcagctacggtgggggctggcgcttcaagggatcctggaacacgggcgaggaggtccaggtgatcgcggtggagccaggcaagaacccgaagaacgtccagaccacccccgggaccttcaaaacccccgagggcgaagtgggggcgatagccctcgacttcaaacctgggacttcgggtagcccgatagtgaaccgtgaggggaagatcgtcggcctgtatggtaacggcgttgtgaccaccagcgggacgtacgtcagcgcgatcgcccaggcaaaggcgagtcaggagggtcccttacctgaaatcgaggacgaggtgttcaagaagcgcaacctcacgatcatggacctgcacccgggcagcggaaagacccgtcgctacctgccggcgatcgtgcgggaggccatcaagaggaagctccgcaccctgatcttggctcccacgcgggtcgtggcctccgagatggccgaagcgctcaagggcatgcccatcaggtatcagacgaccgccgtcaagagtgagcacacggggcgggaaatcgtcgacctgatgtgccatgccacgttcaccatgcgcctgctctcccccgtgagggtgcccaactacaacatgatcatcatggatgaggcacacttcaccgaccccgcaagcatagcggcccgcggctacatctccacccgggtcgggatgggcgaagccgcggccatctttatgacggccacgcctcccggcagcgtggaggccttcccccagtccaacgccgttatccaagacgaggagcgcgacatccccgagcgcagctggaactccgggtatgactggatcaccgatttccccggcaaaaccgtctggttcgtgcccagcatcaagtctgggaacgatatagcgaactgtctgcgtaagaacggcaaacgggtgatccagttatcgagaaagacgttcgacaccgagtaccagaagaccaagaacaacgactgggattacgtcgtgaccacggatatctccgagatgggagcgaacttccgagcggaccgcgtcatcgacccccggagatgtctcaaacccgttatcctgaaggacggccccgagcgggtgattctggccggcccgatgcctgtcacagtggcgagcgccgcccagcgcagagggcgcatcggccgcaaccagaacaaggaaggggaccagtacgtgtacatgggccagcccctcaataacgatgaggatcatgcgcattggaccgaggccaagatgttactagacaacattaacacccccgaggggatcattccggctctcttcgagcccgagcgggagaaatccgccgccatcgatggcgagtaccgcctgcggggcgaggcccgcaagacgttcgtagaactgatgcggagaggggacctcccagtgtggctgagctacaaggtggcatccgagggcttccagtatagcgaccggcgctggtgcttcgacggggagagaaataaccaggtgcttgaggagaacatggatgtggaaatctggaccaaggagggcgagcgcaagaagctccgcccccgctggctggatgcgcgtacctactcagacccactggccctccgcgagttcaaagagttcgctgccgggcggagaagcgtcagcggggacctgatcctggagataggcaagctcccccagcacctgacactgcgggcccagaacgcgttggacaacctggtcatgctgcataactccgaacagggcgggaaggcttaccgccatgccatggaggaactccccgacaccatcgagaccctgatgctgctcgctctgatcgccgtgctgacagggggcgtgaccctctttttcctgagcggcaagggattgggtaagacctccatcgggctcttatgcgtcacggcaagctccgccttactctggatggccagcgtggagccccactggatcgccgcgtccatcatcttggagttcttcctgatggtgctcctgatcccggagcccgaccggcagaggacgcctcaagacaaccagctggcctacgtcgtgatcggccttctgttcatgatcttaacagtggcggctaacgagatggggctactggagaccacgaagaaggatctgggcattggatacgtggccgcggagaaccaccagcacgccacaatgctcgacgtggacctgcacccggccagcgcatggaccctgtacgccgtggcgaccacggtcataacccccatgatgcggcacaccatcgagaacaccacggccaacatctccctcaccgccatcgctaaccaggcagcgatcctgatggggctggacaagggctggcccatctctaagatggacatcggggtgcccttgcttgcgctgggctgctactcacaggtgaacccgctcactctaaccgcagccgtcctgatgctggtcgcgcactacgccatcataggacccggccttcaggccaaggccacgcgcgaggcacagaagagaaccgcggccgggataatgaagaaccccaccgtggacggaatcgtagccatcgacctggaccctgtggtgtacgacgcgaagtttgagaagcaactcgggcagatcatgctactaatcctatgcaccagccagatcctgctgatgaggacgacttgggccctctgtgaatccatcaccctagccaccgggccactgacgaccctctgggagggctcccccggcaagttctggaacaccaccatagccgtctccatggccaacatattccgcgggtcgtacctggccggcgccgggctagcgttctccctcatgaaatccctgggcggcggccggcgcggtaccggggcccagggcgagaccttaggggagaaatggaagagacagctcaatcagctgtccaagagcgagttcaacacctacaagcgcagcggcatcatggaggtcgaccggtccgaagcaaaggaggggctgaagcgcggcgagacgacgaagcacgccgtgagtcggggcacagccaaactgcgttggttcgtcgagcggaacttggtaaaacccgaagggaaggtgatcgacctaggctgcgggcgtggagggtggtcctactactgcgccgggctgaagaaggtcaccgaggttaagggctacaccaagggcgggcccgggcacgaggagccgatccctatggcaacctacggctggaacctcgtgaagctgcacagcgggaaggatgtcttctttatgccgccagagaagtgcgacacgctgctctgtgacatcggcgaatcgagcccgaatcccaccatcgaggagggacggaccttacgtgtgctaaagatggtggagccctggttaagagggaaccagttctgcatcaagatcctgaatccctacatgccgtccgtcgtcgagaccctggagcagatgcaacgcaagcacggcgggatgctcgtgcggaacccactgagccgtaactccacgcacgagatgtactgggtctcgtgcggcaccggcaacatcgtgtccgccgtgaacatgaccagccggatgctactcaaccggttcaccatggcacaccgtaagcccacgtacgaacgggacgtcgacctgggggctggcacccgtcacgtagcagtggagcccgaggttgcgaacctggatatcatcgggcaacggatcgagaatatcaaaaatgagcacaaatccacgtggcactacgacgaggacaacccatacaagacctgggcctaccacggctcgtacgaggtaaagccctccgggagcgcctcctctatggtcaacggcgtggtgcgcctcctgacgaaaccctgggacgtcatccccatggtgacccaaatcgcgatgaccgacaccacgcctttcggccagcagcgggtgttcaaggagaaagtcgacacccgcacgccccgggccaagcgggggactacgcagatcatggaagtgaccgccaagtggctgtgggggttcttgtcccggaacaaaaagccccgcatctgcactagggaggaatttacgcgcaaggtgcgcagcaacgcggccatcggtgcggtctttgtggacgagaatcagtggaactccgcgaaggaggccgtggaggacgagcgcttttgggacttagtccaccgggagagagaactacataagcagggcaagtgcgccacgtgtgtgtacaacatgatggggaagcgggaaaagaagctcggcgagttcggcaaggcgaaagggagtcgcgccatatggtacatgtggctgggggcccgtttcctcgagtttgaggccctagggttcatgaacgaagaccattggtttagtcgagaaaattccctgagcggcgtggaaggggaaggcctgcataagttaggctacatcctgagggacatctccaagatccccggtgggaacatgtacgccgacgataccgcggggtgggacacccgcatcaccgaggatgacctacaaaacgaggccaagataacggacatcatggagccggagcacgccctgctggccaccagcatcttcaagctcacctaccagaacaaggtcgtgagagtgcaacggcccgcgaagaatgggactgtaatggacgtgatctcccgccgggaccagcgcggctcaggccaggtgggcacctacggactcaacaccttcaccaatatggaggtccagttaatacggcagatggaatccgagggcatatttctccctagcgagctcgagacgcctaacttagcggagcgcgcgctggactggctcgagaagcatggggccgagcgcctaaagcgcatggccatctccggcgacgattgcgtggtcaagccaatcgacgaccgcttcgccacggcgctgacagccctcaacgacatgggcaaggttcggaaggacatcccccagtgggagccctcaaagggatggaatgattggcagcaagtcccgttctgcagtcaccacttccaccaactcatcatgaaggacggccgagagatcgtggtgccctgccgcaaccaggacgagctggtggggcgtgcgagagtgagccagggcgccgggtggtcgctgagagagaccgcctgcctgggcaagtcctacgcgcagatgtggcagctgatgtattttcatcgcagggacctccggctggccgccaacgcgatctgctccgcagtccccgtggactgggtacccgcaagcagaacaacttggtctattcacgcgcaccaccagtggatgacgacggaggacatgctgtccgtctggaaccgcgtgtggatcgaggaaaacccctggatggaggataagacccacgtttcttcctgggaggaggttccctacctcggcaaacgcgaggaccagtggtgtggcagcctgatcggcctgaccgcccgggctacatgggcgaccaacatccaggtcgcgattaaccaggtgcgccggctcatcgggaacgaaaactacctggactacatgacctccatgaagcgcttcaaaaacgagtcagaccccgaaggcgccctatggtaa

SEQ ID NO: 24668 - RNA, 9879 nt, synthetic construct
  misc_feature 1..9879: note = derived and/or modified CDS sequence (opt11) from DENV-1__KC692501__SS-prME
  source 1..9879: mol_type = other RNA
agcgtgactatgctgctcatgctgctgcccaccgccctcgcgttccacctaactacacggggcggggaaccacacatgatcgtttccaaacaagagcggggcaagagcttactcttcaagaccagcgcgggggtgaatatgtgtaccctgatcgccatggacctgggcgagctttgcgaggataccatgacctacaagtgtcctcgaataactgaagcggagcccgacgacgtggactgctggtgtaacgcaacagacacttgggtgacctatgggacctgcagccagaccggcgagcatcggcgcgagaagcggtccgtggcgctggcgccacacgtgggcctggggctggagacccgcaccgagacctggatgagctcagaaggcgcatggaagcagattcagcgtgtcgagacctgggccctacgccaccccggttttacggtgatcgccttctttctggctcatgccattggcacaagcatcacccagaagggaatcatcttcatcctcctgatgctcgtgactccgtccatggccatgcggtgcgtaggaattggaaaccgcgatttcgtggaagggctcagcggcgccacctgggtggacgtagtgctggagcacgggtcctgcgtcaccaccatggccaagaataagcccaccctggacatcgagctcctgaagacggaagtcaccaaccccgcggttctgcgtaagctatgcatcgaggctaagatttcaaacaccaccacggactcccggtgcccgacgcaaggcgaagccaccctggtggaagagcaggacgccaacttcgtctgtcggagaacctttgtggaccgggggtggggtaacggctgtgggctgttcggaaagggatcgctcctgacgtgcgctaaatttaagtgtgttacaaagttagaaggaaagatcgtccaatacgaaaacctcaagtactccgttattgttaccgtccacaccggcgaccagcaccaggtggggaacgagacgaccgagcacggtaccattgcgactattacgcctcaggcccccacgagcgagattcaactgaccgattacggggctctgacactcgactgctcaccccgcaccgggctggacttcaacgagatggtcctgctcacgatgaaggagaaatcctggttagtgcacaagcagtggttccttgatctcccacttccctggacatccggggcctccaccagccaggagacgtggaacaggcaggacctgttggtgacgttcaagaccgcacacgcgaaaaagcaggaggtcgtagttctgggctcgcaggaaggggccatgcacaccgccctcaccggggcaacggagatccagacaagcggtaccaccacaatcttcgccgggcatctcaaatgccgtctgaagatggacaagttgacattgaagggcatgtcctacgttatgtgtactgggagcttcaagctcgagaaggaagtcgctgagacccaacacggcacggtgctagtccaggtaaagtatgagggcaccgacgccccatgcaagattcctttctcaacccaagacgagaagggggtgacccagaacgggcgtctgatcactgcaaatcctattgtcactgacaaagagaagcccgttaacattgagaccgagcctcccttcggtgagagctacatcgtcgtcggagccggtgagaaagcgctcaagctgtcgtggtttaagcgcgggagcagtattggcaagatgttcgaagcaaccgcgagaggagcacggcgcatggctatcctgggggacacggcgtgggactttgggagcatcggcggcgtgtttacctcggtggggaagctcgtccaccaggtcttcggcaccgcctatggcgtgctgttcagtggagtctcatggaccatgaagattgggataggcattctgctcacgtggctgggcttgaatagccggtccaccagcctgagtatgacctgtatcgcagtggggatggttactctctacctgggcgtgatggtgcaggccgattccgggtgtgtgatcaactggaagggtcgagagctcaaatgtggatccggcatcttcgtcacgaacgaggttcacacctggaccgagcaatacaagttccaggcagacagcccgaagcggttgagcgcggcgatcggcaaggcctgggaagagggggtgtgcggtatccgatccgccaccagactagagaacatcatgtggaagcagatcagcaatgaactaaaccacatactgctggagaacgatatgaagttcacggtcgtggtgggggacgccaatggcattctcgcgcagggaaaaaagatgatccgcccccagcctatggagcacaagtactcctggaagtcttggggcaaggctaagatcatcggcgccgatatccagaataccaccttcataatcgacgggccggacaccccggagtgccccgacggtcagcgtgcatggaacatctgggaggtcgaggactatgggttcggggtgttcaccacgaacatctggctcaagctgagagactcctacacgcagatgtgcgaccatcgtttgatgagcgcggccattaaggactccaaggcagtccacgccgatatgggctactggatcgagagcgagaagaatgagacctggaagctggcccgcgcctccttcatagaggtcaagacatgcacgtggcccaagagccacaccctctggtccaatggtgtcctcgagagcgagatgatcatccccaagatcttcggaggcccgataagtcaacataactaccggcccggctacttcacacagaccgccggtccctggcacctgggcaagctggagctcgacttcgacctgtgcgagggcaccaccgtggtcgtcgacgagcactgcgggaacaggggcccgtctctgcgcacgacgacggtgacagggaagatcatccacgagtggtgctgccgctcgtgtactctgccgccgctgcggttccgcggcgaggacgggtgttggtacggcatggagatacggccggtcaaggaaaaggaggagaatctcgtgcgcagcatggtgtccgccggctcaggggaggtagacagtttctccctaggaattctatgcgtgagcatcatgatcgaggaggtcatgcgatcccgctggagccgtaaaatgctgatgactggaacactcgctgtcttcctgctgcttatcatgggccagctaacctggaacgacctgatccggctctgcatcatggtgggggcgaacgcctcagacaggatgggcatgggcactacctacctggccctgatggccacgttcaaaatgcggccgatgttcgccgtcgggttattattccgccggctgaccagccgcgaggtactcctgcttactatcggcctctccctggtggcgtctgtcgagctgcccaactcactcgaggaactaggggatggtttggctatgggcatcatgatgctcaagctgctcaccgaatttcagccccaccagctctggacgacgctgctgtccctcacctttgtgaagacgacgctgtccttggattacgcgtggaagaccaccgccatggtcctcagcatcgtgtcccttttcccactgtgcctcagtaccacatcccagaagacaacctggctgccggttctgctcgggtcgttcggttgtaaacccctgacgatgtttctaatcaccgagaacaaaatttgggggagaaagtcttggccgctcaatgaaggcattatggcgatcgggatcgtgtcaatcctgctctccagcttactgaagaacgacgtcccccttgcgggcccgcttatagcaggcggtatgctgattgcctgctatgtgataagcggctcaagcgccgacctgtccctcgaaaaggcagcggaagtaagctgggaacaggaggccgaacactccggggccagccacaatatcctggtcgaagtgcaggacgacgggacgatgaaaatcaaggacgaggagcgcgatgatacacttaccatcctacttaaggccaccttactcgcggtgagtggcgtgtaccccatgagtatacccgcgacgctgttcgtctggtatttctggcaaaagaagaagcagcggtccggcgtgttatgggacactccaagcccccccgaggtcgagcgcgcggtgctcgatgacggcatataccgtatcctccagcgcggtctgctaggcaggtcccaggtgggggtcggtgtgtttcaagacggggtgttccacacgatgtggcacgtaacccgcggcgctgtgctcatgtaccagggaaaaaggctggagcccagctgggcctccgtgaagaaagatctgatctcgtacgggggcgggtggcgcttccagggctcctggaatacgggggaggaggtacaggtaatcgccgtagaacccggcaagaacccgaagaatgtccaaaccaccccgggcaccttcaagacccccgagggagaggtgggcgcgatcgccctagactttaaacccgggacctctggctcacctattgttaaccgggaggagaaaatcgtcggcctgtatggtaacggggtggttaccaccagcgggacgtatgtatccgcgatcgctcaggccaaggcgagccaagagggtccccttcccgagatcgaggatgaggtgttcaagaaacgaaatctcaccatcatggacctccacccggggagcgggaagacgcggcgctacctgcccgctatcgtgcgggaggccatcaagcgtaaactccgcactttgatactggcccccacgcgggtcgtggcgagcgagatggccgaggcgctcaaaggcatgccgatcagataccagaccaccgcggtaaagagcgagcataccggacgggagatcgtcgacctgatgtgccacgcaacgttcaccatgcgactgctctccccggtgcgcgtgccgaactataatatgataattatggatgaggcgcacttcaccgaccccgccagtatcgcagcccgcggctacatatccacgcgtgtcggcatgggtgaggccgccgccatattcatgacagccacgccacccggcagcgtagaggcctttccccagtccaacgccgtgatccaagacgaggagcgcgacatcccggagcggtcctggaactccggctacgactggattaccgacttccccgggaaaacggtctggttcgtcccgagcatcaagtcagggaacgacatcgcgaattgcctacgcaagaacggcaagcgggtgattcaactgagccgaaagacgttcgacaccgagtaccagaagacgaagaataacgactgggactatgtcgtgaccacggacatcagcgagatgggtgccaactttcgggccgatcgcgtgattgacccgaggcgctgtctcaaaccggtcatcctgaaggacggcccagagcgggtgatactggccggaccgatgccggtaacggtggcttcggccgcccaacgtcgtggcaggattgggcgcaaccaaaacaaggagggtgaccagtatgtgtacatgggacagcccctcaacaatgacgaagaccatgcacactggacggaggcgaagatgctactggacaacatcaacacaccagagggcatcattcctgcgctctttgagcccgaacgggaaaagtctgcagcaatcgacggcgagtatcgcctgcgcggagaggccagaaagacattcgtcgagctgatgcgtcgcggggacctacccgtgtggctgagctacaaggtggcctccgagggcttccaatacagtgaccggcgctggtgctttgatggggagcggaacaaccaagtcctagaagagaacatggatgtggagatctggacgaaggagggcgagcgcaagaagctccggccacgctggctcgacgcgcggacctactctgaccctctggccctcagagagttcaaggaattcgccgccgggcggcgcagcgtatctggcgatctgatcttagagattggcaagctaccccagcacctaaccctgcgggcccagaacgcgttagacaacttagttatgttgcacaactccgagcaaggaggcaaggcctaccgccatgccatggaggaactccccgacacgatcgagaccctgatgcttctcgccttaattgcggtgctgacagggggcgtgaccctcttcttcctgagcggtaaggggctggggaaaacctccatcggtctgttatgcgtcacggcttcgtccgccctcctgtggatggccagtgtggaaccccactggatcgccgcgtccatcatcctggagttcttccttatggtgctcctgatcccggagcccgaccgacagcgcacgcctcaggacaaccaactggcctacgtcgtaattggcctacttttcatgattttgacagtggccgctaacgaaatgggactcctggagacgacaaagaaggacttgggcataggctacgtagccgcagaaaaccaccagcatgcaactatgctcgacgtggacttgcaccccgccagcgcctggaccctctacgccgtggcgaccacggtcatcacgcccatgatgagacacaccatcgagaatacgacggccaacataagcctcaccgccatcgcgaaccaagccgccattctgatgggactggataagggctggcccatcagcaaaatggacatcggagtgcccttgctagcgctgggatgctactctcaagtgaacccgttaacactgaccgccgcagtcttaatgctcgtggcgcattacgcaattatcgggcccggcctgcaagcgaaggcaacgcgcgaagctcagaagcgcaccgcggctgggatcatgaagaatcccaccgtcgacggcatagtcgccattgacctggacccagtggtgtacgacgccaagttcgaaaagcaactcggacagatcatgctgttgatcctctgcaccagccaaatcttactgatgcggacgacctgggctttgtgcgagagcatcacgctggcaaccgggccgctgacgaccctttgggaaggcagtcccgggaagttctggaacaccaccatcgccgtctccatggccaacatcttcaggggcagctacctggcgggcgccgggcttgcattctccctcatgaagtccttaggcgggggccgccggggtacgggcgcacagggtgaaaccctcggggaaaagtggaagaggcaactaaaccaactgagcaaaagcgaattcaacacctacaagcgcagcggcatcatggaagtggacagaagcgaggctaaagaggggcttaaacggggggagacaacaaagcacgccgtgtcacggggtaccgctaagttgcggtggttcgtcgagcggaacttagtgaagcccgaaggtaaggtgattgacctgggctgcggtcggggcggttggagctattactgcgcagggttaaagaaagtcaccgaggtgaagggatacacaaagggcggtcccgggcacgaggagccgatcccaatggcaacgtatggctggaacctcgtgaagttgcacagcggcaaggacgtgttcttcatgccgcccgagaagtgcgatacactcctctgcgacattggcgagtccagccccaacccgaccatcgaggagggccgaaccctgcgcgtgctgaagatggtggagccctggctacggggcaaccagttttgcatcaagatcttgaacccttacatgccgtccgtcgtggagaccctggagcaaatgcaacgaaaacatggcgggatgttggtgcggaatcctctgtcgcgcaactccactcacgagatgtactgggtaagctgtggcaccggaaacatcgtgtccgccgtgaatatgacctcgagaatgttgctcaaccgcttcaccatggcccacagaaagcccacgtacgagagggacgtcgatctcggggcgggcaccagacacgtggccgtggagcctgaggtggccaacctggacattattgggcagcgaattgagaacataaaaaatgagcacaaatccacctggcactacgacgaggacaacccgtacaaaacctgggcgtaccacggcagctacgaagtgaaacccagtggtagcgcctccagtatggtgaacggcgttgtgcgcttgctgacgaagccctgggacgtcattcctatggtgacccagattgcgatgaccgacaccacgccgtttggccagcagcgggtgttcaaagagaaggtggacaccagaacgcccagagccaagcgcggcaccactcagatcatggaagtgaccgcgaagtggttatgggggttcctgtcccggaacaaaaagccccgtatctgcactcgggaggagtttacccgcaaggtacggagcaacgctgccatcggggctgtgttcgtggacgagaaccagtggaacagcgccaaggaggccgtggaggacgaacgcttctgggatctcgtccaccgggagagagagttacataagcagggcaagtgcgccacgtgcgtgtacaacatgatgggtaagcgggagaagaagctcggcgagttcgggaaagcgaaaggcagtcgcgcaatctggtacatgtggctgggcgcccggttcctggagttcgaggcactcgggttcatgaacgaggaccactggttcagccgcgagaatagcctgagcggcgttgaaggggaggggctgcataagctcgggtatatcctgcgggacatatccaagattccgggcggcaatatgtacgcagacgacacggcggggtgggacactcgcataacggaggacgatttacagaatgaagccaagattacggacatcatggagccagagcacgcgctgcttgcgacgagcatctttaagctgacctaccaaaacaaagtcgtgcgcgtacagcggccggccaaaaacggcaccgtcatggacgtaatctcccggcgcgatcagagggggagcggtcaggtgggcacgtacgggctcaataccttcaccaacatggaagttcagctgatccggcagatggagtccgagggcatcttcctcccctctgagctcgagaccccgaacctggcggagcgtgcccttgactggctcgagaagcacggggccgagcggctaaagcgcatggccatctccggcgacgactgcgtggttaagccaatcgatgaccggttcgctaccgccctgaccgccctcaacgacatggggaaggttcgcaaggatatcccgcagtgggagccctcaaaaggatggaatgactggcagcaagtcccgttctgctcccaccacttccaccagctgataatgaaggacggccgggaaatcgtggtcccctgccgcaaccaggacgaactggtggggcgggcccgcgtgtcacagggagccgggtggtcactccgggagacagcctgcctgggcaagagctacgcgcagatgtggcagctgatgtacttccaccgccgtgaccttcgcctggctgccaatgccatctgcagtgcggtccccgtggactgggtacccgccagccggaccacctggagcatccacgcccatcatcaatggatgacgaccgaggatatgctttcagtctggaaccgggtatggatagaggaaaatccctggatggaggacaagacccacgtgagctcatgggaggaggtcccctacctcgggaagcgcgaggaccagtggtgtggcagcttgatcggtctgacggcccgggctacgtgggcaaccaacatccaagtggccatcaaccaagtgcgccggctcatcggtaacgagaactacctggactacatgacctccatgaagcgcttcaagaatgagtccgatcccgagggcgccctgtggtga

SEQ ID NO: 24669 - RNA, 9879 nt, synthetic construct
  misc_feature 1..9879: note = derived and/or modified CDS sequence (opt11) from DENV-1__KC692502__SS-prME
  source 1..9879: mol_type = other RNA
agcgtgacgatgctactcatgctgctccccactgcacttgcgtttcacctcactacccgcggtggcgaaccccacatgattgtgtccaaacaggaacggggcaagagcctcctgttcaagactagcgcgggggtgaatatgtgtaccttgatcgctatggacctgggcgaactctgcgaagacacgatgacatacaaatgcccccggattaccgaagccgagccagacgatgtggattgttggtgtaacgcgaccgatacctgggttacctacgggacctgcagccagacgggcgagcaccggcgtgagaaacgatccgttgccctggcaccgcacgtgggtttagggctcgaaacccgaacagagacctggatgagcagcgagggggcctggaagcagatccagcgagtggagacttgggccctgcgccacccggggttcacggtgatcgcattcttcctggcgcacgccatcgggaccagcattacccagaaggggatcatcttcatactcctgatgctggttaccccctccatggctatgcgctgcgtcggcatcggaaatcgcgacttcgtggaaggtctatccggcgccacctgggtggacgtggtcttggagcacgggtcatgcgtcaccaccatggccaagaacaagccaactctggacatcgaactcctaaaaaccgaggtcacaaatcccgcggtgctacgaaaactctgcatcgaagccaagatctccaatactaccacggactctaggtgccctacccagggcgaggccaccctagtcgaggaacaagacgctaatttcgtgtgtcggcgcacctttgtcgaccggggctgggggaacggttgcgggcttttcgggaaggggagccttttgacatgcgccaaattcaagtgtgtgaccaagctggaaggcaagatcgtccagtacgagaatctcaaatactcggttatcgtgactgtgcataccggcgaccaacaccaggtgggaaacgagacgaccgaacacggcaccatcgccactattacgcctcaggcacccactagcgaaatacagcttaccgactatggcgccctgaccctcgactgctcgccacgtaccggtcttgactttaacgagatggtcctactcacgatgaaggagaagtcctggctggtacataaacagtggtttctcgacctcccgctgccctggacctcaggtgcgagcacaagccaagagacctggaaccggcaagacctcttagtgacgttcaagactgcgcatgcgaagaaacaggaggtcgtggtacttggctctcaggagggcgccatgcacactgccctgaccggggcgaccgagatccaaaccagcggtacaaccactatcttcgccggccatctcaagtgtcgcctgaagatggacaagctgaccttgaagggcgtatcctatgtgatgtgcaccgggagcttcaagttagagaaggaagtagcggagacccagcacggcacagtccttgtccaggtgaaatacgaaggcacagatgctccctgtaagatccccttctccacacaggacgagaagggggttactcagaacggccgcctgatcacagccaacccaatcgtgaccgacaaggaaaagccagtgaacatcgagaccgagccaccgtttggggagtcatacatagtcgtcggcgcgggcgagaaggcgctcaaactatcctggttcaagcgagggagttccatcggcaaaatgttcgaggccactgcacgtggggcgcgaaggatggccatcctgggcgacacggcatgggactttggaagcatcggaggggtgttcacctccgtcgggaagctagtgcaccaggtgttcggcaccgcttacggggttctgtttagcggcgtaagttggactatgaagatcgggatcggcattctgctcacctggctgggcctgaacagccggagcacctcgctttccatgacttgtatcgccgttgggatggtcacgctgtaccttggtgtgatggtgcaggcggatagcggttgcgttattaattggaaaggacgcgaactgaaatgcggctcgggcatctttgtgacgaacgaagtccacacctggacagagcaatacaagttccaagctgactctcccaagcggcttagcgcagccattggcaaggcgtgggaggagggggtctgtggtattaggtccgcgacccgactggaaaacatcatgtggaagcaaatcagcaacgagctcaaccacatcctcttggagaacgatatgaagttcaccgtggtagtcggtgatgccaacggcatactcgcccaggggaagaaaatgatccggccccaacctatggagcacaagtactcctggaaatcttgggggaaagcgaaaatcatcggcgccgacatccagaatacgacctttatcattgacggccctgacacgccagaatgccccgatggccaacgggcttggaatatatgggaagtggaagactacggattcggggtattcaccacgaacatctggctgaagctgcgcgacagctatacacagatgtgcgatcaccggttaatgagcgcggccatcaaggactcaaaggctgttcacgcagatatgggttattggatagagagcgagaagaacgagacgtggaagctggcccgcgcatccttcattgaggttaaaacgtgcacttggcccaagtctcatacgctgtggtcgaatggggtgctcgagtctgagatgatcattcctaagatattcggcggaccgatttcccagcataactaccggcctggctactttacccagacggcaggcccctggcatctgggaaagctcgaactggatttcgacctttgcgagggcacgactgtagtggtggacgaacactgtgggaaccggggcccgagcctgaggacgacaaccgtcacagggaagattattcacgagtggtgctgtaggtcctgcaccctgccgccactgagattccgaggcgaagacgggtgctggtacggtatggagatccggcctgtgaaggagaaagaggagaacttggtgcgcagcatggtttccgccggcagcggggaggtagattctttttccctagggattctgtgcgtgagcattatgattgaggaagtgatgcggtcccgctggtctcgcaagatgctgatgacggggacactcgcggtgttcctgctgctcatcatgggccagctgacctggaatgacttgattcggctctgcataatggttggggcgaacgcgtccgatcgcatgggtatggggaccacttacctggctctgatggcgacttttaaaatgcggccgatgttcgccgtcggccttctgttccgccgactgaccagccgcgaagtgctgctgttgaccatcgggctctcccttgtcgcgtcggtggagctacccaactcgctggaggagttgggcgatggcctggccatggggatcatgatgctaaaacttctgactgagttccaaccccaccagctctggacgaccctgctgagcctcacctttgtgcggactactctgtccttagactacgcctggaaaaccaccgcaatggttctcagcattgtgtccctgttcccactttgcctcagcaccacgtcccagaaaacgacctggttacctgtgctgctcggcagctttggctgcaagcccctaacaatgttcctgattactgagaacaagatctgggggcgcaagtcctggccgttaaacgagggtattatggcaatcggtatcgttagcatattactgagttccttgctgaagaacgatgtgccccttgcgggaccgctcatcgcaggcggtatgctgattgcatgctatgtaatcagcggctccagcgccgacctctccctcgagaaggccgcggaggtcagctgggaacaggaagcagaacacagcggggcaagccacaacatcttggtggaggttcaagatgacggtactatgaagataaaggacgaggagcgagacgacactctgaccatactgctgaaggcaacgctgctggctgtatccggggtttatccaatgagcatccccgcaacgctgttcgtgtggtatttttggcagaagaagaaacagcgctccggcgtgttatgggacacgccaagcccacccgaaatggagcgtgccgttttagacgacggaatctaccgcatcctccagagagggctgcttggccgctcccaggtaggggttggggtcttccaggatggggtgttccacacgatgtggcatgtcacgcggggcgccgtgctcatgtaccagggcaagcgcctggaaccctcttgggcatccgtgaagaaggatctcattagctacgggggcggctggagattccagggctcctggaacacgggggaggaggtacaggtgatcgcggtggagccgggtaaaaatcctaagaatgttcagactacccccggtaccttcaagacgcccgagggtgaagtaggcgcgattgcccttgactttaaaccgggtacaagcgggtccccgatcgttaatcgcgaaggcaagatcgtcgggctgtacggtaacggtgtggtgacgaccagcggcacgtacgtctccgccatcgcccaggccaaggccagccaggaagggcccctaccggagatagaggatgaggtgtttaagaagcggaacctcaccataatggatttgcacccagggtctggcaagaccaggcggtaccttcccgccattgtacgtgaggctattaagcgcaaactccggaccctgatcctagcccccacccgggtggtggcaagcgagatggccgaggccctcaaggggatgcccatccggtaccaaaccacggcggtcaagagcgagcacactggccgcgagatcgtagatctgatgtgccacgccacattcaccatgcgtctacttagccccgtccgcgtgccaaattacaacatgatcatcatggacgaggcgcacttcaccgatccggctagcatcgcagcccggggatacatctccacacgcgtcggcatgggggaagctgctgcaatcttcatgacggccacgcctcccggcagcgtggaggccttcccccaatccaatgccgtgatccaggacgaggagagggacatccccgagcgcagctggaactctggctacgactggatcaccgacttcccaggaaagaccgtgtggttcgtacctagcatcaaaagcggcaacgacatcgccaactgcctgcgcaagaacgggaagcgggtgatccaattatcccgaaagacgttcgacaccgagtaccagaaaaccaagaacaacgactgggattacgtcgtgacgacggacatctccgagatgggcgctaattttagggcggaccgggtgatcgatccacggcggtgcttgaagcccgtcatcctaaaggatgggcccgagagggtgatcctggccggcccgatgcccgtcaccgttgcaagcgccgcccaacggcgcggcagaataggcaggaaccagaacaaggagggggatcagtacgtgtacatgggtcagcccctcaacaatgatgaggaccacgcccactggaccgaggccaagatgcttctggataacataaacacccccgaaggtatcataccggcactcttcgagccggaacgcgaaaagtccgccgccatcgatggcgagtaccggctgcgaggagaggcccggaagacgttcgtagagctgatgcgccggggcgacttacccgtttggctcagctacaaggtagcgtccgagggatttcagtactcggaccgccggtggtgcttcgatggcgagcggaacaatcaggtcctggaggagaatatggacgtagagatctggaccaaggagggggagcggaagaaactccgcccccgctggctggatgcgcgcacgtattcagacccgttagcgctacgggagttcaaggagtttgcagctggccggcgaagcgtgagtggggacctgatattggagatagggaagctcccccaacacctgactctgcgggcccagaacgccctcgataacctggtcatgctgcacaacagtgagcagggaggcaaggcctatcggcacgctatggaggagttgcccgacaccatcgaaactctgatgctactggccctcatcgcagtgctgacaggaggggtgacacttttctttctgagcggcaagggcctgggtaagacctcaatcggcctcctttgcgttaccgcctcttccgcccttctctggatggcctcagtggagccccactggatcgctgcgagcatcatactagagttcttcctgatggttctcctaatcccggagcccgaccgccagcggacaccgcaagacaaccagttggcctacgtcgtgataggtttactgtttatgatattaaccgtggccgccaacgaaatgggtctcctggagaccacgaagaaggacctggggatcgggtacgtcgcagcagagaaccaccaacacgccaccatgttggacgtggacctacatcccgcctctgcctggaccctgtacgcggtagcgacaacggttatcacgcctatgatgaggcacaccatagagaataccacggcgaatatctctctcactgccatcgcgaatcaggccgcgatattaatgggcctggacaagggctggccaatctccaaaatggatattggcgtacctctccttgccctggggtgctactcccaagtcaatcctcttaccttaaccgccgccgtcctgatgctcgtggcgcactatgccatcatcggcccgggcttgcaggcgaaggcaacgcgagaggcccagaagcggaccgcggccggcatcatgaaaaatcccactgtcgacggcatcgtcgctatcgaccttgacccagtggtctatgatgctaagttcgaaaagcagctcggacaaatcatgttattaatactctgcacatctcaaatcctgctcatgcgcaccacctgggccttatgcgagtccataaccttagcgaccggcccgttaacgactctctgggagggttcacccggcaaattctggaataccaccatagcggtgtcgatggcaaatatcttccggggtagctaccttgccggagcaggcctcgcgttctccctcatgaagtccctcggcggagggcgcagaggtacgggcgcgcagggggagaccctgggcgagaaatggaaacgccagctcaaccagctatccaaaagcgagttcaatacctacaagcgatcaggcattatggaggtggacagatccgaagcgaaggagggcctgaagcgcggagagaccactaagcacgccgtgagccgtggcaccgcgaagctccgttggtttgtcgaacgaaatctggtaaagccggagggaaaggtaattgaccttgggtgcggccgcgggggctggtcctactactgcgccgggctcaagaaagtgacggaggtgaaggggtacacaaagggtgggccaggacacgaagaacccattcctatggccacctatgggtggaacctcgtgaagctgcacagtggcaaggacgtcttcttcatgccgccggagaagtgtgacaccctgctctgtgacattggggaatccagcccaaacccaaccatagaggaaggccgcaccttaagggtgctgaagatggtcgagccctggttacgcggtaaccaattttgtatcaagatcctgaatccctacatgccgagtgtcgtggaaaccctggagcaaatgcaacggaagcatggaggcatgctcgtgagaaaccccctgagccgtaactccacgcacgagatgtactgggtatcatgtgggacaggcaacatcgtgtcggccgtgaacatgaccagccgaatgttactcaatcgctttaccatggcccatcggaagcccacgtatgagcgcgacgtcgaccttggcgcggggacccggcacgttgccgtagagcctgaggtcgccaacctggacatcatcggtcagcgcatcgagaacatcaagaacgagcacaagtccacatggcactacgacgaggataacccgtataagacctgggcataccacggaagctacgaagtgaagccatcaggcagcgcgtcgagcatggtaaacggggtagtgcgcctcttaacgaaaccttgggacgttatacccatggttactcagattgcgatgaccgataccactcccttcgggcagcagcgggtgttcaaagagaaggtcgacacccggacgccccgggcaaaacggggcaccacgcaaattatggaggtgacggccaaatggctgtgggggttcttatcccgcaacaagaagcctcggatttgtactcgagaggagtttacacggaaggtgcgcagtaacgccgccatcggggcggtctttgtggacgaaaaccaatggaactcagccaaggaagctgtggaagatgagcggttctgggacctagtgcaccgcgagcgggaactgcacaaacagggtaaatgtgctacgtgtgtctataatatgatgggcaagcgcgagaagaaactcggagagttcggcaaggctaagggctccagagccatctggtacatgtggctgggggcccgctttctggagttcgaggctctcggatttatgaacgaggatcattggttcagccgggaaaactcgctttccggggtggaaggggaggggctacacaagctcgggtacatcctgagggacatctccaagatcccgggcggcaacatgtacgcagacgacactgcgggttgggatacccgcatcaccgaggacgacctgcagaacgaggccaagatcacggacatcatggagcccgaacacgccctactggccatgtctattttcaaactgacgtaccagaacaaagtcgtgcgggtgcaacgcccggccaagaacggaaccgtcatggatgtgatttcccgccgcgatcagcggggcagcggccaggttggtacttacggcctcaacacgttcaccaacatggaggtacaactgatcagacagatggagagcgaagggattttcctgccatcagaactcgagaccccaaacctcgcggagcgggctttggattggttagaaaaacacggcgcagagcgtctgaagcgcatggctatttctggggacgattgcgtcgtgaagcctattgatgatcgcttcgccacggcgctgaccgccctcaacgacatgggcaaggtccgaaaggacatcccccagtgggagcccagcaaaggctggaacgattggcagcaagtacccttttgctcccaccacttccaccagctgatcatgaaagacgggcgcgaaatcgtggtaccgtgccggaatcaggacgaactcgtggggagagcccgggtcagtcagggggcgggctggtccctccgcgagaccgcttgtctaggaaagagctacgcacagatgtggcagttgatgtacttccatcggcgggacttgcgcctggcggcaaatgccatatgctctgccgtcccggtggattgggtccctgcgtcgcgcaccacatggagtatccatgcacaccaccagtggatgaccacggaggacatgctgtcggtatggaaccgcgtttggatagaggaaaatccatggatggaagacaaaacccacgtcagctcctgggaggaagtcccctatctcggcaagagagaggatcagtggtgcggatccctgatcgggctgaccgcccgcgcaacgtgggccacgaatatccaggttgccatatcccaggtgcgccgcctcatcggaaacgagaactacctggactacatgaccagcatgaagcgattcaagaacgagtccgaccccgagggtgcactatggtga

SEQ ID NO: 24670 - RNA, 9879 nt, synthetic construct
  misc_feature 1..9879: note = derived and/or modified CDS sequence (opt11) from DENV-1__KC692503__SS-prME
  source 1..9879: mol_type = other RNA
tccgtaaccatgctactaatgctgctccctacggcactcgctttccacctaacgacaaggggaggagaacctcacatgattgtctctaaacaagaacgagggaaaagccttttgttcaaaacaagcgcaggcgttaatatgtgcacgcttatcgctatggacctcggggaattatgcgaagacacaatgacatataagtgtccccggattacggaagcggaaccggacgatgtcgattgctggtgcaacgcaactgacacctgggtcacttacggaacctgtagccaaaccggtgaacacaggcgagaaaaacgatccgtcgccctggcaccacacgtgggcttaggactagaaacccggactgaaacatggatgtcgagtgaaggggcgtggaagcaaatccagagagtcgaaacgtgggcactaagacatcccggtttcactgtaattgcattcttcctcgcacatgcaattggaacgagcataacacaaaaaggcataatattcatcttgctcatgctcgtcacacccagcatggcaatgcgatgtgtgggcatagggaaccgggacttcgtagaagggctgagtggtgcgacgtgggtcgacgtagtcctggagcatggctcctgcgtaacaaccatggccaaaaataagccaacgttagatatcgaactgctgaagactgaggtaacaaatccggccgtcctgcggaaactttgcattgaggccaagatctccaacacgaccacggactcccggtgccccacccagggtgaggccacgctggtagaagaacaagatgcgaactttgtatgccgcagaacgtttgtcgaccggggatggggcaatggctgcgggttattcggcaaaggctcactactaacctgtgcaaagttcaaatgcgtcaccaagctagaggggaaaatagtacagtacgagaacctgaagtattcagtcattgtaacggtccacactggagatcagcaccaggtgggaaacgagacgaccgaacatggaaccatcgcaacaataacaccccaagcaccgacctccgaaatccagctcaccgactacggagcactcaccttagactgtagcccgcgcaccggcctcgacttcaacgagatggtattactcacaatgaaagagaaaagttggctcgttcacaagcaatggtttctggacctaccactcccatggacgagcggcgcctcgacgtcacaagaaacgtggaaccgtcaagatctattagtaaccttcaaaacagcacacgccaagaaacaggaggtggtagtcctgggaagccaagagggcgcgatgcacacggctctgacaggcgcgacagaaattcaaacaagcgggacgaccaccatcttcgcagggcacctaaaatgccgactcaaaatggacagactgactctgaaaggcatgagttatgtcatgtgcacgggcagcttcaaactcgagaaagaggtcgccgaaacacaacacggaaccgttctagtccaagtaaaatacgagggaacagacgcgccatgcaaaataccctttagtacgcaggacgagaagggcgtcacccaaaacggaagactgatcactgccaatcccatagtaacggacaaggagaagcccgtcaatatcgaaacagaacctccatttggtgaatcttacatcgtcgtcggagcaggcgagaaggcactcaaattatcatggttcaaaagaggaagtagcataggaaagatgttcgaagctacggccagaggggccaggcgaatggcaatcctgggtgacacagcctgggacttcgggagcatcggaggggttttcacttcagtcggtaagctagttcaccaggtattcggaacggcctacggcgtattattctccggcgtctcgtggacgatgaaaattggaatcgggatactactgacatggttgggtctcaactcgcgctcgacgtcgctaagcatgacatgcatagcggtaggtatggtaacgctctacctcggagtaatggtacaggcagactcaggatgcgtcattaactggaaaggaagagagttaaaatgcggcagtggcatcttcgtaacgaacgaagtacacacctggactgagcaatacaaattccaagcagactcacccaagcgcctttctgcagctataggcaaagcctgggaagaaggagtctgcggaatccgaagcgccacgaggctagaaaacataatgtggaaacaaatatcgaacgaattgaaccacatccttctggaaaatgacatgaaattcacggtagtagtcggagacgctaatggcatactagcgcagggaaagaagatgatacgaccgcaaccaatggaacacaaatacagctggaaatcatgggggaaagcaaaaataatcggggcagacatacaaaacactacattcatcatcgacggtcccgatacaccagagtgccctgacggtcaacgagcatggaacatatgggaggtagaggattatggcttcggagtgtttacaacgaacatctggctaaagttgcgcgattcgtatacgcaaatctgtgatcacaggctcatgagtgcggccataaaagactccaaggccgtccacgccgacatgggatactggatagagagcgaaaagaacgagacctggaaactcgcgcgagcatccttcattgaagtgaaaacttgcacgtggcccaagtcacacaccctatggagcaacggcgttctcgagtcggaaatgataatccccaaaatattcgggggacctatatcgcagcataactaccggcccgggtacttcacgcaaactgccggcccctggcatctaggtaaactcgagctagacttcgacctctgtgaaggcacaaccgtggttgtcgacgaacactgcggaaatcgcggaccgagcctacgcacaacgaccgtaaccggcaagataattcatgaatggtgttgccgctcctgcaccttaccgccactgaggtttagaggcgaagacggctgctggtacggtatggaaatacgtcccgtcaaagaaaaggaagagaatctggtacgaagtatggtatctgcggggagcggagaggtagacagtttctccctaggaattttatgcgtctcgatcatgatagaggaagtaatgagatcgagatggtcccgaaaaatgctcatgatcggcactctagctgttttcctgctcttaataatggggcaattgacgtggaatgacctcatcagactttgtatcatggtaggcgcaaatgcatcagaccgaatgggcatgggaacaacttaccttgccctgatggcaacattcaaaatgcggcccatgtttgctgttggcctcctgtttcggcgacttacatcacgagaggttctacttttgaccatcggcctgtcgctcgtagcttcagtcgaactcccaaactctctggaagaacttggcgacggcctcgcaatgggaatcatgatgctcaaacttttaacggagttccagccgcaccagctatggacaacgcttttgagtctaacgttcgtcaaaaccacattatcgctcgattatgcgtggaaaaccaccgccatggtactctctatcgtcagtctgttcccactgtgtctctccacaacctcacagaaaaccacgtggctacctgtacttctcggatcattcggatgtaagcccctgaccatgtttctaataaccgaaaacaagatctgggggcgaaaaagctggcccctcaacgaagggatcatggctattgggatagtaagcatacttctctcatcactactcaagaatgatgtaccgctagcgggccccctgatcgccgggggcatgcttatcgcctgctacgtcatcagcggatccagcgcggacctaagtttagagaaagctgccgaagtgtcgtgggagcaagaggctgaacattcgggtgccagtcacaacattctggtagaggtacaagacgatggaacgatgaaaataaaagacgaagaacgcgacgacacgctcaccatactcctcaaggccaccctactcgctgtgagcggggtctacccgatgtccatacccgccaccctattcgtatggtacttctggcagaaaaagaagcaaagaagcggagtactgtgggacacccctagcccacctgaggtcgagcgcgcagtgctcgatgacggtatctaccgcatactgcaacggggattgctagggagaagccaagttggggtcggtgtcttccaggacggcgtcttccacactatgtggcatgttacacgaggagcggtactcatgtaccaaggaaaacgactagagccaagctgggcctccgtcaagaaagacctcatcagttacgggggagggtggagatttcaaggcagctggaacacaggtgaagaagtgcaagtcattgccgtagaaccggggaaaaatcccaaaaacgtgcagacaacgccaggcacgttcaaaacaccggaaggagaggttggcgccatagccctcgacttcaagccggggacaagcggatctccgatcgtcaatcgcgaagagaaaattgtcggcctctacggaaatggcgtcgtcaccacaagcggcacatatgtaagcgcgatcgcacaggccaaggcgtcccaagagggccctctgcccgagatagaagacgaagtgttcaagaaaaggaatctcacgatcatggatctgcatccaggtagcggaaaaactcgaagatacctaccagcaatcgtacgggaagccatcaagcgaaaactccgaaccctaatactcgccccaacacgggtagtcgccagcgagatggcggaagcgctaaagggaatgccgatcagatatcaaaccacagccgtaaaatccgaacatactggtagggaaatcgtcgacctgatgtgccacgcaacattcaccatgaggctcctgagccccgtgcgagtgccaaactataatatgatcataatggacgaagcccatttcaccgacccggccagcatagccgcccgagggtacatctccactcgagtgggcatgggcgaagcagcggctatctttatgacagcgacacccccaggaagcgtcgaagcctttcctcagagcaacgcagtgatacaggatgaggaaagagacataccagagcgatcgtggaactcagggtacgactggataaccgacttccctggaaaaactgtgtggttcgtgccttccataaaaagcgggaacgacatcgccaattgccttagaaagaatggaaaacgggtgatccagctaagccgaaagacctttgacacggagtatcagaaaacaaagaacaacgactgggactacgtggtgaccaccgacatctccgaaatgggcgcgaacttccgggctgaccgcgtaatcgaccccaggcgctgcctgaaacctgtcatcttaaaagatgggccggagcgcgtgattctggcggggccgatgccggtcactgtggcatctgcggcgcagcgccggggacggataggccggaatcaaaacaaggaaggagatcagtacgtatacatgggacaacccttaaacaatgacgaagatcacgcccattggaccgaagctaagatgctgctcgacaacataaacacaccggaaggcataattccagccctattcgaacccgagcgagagaaaagcgcagcgatagatggtgaataccgcctgcgaggagaggcgagaaagacctttgtcgaactcatgcgacgcggagatctgccagtctggctgagctataaggtcgcttccgaaggcttccagtattcagaccgtagatggtgcttcgacggggaacggaacaaccaggtcttggaagaaaacatggatgtagaaatctggacgaaggaaggcgagcgaaagaaacttcggccccgatggctagatgcacggacctactccgatcccctggccctcagggaatttaaggagttcgcggcagggcgaagatcggtctcaggggacttaatactagaaattggcaaattgccccaacatcttacgctccgagcccaaaacgctttggacaacctagttatgctccataacagtgaacaaggaggaaaagcatatcggcacgccatggaggagttaccagacacaatcgagacgcttatgctcctagcgctgattgccgtactgacaggtggtgtaacattatttttcctaagtggaaaaggactgggtaaaacctctatcgggctcctctgcgtaacagcatcttcggcgttactctggatggccagtgtagaaccccattggatcgcagccagcataatcctcgagttcttcctcatggtgctacttatacctgagcccgacagacagcgaactccacaggataaccaactcgcgtacgtagtaatcggactcctgtttatgatcctgacagtggctgcaaacgaaatgggactcctagaaacaactaaaaaggatcttgggataggctacgtggcggcagagaaccaccaacacgcaacgatgctcgatgtagacctgcatccagcgagcgcctggacactatatgcggtggccacgacagtcatcaccccaatgatgcgccacaccatagaaaatacaaccgcaaacatctcactaactgcaatcgcaaaccaagcggccatactcatgggactggacaagggctggcctatatccaagatggacattggggtaccactgctggctctagggtgttacagtcaagtcaacccactcacactcaccgctgcagtcttaatgcttgtcgctcactacgctataatcggcccgggcctgcaagcaaaagccacgagggaagcccagaaacgcacggcagccggcatcatgaaaaacccaacggttgacggtatcgtagcaatagacctagatcccgtggtttatgacgccaaattcgagaaacagctaggccagataatgcttctaatactctgcacgtcccagatactcctcatgcggacgacatgggcgctctgcgagagcataaccctcgctacaggcccactaacgaccctatgggaaggatcacctggaaaattctggaacaccaccatcgcggtaagcatggcgaacatctttcgcggatcatacctcgccggagcaggcctggccttcagcctcatgaaaagtttgggtggagggcgccgaggaaccggagcgcagggggaaacattgggggagaagtggaaacgccaactgaatcaactatcgaagagtgagttcaacacttacaagagatctgggatcatggaagttgaccgatccgaagccaaagagggactgaaacgaggggaaacgactaaacacgccgtttcccgcggaacggcaaaacttaggtggttcgtcgagcggaacctggtaaaaccggaagggaaagtcatagacctggggtgtggaaggggaggctggagctactactgcgcaggcctgaagaaagtcacagaagtgaaaggatacaccaagggtgggccgggacacgaagaacctatcccaatggccacatacgggtggaacctcgtcaaactccactccggcaaagacgttttcttcatgccgcccgaaaaatgcgacaccctactgtgcgacatcggtgaatcatcaccaaacccgaccatcgaagagggccgcaccctccgtgtactaaagatggtcgaaccgtggctccgcggcaaccagttctgcataaagatactgaacccatacatgccctcggtcgtagaaacactcgaacaaatgcagcgaaagcacggtggcatgctagtacgcaatcccctctcaagaaactcaacccatgaaatgtactgggtctcctgcggcacaggcaacatagttagcgccgtaaacatgacaagccgcatgctactaaaccgcttcacaatggcacaccgcaagcccacgtacgagcgcgatgtagacctcggagcagggacgagacatgtagcggttgaaccagaagtggccaacctagacattataggccaacgaatagagaacatcaaaaatgaacacaagtccacatggcactacgatgaagacaacccctacaagacctgggcgtatcacggcagctacgaagtgaagccatcaggaagtgcgtcttccatggtgaacggtgtagtgcgcctcctcacgaaaccctgggacgtcataccgatggtaacacaaatagcgatgactgacacaacaccattcggacaacaaagagtattcaaagagaaggtggacaccaggacgccacgagccaagcgagggacaacccaaatcatggaggttactgcgaaatggttgtgggggttcctatcaagaaataagaaaccaaggatctgtacaagggaggagttcacccggaaggtgcgaagcaacgccgcaatcggagccgtcttcgtcgatgagaaccaatggaactcggcaaaagaggcagtggaagatgaacggttctgggatcttgtacatcgggaacgagagctgcataaacaaggcaaatgtgcaacctgcgtgtacaacatgatggggaaaagagaaaagaaactgggcgagttcggaaaagccaaaggctcccgcgccatttggtatatgtggctgggtgcgagattcctagaatttgaagcgctcggatttatgaatgaggatcactggttcagcagggagaactcattaagcggggtcgagggagagggcctccacaagctaggctacatactacgagacatctcaaaaatccctggagggaacatgtacgccgacgacacagctgggtgggacacacgcataaccgaggacgatctacaaaatgaagcgaagataactgacataatggagccagaacacgccctcctagcaacctccatctttaagctgacctatcagaataaagtagtaagagtccagagaccagccaaaaatggaacggtaatggacgtgatctcccgccgcgatcaaaggggctcaggccaagtggggacttacgggctcaataccttcacaaatatggaagtccagctcatacgtcaaatggaaagcgagggtatcttcctaccatccgaattagaaacccctaatctcgccgagcgagctctagactggctagagaagcacggcgcagaacgacttaaaagaatggcaataagcggtgacgactgcgtagtcaaaccgatcgacgaccgattcgcaaccgcattaacggccctgaacgatatgggaaaggtgaggaaggacatacctcagtgggaacctagcaaagggtggaatgactggcaacaagtcccattctgttcacatcacttccaccagctgatcatgaaggatggacgtgagatcgtcgtaccctgccgcaaccaggacgaactcgtcggccgagcgcgagttagccaaggggcagggtggagcctaagggagacagcctgtctcggcaagtcatacgcacaaatgtggcagctcatgtacttccaccgtcgagacctacgcctcgcggccaacgcaatctgcagcgcagtcccggtggactgggtaccggcgtcgcggacgacctggtcaattcatgcacaccaccaatggatgaccaccgaggacatgttgtcagtttggaaccgggtgtggattgaggagaacccgtggatggaagataagacgcacgtcagctcatgggaggaagtgccatacctgggcaaaagagaagaccaatggtgtggctcattaatagggctaaccgcacgggccacatgggcaaccaatattcaggtggcaataaaccaagtccgccgcctaattgggaacgaaaactacctagattatatgaccagcatgaagcgtttcaaaaacgaaagtgaccccgagggcgctctatggtaa

SEQ ID NO: 24671 - RNA, 9879 nt, synthetic construct
  misc_feature 1..9879: note = derived and/or modified CDS sequence (opt11) from DENV-1__KC692504__SS-prME
  source 1..9879: mol_type = other RNA
agcgtgaccatgcttctaatgctgcttcccacagcactggcattccatttgactacacgcggtggagaaccccacatgatcgtgtctaaacaagaacgcgggaaaagcctactattcaaaacgtcagcaggagtaaacatgtgcacgttgatcgccatggatctaggagaactatgcgaagatacgatgacctacaaatgtccccggatcacagaagcagaaccggacgacgtagattgttggtgtaacgccacagatacttgggtaacatacggaacatgcagccagactggggagcaccgaagagagaaaaggagcgtagccttggctccccatgtaggcctaggattagaaacgcgcacggaaacatggatgtcgagcgaaggtgcatggaggcagatccaacgggtggaaacttgggcactacgccacccgggattcacggtcatcgcattcttcctagcacacgccatcggcacaagcatcacacaaaaaggtatcatatttattcttctcatgctagtcactccatctatggccatgcggtgcgtcggcatagggaatagggacttcgtcgaaggtctgtcgggcgccacctgggtcgatgtagtccttgaacacgggtcgtgcgtcacaacaatggccaaaaacaaacccacgcttgacattgagttattgaaaacagaggtcatgaacccggccgtactgcggaagctgtgcatcgaagcaaaaataagtaataccaccacagacagccgttgtcccacccaaggggaagccactctcgtggaggaacaagacgcaaatttcgtttgcagacgcacattcgtagatcgcggatgggggaatggatgcggccttttcggaaaaggcagcctccttacatgcgccaagttcaaatgcgtcacaaaactggagggaaaaatcgtccagtacgaaaacctgaagtactctgtgatagtaaccgtccacaccggagaccaacaccaggtcggaaatgagactacagagcatgggacaatagccacgataacaccccaggctccgacatcggagatccagctaacagattacggcgcactcacactcgactgctcaccaaggactggcctagactttaacgaaatggtactcctgaccatgaaagagaaatcctggctagtacacaaacaatggttccttgacctcccccttccttggacatccggagcttcgacaagccaagagacgtggaaccgtcaagatctcctggtgaccttcaaaacagcacacgcgaaaaagcaggaagtcgttgtactaggtagtcaagaaggcgcgatgcacacagcactgaccggagcaaccgaaatacaaaccagcgggacaaccacaatattcgccggccacctcaagtgccgactaaaaatggacaagttgaccttaaagggcatgtcatacgtcatgtgcactgggagcttcaagttggaaaaagaagtagcagaaacccaacacgggacagtgttggtacaggtaaagtacgaaggcactgacgcaccttgcaagatacccttcagcacccaagatgaaaaaggggtaacccagaacggccgattgattacggcaaacccaatcgtgacagacaaggagaaaccggttaatatagaaacagagccacccttcggcgaatcgtatattgtagtaggtgctggagaaaaggccttaaaactcagctggtttaaacgagggtcgtctatcgggaaaatgttcgaagcaaccgccagaggggcaagaagaatggcgattttaggcgacacagcctgggacttcggttcgatcggcggcgttttcacctcggtcggcaagctcgtccaccaagtattcggcacagcatacggcgtgctgttctcaggagtatcttggactatgaagatcggcataggaatactactaacctggttagggctaaactcacgatcgacaagcctgtctatgacatgcatcgcagtagggatggtaaccctatatttgggggtaatggtgcaagctgatagtgggtgcgtcatcaactggaagggacgcgaattgaaatgcgggtccggcatcttcgtaacaaacgaagttcacacgtggaccgagcaatataaattccaagcagacagccccaaacgactctccgctgccataggcaaggcctgggaagaaggcgtctgcgggattcgatcagccacaaggcttgaaaacatcatgtggaaacaaatctctaacgagctcaaccacatcctcctcgagaacgacatgaaattcacagtcgtagtcggagacgccaacggaatactagctcaaggaaagaaaatgatacggccacaacccatggaacacaaatactcgtggaagtcctgggggaaggcaaaaattataggagccgacatccaaaacaccacattcatcatcgacgggcccgacacccccgaatgccccgacggacagcgggcttggaatatatgggaggttgaagattacgggttcggagtgtttacaaccaacatatggctcaaacttcgagatagctacacacagatgtgtgaccaccgcctaatgtcagcagccattaaggactcgaaggcggtacacgcagatatgggctactggatcgaatcagagaagaacgaaacctggaagctcgcgcgagccagcttcatagaagtgaaaacatgcacatggcccaagtcacacaccttgtggagcaacggcgtcctcgaatccgaaatgataatccccaaaatcttcggcgggcccataagccaacacaactaccgaccaggctactttacacaaactgcagggccgtggcaccttggcaagctagagctcgatttcgatctctgcgagggaaccacagtagtagtcgacgagcactgcggaaaccgggggccttcactacggacaacaacggtcaccggaaagatcatccatgaatggtgctgccgttcgtgtacgctgccgccactccgtttcaggggcgaagacggctgttggtacggaatggaaataaggccagtcaaggaaaaggaagaaaacctggttcggagcatggtatcagcgggcagcggggaagtagattcgttctccctcgggatcctatgcgtatcgatcatgatcgaggaggtgatgagatctagatggtcccggaaaatgcttatgacagggaccctggcagtattcctgctactaatcatgggacaacttacgtggaacgatctcattaggctctgtataatggtaggcgctaacgcctcagacaggatggggatgggtacgacatatttagccctaatggcgaccttcaagatgcgaccgatgttcgccgtaggcctgttattccgacgcctcacatcgagggaagtgctgctgctgacaataggcctatccctcgtcgcttccgtcgagcttccaaactccttagaggaactcggagatggactcgccatggggataatgatgctcaaactcctaacagagttccaaccccaccagctctggaccacactattatccctaaccttcgtcaaaacgaccctttcattggactacgcatggaagacgacagccatggtcctctcaatagtgtcactctttccactgtgtttgagcaccaccagtcagaaaacgacttggcttccagtcctactgggttcatttggctgcaaaccactgacaatgttcttaatcaccgaaaataagatttggggccgaaagtcatggccattgaacgagggaattatggcaataggcatcgtgagtattttgctgagcagccttctgaagaatgacgtcccgttggcgggcccactcattgcgggagggatgctcatcgcgtgttatgtaatttcaggatccagcgcagacctatccctggagaaggcagccgaggtatcctgggaacaagaagctgaacacagcggcgccagtcacaacatcctagtggaagtgcaagacgacgggactatgaaaattaaagatgaggaacgcgacgacacgttaaccatcctactaaaagcgactcttctggcagtctccggagtctaccctatgtcaatcccagcgaccctatttgtatggtacttctggcagaaaaagaaacagcggtcgggcgtcctatgggacacgccaagtccacccgaagtggagcgagcagtcctagacgacggcatctatcgaatattgcaaagaggactgctcggacgaagtcaagtcggcgtcggagtcttccaagacggagtattccatacaatgtggcatgtaactcgtggggccgtccttatgtatcagggaaaacgcctagagccctcatgggccagcgttaagaaagacctcatatcctacggaggtgggtggcgcttccaaggcagctggaacactggagaagaggtacaagtaatagcggttgaacccggcaaaaacccgaagaatgtccaaaccacgcctggcacattcaagacgcccgaaggagaagtaggagcgatagccctggacttcaaaccaggcacaagcggatctccaattgtcaaccgcgagggaaagattgtcggcttatacggaaacggggttgtcaccactagcggaacatatgtcagcgcaatcgcgcaggcgaaagcatctcaagaggggccattaccggaaatagaggacgaggtattcaagaaacgcaatcttacgatcatggacctccacccaggctcgggaaagactcgtcgatatctaccagcaatagtccgcgaagcgattaagcgtaagttacgcacgctgatcttagccccgacacgggtggtcgccagtgaaatggcagaagcactgaaagggatgccgatcagatatcagacaacggcagttaagtcagagcacaccggcagagaaatcgtcgacttgatgtgccatgcgacattcacaatgcgcctcctaagccccgtccgtgttcctaactataacatgattatcatggacgaagcacacttcacggacccagcaagcatcgcggctagggggtacatctccacaagagtcggaatgggagaagccgcagcgatcttcatgactgcaacgcccccggggtcagttgaggcattcccacaaagtaacgcagtgatccaggatgaagaacgcgacattccagagagaagctggaacagcggctacgattggattaccgacttcccggggaagaccgtctggtttgtgccgagcatcaagagcggtaacgatattgcaaattgcctccgcaaaaatgggaaaagagtcatccaactaagccgcaagacattcgacactgaatatcagaaaacaaagaacaatgactgggactacgtcgtaaccactgacataagcgaaatgggcgcaaacttccgagccgatcgcgttatagatccacgccgatgcctaaaacccgtcatactaaaagacggtcccgaaagagtaatcttagctggacccatgccagtaacggtagctagcgcggcacaacggcgtggcagaataggacggaaccaaaacaaggaaggagaccagtatgtgtacatgggccaacccctgaacaacgatgaagaccatgcgcactggaccgaagcgaagatgctcctcgacaacataaataccccagaaggcattattccagcacttttcgagcccgagcgagagaaaagcgcagccatcgacggagagtaccgactcagaggggaagcgcgtaaaacattcgtggagcttatgcgcagaggggacctgcccgtctggctaagctataaagtagcatccgaggggttccagtacagcgatagacgatggtgcttcgacggtgaacgaaacaaccaggtactcgaagaaaacatggatgtcgaaatatggactaaagaaggagaacgaaagaaactccgaccacgttggctcgacgcccggacctacagtgaccctctagcgctccgagaatttaaagagttcgctgctgggagacggagtgtcagtggcgacctaatactcgaaataggaaaactaccacaacatctgacgctacgtgcacagaacgccctggacaacctcgtcatgctacataactcagaacaaggtggaaaggcttatcgacacgccatggaagaactacccgacacaatagaaactctcatgctcctggcgctcattgctgtcctaacgggcggcgtcactctcttcttcttgagcgggaagggcctaggaaagacaagcatcggcctactatgcgttaccgcatcatcagcactcctctggatggccagtgtcgaaccccactggattgccgcaagtataattcttgagttctttctaatggtgttgctaattcccgaacccgaccgacaacgcacaccacaagataaccaactagcatatgtggtcataggactgctgttcatgatactgacagtcgcagccaacgaaatggggctcctcgagacgaccaaaaaggacctcggaataggctacgtggcagcggaaaaccaccaacacgcaacgatgttagacgtggacttacatcccgccagtgcgtggacactatacgcggtcgcaactactgtgatcacaccgatgatgcgccatacaatagagaacacaacggcgaacatatcactgacagcgatagcgaaccaagcggcaatactaatggggttagacaaagggtggccaatcagcaaaatggacatcggagtacccctgctcgcactcggttgctacagccaggtaaaccccctgaccctaacggcggccgtcctcatgctggtagcacattacgcgataatcggacccgggttgcaagcaaaggcaaccagagaagcgcaaaaacgcacagcggcaggcataatgaaaaacccgacggtcgatggtatagtggccattgacctagacccagtggtttacgatgccaaattcgaaaagcagctcggacaaattatgctattaatactatgtacgtcacagatcctactgatgcgtacaacctgggccctgtgcgaatccatcaccctagctacaggccctctcacgaccctatgggagggcagcccagggaagttctggaatactacgatcgcagtgtcaatggccaacgtctttagaggaagctacttagccggcgccggcttagccttcagcctaatgaaaagcctagggggcggaaggcggggcactggagcgcagggcgaaacactcggagagaagtggaagcgccaactcaaccaactatcaaagagcgagttcaacacctacaagcgctcaggaataatggaagtggacagatccgaagccaaggaaggcctgaaacgaggcgagaccaccaaacatgccgtgagccgaggcaccgcgaagttaagatggttcgtagaaagaaatctagtgaagccggagggcaaggtaatagacctcgggtgcgggagaggagggtggagctactattgcgcaggtctcaagaaagtaactgaagtcaaaggctacacgaaaggcggaccgggccatgaagaacccattcccatggcgacatatggatggaacctagtaaaacttcactcaggaaaggacgttttctttatgccaccagaaaagtgtgatacactactatgcgacattggcgagagcagtccgaaccccacaatagaagaaggcaggacactccgcgtattaaaaatggtggaaccatggctcagaggcaaccaattttgcataaagatactaaacccgtatatgccatccgtagtggaaactcttgagcaaatgcaacggaaacacggcggcatgctcgtgagaaaccctctatcgaggaactccacacacgagatgtactgggtcagctgcggaacaggaaacatcgtatccgcggtaaatatgacttcgcgaatgctactcaaccgctttacaatggcgcaccgtaaacccacatacgaacgagatgttgatctcggcgccgggacccgccacgtcgccgtagaaccagaagtagctaaccttgacataataggacaacgtatagaaaacatcaaaaacgaacacaaatccacctggcactatgatgaagacaatccctacaaaacttgggcataccacggatcgtatgaagtgaaacccagtgggagcgcaagcagcatggtgaatggagtcgtacgcctactcacaaagccctgggatgtcatacctatggtaacacagatcgctatgacggacacaacaccattcggccaacaaagggtctttaaagagaaagtagacactcgaaccccacgcgcgaagcgaggcacgacacagatcatggaggtgacggctaagtggctttggggatttctctcccgcaacaagaagccccggatatgtacccgcgaggagttcacaagaaaagttcgatcaaatgcggccatcggcgcagtttttgtagacgagaaccaatggaactccgcaaaagaagccgtagaagacgaaagattctgggacctagtccacagagagagagagttacacaagcaaggcaagtgcgcaacatgcgtctacaacatgatgggaaagagagagaagaaactaggtgagttcggaaaagccaaaggatcccgagccatctggtacatgtggctgggcgcaaggttcctcgagttcgaagccctcggcttcatgaacgaagaccattggtttagtcgggagaactcgctgtcgggagtagaaggcgaggggctacacaaactcgggtatatactccgagacatatctaaaatacccggagggaacatgtacgcagatgacacggcgggatgggatacacggataaccgaggacgacctgcaaaacgaagcgaaaatcaccgacatcatggaaccagaacacgctttgttggccacgagcatcttcaaactaacatatcaaaacaaagtcgtacgcgtacaacggccagccaaaaacggcaccgtcatggacgtcatctcccgaagggatcagcgaggctccgggcaggtaggcacctacggtctcaatacttttacaaacatggaggtacaactcataagacaaatggaatcagaagggatttttctgccgtccgaattagaaacacccaatctggcggaacgtgcactagattggctagaaaaacatggtgcggaacgactgaagcgtatggccatctccggcgacgactgcgtagtcaaacccatagacgaccgatttgccacagccctgacggcgctaaacgatatgggaaaagtacgcaaagacataccccagtgggagccgtcaaagggatggaatgactggcagcaggtcccgttttgtagccaccacttccaccaattgatcatgaaagacggaagagaaatcgtcgtcccgtgccgtaaccaagatgagctggtcggccgagcaagggtgtcccagggggccggttggtcgctgagagagactgcatgcctaggtaagtcctacgcgcagatgtggcagctaatgtacttccaccgcagagacttaagactggcagcgaacgcgatttgctccgccgtgccagttgactgggtacctgcaagccgaacaacatggagcatacacgctcaccatcaatggatgacgacagaggatatgttatccgtttggaatcgagtctggatcgaagagaacccctggatggaagacaaaacgcatgtttccagctgggaggaggtcccatacctgggcaagagagaagatcagtggtgcggatcgctgataggtctcaccgcacgcgcaacgtgggcgacgaacattcaggtggctataaatcaagttagacggctgatcgggaacgaaaactatctagattatatgacctcgatgaaacgttttaaaaacgagtctgaccctgagggggcgctctggtga

SEQ ID NO: 24672 - RNA, 9879 nt, synthetic construct
  misc_feature 1..9879: note = derived and/or modified CDS sequence (opt11) from DENV-1__KC692508__SS-prME
  source 1..9879: mol_type = other RNA
agcgtgaccatgctactcatgctcttacccaccgcactcgccttccatctgaccacaagggggggggaaccccacatgatcgtaagcaagcaagagcggggcaagagtctcctttttaagacctctgcgggtgtcaacatgtgcaccctgatcgccatggacctgggagaactatgcgaggacactatgacttacaagtgccccaggatcaccgaggccgagcctgacgacgtggactgctggtgtaatgctaccgacacctgggtgacctacgggacctgctcgcagacgggcgagcaccggcgcgaaaagcggtccgtggctctggcgccccatgtgggtctggggctcgagacccgcaccgaaacctggatgtcttccgagggggcctggaagcagattcagcgtgtcgagacctgggcgctgcgccaccccgggttcacggtgatcgccttcttcctggcgcacgccatcggcactagcatcacgcagaagggtatcatcttcatactgttaatgttggtcacaccctccatggcgatgcggtgtgtcggcatcggcaaccgcgacttcgtggaaggactcagtggcgccacttgggtcgacgtcgtcttggaacacggctcctgcgtgactactatggccaagaacaagccaaccctggacatagagctcctgaagacggaggtaaccaaccccgcggtgctgagaaagctgtgcatcgaggctaagatcagcaatacgaccaccgactcccgctgcccgacccagggcgaggcaacccttgtagaggagcaggacgctaacttcgtctgccggagaaccttcgtggatcggggttgggggaacggctgcgggctgttcggcaaaggtagcctcctaacctgcgccaagttcaagtgcgttaccaagctggaggggaagatcgtccagtacgagaacctcaagtactccgttattgtcaccgttcacaccggcgaccaacaccaagtgggtaacgagaccaccgagcatggcaccatcgcgacgataacaccacaggcgcccacgagcgagattcagttaaccgactatggcgccctgaccctcgattgcagcccccggaccggcttagacttcaacgaaatggtcttgttaacgatgaaggagaagtcctggctggtgcacaaacaatggttcctggatctcccgctgccctggacctctggcgccagcaccagccaggagacctggaaccggcaggacctcctcgtgacgttcaagaccgcacacgctaaaaagcaggaggttgttgtgcttggatcccaagagggagccatgcacaccgcactgaccggggccacggagatccagaccagcggcacgaccacgatctttgccgggcatctcaaatgcaggctgaaaatggacaagctgaccctcaaaggcatgtcctacgtaatgtgcaccgggtccttcaaactggagaaagaggtggcggaaacccagcacggcacggtgctagtgcaagtgaagtacgagggcaccgacgccccctgcaagatccctttctcgacacaagacgaaaagggggtgacccagaacggcagactgatcacggccaacccgatcgttaccgacaaggaaaaaccggttaacatcgagacagaaccccccttcggggagagctacatcgtggtcggggcaggcgagaaggcgctcaagctatcctggttcaaacgcgggagttccatcggcaaaatgttcgaggccaccgcccgcggcgcgcgccgcatggcaatcctgggcgacacggcgtgggactttgggtcgataggtggagtgttcacctccgtcgggaagttagtccaccaggtgtttggcaccgcctacggagtgctgttttcaggggtcagttggaccatgaaaatcgggatcggcatcctgctcacgtggctgggcctgaacagccggtccacaagtctctccatgacctgcatcgccgtgggcatggttaccctctacctgggcgttatggtgcaggccgacagcgggtgcgtgatcaactggaaggggcgcgaactcaagtgcgggtcggggatattcgtcacgaatgaggtacacacctggacggagcagtacaaattccaggccgacagcccgaagcggctctctgccgccatagggaaagcctgggaggagggggtgtgcggcatccgctctgcgacccgccttgaaaacatcatgtggaagcagataagcaacgaactcaaccatatcctgctggaaaacgatatgaagttcaccgtagtggttggggacgccaatggcatcctcgcgcagggcaagaagatgattcgcccgcagcctatggagcacaagtactcctggaagtcctggggaaaggccaagattatcggcgccgacatccagaacacgaccttcattatagacgggcccgacaccccggagtgccccgacggccagcgggcatggaacatctgggaggtcgaggactacggctttggcgtcttcaccaccaacatatggctgaagctgagggactcctatactcagatgtgcgatcaccgactcatgagcgcggcaataaaggacagcaaggccgtgcacgccgatatgggctactggattgagagcgaaaagaacgaaacctggaagctcgcccgcgcttccttcatcgaggtcaagacctgcacttggcccaagagccacaccctgtggagcaacggggtgctcgagtccgagatgatcatcccgaagatctttggcgggccgatctcacagcacaactaccggcccggctacttcacacaaaccgcggggccctggcacctgggcaagctcgagctagacttcgacctgtgcgagggcacgaccgtggttgtagacgagcactgcgggaaccggggcccgagcctacggactaccacggtgaccggaaagatcatccatgaatggtgctgtcgcagttgcacactgccccccctgcgattccgcggcgaagacgggtgctggtacggcatggagatccggcccgtcaaggagaaggaggagaacctggtgcgctctatggtgtccgccggcagcggggaggtcgacagcttctcccttggcattctgtgcgtgagcatcatgatcgaggaggtgatgcggtcccgctggagcaggaaaatgctgatgactgggacgctagcagtcttcctgctgctcatcatgggccagctgacctggaacgacctgattcgcctctgcatcatggttggggccaacgcgtccgaccgcatgggcatgggtaccacgtatctcgccttaatggctacgttcaagatgcgacccatgttcgccgtggggctgctgttccgccggttaaccagccgcgaggtcctcctgctgacgatcgggctcagcttagtggcctccgtcgagctgcccaactcgctagaggagctgggggatggcctggcgatgggcatcatgatgctcaagttgctgaccgagttccagccgcaccagttatggacgactctgctgagcctcaccttcgtgaaaaccacgctgagcctggactacgcatggaagacaacggccatggtcctcagcattgtctctttattccccctctgcctcagcacaacgagccagaagacgacctggttgccggtgctgctcgggtccttcggctgcaaaccactgaccatgttcctgatcaccgagaacaaaatctgggggcggaagtcttggcccctaaacgaggggattatggccatcgggatcgttagcatcctgctgtccagcctcctgaagaacgacgtacccctggcaggcccgctaatcgccggcgggatgctgatcgcatgctacgtgatctctggctcctccgcggacctgagccttgaaaaagccgcggaggtgagctgggagcaggaagccgagcactccggagcgtcccacaacatcctggtcgaagtccaggacgacggcacgatgaagataaaggacgaggagcgggacgacaccctgacgatcttgctgaaggctaccctgctcgccgtgtccggtgtctaccccatgagtatccctgcaaccctgtttgtgtggtacttctggcagaagaagaagcagcggtccggcgtcctgtgggacactccctccccgcccgaagtggagcgagccgtgcttgacgacgggatctaccggatcttacagcgcgggctcttgggtaggagtcaagtgggggtcggcgtgtttcaggacggggtgttccacaccatgtggcacgtcaccaggggtgccgtcctcatgtaccagggcaagcggcttgagccgagctgggcctccgttaagaaggacctgatcagttacggtggagggtggaggttccaaggatcttggaacacaggtgaggaagtacaagtgatcgccgtagagcccggaaagaacccgaagaacgtccagaccacccccggtacattcaaaacgcccgagggcgaggtgggcgcgattgccctcgacttcaaacctgggaccagcggctcaccgatcgttaatcgggagggcaagattgtcgggctttatggcaacggggtggtgaccacgagcggaacgtacgtctccgcgatcgcccaagctaaggcaagccaggaggggcctctgcccgagatagaggacgaagtgttcaaaaagcgcaacctgacgattatggacctacacccgggcagcggcaagaccaggcgctaccttcccgccatagtcagagaggccatcaagcgcaagctcaggacactgatcctcgcccccacgcgggtcgtcgcttccgagatggcagaggctctcaaagggatgcccatccgctatcagaccaccgcagtcaagagcgagcacaccggtcgggaaattgtggaccttatgtgccacgccacgtttaccatgcgcctgctctcccctgttcgggtccccaactacaatatgatcatcatggacgaggcgcatttcaccgatcccgcctccatcgccgctcgcgggtacatctccacccgagtcggcatgggcgaggccgcggcaatatttatgacagccacgccgccaggatcagtggaggccttcccacaatctaacgccgttatccaggatgaggagcgcgacatacccgagaggagctggaactccggctacgactggatcaccgacttcccgggaaagacggtgtggttcgtgcccagcataaagtctggaaacgacattgcgaactgcctccgcaagaacggaaagcgggtgatacaactcagtagaaagacgttcgacactgagtaccaaaagaccaaaaacaacgattgggactacgtcgtcaccactgacatcagtgaaatgggcgcgaattttcgggccgaccgcgttattgacccccggcgctgcctcaagcccgtcatcctgaaagacggtcccgagagagtcatcctggcgggcccgatgccggtcacggtggcgagcgccgctcagcgccggggacgtatagggcgcaaccaaaacaaggagggcgaccaatacgtgtacatgggtcagcccctcaacaacgacgaagagcacgcccattggaccgaagccaaaatgctgctggacaacataaacacccccgagggtattattccggctctcttcgagcctgagcgggaaaagtccgccgccatcgatggtgaataccgcctgcggggcgaggccagaaagacgttcgtcgagctcatgcggcgcggggacctgccagtgtggctgagctacaaggttgcttccgaaggtttccagtactccgaccggagatggtgctttgatggagagagaaataatcaggttctggaagaaaacatggacgtcgagatctggacaaaggagggggagcgcaagaaactccggcctcgctggctagacgcccggacatactctgacccgcttgccctccgcgaattcaaagagtttgccgccggccgccgaagcgtgagcggcgacctcattctggagatcggcaagctccctcagcacttgaccctgcgcgcacaaaacgcgctagacaacctagtcatgttacataactccgagcaaggcgggaaagcataccgccatgccatggaggagttgcccgacacaatcgagacgcttatgctcctcgccctgatagccgttctgactggcggggtgaccctcttcttcctgagcggcaaagggctggggaagacttccatcggcttgctgtgcgtgacggcaagctccgctctgttatggatggcctcagttgagccccactggatcgccgcgtcaatcatcctggagttcttcctgatggtgctcctaatcccggaacccgaccggcagcgtacgccccaagacaatcagctggcttacgtagtgatcgggctcctgttcatgatactgaccgtggcagccaacgagatgggccttctggagaccacgaagaaagacctagggatcggctacgtcgccgccgagaaccaccagcacgccaccatgctcgacgtggatttgcatccggctagcgcatggaccctttacgctgtcgcgaccacagtgatcacccccatgatgaggcacaccattgaaaacaccacggctaatatctccctaacagctatcgccaaccaggccgcaatcctcatgggactggacaaagggtggccgataagcaagatggacataggcgtaccactccttgccctggggtgttactcccaggtgaaccccctcactctaaccgcggccgtcctaatgctcgtggcgcattacgccatcatcggccccggcttgcaggccaaagccacgagagaagcccagaagcgcaccgcggccggaataatgaagaacccaactgtggatggcatcgtcgctatcgacctggacccagtagtctacgacgccaagttcgagaagcagctcgggcagatcatgttgctgatactctgcaccagccagatattgctgatgcgcaccacctgggccctgtgcgagtccatcaccctggcgactggcccgctcacgaccctgtgggagggctcgccgggcaagttctggaacaccaccatcgccgtgtccatggccaacatattccgcggcagctacttggcaggggccggcctggccttctccttaatgaagtccctcggcggcgggcggcgaggcacgggcgctcagggggaaaccttgggcgagaagtggaagcggcaactgaaccagctgtccaaatcggaattcaacacatacaagcgcagcgggataatggaggtagaccggagtgaggccaaagaaggtctgaagcgtggcgagaccacgaagcacgccgtgtcgaggggcaccgcgaagctccgttggttcgtagagcggaacttagtgaagcccgaaggaaaggtgatagacctgggctgtgggagggggggctggagctactactgcgccgggctgaagaaggtaaccgaggtgaagggttataccaagggcgggcccgggcacgaggagccgatcccgatggccacctacgggtggaatctggtcaagctgcactccggcaaggacgtctttttcatgccccccgagaagtgcgatacgctgctctgtgacatcggggagagtagcccgaatccgaccattgaggagggtagaaccctacgcgtcctaaaaatggtggagccctggctccgaggcaaccagttttgcattaagatcctgaacccgtacatgccttccgtcgtagagactctagaacagatgcagcgcaaacacggcggaatgctcgtgcggaaccccctaagccgaaactcaacgcacgagatgtactgggtgagctgcgggaccggcaacatcgtgtccgccgtgaacatgacaagcaggatgctgctgaaccggtttaccatggcccacagaaagcccacctacgagagggatgttgacctgggcgcggggacccgacatgtagccgtggagcccgaagtggccaatctggacatcataggccagcgtatcgaaaacatcaagaacgagcacaagtccacgtggcactacgacgaggataacccatacaagacttgggcataccacgggtcatacgaagtgaagccctcaggcagcgcctcctcaatggtcaatggggttgtgcgcctcctgacgaagccctgggacgtcattccaatggtgacccaaattgcgatgacagacaccactccgttcgggcagcagcgagtgttcaaggagaaagtcgataccagaacaccccgggccaagcgcggaacgacgcagataatggaggtgaccgcaaagtggctgtggtccttcctcagcagaaacaaaaagcctcgcatctgtacccgggaggagttcacccgcaaggtgcgctcgaacgccgccatcggtgcggtctttgtggatgagaaccaatggaactccgccaaggaggccgtggaagacgagcgattctgggacctggtccaccgggagcgcgagctgcacaagcaaggcaagtgcgcgacgtgcgtatataacatgatgggaaaacgggagaagaagctcggcgagttcggcaaggcgaagggcagccgcgccatctggtatatgtggctaggcgcccggttcttagagttcgaagcgctcggcttcatgaatgaggaccattggttctcccgcgagaatagcttgtccggcgtggaaggcgagggtctgcacaagctcggatacatcctgcgggatatctctaagatcccgggtggaaacatgtacgcggacgacacggcggggtgggacacccgtataactgaggacgacctgcagaacgaggccaaaataacggacatcatggagcccgaacatgctctcctggccacctccatctttaagctgacgtaccaaaacaaggtcgtgcgagtccagaggcccgccaagaacggcaccgttatggacgtgataagcagacgagaccaacgcggaagtggccaggtgggcacctacgggctcaataccttcaccaacatggaggtccagctgattcggcagatggagagcgagggcatcttcctgccatccgagctcgagactccgaacctggcagagcgcgccctggattggttagagaagcacggggccgagcggctgaagcgcatggccatcagcggtgatgactgcgtggtgaagcccatagacgatcggttcgccactgcgctgaccgccttaaacgacatggggaaagttcgcaaagacatccctcagtgggagccatccaaaggctggaacgattggcaacaagtgccgttttgcagccaccacttccaccaactgatcatgaaggacggccgggagatcgtggtcccctgccgcaaccaggacgagttagtggggcgtgcccgcgtgtcccagggcgcagggtggagcctccgggaaaccgcatgtctgggaaaatcctacgctcaaatgtggcaactgatgtacttccaccgccgggatctccgcctggccgcaaatgccatctgctccgccgtacccgtggactgggttcccgcctctcgtactacttggtctattcacgcccatcaccagtggatgacgacagaggatatgctgagcgtgtggaaccgtgtgtggatcgaggagaacccgtggatggaggacaaaacccacgtgtctagctgggaagaggtcccctacctggggaagcgggaggatcagtggtgcgggtccctgatcggcttaacggcccgggcaacttgggcaaccaacatacaagtggcgataaaccaggtgcgacggctcattggaaacgaaaactacctggactacatgaccagcatgaaacgcttcaagaacgagagtgaccccgaaggcgctctgtggtga

SEQ ID NO: 24673 - RNA, 9879 nt, synthetic construct
  misc_feature 1..9879: note = derived and/or modified CDS sequence (opt11) from DENV-1__KC692509__SS-prME
  source 1..9879: mol_type = other RNA
tccgtgaccatgcttctaatgctgctgccgactgcattggccttccaccttaccactcgtggaggggaaccccacatgatcgtgagcaaacaggagcgggggaagtcgctactgtttaaaacgagcgccggtgtgaacatgtgtaccctgatcgccatggacctgggggagttatgcgaggacactatgacctacaagtgcccccggatcactgaagccgagccggatgacgtcgactgctggtgcaacgccaccgatacctgggtgacctacgggacttgcagccagaccggagagcaccggcgcgaaaagcggtccgttgccctggctccccatgtgggcctcggcctcgagacccggaccgaaacctggatgtcctccgaaggggcctggaagcagattcagcgcgtggagacctgggccttgaggcatcccgggttcacggtgatcgccttcttcctcgcgcatgccatcggcacctcgatcacccagaaggggatcatattcatcctcttaatgttagtcaccccgtccatggccatgcgctgcgtcggaattggcaaccgcgacttcgtggaggggctctccggcgccacgtgggtggacgtcgtgctcgagcatggatcctgtgtgaccaccatggccaagaataagcccaccctggacatcgagctcctaaagacggaggtcaccaatcccgcggttttacgtaagctctgcatcgaggccaagatcagcaacaccacaacggactcccgctgtccgacccaaggcgaagccactctggtggaggagcaggacgccaactttgtctgccggcgaaccttcgtggaccggggctgggggaatggttgcgggctgttcggaaagggctctctcctgacgtgcgcaaagttcaagtgcgtgaccaaactggagggcaagatcgttcagtacgagaacctcaagtactctgtgatcgtgaccgtgcatactggcgaccagcaccaagtgggcaatgagacgactgagcatggcaccatcgcgacgataacgccccaggcccccacaagcgagattcagctgacggattacggcgccttgactctcgactgctcaccccggaccggcctggatttcaacgagatggtcttgttgactatgaaggagaagtcctggctggtgcacaagcaatggttcctcgacctccctctgccatggacatccggcgccagcaccagccaagagacctggaaccggcaggacctcctcgtgacgtttaagactgcacacgcgaagaaacaggaggtagtcgtgctcggctcccaggagggcgccatgcacaccgccctgaccggggccacggagatccagacaagcggaactacaacaattttcgcaggtcacctaaagtgccgcctgaaaatggacaagttgactctcaagggcgtctcttacgtgatgtgcaccggcagcttcaaactggagaaagaggttgcggagactcagcacggtacggtgctggtacaggtaaagtacgaaggcacagacgccccttgcaagatccccttcagtactcaagacgagaagggggtcacccagaacggcaggctaatcactgcaaaccccatcgtgaccgataaagaaaaaccagtgaacatcgagaccgagccgccctttggggagagctatatcgtcgtgggtgccggcgaaaaggcactgaagttgtcttggttcaagcgcgggagctccatcggcaagatgttcgaagccacagcccgcggggcgcgacggatggccatcctgggcgacactgcgtgggacttcgggtctatcggcggcgtgttcacctcggtcgggaaactcgtacatcaggtgttcggcaccgcctatggggtcctgttcagcggcgtttcatggaccatgaagatcgggatcggtatcctgcttacgtggctggggctaaatagccggtccacctctctctccatgacttgcatagccgtgggcatggtcaccttatacctgggagtgatggtgcaggccgacagcggatgtgtcatcaactggaagggccgcgagctcaagtgcgggtccggaatcttcgtcacgaacgaggtgcatacttggaccgagcagtacaagttccaggccgacagcccgaagcgcctctcagcggccatcggcaaagcctgggaggagggggtatgtggcatccggtccgccacccggctggaaaatatcatgtggaaacaaatcagcaacgagctcaaccacatcctgctggagaacgacatgaaattcacggtggtggtcggcgatgccaacggcatcctcgcgcaggggaagaagatgattagaccgcagcccatggagcacaagtattcatggaaaagctggggcaaggctaagataataggagcagacatacagaacacgaccttcatcatcgacgggcccgataccccggagtgccctgacggccagcgggcatggaacatctgggaagtggaagactacggattcggagtgttcaccacgaatatctggcttaagctgcgcgattcatacacccagatgtgcgaccaccggctcatgtcagcggctatcaaggactccaaagctgtccacgccgacatgggctactggattgagagcgagaagaatgagacatggaagctggcgcgggcgtcctttatcgaagtaaagacctgcacgtggcccaaaagccacactctgtggtccaacggagtgttagagagtgagatgatcatccccaagatattcggtgggccgatttcccagcataactatagacccggttatttcacccagacggcagggccctggcacctgggcaaactagagctcgacttcgacctgtgtgaggggaccaccgttgtggtagacgagcactgcggcaatcgcggaccgtcgttacggaccaccacggttaccgggaagatcatacacgaatggtgctgccgatcctgcacactgccgcccctccggttccgcggcgaggacgggtgctggtacgggatggagatccggccggttaaagaaaaggaagagaacctggtgcgcagcatggtatccgctggctccggggaggtggacagcttctcgttgggcatcctctgcgtcagcatcatgatagaggaggtaatgcggtcccgctggagtcgcaagatgctgatgactgggacgttggccgtttttctgttgctcatcatgggtcagctgacctggaacgacttaattcggctctgcatcatggtgggggcaaatgcgtccgatcgcatgggcatgggcaccacctacctggccctgatggccacatttaagatgagaccgatgttcgccgtcggtctcctgttccgccgactgacgagccgagaggttctcttattgaccatcggtctatccctggtagcaagcgtggagctgcccaactctctggaggagctgggcgacggcctggcgatgggcataatgatgctcaagctgctaaccgaatttcagccccaccagctctggaccacactgttaagcctcaccttcgtccggaccactctgagtctggactacgcttggaagaccaccgccatggtcctcagcatcgtgtccctcttccccctgtgcctcagcaccacgtcccagaagacaacctggcttccggtgctgcttggcagcttcggctgtaaacccctgaccatgttcctgatcaccgagaacaagatctgggggcgcaagtcatggccactcaacgagggtatcatggccatcggtatcgtcagcatactgttgtcatctctcctgaagaacgacgtgccccttgcgggcccactcatcgcgggcgggatgttaatagcctgttacgtgatcagcggctccagcgccgatctctccctcgagaaagcggctgaggtcagctgggaacaggaggccgagcactcgggggcgagccacaacatactggtagaggtccaggacgacggcacgatgaagataaaggacgaggagagagacgacaccctgaccatcctcctgaaggccaccctgctcgctgtcagcggggtgtacccgatgagcatccccgcaacgctgttcgtgtggtacttctggcagaagaaaaagcagcgcagtggggtcctgtgggacacacctagtcctcccgagatggagcgggccgtgctcgacgacggcatctatcgtattctacaacggggtctgttgggcaggtcccaggtaggcgtcggcgtgtttcaagatggagtattccataccatgtggcacgtgaccagaggggcggtattgatgtaccagggcaagcgcttagaaccctcttgggccagtgtgaagaaagacctgatctcatacgggggagggtggaggttccagggttcctggaacacgggagaggaggtacaggtgatcgccgtggagcccggcaagaatcccaagaacgtccaaaccacccccgggacgttcaagacacccgagggggaggtgggcgcgatcgcgctagacttcaagcccgggacctctggctccccgatcgtgaaccgcgagggcaagatcgtcgggctgtacggcaatggggtcgtaaccaccagcggcacttacgtatccgccatagcccaagccaaagcgagccaggaggggccgctaccagaaatagaggatgaggtgttcaaaaagcgcaacctcaccataatggacctgcacccgggcagcggcaagacacgccggtatctacccgccatcgtgcgcgaggcgatcaagagaaaactacggaccctgattctggctcctacgagggtcgtggcgtctgaaatggccgaagcgctcaaggggatgcccatcagatatcaaaccaccgccgtaaagagcgagcacaccgggcgcgagattgtcgacctgatgtgccatgcaacgttcaccatgcgactattatcacccgtgcgcgtgcccaactacaacatgatcattatggatgaagcgcacttcaccgaccccgcgagcatcgccgcccggggatatatctccacccgcgtgggcatgggggaggccgcggccatcttcatgacggccacgccacccggcagcgtagaagcctttccacagtcgaacgccgtgatccaggacgaggaacgggacatcccggaacggagttggaactccggctacgactggataaccgacttccccgggaagaccgtctggttcgtgcccagcatcaagtccggaaatgacatcgcgaactgcctgcggaagaatgggaagcgcgtgattcaactgagccgaaagactttcgacactgaataccagaagactaagaacaacgactgggactacgtcgtgaccacagatatctctgagatgggggccaacttccgtgccgatagagtgatcgaccctcgccggtgcctcaagcctgtcatcctgaaggacgggcccgagcgcgtgattctggccggtcctatgcccgttacggttgccagcgcagctcaacggcgcggccgcatcgggcgtaaccagaacaaggagggcgaccaatacgtttacatgggacagcccttaaataacgacgaggaccacgcccactggacagaggccaagatgctgctggacaacatcaacactcccgaaggcatcatcccagctctcttcgagccagagcgcgagaagtccgcagccatcgacggggagtaccgactgcgcggcgaggcgcgaaaaaccttcgtcgagctgatgcgccggggtgacctccccgtgtggctgagctacaaggtggcgagcgagggattccagtacagcgaccgtcggtggtgcttcgatggcgagcgaaacaaccaggtcctggaagagaacatggacgtagaaatctggaccaaggagggggagagaaagaagctccgcccaagatggctggacgcgcgcacatactccgacccgctagccctccgcgagttcaaagagttcgctgccggccgtcgtagtgtgagcggcgatctcatcttggagattgggaagctaccccagcacctgacccttcgcgctcagaatgccctcgataatctggtcatgctacacaattccgagcaaggcgggaaggcttacagacatgccatggaggagctccccgataccatagagacgttaatgctgctcgccctcattgcggtgttgaccggcggggttaccctcttcttcctcagcggcaagggccttgggaagacctccatcggccttctgtgcgtcacggcgtcttctgccctgctgtggatggcctcagtggagccccactggatcgccgcgtccatcatactggagttcttcctcatggtgctcctgatcccggagcccgatcggcaacggactccccaggacaaccagctggcctacgtcgtgatagggctcttatttatgatcttaacggtggccgccaacgagatgggactcctggagaccacgaagaaagacctggggatcggatacgttgccgccgagaaccaccagcatgcgactatgttggacgtagatctgcacccggctagcgcctggaccctgtacgcagtggcaactacggtcatcacccccatgatgcgtcacacaatcgagaatacgacagccaacatttccctcaccgcaattgccaatcaggccgcgatcctgatgggcctggacaaggggtggccaatcagcaagatggacatcggagtgcctctcctggcgctgggctgctactcccaggtgaacccactcaccctgacggcggccgttttaatgttagtggcgcactacgccatcatcggccccggactgcaggccaaggccacccgcgaggctcagaagaggaccgcggccggtatcatgaagaatccgaccgtggacggcatcgtcgccatcgatctggatccggtggtttatgacgcgaaattcgagaagcagctgggccagattatgctgctgatcctctgcacaagccagatactcctgatgagaacgacctgggctctgtgcgagtccattaccctggcgaccggcccgctcaccaccctctgggaggggagcccgggcaagttctggaataccacgatcgcagtttccatggctaacatcttccggggtagctatctggccggggcgggccttgcgttctcactcatgaaatctctcggtggtgggcgccggggaacgggcgcacagggggaaaccttaggagagaagtggaagcgccagctgaaccagctatccaagagcgagttcaacacctacaagcggtccgggatcatggaggtggaccgatccgaggcgaaggagggcctgaagagaggggaaaccacgaaacacgccgtttccaggggcactgcgaagctccggtggttcgtagaaaggaacctggtgaagcccgagggcaaggtgatagacctggggtgcggccggggtgggtggtcctactactgcgctgggctcaaaaaggtcaccgaggtgaagggctatacaaagggaggccccggccacgaggagccgatccccatggccacctatggatggaacctggtgaaacttcacagcggtaaggatgtgttcttcatgccgcccgagaagtgtgataccttgttatgcgacatcggggaatcctcgccgaatcccaccatagaggaggggcgcaccctgcgagtgctgaaaatggtggagccctggctccgcggcaatcagttctgcatcaagatcctgaacccctacatgccatcagtcgtggaaaccctggaacagatgcagcggaagcatgggggtatgcttgtgcggaaccccctgtcacggaactcaacgcacgagatgtactgggtcagctgcgggacaggaaacatcgtttccgccgtgaacatgacctcgcgcatgctgctaaaccgcttcactatggcccaccggaagcccacttacgagcgcgacgtcgatctgggcgcggggacccggcacgtagccgtggagccagaggtcgccaacctggacatcattggccagcgaatagagaacataaagaacgaacacaagtccacctggcactatgacgaggacaacccctataagacatgggcctaccatggcagctacgaagtaaagccttccggcagcgcctctagtatggtgaacggggtggtgagactcctgaccaagccgtgggacgtaatccccatggtgacccagatcgcgatgaccgacacgacgccgttcgggcagcagcgcgtgttcaaggagaaggttgacacccggacgccccgagccaagcgtggcaccacgcagattatggaagtgaccgccaagtggctatgggggttcctctcccgaaacaagaaaccccgaatctgtacccgcgaggagttcacgaggaaggtgcgcagcaacgccgccatcggggcagtttttgttgacgagaatcaatggaacagcgccaaggaggccgtggaggacgaacggttctgggatctggtccatcgcgagcgggaactgcataagcaggggaagtgcgccacatgtgtgtacaatatgatgggaaagcgcgagaagaagctcggagagttcggcaaggcaaaaggttcccgggctatttggtatatgtggttgggggcccgcttcctggagttcgaggccttgggctttatgaatgaagaccactggttctcacgggagaactcactgagcggggtggagggggaagggctgcacaagctggggtacatcctgcgcgacatatccaagatcccaggagggaacatgtacgccgacgacacagcgggctgggacacccgcatcacagaggacgatttacagaacgaggccaagatcacggacataatggagcctgagcatgcgctcctggcgaccagtatatttaaactgacgtaccagaacaaggtcgtgcgggtgcaaagaccagccaaaaatgggaccgtcatggacgtgatctcccgccgcgaccaacggggctctggacaggtgggtacgtacggcctcaacaccttcacaaacatggaggtccagctgatacgccagatggagtccgaggggattttcctgcctagcgagctcgaaacacccaacttagcggagcgggccttggactggttggagaagcacggcgccgagcgcctgaagcgtatggccatcagtggggacgactgcgtggtgaagcctatcgacgatcgcttcgccactgcgctgacagccttgaacgatatggggaaagtacgtaaggacattccccagtgggaaccaagcaaaggctggaacgactggcaacaggtccctttttgctcccaccacttccatcagttaataatgaaggacggtcgcgagatcgtggtcccctgccgtaaccaggatgagttagtgggccgcgcgcgcgtcagtcaaggggcgggctggtccctccgcgagaccgcctgccttggtaagagctacgcgcagatgtggcagcttatgtacttccaccggagagacctgagattggctgccaacgctatctgttccgcagtcccggtggactgggtgcccgccagccgcactacctggtccatccacgcccaccaccaatggatgacaactgaagacatgctctccgtctggaaccgtgtgtggatcgaggagaacccgtggatggaagacaagactcacgtatcatcctgggaggaagtcccctatttgggcaaacgggaggaccagtggtgcggcagcctgatcgggctgactgcacgcgccacatgggccacgaacattcaagtcgcgatatcccaggtgcggcgcctcattggcaacgagaattacctagattacatgaccagcatgaagcggtttaagaacgagtccgaccctgagggggctctgtggtaa

SEQ ID NO: 24674 - RNA, 9879 nt, synthetic construct
  misc_feature 1..9879: note = derived and/or modified CDS sequence (opt11) from DENV-1__KC692510__SS-prME
  source 1..9879: mol_type = other RNA
agcgtgaccatgctgctcatgctgctgcctaccgcgctcgccttccacctgaccaccaggggcggggagccccacatgatcgttagcaagcaggagcggggcaaaagcttactgttcaagacatccgcgggggtgaacatgtgcaccctgatcgccatggacttgggcgagttatgcgaggacaccatgacgtacaagtgcccccggatcaccgaggctgagcccgacgacgttgactgctggtgcaacgccaccgacacctgggtcacctatgggacctgcagccaaactggcgaacaccggcgcgagaagcggtccgtggccctggcgccccacgttggcctggggttggaaacccgcaccgaaacatggatgagcagcgagggtgcctggcgacagatccagcgcgtcgaaacctgggcgctccggcaccccgggttcacggtgattgccttctttctggcgcacgccataggcacctcaatcacacagaaagggatcattttcatactcctgatgctagtgaccccctccatggcaatgcgctgtgtaggcatcggcaatcgggacttcgttgaggggctttcaggcgccacgtgggtggacgtcgtgctggagcacgggtcctgcgtcaccaccatggctaagaacaagcccaccctggacatcgagctcctgaagaccgaagtcaccaacccggcggtgctgaggaagctctgcattgaggctaagatcagcaacacaacgactgactcccggtgcccaacccagggcgaggccaccctggtggaggaacaggatgccaacttcgtctgtagacggaccttcgtggaccgtggctggggcaacggctgcgggctgttcggcaaggggagcctcctgacgtgcgcaaagtttaagtgcgtcaccaagctggagggaaagatcgtccaatatgagaacttgaagtactccgtgatcgtcaccgtgcatacgggggaccaacatcaggtgggcaatgagacaacagagcatggcaccatagcgaccatcacaccgcaggcccccactagcgaaatccagctgacagactatggggcactcaccctcgactgctcaccccgcaccggcctcgatttcaacgagatggtcctgctcactatgaaggagaagtcctggttggttcacaagcagtggttcctggatttgccgttaccttggacctccggggcctcgaccagtcaggagacctggaaccgccaggacctgctcgtgaccttcaagaccgcccacgcaaagaagcaggaggtcgtcgtgttaggctcgcaggagggggccatgcacaccgcgctgaccggagccacagaaatccagacgtcaggcacgaccacgatcttcgccggacacctcaagtgccggttgaaaatggataagctaaccctcaagggcatgtcctacgtcatgtgcaccgggagcttcaagctcgagaaagaggtggcggaaacccagcacggcactgtactggtccaggtgaagtacgagggtaccgatgcaccttgcaagatccccttttccactcaggacgagaagggggtgacacagaacggccggcttatcacggccaacccgatcgtcaccgacaaggagaagcccgtgaatattgagaccgagccacctttcggggagagctacatagtggtcggagcaggtgagaaggcgctcaagctgtcctggttcaagcgagggagctccatcggtaagatgttcgaggccaccgcccgaggggcccgccggatggcgatcctgggcgatacggcctgggacttcggatcaatcggaggcgtgttcacctccgtggggaagcttgtccaccaggtgttcggcacagcctacggggtactgttctcgggcgtgtcgtggaccatgaaaatagggatcggcatcctgctcacttggttaggcctgaacagccgcagtacgagcctctccatgacctgcatcgccgtcgggatggttaccctttacctgggcgtcatggtgcaggcggactcaggatgcgtgataaactggaagggccgggaactcaagtgtgggtcaggtatcttcgtcacgaatgaggtgcacacctggactgagcaatacaaattccaggcagactctccgaagcgcctaagcgcggcgataggtaaggcctgggaggagggggtgtgcggcatcagatccgccaccaggctggagaacatcatgtggaagcagatctcgaacgagctcaaccacatcctgctggagaacgacatgaaattcactgtcgtggtgggggatgccaatggcatccttgcccaggggaagaagatgattcggccacagcccatggagcacaagtactcctggaagtcctggggcaaggccaagatcatcggcgcggatatccagaacacgacattcatcatcgacgggcccgatacgccggagtgcccagatggccagcgagcctggaatatctgggaggtcgaggactacgggttcggcgtattcaccacgaacatctggttaaagctgcgggactcatatacccagatgtgcgatcaccggttgatgagtgcggcaatcaaagactccaaggcagtgcacgccgacatgggctactggatcgagtccgaaaaaaacgaaacctggaagctggcccgggcgtccttcatcgaggtcaagacctgcacctggcccaagagccataccctgtggtctaacggggtcttagaaagcgagatgattatccccaagatattcggcgggccgatatcccagcacaactatcgcccgggctatttcacacagaccgccgggccctggcaccttggcaagctcgagctcgacttcgacctctgcgagggcactaccgtggtcgttgacgagcactgcggaaatagaggtccgagcctgcgcaccaccacggtcaccgggaagattatacacgagtggtgttgccggtcctgtaccctgccccccttacgatttcggggagaagacgggtgttggtacggcatggagatcaggcccgttaaggagaaggaggaaaacctggtgcggagcatggtgagcgctggctcgggggaggtcgatagcttctcccttggcatcttgtgcgtgtctattatgatcgaggaggtgatgcgctcacgctggagccgtaagatgttgatgaccgggacgctcgccgtcttcctgttgctcatcatgggccagctgacatggaacgacctaatccgcttgtgcataatggttggtgccaacgcgtcagaccggatgggcatgggcaccacctatcttgcccttatggcgacgttcaagatgaggccaatgtttgcggtgggtctccttttccggcgcctaacgagccgggaagtcctcctgctgaccataggcctatctttggtagcaagcgtcgagctgcccaatagcctcgaggaactgggggatggcctggctatggggataatgatgctcaagctgttgaccgagttccagcctcaccagctttggacgaccctgctgagcctgacattcgttaagacgaccttgagtctggattacgcctggaaaaccaccgccatggtgctcagcatagtcagtctgttccctctgtgcctcagcaccacttcccagaagactacctggctgccagtgcttttggggagcttcggttgtaagcccctgacaatgtttctgatcaccgaaaacaagatctgggggcgcaagtcctggcccctcaacgagggcatcatggccatcgggattgtaagcatcctgctgtcgagcctcctgaagaacgacgtccccctcgcaggcccgctcattgcgggggggatgctgatcgcctgctacgtgataagcggctccagcgctgatctgtccctggagaaggccgcggaagtcagctgggagcaagaggccgagcattccggggccagccataacatcctggtcgaggtgcaggacgatggcacgatgaagatcaaggatgaggagcgggacgacaccctgactatcttgctgaaggccacactcttagccgtgtccggggtctaccccatgtcaatccccgcgacgctgttcgtgtggtatttctggcagaagaagaagcaacgctccggcgtgctgtgggacacgcccagcccgccagaggtcgagcgcgccgtgctcgatgacgggatataccgcatcctgcagcgggggctgctgggccgctcccaggtgggagttggcgtgtttcaagacggggttttccacaccatgtggcacgtcaccaggggcgctgttctaatgtaccaaggcaagcgcctggagccctcttgggccagcgtgaagaaagacctaatcagctacggtggcgggtggcggttccaaggatcctggaatacgggggaggaggtacaggttatcgccgtggaacccggaaagaatccaaagaacgtccagaccacccctggcaccttcaagacacccgaaggggaggtgggcgcaatcgcactcgacttcaagccagggaccagcggctctccaatcgttaatcgcgagggcaagatagtcgggctgtacggcaacggggtggtgaccacctctggcacgtacgtctcggccatcgcccaagccaaggcgagccaggaagggcccctgcccgagattgaggatgaggtgttcaagaagcggaacctcaccatcatggatctccaccccggcagcggaaagacccgtcgctacctgcccgcaattgtgcgcgaggccatcaagcggaaactccggactctgatcctggcccccacgagagtcgtagcctcagagatggccgaggccctcaaggggatgcctatccggtatcagacaaccgcagtcaagagcgagcataccggccgcgaaatcgtcgacctgatgtgccacgccacgttcaccatgcggctgctctccccggtgcgcgtgcccaactacaacatgatcattatggacgaggcgcatttcaccgaccccgcgagcatcgccgctcgtgggtatatctccactagggtcgggatgggggaggcagcagccatctttatgacggctacgccgcccggaagcgtagaggccttcccccagtcaaacgccgtgatccaggacgaagaacgggacatccccgagcgtagctggaacagtggctacgactggatcaccgacttccccgggaagaccgtatggttcgtccctagcatcaagtccggcaatgacatcgcaaactgcttacgaaagaacggaaaacgcgtgatccaacttagccggaagacgttcgacaccgaatatcaaaagaccaagaacaatgactgggactacgtcgtgaccacggacatctccgagatgggcgccaatttccgcgctgaccgggtgatcgacccaagacgttgcctaaagcctgtcatattgaaagacggtccagagcgcgttatcctggccggcccgatgcccgtaaccgtggcgagtgccgcccaaaggcgtggccggatcggacggaaccaaaacaaggagggcgaccaatacgtgtacatggggcagcccttgaacaacgacgaggatcacgcccactggaccgaggccaagatgctgctggacaatatcaacacccccgagggcatcatccccgcactcttcgaacccgagagagagaagtctgccgccatcgacggggagtaccgcctacgcggcgaggcgcgaaagactttcgtcgagctgatgcgccggggcgacctccctgtgtggctgagctacaaggtcgcatccgagggcttccagtactccgaccgccggtggtgcttcgacggggagcggaacaaccaggtcctggaggagaacatggacgtcgaaatatggaccaaggagggggagcggaagaagctccgcccgcgttggctggacgcgaggacctacagtgacccgctggccctccgagagttcaaggagtttgccgccggtagacggagcgtaagtggcgacctgatactggaaatcgggaagctccctcagcacctgaccctccgcgcgcagaacgcgctcgacaatcttgtcatgctccacaactccgagcaaggcggtaaggcctaccggcacgccatggaggagctgcccgacacgatcgagacgctgatgctccttgccctcatcgcggtgctcaccggcggggttacactcttcttcctgtccggcaagggcctggggaagacctccataggcctcctgtgcgttacggccagctccgccctcctttggatggccagcgttgagccccactggatcgccgcatccatcatactcgaatttttcctgatggtgctgctgatcccggaacccgaccgccagcggacgccacaggacaaccagttggcgtacgtcgtcatcgggctactgttcatgatcttaacggtggccgccaacgagatgggcctcctggagacgacgaagaaggacctggggataggctacgtcgccgcggagaaccatcaacatgcaaccatgctcgacgtggatctgcacccagcctctgcctggaccctgtatgcagtggcgaccacagtcatcacgcccatgatgcgccataccatcgaaaataccacggcgaacatctccctcacggcgatcgcgaaccaggccgcgatcctcatgggcctggacaaggggtggccaataagcaagatggacatcggggtgccccttctggcgctgggctgctactcccaagtgaacccgctaaccctgaccgccgccgtcctgatgctcgtggcccattacgccatcatcggcccaggactgcaggccaaggccacacgggaggctcagaagcggactgcagccggcatcatgaagaatcccaccgtggacggcatcgtcgccatcgacctggaccccgtggtgtacgacgccaagttcgagaagcagctcgggcagatcatgctgctgatactctgcactagccaaatcctgctgatgcgcacgacctgggctctgtgcgagtccatcaccctggcgactggcccgctcacgaccctatgggaggggagccccggtaagttctggaacaccaccatcgctgtctccatggcgaatatatttagaggcagctacctggcaggggccgggctagccttctccctcatgaagtccctcgggggtgggcgcagagggacgggcgcccagggggaaaccctaggtgagaagtggaaacgccagctcaaccagctttcaaagagcgagttcaacacatacaagagaagcgggatcatggaagtagatcgctccgaagccaaggagggcctgaagcgcggggagaccaccaaacacgccgttagccgcgggactgcgaagctacgatggtttgtcgagagaaacttggtgaaacccgagggcaaggtcatcgacctgggatgcggccgcggaggatggagctattactgcgccgggctgaagaaggttaccgaagtgaagggctatacaaagggcggtcccggccacgaagagccgatccccatggccacgtacgggtggaatctcgtgaagctgcacagtggcaaggacgttttcttcatgccaccggagaaatgcgacaccctgttatgtgacatcggggaatccagcccgaacccaaccattgaggagggccgcaccctgcgggtgctgaagatggtggaaccctggctccgaggaaaccaattttgtatcaagatcctgaacccctacatgccgtcagttgtagagaccctggaacagatgcagcggaagcatgggggcatgctcgtgcgcaatcctctgagccggaattctacgcatgagatgtattgggtcagctgtgggaccggcaatatcgtatccgccgtgaatatgaccagccgcatgctgctgaataggttcactatggcccaccggaagcctacgtatgaacgagacgtcgacctaggcgcgggtactcggcacgtggccgtggaacccgaggtcgcgaacttggacataatcggccagcggatcgagaacataaagaacgagcacaagagcacttggcactacgacgaagacaacccctacaaaacctgggcctaccacgggtcttacgaagtgaagccctccggtagcgcctcctctatggtcaacggggtcgttcggctactgaccaaaccatgggacgtaattcccatggtgacacaaattgcaatgaccgataccactccattcggccagcaacgcgtgttcaaagagaaagtcgacacccggacgccccgcgccaagcggggaaccacacagatcatggaggtcaccgccaagtggctttgggggttcctctcccgaaataaaaaaccacgaatctgcacccgcgaagaattcacccgaaaagtgcgtagcaacgccgccatcggcgccgtctttgtggacgagaatcagtggaacagcgccaaggaggccgtggaggatgaacggttttgggacctggtccatagggaacgggagctacataagcagggaaaatgtgccacgtgtgtgtacaacatgatgggcaagcgcgaaaagaagttgggggagttcggcaaggcaaagggctcccgcgcaatttggtacatgtggctgggggcaagatttctggagttcgaggccctcgggttcatgaatgaggatcactggttcagccgagagaactccctgagcggggttgagggcgaggggttacacaagctcggctacatcctgcgagacatctccaagatcccgggcgggaacatgtacgctgacgacaccgccggctgggacacgaggatcaccgaagacgacctgcagaacgaagctaagatcacggatatcatggagccagagcacgccttactggccaccagcatcttcaagctgacctaccagaacaaggtcgtgcgggtgcagcggcccgcaaagaacggcaccgtcatggacgtgatttccagacgcgatcaacggggcagcggccaggtgggtacgtacggtctcaacaccttcacaaacatggaggttcaacttatccgccagatggagtccgaggggatcttcctgccgagtgagctcgagaccccgaacctggcagagcgagccctggactggttagagaagcacggcgctgagcgccttaagcggatggccatttccggggacgactgcgtggtaaagcccatcgacgaccgcttcgccacggcgctgaccgccctcaatgatatgggcaaggtccggaaagacatcccccaatgggaacccagcaaaggctggaacgactggcagcaagttccgttctgctcccaccacttccaccagctaattatgaaggatgggcgcgagatcgtggttccgtgccggaaccaggacgagctggtggggcgggccagagtcagccagggggccggctggtccctccgcgagaccgcctgtctgggaaagagctacgcgcagatgtggcagcttatgtactttcaccggagagacctccgtctggccgctaacgccatctgctccgcagttcccgtggactgggttcctgcctccagaaccacgtggagcatccatgcgcaccaccagtggatgacgaccgaggacatgctgtccgtgtggaaccgcgtgtggatcgaggagaacccgtggatggaggacaagactcacgtgagttcctgggaggaggtcccctacctcggcaagcgggaagaccagtggtgcggaagtctcattgggctgaccgcacgcgccacgtgggcgaccaacatacaagtggccatcaaccaagtgcggcgtctcatcggcaacgagaactacctggattacatgacctccatgaaacggttcaagaacgaaagcgaccccgagggggccctttggtaa

SEQ ID NO: 24675 - RNA, 9879 nt, synthetic construct
  misc_feature 1..9879: note = derived and/or modified CDS sequence (opt11) from DENV-1__KC692511__SS-prME
  source 1..9879: mol_type = other RNA
agcgtgaccatgctgctcatgttgctgcccaccgccttagccttccacttgacgacccggggcggggagccccacatgatcgtatcgaagcaggagcggggaaagagcttactgttcaagactagcgtgggggttaacatgtgcaccctaatagcgatggacctgggcgaactgtgtgaagacaccatgacctacaagtgcccccgcattaccgaggccgagcccgacgacgtggactgttggtgcaacgccaccgacacctgggtgacctacgggacctgcagccaaaccggcgagcaccgacgcgacaagcggtccgtggccctggcgccccatgtcggcctggggctcgagacacgcaccgagacctggatgagctccgagggcgcttggaagcagatccagaaggtggaaaactgggcgctgcggcaccccgggttcaccgtgatagcactgttcttagcccatgcaattggtacaagcatcacccagaaggggatcatcttcatcctcctgatgctcgtaacaccgtccatggctatgcgctgcgtgggcattggaaaccgggactttgtggaggggctgtcgggagccacctgggtcgatgtggtgctggagcacgggtcctgcgttacgaccatggccaaaaacaagcccaccctcgacattgaactcctgaaaaccgaggtgactaacccggcagttctcaggaagctgtgcatcgaggcgaaaatcagtaacaccaccaccgactccaggtgcccgactcagggcgaggccaccctggtcgaggagcaggatgctaacttcgtgtgcaggcggacattcgtggaccgcggctggggaaacggctgcggcctcttcggcaagggatcgctgttgacctgcgccaagttcaagtgcgtcacgaagctcgagggcaagatcgttcagtacgagaacctgaagtattccgtgatcgttaccgtccacaccggcgaccagcaccaggtcgggaacgagaccacggagcacggcactatcgccaccatcacgccccaagcgccaaccagcgagatccaacttaccgactacggggccctcaccctggactgcagcccccggaccggccttgacttcaacgagatggtgttgctgaccatgaaggagaagtcctggctcgtgcacaagcagtggttcctcgacttgccgctgccgtggacgtccggggccagcaccagccaagagacctggaatcgccaagacctactggtcacgttcaagacggctcacgccaagaagcaggaggtggtcgtcctgggctcccaggaaggcgccatgcacaccgccctcaccggggccactgagatccaaactagcgggacgaccaccatcttcgctggccacctgaaatgccggctgaagatggacaagctcaccttaaaggggatgtcttacgtgatgtgcaccggtagcttcaagctggagaaagaggttgccgaaacgcagcacggcaccgtcctggtccaagtgaagtacgagggaactgacgcaccctgcaagatccccttcctcacccaggatgagaaaggggtcacgcagaacggacgcctgatcaccgccaacccaatcgtgacggacaaggagaagcccgtgaatatcgagaccgagccgcccttcggggagtcttacatagtagtgggcgccggggagaaagccctgaagctctcctggttcaagaaggggtcctcaatcggcaagatgttcgaggcgaccgcccgcggtgcccgccggatggccatcctgggggacaccgcttgggacttcgggtccatcggcggcctgttcacatctgtggggaagctcatccaccagatcttcggcacggcgtacggtgtacttttctccggcgtaagctggaccatgaagatcggtatcggcatcctgctcacctggctgggcctgaactcccgcagcaccagtctaagcatgacctgcatcgccgtggggatggtcaccttataccttggcgtgatggtgcaggctgactccgggtgcgttatcaactggaagggccgagagctgaagtgcggcagcggcatcttcgtgaccaacgaggtgcacacgtggaccgaacagtacaagttccaggccgattctccgaagcggctgtctgccgccatcggcaaggcatgggaagagggggtctgcggcatccgcagcgccacccggctggagaacataatgtggaaacaaatatccaacgagctcaattacattctgctggaaaacgatatgaagttcaccgtggtggttggggacatcaatggaatcctcgcccagggtaagaaaatgatccgcccccagccgatggagcacaagtacagctggaagtcctggggcaaggcgaagatcatcggcgcggacatacagaacacgacgttcatcatcgacgggcccgacaccccggagtgccccaacgatcagagggcgtggaacatctgggaggtggaggactacggcttcggtattttcaccaccaatatatggctgaaactgcgcgattcccacacgcagatgtgcgaccaccggctaatgtccgctgccatcaaggacagcaaagcggtgcatgccgacatgggatactggatcgagtccgagaagaacgagacttggaagctggcacgcgccagcttcatcgaggttaagacctgtatatggcccaagagccacaccctgtggagcaacggcgtgctcgagagcgagatggtaataccaaagatctacgggggccctatcagtcagcacaactaccggcccgggtacttcacgcagaccgccggcccctggcatctaggtaagctagagctcgatttcgacctgtgcgagggcaccactgtcgtggtggacgagcactgcggctaccgcgggccgtccctgcgcaccaccaccgtcactggcaagatcatccacgagtggtgctgtcgctcgtgtacactgccgcccttgcggtttcgcggtgaggacggctgttggtacgggatggaaatccggcccgtgaaggagaaggaggagaacttggtgcgctccatggtaagcgcgggatccggcgaggtggatagcttcagcctcggaatcctgtgtgtgtccatcctgatcgaggaggtcatgcggtcacggtggtcccggaagatgctcatgacaggcaccctggccgtgttcctgctcttgattatggggcagctgacctggaatgacctcatacgcctgtgcatcatggtgggcgccaacgccagtgaccgcatgggtatgggcacgacctacctggccctcatggccacctttaagatgcgccctatgttcgcggtcgggctcctgtttcgccggctcacctctcgcgaggtgctgctcctcacggtggggctctctctggtcgcctccgtggaactccccaactctctggaagaactgggcgacggactcgccatgggcatcatgatgctcaagttactcaccgacttccaaccgcaccagctatggaccaccctgctttctctgacgttcatccggacctccctgtccttagactacgcctggaagacgatggcaatggccctgtctatcgtctccctgtttcccctctgcctcagcaccacgtcccagaagaccacatggctgccggtgctcttaggcagtttcgggtgcaagcccctgaccatgttcctcatcacggagaacaagatctggggccgcaaatcctggcccatcaacgaggggatcatggccgtgggcattgtcagcattctgctgtccagtctcctgaagaacgatgtgcccctggccgggccgctcatcgcgggcggcatgctgatcgcatgctacgtgatcagcgggtccagcgccgacctttccctcgaaaaagccgccgaggtcagctgggaggaggaggcggagcactccggcaccagccacaacatcctggtagaagtgcaggacgacggtacgatgaagatcaaggacgaggaacgagacgacaccctgactatcctccttaaggcgacgttgctcgccgtttccggcgtgtatcccatgagcatacccgcgaccctgttcgtgtggtacttctggcagaagaagaagcagcgctcaggggttctttgggacaccccgagcccgcccgaagtagagcgggcggtgctggacgatggcatctaccgcatcctgcagcggggcctgctggggcgatcccaagtcggcgtgggggtgtttcaagacggtgtattccacaccatgtggcacgtgacgcgtggggcagtgctcatgtaccaaggcaagagactggagcccagttgggcctccgtcaagaaggacctgatcagctatggcgggggctggcggttccaggggtcctggaacacgggcgaggaagtccaggtgatcgccgtggaacccggtaagaacccgaagaacgtgcagaccacgcccggaacgttcaaaacacccgagggcgaggtcggggccatcgccttggattttaagcccggcacgagcgggtccccgatcgtcaacagggaaggtaagatcgtgggcctgtacggtaatggtgtggtcactacatcggggacctacgtgtccgcgatcgcccaggcgaaggctacccaggagggccccctgcccgaaatcgaggacgaggtgtttaagaagagaaacctcaccatcatggacctgcatccgggaagcggaaagacgcgcaggtacctgccggccatcgtccgggaagcgatcaagcggaagctccgcactctgatactggcccccacacgcgtggtggccagcgagatggccgaggcgctcaaaggcatgcccatcagataccaaaccacggccgtcaaatccgagcacacgggtagagagattgtggatctgatgtgccacgccacgttcaccatgcggctgctcagtccggtccgggtacccaattacaacatgatcatcatggacgaggctcacttcacggaccccgcctccattgcagcccgaggttacatcagcacccgcgtggggatgggcgaggccgccgcaatcttcatgaccgcgacaccacccgggtccgtggaggccttcccacagagtaacgcagtcatacaggacgaggagcgggacatccctgagcgctcctggaacagcggatacgactggatcacggacttcccgggcaagaccgtgtggtttgtgccctccatcaagagcgggaacgacatcgccaactgtctgcggaagaacggcaagcgcgtcattcagctgtcccggaaaaccttcgacaccgaataccagaagacgaagaacaatgattgggactacgtggtgaccacggacatcagcgaaatgggggccaacttcagggcggaccgtgtcatcgacccccgccggtgcctcaagcccgtgatcctgaaggaggggcccgaacgcgtgatcctggccgggccaatgcccgtcaccgtggcctctgccgcgcagcggaggggccggattggccgcaaccagaacaaggagggggaccagtacatctacatgggccagccgctcaacaatgacgaggatcacgcacactggacggaggcgaagatgctgctggacaatatcaacacgcccgaggggatcatcccagccctcttcgagcccgaacgcgagaagtccgccgctattgacggcgagtaccggctacgcggggaagcacggaaaaccttcgtcgagctgatgcgtcggggtgacctcccggtgtggctgtcctacaaggtggccagcgagggcttccagtacagcgacagaaggtggtgctttgacggtgagcgcaacaaccaggtcctggaggaaaacatggacgtggaaatctggaccaaagagggcgagcgtaagaaacttcgcccccggtggctggacgccaggacgtacagcgacccgctcgccttacgggagttcaaagagttcgcggccgggcgccggtccgtgagcggcgacctgatcctggagatcgggaagctcccccaacacctgacgctgcgagctcaaaacgccctagacaatctggtcatgctacacaacagcgagcagggcgggaaggcctaccggcatgcgatggaggagctcccagacaccatcgagaccttaatgctgctcgccctgatcgccgttctgaccgggggcgtgaccctcttcttcctgagtgggaagggcctaggtaagaccagcatagggctgctgtgcgtcatggcctccagcgccctgctctggatggcctccgtagagccccactggatcgccgccagcatcattctggagttcttcctgatggtgctcctgatccccgagcccgaccgacagcggacaccccaggacaaccagctggcgtacgtcgtgatcggcctcttgttcatgatcctgaccgtggcggctaatgagatgggactcctggagacgaccaaaaaggacctgggaattggccacgtcgccgtggagaaccaccaccacgccacaatgctcgacgtggacctccgccccgcctccgcgtggaccctctacgccgtcgcgacgaccgttatcacccctatgatgcggcacactatcgaaaataccacggcgaacatcagcctcaccgccattgcgaaccaggcagccatcctgatgggcctggacaagggctggcccatctccaagatggacatcggggttcccctcctggccctgggatgctatagccaggtcaacccgctcaccctgacggccgcggtactgatgctcgtggcacactacgccatcattggacccgggcttcaggccaaggcgaccagagaggcccagaagagaaccgccgccggcattatgaagaaccccacggtcgacggtatcgttaccatcgacctggaccccgtggtttacgacgccaaattcgagaagcagctcggtcagataatgctgctgatcctctgcacctcccagatattgcttatgcggaccacctgggcgctctgcgagagtatcacactggccaccgggccgctgaccaccctctgggaggggtcccccgggaaattctggaacacgaccatcgccgttagcatggccaacatctttagaggctcctatctagccggcgcggggctggctttcagcctcatgaagtcactgggcggtggccggcgcggcaccggcgcccagggagagaccctgggggagaagtggaagcggcagctcaaccagttaagcaagtccgagtttaatacgtacaagaagtccggcatcatggaggtcgaccgcagcgaggccaaggaagggctgaagcggggcgagaccaccaagcacgcagtatcccgcggtaccgcgaagctgcgatggttcgtggaacgcaacctcgttaagcctgagggcaaggtcatcgacttgggctgcgggcggggcgggtggagctactactgcgccggcctcaagaaggttactgaggtgaaggggtacaccaagggcggacccgggcacgaggagccgataccaatggccacctacggatggaaccttgtgaaattacactccgggaaggatgtatttttcacgccgcccgagaagtgcgacaccttgctgtgcgacatcggcgagagctccccgaatccaacgatagaggaagggcgcaccctgagagttctgaagatggtcgaaccctggctacgcgggaaccaattctgcatcaagatcctgaatccctacatgccgagcgtggtggagacactggagcagatgcagcgcaaacacggcgggatgctcgtacgtaaccccctgtcccggaacagcacccacgagatgtactgggtgtcctgtggcacggggaatattgtgagcgccgtcaacatgacttcccgcatgctattgaacaggtttacaatggcgcatcgcaagcccacctacgagcgcgacgtggacctgggtgccggcactaggcacgtggccgtcgagcccgaggtggccaacctggatataatcgggcagagaatcgagaatatcaagaatgagcacaaaagcacctggcactatgacgaggacaacccgtacaagacctgggcctaccacggctcctatgaggtgaagccgagcggaagtgccagctccatggtcaacggcgttgtccggctcctaaccaagccctgggacgtgatcccaatggtgactcagatcgcaatgaccgacactacccccttcgggcaacaacgcgttttcaaggagaaggtggacacacggacgccccgggctaagcggggcaccgctcagatcatggaggtgaccgccaagtggctgtggggctttctcagccgcaataagaagccgcgaatctgtacgcgggaggagttcactaggaaggtcaggagcaacgcggccatcggggccgtgttcgtggacgagaaccagtggaacagcgccaaggaggccgtcgaagacgagcggttctgggacctggtccaccgggagcgcgagctgcacaagcagggcaagtgcgccacttgcgtgtataacatgatgggcaagcgcgagaagaagctcggtgagttcggaaaagccaagggcagccgagccatctggtacatgtggctgggcgcccgcttcctggagttcgaggcgctcgggttcatgaacgaggaccactggttttcccgtgagaacagtctgtccggggttgagggggagggccttcacaagctcggttacatcctgcgcgacataagcaagatcccgggcggcaacatgtacgcagacgacaccgccgggtgggacacacggataacggaggacgacctgcaaaacgaagccaagattaccgacattatggaacccgagcacgccctcctggcgacctccatcttcaagctgacgtaccagaacaaggttgtgcgcgtccagcgtcccgccaaatctggcaccgtgatggacgtgatctcccgacgcgaccagcgggggagcggccaggtcggcacctacgggctcaacaccttcacgaacatggaggtgcagctgatccgccagatggagtccgaaggcatcttctctcccagtgaactggagaccccgaacctcgcaaagaaagtgctggactggctagagaagcacggcgccgagcggctcaaaagaatggccatcagcggcgacgactgcgtcgtgaagcccatcgacgatcggttcgcgaccgccctgacagccctgaacgacatgggcaaggtgagaaaggacatccctcagtgggagccttcaaagggttggaacgactggcagcaggtcccattctgcagccaccacttccaccagctcatcatgaaggacggccgtgagatcgtggttccatgccgaaaccaggatgagttagtcggacgggcacgcgtctcccagggcgcggggtggagcctgcgggaaacggcgtgcctcggtaagtcctacgcacagatgtggcagttgatgtacttccacagacgcgatctaagactcgccgccaatgcgatctgcagcgctgtgcccgttgattgggtgcccaccagccggaccacttggtctattcacgcccaccaccagtggatgactacggaggacatgctgtcggtgtggaaccgcgtatggatcgaggagaacccgtggatggaggataagacccacgtgtccagctgggaggaggtgccctacctggggaagcgggaggaccagtggtgcggctccctcattggtctgacagcgcgtgcgacctgggcgacaaacatccaggtcgccatcaaccaagtgcgccggctgatcgggaacgagaactacctagactatatgactagcatgaagcgcttcaagaacgaatccgaccccgaaggcgcgctgtggtga

SEQ ID NO: 24676 - RNA, 9879 nt, synthetic construct
  misc_feature 1..9879: note = derived and/or modified CDS sequence (opt11) from DENV-1__KC692512__SS-prME
  source 1..9879: mol_type = other RNA
agcgtaactatgctattaatgctactcccaaccgcactcgcatttcatcttactacaagaggaggagaaccacacatgatcgtatcaaaacaagaaaggggaaagagcctgttattcaaaacgagtgctggcgtgaatatgtgtacgctgatagcaatggatctgggtgaactttgcgaagacacgatgacctataaatgcccacgaattacggaggcagaaccagacgacgtagactgttggtgtaacgcgaccgatacgtgggtaacctacgggacttgctcacaaactggtgagcacaggagagaaaaacgtagcgtggcactggcgccacacgtcgggctcgggctcgaaacacgcaccgagacatggatgagcagcgaaggggcatggaagcaaatccaaagagtcgaaacctgggctttacgacacccagggttcaccgtgatcgccctctttcttgcgcacgcaataggtacctcaataacacaaaagggaataatattcatactgctcatgttagttacgcccagcatggcgatgcgatgcgtaggaatagggaatcgggacttcgtcgaaggcctctcgggggcgacttgggtggatgtagtgctggagcatgggtcatgcgtgactacaatggcaaagaacaagccaacgctggacatcgagctactaaaaacggaggtcacaaacccagcggtactaaggaaactttgcatagaagcaaagatatccaataccacaacggattcacgctgcccaacgcaaggcgaagcgaccctcgtggaggaacaagacgccaattttgtgtgtcgaagaaccttcgtagatagaggctggggaaacgggtgcggcctatttgggaaggggagcctgctgacatgcgcgaagttcaaatgcgtgacaaagctagagggaaaaatcgtacaatatgagaacctcaagtacagcgtcatagtcacagtgcacaccggagaccaacaccaggtcggcaacgaaacgacggaacacggaacgatagccactataacaccccaggcccctacatcagaaatccaactcaccgactacggcgccctaacattagactgctcaccgagaacaggtcttgacttcaacgaaatggttctgctgacaatgaaggaaaagagctggctagtgcacaaacaatggttcctagacctcccattgccctggacatccggagcaagcacaagtcaagagacatggaacaggcaggacctcctagtgacatttaaaacggcgcacgccaagaaacaggaagtagttgtgttgggaagccaagaaggtgccatgcatacagcgctgaccggcgcaacggaaattcaaacctcaggcaccacaaccatattcgctggacacctaaaatgccgactcaaaatggacaaactaaccctaaaaggcatgagctacgtgatgtgcaccgggagcttcaaacttgaaaaagaggtcgctgaaacacaacacggcactgtcctcgtgcaggtaaaatacgagggcacggacgcaccgtgcaaaataccattctctacgcaggatgaaaaaggagtcactcaaaacggccgcctaattacagccaacccgatagtgacagacaaggaaaaaccggtcaatattgaaactgaacccccgtttggagagagttacatagtggtaggagccggggaaaaagctctgaaactctcatggttcaagcgtggcagctctattgggaagatgttcgaagcgacagcgaggggagcccggaggatggcaatactaggggacacagcgtgggactttggctccattggcggtgtattcacgagcgtcggaaaacttgtccaccaggttttcgggacagcctacggagtacttttctcgggggtaagttggactatgaaaatcgggattggcatcctcctcacctggcttgggttgaacagcaggtcaacctcactttcgatgacgtgcattgcggtagggatggtaacgctctatctaggcgtaatggttcaggccgactcaggatgcgtaatcaactggaagggccgagaactcaaatgtggctccggaattttcgtcacaaatgaagtgcacacgtggactgaacaatacaaattccaagcggactccccgaaaagattatccgcagcaatcggcaaggcctgggaagagggcgtgtgtgggatcaggtctgcaacacggttagaaaatattatgtggaaacagatttctaacgagctcaatcacatcctactagagaatgacatgaaatttacagtagtcgtcggggatgcaaatggtatccttgcccagggcaagaaaatgatcagaccccaaccgatggaacacaaatacagctggaaatcctggggaaaggcgaaaataataggggcggacattcaaaacaccacttttatcatagacggccctgacacaccggaatgtcccgacggacagcgcgcctggaacatctgggaggtcgaggactacggattcggagtattcacaactaacatatggttaaagttacgtgactcctacacacagatgtgtgatcatcggctgatgtcggctgccattaaagattcgaaggccgtgcacgcggatatgggctactggatcgagtcggagaaaaatgagacatggaaactcgctcgtgccagcttcatagaggtcaaaacctgcacctggcctaaaagtcacacactatggtcaaacggagtcctcgagtctgagatgatcatccccaagatttttggagggccaatatcccagcataactaccgtccaggttactttacgcagaccgccgggccctggcacttggggaagctagaactggacttcgacctctgcgaaggaacaacggtcgtcgtggacgaacattgcggtaatagggggcccagcttaagaacaacaacagtcaccggaaagattatccatgaatggtgctgtcggagctgtacactaccgcccctaagattccgaggggaggacggctgctggtacggcatggaaatccgaccggtgaaagagaaagaagagaacctggttagaagtatggtcagtgcggggagcggcgaagtcgactccttctccctaggcattctatgtgtatcgattatgatagaggaggtgatgcggtcaagatggagccgcaagatgctcatgaccggaacgctagcagtctttctgctactaatcatgggacaactaacctggaacgacttaatacggctctgcataatggtgggcgccaacgcatcagaccgcatgggaatgggtacaacctacctcgcgttaatggcaacattcaagatgcggcctatgttcgccgtggggctattgtttcgacgattaaccagccgcgaggtgcttctacttacaatcggcctaagcctcgttgctagcgtcgagctgcctaacagtctagaagaactcggcgacggactcgccatgggtataatgatgctgaagctgctcacggagtttcaaccccatcaactgtggacgaccctgctgtcactaaccttcgtcaagactacactgtcactcgattacgcctggaagaccacagcaatggttctgtcgatcgtgagtctgttccctctctgcttgtcaacgactagccagaaaacaacatggctcccggtccttttagggagtttcggctgcaaaccactaacgatgttccttataaccgaaaacaaaatctgggggcggaagtcgtggccgctcaacgaaggaataatggcaatcggtatagtgagcatattactcagcagcctcctcaagaacgatgtgccccttgccggacccctaatagcgggaggcatgctgatagcctgttacgtcatctcgggaagcagcgcggacttaagcctagaaaaagcagccgaagtatcgtgggaacaagaggcggagcactctggcgcttcccataacatcctagtcgaagttcaagacgatggaaccatgaaaataaaagacgaggagcgcgacgacactcttacgatattgctcaaagcgacattactggcagtcagtggagtctaccccatgagcatcccagccacccttttcgtctggtatttctggcagaagaaaaagcagcgtagcggcgtattgtgggacacaccaagtcctcctgaagtagaacgagcggtgctggacgatggaatctataggatcctacaacggggcctcctgggaaggagtcaggtaggagttggggtcttccaagacggggtattccacacaatgtggcacgtgacaagaggcgcggtgctaatgtaccaaggtaaacggctcgaaccctcgtgggcaagcgtaaagaaagacctcatctcctacggaggcggatggaggttccagggatcatggaatacaggagaagaggtgcaagtgatagctgtggaaccagggaaaaaccccaaaaacgtacaaacgacacccgggacctttaaaacaccagagggcgaggtcggagctatagcactcgacttcaaaccgggcacgagtggaagtcccattgtaaatcgagaagagaaaatcgtgggactgtacggcaacggggtggtgaccacctccggcacgtacgtgagtgcgatagctcaagcgaaggcgtctcaggagggcccattaccggagattgaggacgaagtattcaaaaagagaaaccttacaataatggacctacaccccggatcgggcaaaaccagacgataccttccagccatcgtccgtgaagccatcaagagaaaactacgaacacttatactggcacctacgagagtcgtggcaagtgaaatggcggaagcgctcaaaggcatgcccatacgctaccaaacaaccgcagtcaagtcagaacacaccggccgtgagatagttgacctcatgtgccacgcaactttcaccatgagactgctctcaccggtgagagtacccaactacaatatgataataatggacgaagctcacttcacagatcccgccagtatagctgctcgaggctacatatcaacacgggtaggaatgggcgaggcggcggcaatcttcatgaccgctactccgccaggtagcgtagaggcgttcccgcagtcaaatgcagtcatccaggacgaggagcgcgacattcccgagaggagctggaatagcggctatgactggataaccgactttccgggaaagacggtgtggttcgtcccctcgatcaaatcaggaaatgacatcgcaaattgcctccgcaagaatgggaaaagagtaatccagctgtcgcgaaaaacgttcgacacggaatatcagaaaaccaaaaacaacgactgggactacgtcgttacaactgacatatcagagatgggggcaaactttagagcagaccgagtaatcgaccccagacgatgccttaaacctgtaattctcaaggatggccctgaaagagtaatactagctggacccatgcccgttacggtcgccagcgccgcacaaagacggggcagaataggaagaaatcagaacaaggaaggtgatcagtacgtttatatgggacagcccctgaacaacgatgaggaccacgcacactggacagaggcaaaaatgcttctggacaacattaacacccccgaaggaataataccagcactattcgagccggagagggagaaaagcgccgctatagacggcgagtaccgactcagaggcgaagcacgcaaaacgttcgtcgaactcatgagaagaggtgacctccccgtatggctgtcatataaggtagcgtcagaaggctttcaatactccgatcgccgctggtgcttcgacggggaacggaacaaccaagtattggaagaaaacatggacgtcgagatatggaccaaagagggggagaggaagaaattgagaccgcgctggttagacgcgagaacctacagtgatcctctggcgctaagggagttcaaagagttcgcagccggcagaaggagcgtcagcggcgatttaatcctggaaatagggaaactgccccagcacctaaccctgcgagctcagaacgcacttgataatctcgtaatgctccacaacagcgaacaaggcggtaaagcgtataggcacgcgatggaggaattgccagacaccatagaaacactcatgttgctagccctcatagccgtactcaccggcggggtaacgctattcttcctcagcgggaaggggcttggaaaaacgagcataggactactatgcgttacagcgtcaagcgcattgttatggatggcaagtgtcgaacctcactggattgcagcatccatcatactcgagtttttcctcatggtgctcctcataccagaacccgacagacagagaaccccgcaggataatcaactagcgtacgttgtgataggattactcttcatgatcctgacagttgcggcaaacgaaatgggcctactggaaaccacgaaaaaggacctaggcataggacacgtggctgcggaaaaccatcaacattccaccatgctagacgtagaccttcaccccgctagcgcgtggaccctgtacgccgttgccaccaccgtcataaccccgatgatgcggcacacaatagagaacacgacagcgaacatatctctgacggcaatagcaaaccaagcagccatcctgatgggcctagacaaagggtggccaatttccaaaatggatatcggagtaccactgctagccctaggatgctactcgcaggtaaatccgcttaccttgacagcagcagtcctaatgctcgtcgcccactacgcgataataggaccaggtctacaagcgaaagccaccagagaagcccagaaacgtaccgccgcgggtatcatgaagaaccccacagtggacggcatcgtagccattgacctagatcccgtagtatacgacgcgaaatttgaaaaacaactaggccagataatgctacttatcctctgcacatcacaaattctccttatgcggacaacgtgggcactatgcgaaagcatcaccctggctacgggacccctaacaacactttgggaaggtagcccaggtaagttttggaatacaacaattgccgtgagtatggctaacattttccgagggtcttacctagcgggagccgggctggctttctctctcatgaagtcattaggcgggggcaggcgaggaaccggcgcccaaggcgaaacccttggtgaaaaatggaaacgccaactaaatcagttgagcaaaagcgagttcaacacttacaaacgatcgggcataatggaggtagaccggtcggaagccaaagaaggtttaaaacgaggggaaacgacgaaacacgcagtaagccgaggcaccgcaaagttacgctggttcgtagaacgtaacctcgtcaaaccagaaggcaaggtcatagatcttgggtgtggccggggcggctggagttactactgcgccggactaaagaaagtcacagaagtaaaaggatacaccaagggaggacctggccacgaagaaccaatcccaatggccacatatggatggaatctagtgaagctccactcggggaaagacgtattcttcatgccgcctgagaagtgcgacactctcctttgcgatattggggagagcagcccgaatccgacaatagaagagggaagaaccctaagggtcctcaaaatggtcgaaccgtggctccgcggcaaccaattctgtatcaaaatacttaatccgtacatgcccagcgtagtcgagacattggagcaaatgcagcgtaaacacggcggtatgctcgtacgcaaccccctcagtcggaacagcactcacgaaatgtactgggtaagctgcggaacgggaaacatagtgtctgcagtgaacatgacaagccgaatgctgcttaaccgcttcacaatggcgcatcggaaacccacgtacgagagagacgtggacctgggggcagggaccagacacgtagcagtggaacccgaggtagcaaacctggacatcatagggcagaggatcgaaaacataaagaacgagcataggtccacatggcactacgacgaggacaacccatacaaaacctgggcgtaccacggttcatacgaagtaaagccaagtggctccgccagctctatggtaaacggcgtagtacgcctactaaccaagccttgggacgtaataccaatggtaactcagatcgcgatgaccgacaccacaccttttgggcaacagcgtgtctttaaggagaaggtcgacactcgtacgccaagagcaaagcgcggaacaacccaaatcatggaggtaacggccaaatggctctggggctttctaagccggaacaagaagccacgtatatgcacccgagaggagttcacccgcaaagtccgtagcaatgctgcgataggagcagtattcgtcgacgaaaaccagtggaactccgccaaagaggcggtggaagacgagcgcttctgggacctggtccaccgagagagggagctacataagcaagggaagtgcgcaacatgcgtctacaacatgatggggaagcgagagaaaaagctaggagagttcggcaaggctaaagggtcccgagccatatggtacatgtggctgggagcgaggttcctagaatttgaggctctcggattcatgaacgaagaccactggttcagcagagaaaactccttgagcggggtcgaaggggagggccttcacaaactaggctacatcctaagagacatttcgaaaataccaggcggaaatatgtacgcagacgataccgcaggctgggacacgcgaattacggaagacgacctccagaacgaagcaaagattaccgatataatggagccagaacacgcgctactcgcgacatcaatcttcaaattgacataccagaacaaagtagtacgagtgcaaagaccagccaaaaacgggactgtcatggacgtaatatcccgtcgcgaccagagaggcagtgggcaagtcgggacctacggtttaaacacattcacaaacatggaagtgcaactgatccgccaaatggagtctgaaggcatctttctcccctcggagctagaaacaccaaacctagcagaaagggcactcgattggctcgagaagcatggtgccgagcgcctgaagaggatggccatatccggcgacgactgcgtcgtaaagcccatagacgaccggttcgcaaccgccctaacggccttaaacgacatgggtaaagtacgaaaagatatacctcagtgggagccctccaagggctggaacgactggcaacaggtaccattctgctcccatcatttccatcagctaatcatgaaagatgggcgtgaaatagtcgtgccgtgcagaaatcaggacgagctggttgggagagcacgggtgtcccagggagccggatggtccctccgcgagactgcatgccttggaaaatcgtacgcccaaatgtggcagctcatgtacttccaccgccgagacctacgcctcgcggccaacgcaatctgcagcgcggttccggtagactgggtcccggccagcaggacaacatggtcaatccacgcacatcaccaatggatgacgacagaagacatgttatcagtatggaacagagtatggatcgaagaaaacccttggatggaagacaaaacacacgtaagctcctgggaagaggtcccgtacctgggcaagagagaagaccagtggtgtggttcactcatcggtctaacggccagagcaacatgggccacgaacattcaggtcgcaataaaccaagtccgtcgcctcattgggaatgaaaactacttagattatatgacctcaatgaagaggttcaagaacgaatcggacccggagggggcactttggtaa

SEQ ID NO: 24677 - RNA, 9879 nt, synthetic construct
  misc_feature 1..9879: note = derived and/or modified CDS sequence (opt11) from DENV-1__KC692513__SS-prME
  source 1..9879: mol_type = other RNA
agcgtgaccatgctgctcatgctgctgcccactgccctcgccttccacctgaccacccggggcggggagccccacatgatcgtgagtaagcaagaaaggggcaagagcctgctattcaaaacctccgtgggggtgaacatgtgcaccctgattgcgatggacctgggggagctctgtgaagacactatgacttataagtgtccccgcatcacagaggccgaaccggacgacgttgactgctggtgcaatgcgaccgatacctgggtgacatacggaacctgcagccagactggcgagcaccggagggacaagcggtcggtggccttggcgccccacgtcggcctggggctcgagacgcgcaccgagacctggatgagctccgagggagcttggaaacagatccagaaggtggaaacctgggccctgcggcaccccgggttcacggtgatcgccctgttcctcgcccatgcgatcggcacgagtatcacgcagaaggggatcatcttcatcttactgatgctcgtcaccccctccatggccatgcgctgcgtgggcatcggcaaccgtgacttcgtggaggggctgagtggcgcgacgtgggtcgacgtggtgctggagcacgggtcctgcgtcaccaccatggccaagaacaagcccactctggacatcgagttactaaagacagaggttacaaaccccgccgtgctacgaaagctgtgcatcgaggcgaagatcagcaataccaccacagactcccgctgcccgacccagggcgaagcgactcttgtggaggagcaggatgccaacttcgtgtgcagaaggaccttcgtggaccgcggctgggggaacggatgcggcctcttcggcaaggggagcctgctgacgtgcgccaaatttaaatgcgtcaccaaactcgagggcaaaatcgtacagtacgagaacttgaagtacagtgtgatcgtgacggtgcacaccggcgatcagcaccaggttgggaatgagaccaccgagcacggcaccatcgcaaccatcacaccccaagcgccaacttctgaaattcaactgactgattacggtgccttaacactggattgttccccaagaacgggcctggacttcaatgagatggtcctcctgacgatgaaggagaagtcatggctggtgcacaagcagtggttcctcgaccttcccctgccctggacctccggggccagcacgccccaggagacctggaaccgccaagaccttttggttacgttcaagaccgcacacgccaagaagcaggaggtagtggttctgggctcacaggagggcgcgatgcacaccgcactcacgggcgccactgagatccagacttctggaaccaccacgatcttcgccgggcacctgaagtgtcgactgaaaatggacaagctcacgctgaagggtatgtcatacgtgatgtgcaccggctccttcaagttggagaaggaggtggccgaaacccaacacggcacggtgttggtacaagtcaagtatgagggcaccgatgcgccctgcaagatcccgtttctcacgcaggacgagaagggggtcacccaaaacggaaggcttatcacggcaaaccccatcgtcaccgacaaggagaagcccgttaacatcgagacagagcccccgttcggcgagagctacattgtcgtgggcgcaggggagaaagccttaaagttatcctggttcaagaaggggagctctattggcaagatgttcgaggcgaccgcccgtggagcccgacggatggccatcctaggcgacacggcctgggacttcggtagcatcggcggactgttcacttccgtggggaagctcatccaccaggtcttcggtactgcttacggcgtgcttttcagtggcgtgtcctggactatgaaaattggaattggaatcctgctcacatggctgggcctgaacagccgcagcacgagcctatccatgacctgtatcgccgtcgggatggtgaccctgtacttaggcgtgatggtacaagcagacagcggctgtgtgataaactggaaaggcagagagctcaagtgcggatccggcatctttgtgaccaacgaagtccacacctggaccgaacagtacaagttccaggccgactcacccaagcgtctgtcagcagctatcgggaaggcctgggaggagggagtgtgcggtatccgcagcgccaccagactggagaacatcatgtggaagcagatcagcaacgaactcaactacatcctgctggagaacgacatgaagttcaccgtcgtggtgggggatatcaatggcatcctcgcccaggggaagaagatgatccgaccccagccgatggagcataagtactcctggaaatcctggggcaaggcgaagatcataggcgcggacatccagaacaccacctttataatcgacggtccggacacgcctgagtgccctgatgaccagcgggcctggaacatatgggaagttgaggattacgggttcgggatcttcacaacgaacatctggcttaagctaagagattcgcacacccagatgtgcgaccaccggctcatgagcgccgcgatcaaggattccaaggcggtccacgccgacatgggctattggatcgagagcgaaaagaatgagacctggaaattggcccgcgcctcctttatcgaagtgaagacctgcatctggcccaagagccacacactgtggtccaatggcgttcttgaatccgagatggtcatccccaagatctacgggggcccaatcagccagcacaattaccggcccggctactttacccagaccgccgggccgtggcacctcgggaagctggaacttgacttcgacctatgcgagggcaccacggtcgtggtcgatgagcactgcggctaccgcggtccctcgctgcggaccaccacagtgaccggaaagattatccacgagtggtgctgccgatcctgcacgctgccgccccttcggttccgcggggaggatggctgttggtatgggatggagatccggccggtgaaggagaaggaggagaacttagtccgcagcatggtgtccgcgggctctggcgaggtggactcatttagcctcgggatactgtgcgtcagcatccttattgaggaggtgatgcggtcacgatggagccggaagatgctcatgaccggcaccctggcggtgttcctgcttctcattatgggtcagctgacttggaacgacctcatccgcctgtgcataatggtcggcgccaacgcctctgatcgcatggggatgggcaccacctaccttgccctcatggctacatttaagatgcggcccatgttcgcagttggcctgctgttccgccgcctaactagcagggaagttctgttactcaccgtgggactgtccctggtagccagcgtcgagctcccaaactctctggaggagctgggagatggtctcgccatgggcatcatgatgttaaagctgctcaccgatttccagccccaccagctgtggaccacgctgctcagcctgacattcatccggacttccctgtcgctcgactacgcatggaaaacaatggctatggccctgtcgattgtaagtctgttcccgctttgcctgtccacgaccagccagaaaaccacatggttgcctgtgttgctgggctccttcgggtgcaagccgctaacgatgttcctcatcaccgagaacaagatctggggccgcaaatcatggccaataaacgaggggatcatggccgtcggaatcgtgtccatcctgctgagttccctcctgaagaacgacgtgccgctggccggacctctcatcgcgggcggtatgctgatcgcgtgctacgtcatctctggcagctccgccgacctaagcctcgagaaagcggctgaggtgtcctgggaggaggaggccgagcacagcggcacctcccacaacatcttagtggaggtccaggatgacgggaccatgaagataaaggacgaggaacgggacgacaccctaacgatccttctgaaggccaccctcctcgccgtgagcggcgtgtatcctatgtccattcctgccaccctgttcgtatggtacttttggcaaaagaagaagcagcgcagtggggtgctgtgggatactccgagccctcccgaggtggagcgcgccgtcctggacgacggaatctaccggatcctccagcggggcctgctggggcgcagccaggtcggggtgggggtcttccaagacggcgtgttccacacgatgtggcacgtgacacgcggggcggtcctaatgtatcagggtaaacgcttggagccttcctgggccagcgtgaagaaggacctgatctcctacggagggggttggcggtttcagggcagttggaacaccggcgaggaggtacaagtaatcgctgtcgagccgggcaagaatccgaagaacgtgcaaaccactcccggcacctttaagacgcccgagggcgaggtcggggccatcgccctcgacttcaagccggggacctctgggtctcccattgtgaaccgcgagggcaagatcgtgggcctgtacgggaacggtgtggtgaccacctccgggacctacgtgagcgccatagcccaagccaaggccacacaagaggggccccttccggagattgaagacgaggtcttcaaaaaacggaacctcacgatcatggatttacaccctgggtccggcaagactagacggtacctgcctgccatcgtccgggaggcgattaagcggaagctccgcaccctgatcctggccccgacccgcgtggtcgcaagcgagatggcagaggcgctcaaaggcatgccgatcagataccagactaccgccgtcaaaagtgagcacacagggagagagatcgtggatctgatgtgccatgccaccttcacgatgcgacttttgtccccagtcagagtgcctaactacaacatgatcatcatggacgaggcccatttcaccgaccctgccagcatagcggcccggggctacatatccacacgtgtcgggatgggcgaagcagccgccatcttcatgacagcgacgcctccagggagcgtcgaggcattcccccagtccaatgccgtgatccaggacgaggagcgcgacatacctgagcggagttggaactccgggtacgactggatcaccgactttccaggcaagaccgtgtggttcgtgcccagcatcaagtccggtaatgacatcgccaattgtctgcggaaaaacggcaaacgcgtgatacagctcagccggaagactttcgacacggaataccagaaaaccaagaacaacgattgggactatgttgtcaccaccgacatatcagagatgggggccaacttccgtgcggatcgggtgatcgacccccgccgatgcttgaagcccgtgatcctgaaggagggcccggaacgcgttatcttagccgggcccatgcccgttacggtcgccagcgccgcccagcggcggggccggatcggcagaaaccaaaacaaggagggggaccagtacatctatatgggccagcccctcaacaacgatgaggaccacgcccactggaccgaggccaaaatgttgttagacaacatcaacaccccggaggggatcattcccgccctcttcgagcccgagcgcgagaaatcagccgcgatcgacggcgagtaccgtctgaggggagaggcccggaagaccttcgtggagttgatgagaaggggagacttacctgtgtggctcagctacaaagtcgcctccgagggattccagtacagcgatcgccggtggtgctttgacggggagcgcaacaaccaggtcctggaggagaacatggacgtggagatctggacgaaggagggcgaacgaaagaagcttcgcccccggtggctggacgcacgcacctactcagaccctttggcactccgggagtttaaagagttcgcggccggaaggcggagcgtttccggcgacctgatcctggagatcggcaaactcccccaacacctgactctgcgcgcccagaacgccttggacaacctggtgatgctgcacaacagcgagcagggcgggaaggcctacagacacgcaatggaggaactgccggacaccatcgagaccctgatgctgctcgccctgatcgcggttctgaccggcggtgtcactctcttcttcctgagcggaaagggtctaggcaagaccagcattgggctcctttgcgtgatggccagctccgctctcctgtggatggccagcgtggagccgcactggatcgccgccagcatcatcctggagttctttctgatggtcctcctgatccctgagcccgacaggcagagaacgccccaggacaaccaactggcctacgtcgtgatcggactcctgttcatgattctgacggtcgccgccaacgagatggggctgctggagaccacaaaaaaggacctgggtatcgggcacgtggccgtggaaaaccaccaccatgcaaccatgctcgacgttgacctgcgccccgccagcgcctggacgttgtatgccgtggccaccacagtgatcacccctatgatgaggcacacgattgagaacaccaccgccaatatctcgctcaccgccatcgcgaaccaggctgccatcttaatgggacttgacaaaggctggccgatcagcaagatggacatcggggtcccgttgcttgctctgggatgctattcccaggtcaaccccctcacgctgaccgccgcggtactgatgctcgtcgcccactacgcaatcattggccctgggcttcaggccaaagctacccgcgaggcccagaagcgcacggccgcgggcatcatgaagaatcccaccgtggacggcatcgtgaccatcgacctagatccggtagtgtacgacgctaagttcgagaaacagttgggccagatcatgctgctgatcctctgcacgagccagatcctgctcatgcggaccacgtgggcgctctgtgagagcatcaccctggccaccgggcccctgaccacgttatgggagggcagccccgggaagttctggaacaccacaatcgccgtctccatggccaacatcttccgcggaagctatctagccggagctgggctggccttttccctcatgaagtccctgggcgggggccggcgcgggaccggcgctcagggcgagaccctgggcgagaagtggaagcgacagctcaaccagctgtccaagtctgagttcaacacctacaaaaaaagtggcatcatggaggtggaccgaagcgaggccaaggaggggctgaagcgcggcgagacaaccaagcacgcggtgagccgcgggaccgctaaactgagatggtttgtggaacggaatctcgtgaagccggagggcaaagtgattgacctcggctgcggtcggggcgggtggtcctactactgcgccggcctgaagaaggtgaccgaagtcaaggggtacaccaagggtggcccagggcatgaggaacctatcccaatggctacgtatggctggaacctcgtgaagttacacagcgggaaggacgtgttcttcacaccgcccgagaagtgcgacacgctactttgcgacatcggagagtccagccccaaccccacaatcgaagaaggtcgcaccctgcgggtcctgaaaatggtagagccctggctccgcggaaaccagttttgcatcaaaatacttaatccctatatgccctccgttgtggagaccctggagcagatgcaacggaagcacggcgggatgctcgtgagaaatcccctgagccggaactcaacgcatgagatgtattgggtgtcttgcgggacggggaacatagtgtctgccgtgaacatgaccagccgcatgctgctcaatcggttcacaatggcgcatcgcaaacccacgtacgagcgcgatgtggacctgggcgccggcacccggcatgtcgccgtcgagccggaagtagccaacctcgacatcatcgggcagcgcattgagaacatcaagaacgagcacaaaagcacctggcactacgacgaggacaacccctataaaacctgggcctaccacggatcatacgaggtcaagccctccggtagcgcatcctccatggtgaacggcgtcgtgcggttgctgacgaaaccctgggacgtaatcccgatggtcacccagatagccatgacagatacaacacccttcgggcaacagcgcgtgttcaaggagaaggtggacacccggacgccccgggccaagcgaggcaccgcccagattatggaggtaacggcaaagtggctgtggggcttcctctcccgcaacaagaagccgcggatctgcacccgcgaggaattcacccggaaggtccgcagcaacgcggccatcggggccgtcttcgttgacgagaaccaatggaactccgccaaggaggccgtcgaagacgagcggttctgggatctggtgcatagagagcgggagctacataaacagggaaagtgcgcgacctgcgtctacaacatgatggggaaacgggagaaaaagctcggagagttcgggaaggctaaaggctcccgagccatttggtacatgtggctgggcgcccggttcctggagtttgaggcgctcgggttcatgaacgaggaccactggttcagccgtgagaactccctttcaggcgtcgagggggagggcctgcacaaacttggctacatcctgcgcgacatctctaagatccccgggggcaacatgtatgccgatgacacggccgggtgggacacccggatcaccgaggacgacttgcagaacgaggcaaagatcacagatatcatggagcccgagcatgccctcctggcgaccagcatcttcaagctgacctaccagaacaaggtggttcgagtgcagcgccccgccaagtccggcaccgttatggacgtcatcagccggagagatcaacgggggtccggccaggtgggaacctacgggctaaatactttcaccaatatggaagtgcagctgattcgccagatggagagcgagggcatcttctccccgtcggagctggagacccccaacctcgcgaagaaagtcctggactggctggagaagcacggtgccgagcggctcaagcgcatggccatctccggcgacgactgcgtggttaagcccatcgatgaccggttcgcgaccgccctgacggccttgaacgacatgggcaaggtccggaaagacatcccccagtgggagccgagcaagggctggaacgattggcagcaggtccccttctgctcacaccacttccaccagctcatcatgaaagacgggcgggagatagtggtcccctgccgcaatcaggacgagctggtggggcgggcccgcgtgtctcagggcgccgggtggtcactgcgggaaaccgcttgcctcggcaaatcgtacgcccagatgtggcagctgatgtatttccaccgacgggacctgcgcttagcagccaacgccatctgctccgcggtccccgtggattgggtacccacctctcggacaacctggagcattcacgcccaccaccagtggatgacaaccgaggacatgctgtccgtctggaatcgcgtgtggatcgaggagaacccctggatggaggacaagacccacgtgagctcctgggaggaggtcccctatctggggaagcgggaggaccagtggtgcggcagcctgattgggctgaccgcccgcgccacgtgggcgaccaacatccaggtggccatcaaccaggttcgtcggctgatcggctcagaaaactacctcgactacatgaccagtatgaagcgcttcaagaacgagtccgacccagaaggcgccctatggtga

SEQ ID NO: 24678 - RNA, 9879 nt, synthetic construct
  misc_feature 1..9879: note = derived and/or modified CDS sequence (opt11) from DENV-1__KC692514__SS-prME
  source 1..9879: mol_type = other RNA
tcggttaccatgctgttaatgctgctgcccaccgccctggccttccacctgaccacccgcggcggggagccccacatgatcgtgtcaaagcaggagcggggcaagtcgctccttttcaagacctcggccggtgtgaatatgtgcaccctgatcgccatggacttaggcgagctatgcgaggacaccatgacctacaagtgcccccgcatcaccgaggccgagcccgacgacgtggactgctggtgcaatgccaccgacacctgggtaacctacggaacctgcagccagaccggcgagcaccggcgagagaagcgttccgtggccctggctccccacgtgggtctgggtctcgagacccgcacggagacctggatgagctccgagggcgcttggcggcagatccaaagggtcgagacttgggccttacggcaccccggctttactgtgatcgccttcttcttggcgcacgcgattggtaccagcatcacccagaaggggatcatcttcatcctcctgatgctggtgaccccctccatggccatgcgctgcgtcggcatcgggaaccgggatttcgtggaggggctcagcggcgccacgtgggtggacgtcgtgcttgagcacgggtcctgcgtgaccacgatggccaagaataagcccacacttgacatcgagctcctgaagacggaagtcaccaatccagcggtgctccgcaagctctgcatcgaggccaagatcagtaacacgaccacggactcccggtgcccgacacagggggaggccaccctggtggaggagcaggacgccaacttcgtctgccgccggacattcgtggacagaggctggggcaatggatgcgggctgttcggaaaggggagcctcctgacatgcgcaaaattcaaatgtgtaaccaaacttgagggcaaaatcgtccagtacgaaaatctcaagtactccgtgatcgtgaccgtccataccggcgaccaacaccaggtagggaacgagacgaccgagcacggcaccatcgcgaccatcacaccccaggcccccaccagcgagattcagctgacggactacggggccctgaccttagattgcagcccccggaccgggctggacttcaacgagatggtattactcacgatgaaggagaagtcctggctggtgcataagcagtggttcttagacctcccgctgccatggacctccggggcgagcacttctcaggagacctggaaccgccaggatctgctcgtgacgtttaagaccgcacacgcgaagaaacaggaggtagtggtgctgggctcccaagagggtgcgatgcacacagccctgaccggggccactgagatccagacaagtggcaccaccaccatctttgccgggcacctcaagtgccggttaaagatggacaagctgaccttaaagggcatgtcctatgtcatgtgtaccggctccttcaaactggagaaagaggtggcggagacccagcacggcactgtgctggtccaggtgaagtacgagggaaccgacgccccctgcaaaatcccattctctacccaggatgagaagggggtgacccagaacggccgcctaatcacggcaaacccgatagtcaccgacaaggagaagcccgtgaacattgagaccgagccgccattcggcgaatcttacatcgtggtcggggccggtgagaaagcgctcaagctgagttggttcaaacgggggagctccataggcaagatgttcgaagcgaccgcgcgtggtgcccgccggatggccattctaggcgatacggcatgggacttcgggagcatcggcggcgtgttcacctccgttgggaagttggtccaccaggttttcggcaccgcttacggggtgttgttcagcggcgtcagttggacaatgaagatcgggatcggcatactcctgacctggctgggcctgaacagccgctcgaccagcctctccatgacatgcatcgccgtcggtatggtgaccctgtatcttggcgtcatggtgcaggccgacagcgggtgtgtcatcaactggaagggccgtgagctcaagtgcgggtccggaatcttcgtcacgaacgaggtgcacacctggaccgagcagtacaagttccaggccgactctccgaagcgcctgagcgcggccatcgggaaagcctgggaggagggggtgtgcggcatccggtccgccacccgtctagaaaatatcatgtggaaacagatttctaacgagctcaaccacatcctgctggagaacgacatgaagttcaccgtcgtggtgggggacgccaatggcatcctcgcacaggggaagaagatgatacgaccccaaccaatggagcacaagtattcctggaagtcctggggcaaagcaaagataatcggcgccgacatccagaacacgaccttcatcatcgacgggcccgacaccccggagtgccccgacggccagcgagcctggaacatctgggaggtcgaggactacggttttggcgtgttcaccacgaacatttggctgaagctgcgggacagttacacccagatgtgcgaccaccggctgatgagtgcggccatcaaggactctaaggcagtgcacgctgatatgggctactggatcgagagcgagaagaacgaaacctggaagctggcccgagcgtcatttatcgaggtcaagacctgcacgtggcccaaatcgcacaccctctggagtaacggtgtattagagagcgagatgatcatcccaaagattttcggtgggccgatctcccagcacaactaccgccccggctatttcacccagaccgcagggccctggcacctaggcaagctggaactcgacttcgacctgtgcgagggcacgacggtggtagtggacgagcactgcgggaaccggggcccgagcctgcgcaccaccacggtgaccgggaagattatccacgagtggtgctgcaggtcctgcactctgccgccgctgaggtttcgcggcgaggacgggtgctggtacggcatggagatccgcccagtcaaggaaaaggaggagaacctggtgcggagcatggtgtccgccggctccggggaggtcgattctttctccctcggcatcctgtgcgtcagcatcatgatcgaggaggtcatgcgctcgcgctggagccggaagatgcttatgaccgggacgctcgccgttttcttactgctcatcatgggccaactgacctggaatgacctgatccgcctctgcataatggtgggagccaatgcttccgaccggatgggaatgggcaccacctatctggctctgatggctaccttcaagatgcgcccgatgttcgccgttgggttactgtttcggcgcctgacgagccgggaagtcctcctgctgaccatcggcctctccctggtggcgagcgtcgaactgcccaactccctcgaggagctgggggacggcctggcgatgggtatcatgatgctcaagctgctgaccgagttccagccccaccagctctggacgaccctgctgagcctcaccttcgtgaagaccacgttatccctggactacgcctggaagaccacagccatggtcctcagcatcgtctcgctgtttcccctgtgcctctcaaccacatctcagaagaccacctggctgccggtgctgctcgggtctttcggctgcaaacccctgaccatgttcctgattacagagaacaagatctgggggaggaagtcctggccgctcaacgaagggatcatggcgataggaatcgtgagtatcctgctgagtagcctactgaagaacgacgtccccctggctggcccgctcattgccggcgggatgctgatcgcctgctacgtgatctccggttctagcgccgacctgtccctagagaaggccgcggaggtgagctgggagcaggaggccgagcactctggggcctcacacaacatcctggttgaggtgcaggacgacggcacgatgaagatcaaggacgaggagcgggacgacaccctgaccatcctactcaaggccacactgctcgccgtgtccggggtctaccccatgagcatccccgcgacgctgttcgtctggtacttctggcagaagaagaagcagcgctccggcgtgctgtgggacacccccagcccgcccgaggtcgagcgggccgtactcgacgacggaatatacaggatcctgcagcggggtctgttggggcgctcgcaggtcggggttggagttttccaagatggagtgttccacaccatgtggcatgtaacccgtggcgccgtgctcatgtatcagggcaagcgcctggaacccagctgggcctccgtcaaaaaggacctcatcagctacgggggcgggtggcggtttcagggctcctggaacacaggggaggaggtacaggtgattgccgtagagcccgggaagaacccgaagaacgtccagaccacccccggcaccttcaagacgcccgaaggggaggtgggcgcgatcgccctcgactttaaacccgggaccagcggcagccctatcgtgaaccgcgaaggcaagatcgtcgggctgtatggcaatggggtggtgaccacaagcggcacatacgtctccgccatcgcccaggccaagaccagccaggaggggcccctgcccgagatcgaggacgaggtgttcaagaagcggaaccttaccatcatggacctgcacccgggcagcggtaagacccgccggtacctgcccgcgatagtccgcgaggccattaagcgcaagctccggacactgatccttgcccccaccagagtcgtggcctccgaaatggcagaggccctcaaggggatgcccatccggtaccaaaccacggcggtcaagagcgagcacaccggacgagagatcgtcgacctgatgtgccacgccacattcaccatgcggctgctctcccccgtgcgggttcccaactacaacatgatcatcatggacgaggcacacttcaccgaccccgccagcatcgccgcccgagggtacatctccacgcgcgtcggcatgggggaggccgcagcgatcttcatgacggcgacgccgcccggcagcgtggaagccttccctcagtctaacgccgtgatccaggacgaggagcgggacatccctgagcgcagctggaactccggctacgattggatcaccgacttccccgggaagacggtctggttcgttcccagcatcaagtccggcaacgacatcgccaactgcttgcggaagaacgggaagcgggtgattcagctgtcccggaagaccttcgacacggaataccagaaaaccaaaaacaacgactgggactacgtagtgacgaccgacatatccgagatgggcgcgaacttccgcgccgaccgagtgatcgacccccgccgctgcctcaagcccgtgatcctgaaggacgggcccgagcgcgtaatcctggccggcccgatgcccgtcacggtggccagcgcagcccagcggcgcggccgcatcgggcggaaccaaaacaaggaaggtgaccagtacgtgtacatggggcagccccttaataacgacgaggaccacgcacactggaccgaagccaagatgctgctggataacatcaacacgcctgagggcatcatccccgctctctttgagcctgagcgcgagaagtccgcggccatcgatggggagtaccggctacgcggagaggcccggaagacctttgtcgaactgatgcgcagaggggacctcccggtgtggctgagctacaaggtagcctccgaaggattccagtacagcgatcgccgctggtgcttcgacggcgagcgcaacaaccaggtcctggaggagaacatggacgtggaaatttggacgaaggagggggaacggaagaaacttcgcccgaggtggctggacgcccgcacctactccgaccctctggcgctccgggagttcaaggaatttgccgccggccgccggagcgtgagcggcgacctgatattggagattgggaaactccctcagcacctgacccttcgcgcccaaaacgccctggacaatctagtcatgctgcacaactccgagcagggcgggaaggcctatcggcacgcaatggaggagctccccgacacgatcgagaccctgatgctgctcgccctgatcgccgtgctgaccggcggggtgaccctcttcttcctgagcggcaagggcctggggaagacgtccattggactattgtgcgtcaccgcgagctcagccctactctggatggccagcgtagaaccccactggatagcggcctccatcatcctggagttcttcctcatggtgctcctgatcccggagcctgacaggcagcggactccacaggacaaccagttggcctacgtagtgatcgggctcttattcatgatcctgaccgttgctgccaacgagatgggtctcctggaaacgaccaagaaggacctggggatcggctacgtcgcggccgagaatcaccagcatgcgaccatgctagacgtggacctgcaccccgcctcggcttggaccttatacgcggttgcaacgaccgtcatcacccccatgatgcgccacacaatcgagaacacgaccgctaacatctcattaaccgccatcgccaaccaggccgccatactgatgggcctggacaaggggtggcccatcagcaagatggatatcggagtgcccctcctggcactggggtgctacagccaggtgaacccgctcacactgacggccgccgtcttgatgctcgttgcccattacgcgatcatcggccccggcctgcaggccaaggccacccgcgaggcccagaagcggaccgccgcaggcatcatgaagaacccaaccgtagacggcatcgtcgccatcgacctggaccctgtggtgtacgatgccaagttcgagaagcagctcgggcagatcatgctgttgattctctgcacgagccagatcctgctgatgcgcaccacctgggccctctgtgagtccatcaccctggccacgggcccgctgactaccctctgggaagggagccccggcaagttctggaacaccaccatcgcggtctccatggcgaacatcttcaggggcagctacctggcgggggccggcctggccttcagcttgatgaagtccctcgggggagggcgccgcggaaccggagcgcaaggggagaccctgggagagaagtggaagcgtcagctcaaccagctgtccaagagcgagttcaacacctacaagcggagcgggatcatggaagtggaccgatccgaggccaaggaaggcctgaagagaggggaaacgacaaagcacgccgtaagccgaggcaccgccaagctacgctggttcgtcgagcgcaatttagtgaagccagagggcaaggtgatcgaccttgggtgcggccgcggtggctggtcctactattgcgcggggcttaaaaaggtcaccgaggtgaagggctacactaagggagggcccggtcacgaggagccgatccccatggccacgtatgggtggaacctcgtgaagctgcacagtggaaaggacgtcttcttcatgccgccggagaagtgcgacaccctgctctgcgacatcggggagtcctctccgaatcccacaatcgaggagggaaggaccctccgcgtgctgaagatggtggaaccctggctccgtggcaatcagttttgcatcaagatcctgaatccctatatgccgtccgtcgtggagacgctggagcagatgcagcgcaagcacgggggtatgctcgtacgcaaccccctgagccggaacagtacccacgagatgtactgggtcagctgcgggactggcaacatagtgtccgcagtgaacatgaccagccgcatgttactcaatcgcttcacgatggcccaccggaaacccacttacgagcgggacgtcgacctgggcgccgggacccggcacgtggcggtggagcccgaggtcgccaacctggacataatcggccagcgcatcgagaacataaagaacgagcacaagtcgacctggcactacgatgaagacaacccgtacaagacgtgggcctaccacggaagctacgaggtgaagccctctggctccgcgtcctccatggttaacggggtagtgcggctcctgaccaaaccgtgggacgtcatccccatggtgacccaaatagcaatgaccgacacgaccccgttcggccagcagcgcgtgttcaaagaaaaggtcgacacccggacgccgcgggcgaagcgaggcacaacacaaatcatggaagtgaccgccaagtggctatgggggttcctatcccgcaacaagaagcctcggatctgcacccgcgaggagttcacgcggaaggtgcgctcgaacgctgccatcggcgccgtcttcgtggacgagaaccaatggaacagcgcgaaggaggccgtggaagacgagcggttctgggaccttgttcaccgcgagcgggagctgcacaaacaagggaagtgcgcgacctgcgtgtacaacatgatgggaaagcgcgaaaagaagctcggtgaatttggcaaggccaagggctcccgagcgatatggtatatgtggctgggggcacgttttctcgagttcgaggccctcggctttatgaacgaggatcactggttttcccgggaaaattccctcagcggcgtggagggagaggggctgcacaagctaggctacatcttgcgagacatctccaagatcccgggcgggaacatgtacgccgacgacacggcgggctgggacacccgcatcacggaggacgacctgcagaacgaggcgaagatcaccgacatcatggagcccgagcacgctctccttgcaacgagcatcttcaagctgacctatcagaacaaggtcgttcgggtgcaacgccccgctaagaatgggacggtcatggacgttatctcccggcgggaccagcggggcagcggccaggtggggacctacggcctcaacaccttcaccaacatggaggtccagctgatccgccagatggagtccgaggggatcttcctcccctccgaactcgagacgccgaatctggctgaacgggcgttagactggctcgaaaagcacggcgccgaacgcctgaagcggatggcaatatccggcgacgactgtgtcgtgaagcccatcgacgatcgcttcgccaccgcccttaccgctttgaatgacatgggtaaggtccggaaggacatcccccagtgggagcccagcaagggttggaacgattggcagcaggtcccattctgttcccaccactttcaccagctgattatgaaggatgggcgcgagatcgtggttccctgccggaaccaggacgagctggtgggacgcgcccgggtgagccaaggcgccggctggagtttacgcgagaccgcctgtctgggcaagagctacgctcagatgtggcagctgatgtacttccaccgacgcgatctcaggttagccgcaaacgcaatttgttccgccgtgcccgtggactgggtgcccgcgagccgcaccacgtggagcatccacgcccaccaccagtggatgaccaccgaagacatgctgtccgtgtggaacagggtgtggatcgaggagaacccgtggatggaggacaagacgcacgttagctcctgggaggaggtcccctacctcggcaagagagaagaccagtggtgcggttccctgatcgggttaacggcccgtgccacatgggccaccaacatccaggtggcgatcaaccaggttcgccgcctaataggaaacgagaactaccttgattatatgacctccatgaagcggttcaaaaatgagagcgacccggagggcgctctgtggtga

SEQ ID NO: 24679 - RNA, 9879 nt, synthetic construct
  misc_feature 1..9879: note = derived and/or modified CDS sequence (opt11) from DENV-1__KC692515__SS-prME
  source 1..9879: mol_type = other RNA
agcgtcaccatgctactgatgctcctccccactgcactcgcgttccacctaactactcgaggcggggaaccccatatgatcgtcagcaagcaagaacgcggaaaatccctactctttaaaacttccgcaggagtaaacatgtgcacattaatagcgatggacctcggggaattgtgcgaagacacgatgacttacaaatgtccacgcatcaccgaagcagaaccagatgacgtagactgttggtgtaatgccacagacacctgggtcacgtacggaacgtgcagtcaaacgggggagcatagaagagaaaagcgctcagtcgcgctagcgccccacgtgggcctggggctcgaaacgcgtacagaaacctggatgagctcagagggtgcgtggaagcaaatacagagagttgagacctgggctctaagacacccagggtttaccgtcatcgctctattcctcgctcatgccatcggtacctcgataacgcaaaaagggataatattcatccttctcatgctagtaaccccttcaatggcgatgcgttgcgtcggcatcggcaatcgagactttgtagaaggattgtcgggcgccacgtgggtggatgtagttctggaacacggttcatgcgtaaccacaatggctaaaaacaaaccaacgctcgacatcgaactactcaaaacagaggtaacaaacccagccgtactacgaaaattatgcatagaggccaagatatcgaacaccactacagactcgagatgtccaacgcaaggggaagccaccctagtcgaggagcaagatgcaaactttgtctgtcgccgaacattcgtcgaccgaggatggggcaatggctgcgggctattcggcaagggctcgctgctaacatgtgcgaaattcaagtgcgttacaaagttagaaggaaagatagtgcagtacgaaaatctcaaatactcggtgatagtaactgtgcacaccggggaccagcaccaagtcgggaacgagacaaccgagcacggcacaatcgccaccataacaccccaggctccgacgtccgagattcagctcacggactatggtgcgctaaccctggactgcagcccccgaacaggcctggatttcaacgaaatggtattactgacgatgaaagaaaaatcttggctagtacataagcaatggttcctcgatctacctctcccctggaccagtggcgcgtcaacatcgcaagaaacctggaacagacaggacctattagtaacattcaagaccgcacacgcgaagaaacaagaggttgttgtgctgggtagccaagaaggcgcaatgcatactgccctcacgggggccacagaaatacaaactagcggcactacgacgatattcgcgggtcatctcaagtgcagactaaagatggacaagctgaccttaaagggcatgagctatgtcatgtgcacagggtcgttcaaactcgaaaaagaagtagcggaaacccaacacggaaccgtcctagtacaggtgaaatacgaagggaccgatgccccatgtaagatcccctttagcacccaggatgaaaagggtgtaacgcagaacgggagactcatcacggccaacccaattgtgaccgataaggaaaagcctgtcaacatcgaaacagagccaccattcggagaaagctacatcgttgtaggcgcgggaggcaaagccctaaagctgtcatggttcaaacgaggaagcagcatagggaaaatgttcgaagcaaccgcgcggggcgcgagaagaatggccatactcggtgacacggcatgggacttcgggagtataggcggggtgttcacaagtgtcgggaaactcgtccaccaggtgttcggcacggcatatggagtgctatttagcggcgtaagctggacgatgaagatcggaatcgggattctgctcacgtggcttggactcaacagtcgatcaacaagcctcagcatgacgtgcatcgcagtcggcatggttacgctctacttaggagtaatggttcaagctgactcaggatgcgtcataaattggaagggacgggaactcaaatgcggctcagggatattcgttaccaacgaggtacatacatggacagaacaatacaaattccaggctgactcaccgaagcgccttagcgcggccatcggtaaagcatgggaagaaggagtctgcggcatacgctcagcaacccgtctcgaaaatataatgtggaagcagataagcaacgaactgaatcacatactcctcgagaacgacatgaagttcacagtcgtagtcggtgatgcgaacggcattctagcccagggcaaaaagatgatacgcccacaaccgatggagcataagtatagctggaaatcttggggaaaagccaaaatcatcggggcggacatacagaatacaacctttatcattgatggccctgacacaccagagtgccccgacgggcagagagcttggaacatctgggaagtcgaagactacggctttggcgtctttacgaccaatatatggctaaaactgagagactcatacacgcagatgtgcgaccaccgcctaatgtctgcggcaatcaaagactcgaaagcggtacacgcagacatgggatattggatcgaaagcgaaaagaacgagacctggaaacttgccagagctagcttcatagaagtaaagacgtgcacttggcccaaaagccacacgttgtggagcaacggagtactcgagagcgagatgattattccaaaaatattcggcggaccgatctctcagcacaactacagaccgggatatttcacccaaaccgcagggccctggcacctcgggaaattagaactagactttgacctctgcgaaggaaccactgtagtagtcgatgaacactgcggcaatcgcggtccttcgctacgaaccacaaccgtgaccgggaaaattatacacgaatggtgctgcagaagctgcacattaccgccactccgattccggggcgaagacggatgctggtacgggatggagatccgtccagtaaaagaaaaagaagaaaacctagtacggtcaatggtatctgccgggagcggagaagtcgactcgttcagcctcggaatactatgtgtaagtatcatgatagaagaggtcatgcgttcgcgatggtccaggaagatgctgatgaccggaacgctcgcagtgtttcttttgctcataatgggccaactaacgtggaacgatctgattcgtttatgcatcatggtcggtgcgaacgcatccgatcggatggggatggggaccacatacctcgctttaatggcgacatttaagatgaggcccatgtttgcagtaggtctcctattcaggcgcctcacgtcgcgagaggtactgttactgacgatcgggctaagtctcgtagcgtccgttgaactgcccaactccctggaagaactcggcgacggattggcgatggggataatgatgttaaaattattgacagagttccaacctcatcaactgtggacaacccttctaagcctaacgtttgttaagaccaccctaagtctcgactatgcctggaagaccaccgccatggtcctaagtatagtatcactgttcccattatgcctctcaaccacgtcgcagaaaacgacctggttaccagtactgctggggagctttggctgcaaaccgctaacaatgttcctaataacagaaaacaagatttgggggcggaagtcctggccactaaacgagggtatcatggcgattggcatagttagcatactgctatcctccctgctcaagaacgacgtccctctagcgggaccactgatcgcagggggaatgttgatagcctgttacgtaataagtggttcatcagctgacctgtctctagagaaagcggccgaggtgagctgggaacaagaagctgaacatagtggggctagccacaacatcctcgtggaggtccaagacgacggaacaatgaagatcaaggacgaagaaagagacgacacactaacaatactgctaaaggcgacccttcttgccgtctcaggcgtttaccccatgagcatccccgccacattgttcgtctggtacttctggcagaaaaagaaacaaaggtcaggtgttctgtgggacactccgtcaccaccagaagtcgagcgggcagtactagacgatggaatataccggatacttcaacgcggactactcgggagaagccaggtcggcgtgggtgtatttcaagatggggtattccacaccatgtggcacgttacacggggcgcagttttaatgtaccaaggcaaacgattagaaccatcctgggctagcgtaaagaaggacttaatatcctacggcgggggctggaggttccagggaagctggaacacgggcgaagaagttcaagtgatcgcagtggagccgggtaaaaaccccaagaatgttcagacaacccctggcactttcaaaacaccagagggcgaggtcggcgccatagccctagactttaaacccggcacgagcgggagcccaatagtaaacagagaagagaagatcgtgggactgtacggcaacggggtcgtgacaacgagcggtacgtacgtatccgcgatagcacaggccaaggccagccaggaggggcccctgcctgagatcgaggacgaagtctttaagaaaaggaacctgactataatggacctccatccaggatctgggaagacacgaaggtacctacccgcaattgtccgagaagccataaaacggaaactccgcactcttatcctcgcgccgacgcgagtggtcgctagcgaaatggcagaggcactcaaagggatgcctatacgatatcaaaccacggcagtcaaatccgaacacacgggccgcgaaatagtagacctgatgtgccacgcgaccttcacaatgaggctcctaagccccgtccgagtaccaaactataatatgataatcatggacgaagcccactttaccgaccccgcgagtatcgcggcccggggctacattagtactcgagtcgggatgggcgaggcagccgcgatcttcatgaccgcaacgccacctgggagcgtcgaggccttcccgcaaagtaacgctgtcattcaggatgaggagagagacattccggagagatcctggaatagcggctacgactggataacagacttccctggcaagactgtctggtttgtaccctccataaagtccggcaacgatatcgcgaactgcctgagaaagaacggcaaacgcgtaatccaacttagtagaaagacgtttgacacagaataccaaaagacaaagaacaacgactgggattatgtcgtcacgacggacataagcgaaatgggagccaacttccgcgccgacagggtgatagacccacgccgatgtcttaagccggtgatcctgaaagacggacccgaacgtgtcatactagcaggcccgatgcctgtaactgtagccagcgccgcgcaacgtcgagggagaatcgggcgaaatcagaacaaggagggcgaccaatacgtgtatatgggccaaccactaaacaacgatgaagatcatgcgcattggacagaggcaaaaatgctcctagacaacataaacacccctgagggaattatcccggccctctttgaacccgaacgagagaagtcagcggcaatagacggtgaatacagacttaggggcgaggctcgaaaaaccttcgtagaattaatgaggcgcggggacctcccagtctggttgtcgtacaaagtcgcaagcgaggggtttcagtatagcgatcgtagatggtgcttcgacggcgaacgtaacaaccaagtactcgaggaaaacatggacgtggaaatatggaccaaagaaggagagaggaagaaactccgcccaagatggttagacgcaagaacatacagtgaccctctagccctccgagagttcaaagaatttgctgccggccggaggtcggtcagcggagatctgatattagagatcgggaagctgccacagcacctcacccttcgagcacagaacgcattggacaacctcgtaatgctccacaatagtgagcaaggaggaaaagcgtacaggcacgccatggaagaactacctgatacaatagaaacgctcatgctcctagccctgatcgcggtgcttacgggtggcgtaacattattcttcctatccgggaaaggattgggcaaaaccagcatcgggctgctatgtgttacagcaagttccgccctactatggatggcctccgtggaaccacactggatagcggcctccataatcctggagttcttcctgatggtgctactaatacccgagccagaccgccaaagaacaccgcaagacaaccagctcgcatatgtcgttatcggactcctcttcatgattctcacagtcgcagcgaacgagatggggctcctagaaacgacgaagaaggatttagggataggacacgtcgcagccgagaatcatcagcactccaccatgttagacgtggatctgcacccggcatccgcttggacactttacgccgtggctacgactgtaatcacccccatgatgcgacataccatcgagaacacaacggcaaatatatccctcacggcaatagcgaaccaggcggcaatactaatgggtctagacaagggctggccaatcagcaaaatggacatcggtgtccccttgctcgccctagggtgttacagccaagtaaacccacttactctgacagccgcagtactcatgctcgtggcacactacgccatcatcggcccggggctacaggcgaaagccacacgggaagcccaaaagcggaccgccgctgggatcatgaaaaaccccacagtggatggaatcgttgccatcgacctcgacccagtcgtatatgatgcaaagttcgagaagcaactcgggcaaattatgctcctgatattgtgcacaagtcaaattcttctcatgcggacaacctgggcgctatgtgaatcgataaccctcgctaccggacccctcaccactctctgggaggggtcgccagggaaattctggaacacaacaattgcggtaagcatggccaacattttcaggggatcatacctggcgggagcaggcctagcgttcagcctcatgaagagtctcgggggcggaaggcgggggactggcgcacaaggagagactctcggcgagaaatggaaacgccaacttaatcaattgtcaaaatcagagttcaatacgtataaacgatcaggaataatggaggtcgaccgatcggaagcgaaagaagggcttaagagaggagaaacgaccaaacatgcagtctcacgcggaacagctaagctccggtggttcgtcgaaagaaaccttgtaaaacccgagggtaaggttatcgaccttggatgtgggagaggagggtggagttattactgcgccggactcaagaaagtcacagaggtaaaaggatacacgaaagggggaccaggacacgaagaaccgataccaatggcaacctacggctggaatctcgtcaaattacacagtggaaaagacgtcttctttatgccacccgaaaagtgtgacacactcctctgcgacatcggcgaaagttcacccaatccaacaatcgaggagggacgcactctccgggtcttaaaaatggtggagccatggctgagaggcaaccagttttgcatcaaaattctaaacccctacatgcccagcgtcgtggaaactttagaacaaatgcagcgaaagcacggcggcatgctagtgcggaacccgctatcaagaaactcgacccacgaaatgtactgggtgagttgtggcaccggaaatattgtgtccgcggtcaacatgacatcccgaatgcttctcaataggtttactatggcacatagaaaaccaacatacgagagagacgtagacctcggggccggaacacgacacgtggccgtcgaacctgaagttgccaatctagatatcattggccaaagaatcgagaacatcaagaacgagcaccggtccacatggcactacgacgaagacaacccatataaaacgtgggcgtaccatgggtcgtacgaagttaaaccaagcggaagcgcaagtagcatggttaacggggtagtgagactcctcactaagccgtgggatgtaatacccatggtgacccaaatcgccatgacggacacgaccccattcggccaacagagagtctttaaggaaaaagtagacacacggaccccaagggcaaaaagaggcaccacgcaaatcatggaagtgacggcaaagtggctctggggattcctaagccgaaacaagaagccaaggatctgcacccgagaagagttcacacgaaaggtgcgatcaaacgctgccatcggggcagtcttcgtagacgagaatcagtggaacagtgccaaagaagccgtggaagacgaacgattctgggacctagtacatagggaaagagagcttcataaacaaggcaagtgcgcaacctgcgtgtacaacatgatgggaaaacgagagaagaaattgggtgagttcggcaaagcaaaaggctctagggcgatctggtacatgtggctcggcgctcgcttcttggagttcgaagcgctgggatttatgaacgaggaccactggttctcccgagagaatagcttatcgggagtagaaggggaagggttacacaagctaggctatatactgagagacatctctaaaataccgggcgggaacatgtatgcagacgataccgcaggatgggatacacgaataaccgaagatgatctgcaaaatgaagccaagataacagacataatggaacccgaacacgccctacttgccacatccatcttcaaactcacgtaccagaacaaagtagtaagggtacaaaggccagccaaaaacggcactgtgatggacgtaataagtcgccgagatcagcgaggcagtggacaggtcggaacatacggcctaaacacgttcacgaacatggaagtccaactcatcaggcaaatggaaagcgaaggtatattcctcccgtcagaactggagaccccaaacctagcagaacgagcgctcgactggctcgaaaaacacggagcggagagattaaaacgaatggctatctcgggcgacgactgcgtagttaaaccgatcgacgatcgatttgccacagcattaacagccctcaacgacatgggaaaagttcgcaaagacatcccgcaatgggagccgagcaaggggtggaacgattggcaacaagttccgttttgctcgcaccactttcaccaattaatcatgaaagacggacgagaaattgtggtaccatgtaggaaccaggacgagctagtgggccgggctcgcgtcagccaaggagccggttggtcattgcgagagaccgcctgtctcggaaaatcatatgcgcagatgtggcaactgatgtactttcaccgccgagacctccgcctagctgcaaatgccatatgttccgccgtcccagtggactgggttcccgcgtcccgaaccacatggagcatccatgctcaccaccaatggatgacaaccgaggatatgctaagcgtttggaaccgcgtgtggatcgaggaaaacccgtggatggaggataagacacacgttagctcctgggaagaggtcccgtacctaggaaagcgcgaagatcaatggtgcggatcactaataggtttaacggcgcgcgccacatgggccacaaacatccaagtggcaataaaccaagtccgccgcctcattgggaatgaaaactacctcgactatatgaccagcatgaaacggtttaagaacgaaagcgatccagaaggggcgctttggtaa

SEQ ID NO: 24680 - RNA, 9879 nt, synthetic construct
  misc_feature 1..9879: note = derived and/or modified CDS sequence (opt11) from DENV-1__KC692516__SS-prME
  source 1..9879: mol_type = other RNA
agcgtgaccatgttactcatgctgctgcccaccgccttagcgttccacctgaccaccaggggcggggagccccatatgatcgtgagcaagcaggagcggggcaaaagcctcttgttcaagacaagcgcgggggtgaacatgtgcacgttgattgcaatggaccttggagagctctgcgaggacacgatgacctacaagtgtcctcgcatcacggaggccgagcccgacgacgtagactgctggtgcaacgctaccgacacttgggtaacctatggaacttgcagccagaccggggagcaccggcgggagaagcggtcggtggcgctggctccccacgtcggcctggggctcgaaacgcgcacagagacttggatgagctccgagggcgcctggaagcagatccagcgggtcgagacctgggcccttcgccaccccgggttcacggtgatcgcgttcttcctcgcgcacgccatcggcaccagcatcacccagaagggtataatctttatcctcctgatgctcgtgacaccctccatggccatgcggtgcgtcggcatcggtaaccgcgacttcgtggaggggctcagtggtgcgacgtgggtcgacgtcgtgcttgagcacgggtcctgcgtgaccaccatggccaaaaacaagccgaccttggacatcgagcttctgaaaacggaggttaccaaccccgccgtgctgcggaagctctgcatagaggccaaaatctctaacaccaccacggactcccgctgcccgacccagggcgaggccacactggtggaggagcaggatgctaatttcgtctgccggcgcacattcgtggaccggggctgggggaatggctgtgggctgttcggtaaggggtccctcctgacgtgcgcgaaattcaagtgcgtgaccaaattggaggggaagatcgtccagtacgagaacctcaagtactccgttatcgtcaccgtacacacaggcgaccagcaccaggtggggaatgagacgaccgagcacggcacaatcgcgaccataacaccccaagcccccacgagcgagatccagctcaccgactacggggccctgaccctcgactgcagcccccggaccggcctcgacttcaacgagatggttctgctcacgatgaaggagaagtcctggctggtgcataaacaatggttcctggacctaccgctgccatggacgagtggggccagcacctcgcaggagacatggaaccgacaggacctgctcgtaacgttcaagacggcccacgcgaagaaacaggaggtcgtggttctaggctcccaggaaggggcaatgcacaccgccctgaccggcgccacggagatccagaccagcggaaccaccacgatcttcgccgggcacctcaagtgccgccttaaaatggacaaactgaccctgaagggtatgagctacgtgatgtgcaccgggagcttcaagctggagaaggaggtggcggagacccagcacggcactgtgctagtccaggtgaagtacgagggcactgacgccccttgtaagataccattctccacccaggacgagaagggtgtgacccagaacggccggctgatcactgcgaaccctattgtaaccgataaagagaagccggtgaacatagaaactgagccgcccttcggggaaagctacatcgttgtcggagccggggagaaggcgctcaagctgtcctggtttaagcgcggaagcagtataggcaagatgtttgaggctaccgcccgcggggcacgccgcatggccattctcggcgacacggcgtgggacttcgggagcattggcggggtgtttacctccgtggggaagctcgtccaccaggtttttggaaccgcctacggagtgctgttttcaggcgtctcctggaccatgaagatcgggatcggcatcctgctcacttggctcggcctgaacagccggtcgacaagcctttccatgacctgcatcgccgtggggatggtgaccctgtacttgggcgtgatggtgcaggccgactcagggtgcgttatcaactggaaggggcgggaactcaaatgcgggtccggaatcttcgtcacgaacgaggtgcacacctggaccgagcagtacaagtttcaggctgacagcccgaagcggttaagcgctgccatcggcaaggcctgggaagagggggtttgcggaatccgctccgccacccgcctcgaaaatatcatgtggaagcagatttcgaacgaactcaatcatattttactggagaatgacatgaagtttactgtagtggtgggagacgccaatggcatcctcgcgcagggtaagaaaatgatccgaccccagcccatggagcacaagtacagctggaagagttggggcaaggccaagatcatcggcgctgacatccaaaacacgaccttcatcatagatgggcctgatacaccggagtgccccgacggacagagggcctggaacatctgggaggtcgaagactacgggttcggcatcttcacaacgaatatttggctgaagctgcgcgactcctacacacagatgtgcgatcatcgtctcatgagcgctgccatcaaagactccaaggccgttcacgcagacatgggctattggatcgaaagcgagaagaacgagacgtggaaactcgctcgggcgtccttcattgaggtgaagacctgcacgtggcccaagagccacaccctgtggtccaacggggtcctcgagagcgagatgatcatcccaaagatctacggcgggccgatttcacagcacaactaccggccgggctacttcacccagacagccgggccctggcacttgggcaagctggagctcgacttcgatctatgcgagggcacgacagtggtggtcgacgagcactgcgggaaccgaggcccatccctacggaccaccacggtgacggggaagatcatccacgagtggtgctgccgctcctgcaccctgccgcccctgcgctttagaggcgaggacggctgctggtatggcatggagatccgtcccgtgaaggagaaggaggagaacctggtccgcagtatggtctccgccggcagcggagaggtagacaactttagcctcggcatcctgtgcgtctccatcatgatcgaagaggtgatgcggagccgctggtccagaaaaatgctgatgaccgggacgctcgccgtgtttctgctgctcataatgggccagcttacatggaacgacctgatccggttatgcatcatggtcggggcaaacgccagcgatcgcatgggcatgggtaccacgtacctagccttgatggccaccttcaagatgaggccgatgttcgcagtggggctcctctttagaaggctgacctcccgagaggtgctattgctgactataggtctcagcctggtcgcctccctggagctccccaatagcctcgaggaactgggggacggtttagcgatgggcattatgatgttgaagcttctcaccgagtttcaaccccaccagttgtggacaaccttattgtccctgacctttgtgaagaccaccctgagcctcgactacgcatggaagaccaccgccatggtcctgtccatagtgagcctgttccccctctgcctgtccaccacgagccagaagaccacctggctgccggtacttctggggtcctttggctgcaagcccttgacgatgtttctcattactgagaacaagatctgggggcgcaagtcgtggccgctgaacgagggcatcatggccatcgggatcgtcagcatcctgctctcgtccctgctcaagaacgacgtccccctcgcaggcccgctgattgcaggcgggatgttaatagcctgctacgtgatctccggctcctcagcagacctctccctggagaaggccgctgaggtctcttgggagcaggaggccgagcacagcggggcctcccataacatcttagtggaggtgcaggacgacggaacgatgaagatcaaggacgaggaacgcgacgacaccctcaccatcctgctgaaagccaccttactggccgtctctggggtgtaccctatgagtatcccggcgacgttgttcgtgtggtacttttggcagaaaaagaagcagcggagcggcgtcctttgggacaccccctcaccacccgaggtggaacgcgctgtgctggatgacggcatctaccggatcctgcagcgcgggctgctgggccggtcacaggtcggggtgggggtgtttcaggacggggtcttccacaccatgtggcatgtgacccgcggcgccgtgctgatgtatcagggcaagcggctggagccctcctgggcgtgcgtcaaaaaggacctcatcagctatggcggcgggtggcgcttccagggcctgtggaacacgggcgaggaggtacaggtgatcgcggtcgaacccggaaaaaacccgaagaacgtgcagaccacccccggtactttcaagacgcccgaaggggaggtgggcgcgatcgcgctggactttaagcccgggacctccggcagcccgatcgttaaccgggagggcaagatcgtcgggctgtacgggaacggggttgtgaccacctccggcacgtacgtgagcgccatcgcccaggcaaaggcctcgcaggaggggccccttccagaaatcgaggacgaggtgttcaagaagcgtaacctaacgatcatggacctccacccgggctccggcaagacccgtcgctacctgcccgcaatcgtccgggaggccatcaagcgtaagctgcgcaccctcatcctggccccgacccgggtggtcgcttccgagatggccgaagcacttaaggggatgcccatacgctaccaaaccaccgccgtaaagagcgagcatacgggcagagagatcgtggacctcatgtgtcacgccacattcaccatgcgcctactcagccccgttcgggtccccaactacaatatgatcatcatggacgaggcgcacttcaccgaccccgcctccatcgcagcccgagggtatatcagcacccgggtaggcatgggggaggctgcggctatatttatgacggcgacgccccctggttccgtggaggcgttcccccaaagcaacgccgtcatccaggacgaggagcgcgacatccccgagagatcctggaacagcggctacgactggattaccgacttccccgggaaaacggtgtggttcgtgccttcaatcaaaagcggcaatgacatcgcgaactgcctacgcaagaacgggaagcgcgtcatccagctgtccaggaagacgttcgataccgagtaccagaagaccaagaacaacgactgggactacgtggtgaccacggacatcagcgagatgggtgccaatttccgcgccgaccgcgtaatcgacccacggcgctgcctaaagcccgtgatcctgaaggacgggcccgagcgggttatcctggccggccctatgcccgtcaccgttgcctctgcagcccagcgccggggcagaattgggcggaaccagaataaggagggggaccaatacgtttacatgggtcagcccctaaacaacgacgaggaccatgcccactggacggaagccaagatgctcctggacaacattaatacgccggagggcatcatccctgcgctgttcgagcccgagcgggagaagtccgccgccatcgacggggagtaccggctccgtggtgaggcccgcaagacttttgtggagctgatgcggaggggcgacctgccagtctggctctcctacaaagtggcgagcgaggggttccaatactccgacaggcgatggtgcttcgacggcgagagaaacaaccaggtactagaggagaatatggacgtggagatctggactaaggaaggggagcggaagaaactgcgaccccgctggctcgacgcgcggacatacagcgaccctctggccctcagggagttcaaagagttcgccgccggcaggcgctccgtttcgggtgacctcatcctggagatcgggaaactgccccagcacctcaccctgagggcccagaacgcgctggacaatttagtgatgctgcacaattccgagcaaggcgggaaagcctaccgccacgccatggaggagctgcccgacaccatcgagacgctcatgctcctggccttgatcgcggtgttgacaggtggggtcacgctgttttttctttccggcaaaggcctggggaagacctcaattggcctactatgcgtgacggcctcaagcgcactcctgtggatggcgtcggtggagccccactggattgccgcgtctataatcttggagttctttctgatggtcctattaatcccggaacccgaccggcagcgcacgccgcaggacaaccagctggcctacgtggtaatcgggctactctttatgatcctaaccgtagccgccaacgagatgggcctgctagagaccaccaagaaggacttagggatcggccacgtggccgcggagaaccatcagcacgccactatgctggacgtggacctccacccagcctccgcctggaccctgtacgccgtagccaccacggtgatcaccccaatgatgcggcacactattgagaataccacggctaacatcagcctgaccgccatcgcgaaccaggccgcgatcttgatgggcctggacaaggggtggcccatttccaagatggacattggcgtgcccttactcgctctggggtgctacagccaggttaacccgctgacactcaccgccgctgttctaatgctggttgcgcactatgccatcatcggacccgggctccaggccaaggccacgagggaggcccagaagcgcaccgcggcgggtatcatgaaaaaccccaccgtggacggcatcgtggctatcgacctggaccccgtggtctacgacgccaagtttgagaagcagctgggacagatcatgctcctaattctgtgcaccagccagatcctcctaatgcgaacgacctgggcgctgtgcgaatccattacgctcgcgactggcccactgacaaccctgtgggaggggtcccccggaaagttttggaacacaaccatcgccgtgagcatggccaatatctttcgcggttcctacctcgccggggccggcttagcgttcagcctaatgaagtcccttgggggcgggcggcgcggcacgggcgcccagggcgaaaccctgggggagaaatggaagcggcagctgaaccagctcagcaagtccgagtttaacacctacaagcgcagcgggatcatggaggtggaccgttctgaggccaaggagggtctgaagcgcggggagaccacgaagcacgcggtcagccggggcaccgcgaaactgcgatggttcgttgagcggaacttggtgaagcccgagggtaaggttatcgacctagggtgcggacgcggaggctggtcttattactgcgcgggcctgaaaaaggtgactgaggtcaagggatacactaaaggcgggccaggccatgaggagccgatacccatggctacctacgggtggaacctggtcaagctccactctggcaaggacgtgttcttcatgccgcccgagaagtgcgacacgctgctgtgcgacatcggggagagctccccgaaccctaccatcgaggaggggaggaccttgagggttctcaagatggtagaaccttggttgcggggcaaccagttctgcataaagatactcaatccctatatgccttcggtggtggagacccttgagcagatgcagcgcaagcacgggggcatgctggtccggaatcccctctcccgtaactctacgcacgagatgtactgggtatcccgggggacgggcaacatcgtgagcgccgtcaacatgacgtccagaatgctactcaaccgcttcacaatggcccacagaaagcccacgtatgagcgcgatgtggatctcggggccgggacacggcacgttgccgtcgagcccgaagttgccaaccttgacatcatcggccagcgcatcgaaaacatcaagaacgagcacaagagcacctggcactacgacgaagacaacccgtacaagacgtgggcctaccacggctcctacgaggtgaaaccctcaggatccgcctcgtccatggtcaacggggtggtccgtctgctcacgaagccctgggatgttatacctatggtgacccaaatcgcaatgaccgacaccaccccgtttggccagcaacgcgtcttcaaagagaaagtggacacccggactccccgggccaagcggggcaccacccagatcatggaggtgaccgccaagtggctgtgggggttcctgtcacgcaacaagaagccgaggatctgcacccgcgaagagttcacccggaaggtccgcagcaacgcagccatcggcgctgtatttgtggatgagaagcagtggaacagtgccaaggaggccgttgaggacgaacggttctgggacctcgtgcaccgcgagcgggagctgcacaagcaggggaaatgcgcaacctgcgtgtacaatatgatgggcaagcgcgagaagaagttaggggagttcgggaaggcaaagggctcccgggccatctggtacatgtggttaggcgccaggttcctggagttcgaggccctgggcttcatgaacgaggaccactggttcagccgcgagaacagcctctcgggggtggaaggggaggggctgcacaagctggggtacatcttacgcgacatcagtaagatccccggggggaacatgtacgccgatgacaccgcaggctgggacacccggatcaccgaagacgacctgcagaacgaggcaaagatcacagacatcatggagcccgagcacgctctcctcgccacctcaatattcaagcttacttaccaaaacaaggtagtgagagttcagcgccctgccaagaacggaaccgtaatggacgtgatcagccggcgtgaccaaagaggctccggccaggtcgggacatacggcctgaataccttcaccaacatggaggtgcagctcatccgtcagatggagtctgaggggatctttttgccttccgaacttgagacgccgaacctcgctgagcgggtgctggattggctggagaagcacggcgccgagcgcctcaaaaggatggcgatctcgggggatgactgtgtcgtgaagcccattgacgaccgcttcgcgacggctctgaccgcgctgaatgacatggggaaggtgcggaaggacatcccccagtgggagccctccaagggctggaacgactggcaacaggtcccgttctgcagccaccacttccatcagctaattatgaaggacgggcgcgagatcgttgtgccctgccgcaaccaggacgagttggtcggccgcgccagagtgagtcagggtgccggctggtcgttgcgtgagacggcctgtttggggaaatcttacgcccagatgtggcaactcatgtatttccaccgacgcgacctgcggctcgcggccaacgcaatctgtagcgccgtgcccgtcgactgggtaccgacctcccgcactacgtggagtatccacgcccatcaccagtggatgacgacagaggacatgttatccgtatggaaccgcgtctggatagaggaaaacccctggatggaggacaagacccacgtgagctcctgggaggaggtgccctacctgggcaagcgggaggaccagtggtgcggctccctcatcgggctgacggcacgcgcaacttgggctaccaatattcaggtcgcgatcaaccaggtgcggcgcttaattggcaatgagaactacttagactatatgacaagcatgaagcggtttaagaacgagtccgatcccgagggggcgctgtggtga

SEQ ID NO: 24681 - RNA, 9879 nt, synthetic construct
  misc_feature 1..9879: note = derived and/or modified CDS sequence (opt11) from DENV-1__KC692517__SS-prME
  source 1..9879: mol_type = other RNA
agcgtgacaatgctgctgatgttacttcccaccgccctcgccttccacttgacgacccgaggcggggagccccatatgatagtgagtaagcaagaacggggcaagagcttgctgttcaaaaccagtgccggggtgaacatgtgcaccctcattgccatggacctgggcgagctctgcgaggacaccatgacctacaagtgcccccgcatcaccgaggccgagccggacgacgtggactgttggtgcaacgccaccgacacctgggtcacttatgggacctgcagccaaaccggcgagcaccggcgcgataaacggtccgtggcgctggcgccacacgtgggcctgggcttggagacgcgcactgagacctggatgagctccgagggcgcttggaagcagatacagagagtggagacctgggccctgcgtcaccccgggttcactgtaatcgccctgttcctcgcgcacgccataggcacaagcatcacccagaaaggaattatcttcatcctgctgatgctcgtgaccccctccatggccatgcggtgcgtaggcatcggaaaccgcgactttgtggaggggctgagcggggccacgtgggtggacgtcgttctggagcatggttcatgcgtgaccacgatggctaagaacaaacccaccctggacatcgagctcttaaaaacagaggtcaccaaccccgcggtcctccggaagctgtgcatagaggccaagataagcaacacgaccacggactcccgctgccccacacagggcgaggcgacactggtggaggaacaggacgcaaactttgtctgtcggcgaaccttcgtggaccggggctggggtaatggctgtggcctcttcggcaagggaagcttgctgacgtgcgccaagttcaaatgcgtaaccaaactcgagggcaagatcgtccagtacgagaacttaaagtactctgtcatcgtgaccgtccacacgggcgaccaacaccaggtgggtaacgagaccatcgagcacggcactatcgcgaccataacgccccaagcaccgaccagcgagatacagctgaccgactacggggccctcaccctggactgtagtcccagaacagggttagacttcaacgaaatggtgttactgactatgaaggaaaagtcctggttagttcacaagcagtggttcctcgacctgccgctgccctggacttccggggccagcacaccccaggaaacctggaaccgacaggaccttttagtgacctttaagacggcgcacgcgaagaagcaggaggtcgtggtgctgggaagccaggagggcgccatgcacaccgcactcaccggggccaccgaaatccagacgtccgggacgaccaccatcttcgccgggcacctgaagtgccgcttaaagatggacaaactcacgctgaaaggcatgtcgtacgtgatgtgcacaggctccttcaagctcgaaaaggaagtggcggagactcagcacgggaccgtgttagtgcaggtgaagtacgagggcacggacgccccgtgcaagattccgttcagcacccaggatgagaagggggtgacccagaacggccggctcatcaccgccaacccgatagtcacggacaaggaaaagtccgtgaacatcgaaactgaaccgccctttggggagagctacatcgtagtaggcgtcggtgagaaggccctgaaactgagctggtttaagaaggggtcttccatcggcaagatgttcgaagcaactgcccgcggggcccggcgcatggctatcctcggtgacaccgcttgggacttcgggtccataggcggcgtgtttacgtccgtcgggaagcttgtgcatcaagtattcggaacagcgtacggcgttctattcagcggcgtgtcctggaccatgaagataggcatcggcatcctcctcacctggttaggcctcaactcacgtagtacgtctctgtccatgacctgcattgccgtggggatggtcaccctgtatctcggcgtcatggtacaggccgacagcggctgcgtcatcaactggaaaggccgggaactgaagtgcgggtctggcatcttcgtgaccaacgaggttcacacgtggacagagcagtacaagttccaggccgactcacccaaacgcctgagcgccgcgatcggcaaggcctgggaggagggggtctgcggaatccggagtgcgacacgcctcgaaaacattatgtggaagcagatcagcaacgaattaaaccacatcctcctggagaacgacatgaagtttaccgtggtggttggcgatgccaacggcatcctcgcccagggtaagaagatgatccgaccccagcccatggagcacaagtactcctggaagtcctggggcaaagctaaaatcatcggcgccgacattcagaacaccacgttcatcatcgatggccctgataccccggagtgcccggacggccagcgcgcctggaatatctgggaggtagaggactacgggttcggcatcttcaccaccaacatctggctcaagctacgtgactcctacacgcagatgtgcgaccacagactgatgtccgccgcgatcaaggacagcaaagccgtgcacgcagatatgggctactggatcgagagcgaaaagaatgagacctggaagctggcccgagcctcctttatcgaagtcaagacgtgcacctggccaaagagccacacgctctggagtaatggggtgctagagagcgagatgatcatccccaagatttacggcggcccgatttcccagcacaactaccggcccggctacttcacccagaccgcggggccctggcacctgggcaagctcgagctagacttcgacctgtgtgaggggaccacggttgtcgttgacgagcactgcgggaaccggggcccgagcctccgcaccacaaccgtgacggggaagatcattcacgagtggtgttgccggagctgcaccctgccgcccttacgcttccggggcgaggacggctgttggtacggaatggagatcaggcccgtaaaggagaaggaagagaacctcgtgcggtccatggtgagcgcagggtctggggaggtagacagtttctcgctgggcatcctgtgcgtgagcataatgatagaagaagtgatgcgctcccggtggagtcgcaagatgctcatgaccgggaccttagccgtcttcctactcctgatcatgggccagctgacgtggaacgacctcatcaggctatgcataatggtgggggccaacgcctctgaccggatgggcatggggaccacctacctggctctcatggcaacctttaagatgcgccccatgttcgccgtcggattactgttccggcgccttacttcgcgggaggtcctgctgctaaccatcggtctgtccctagtcgccagcgtcgagctccccaattccctggaagaacttggggatgggctcgccatgggaatcatgatgctgaaactgctcaccgagtttcaaccccaccagttgtggactacgctgctcagtcttaccttcgtaaagaccaccctgtccctcgactacgcttggaagacgaccgccatggtactgagcatcgtctccctcttccccctctgcctgagcaccaccagccagaagactacgtggctaccagtgctccttgggagctttgggtgcaatccactgaccatgttcctcatcaccgaaaataagatctgggggcgcaagagctggcccctaaacgagggcatcatggccatcgggatagtgagcattctgctctccagcctgctgaaaaacgacgtccccctcgccggcccgctgatcgcgggcgggatgctgattgcctgctacgtcatctccggcagctcagcggacctctccctggagaaggctgccgaggtgagctgggagcaggaggcggagcactccggggcctcacacaacatcctcgtagaggtgcaggatgacggcaccatgaaaatcaaggacgaagagcgcgacgacaccctcaccatcttgctgaaggcgaccctactcgccgtgtccggtgtatacccaatgagcattcccgccactctgttcgtgtggtacttctggcagaagaagaagcagcgctccggcgtgctatgggacacgccctcgccgcccaaagtcgagcgtgcggtattagacgatggcatctaccgcatcctgcagagagggctgctcggacgctcccaggtgggggtcggcgtgtttcaggacggcgtattccacaccatgtggcacgtcacccggggcgccgtgttaatgtaccagggcaagcgcttagagcctagctgggcctccgtgaaaaaagacctcataagctatggtggagggtggagattccaggggtcctggaacacaggtgaggaggtccaagtgattgccgtggagcccggaaagaacccaaagaacgtgcagacaaccccgggcaccttcaagacgcccgagggcgaggtgggcgccattgcgttagactttaagcccgggacgagtggctcaccgatcgtgaaccgcgaaggcaagatcgttggtttgtacggcaacggggtggtgaccaccagcggcacctacgtgtccgcgatcgcccaggcgaaagccagccaagaggggcccctccctgagatcgaagacgaggtgttcaagaagcggaaccttactatcatggacctgcacccgggcagcggcaagacccgccggtacctccccgccatcgttagagaggccatcaagcggaaactgcgcacccttatcctcgcccccacccgcgtcgtggcatccgaaatggcggaggctctgaaggggatgcccatccggtaccagacgaccgccgtcaaatctgagcacacaggccgcgagatcgtggatttgatgtgtcacgccaccttcaccatgcggctcctgagtcctgtgcgtgttcccaactacaatatgatcattatggacgaggcccacttcaccgaccccgcgagcatagccgcccgggggtacatctcaacccgcgtcggcatgggggaggcggcagcgatcttcatgaccgccacaccccccggcagcgtggaggcattcccccagagtaacgcagtgatccaggacgaggaacgggacatccccgagcgcagctggaactccgggtatgattggatcaccgatttccccgggaagaccgtctggttcgtgcccagcataaagtcgggcaacgacatcgccaactgcctgcggaagaacgggaagcgcgttatacagctctcgcggaagaccttcgacacggagtaccagaagaccaagaacaacgactgggattacgtggtgaccaccgacatttccgagatgggcgcaaacttccgggccgacagagtgatcgacccgcgccggtgcctgaagcccgtcatcctgaaggacggccccgagcgtgtgatcctcgccggcccgatgcccgtcacggtagccagcgcggcgcagcgacgcggacggattgggcgcaaccagaacaaggagggcgaccaatacgtatatatggggcagcccttgaacaacgacgaggatcacgcgcactggacggaagctaagatgctgctcgacaacatcaacaccccagagggcatcatcccggcccttttcgagcccgaacgcgaaaagtccgcggccatcgatggggagtaccggctgcgcggcgaggcccggaaaacctttgtcgaattaatgcgccggggcgacctgccagtctggttgagctacaaggtggcctccgaagggttccagtacagtgaccgccggtggtgcttcgacggcgagcgcaacaaccaggtcctcgaggaaaacatggatgtggagatctggaccaaggagggagagaggaagaagctgcgccctcggtggttggacgcccggacctactccgacccgctggcgctgcgggagttcaaagagttcgccgccggccgccggagtgtgagtggcgacctgatcctcgagatcgggaagctgccccagcacctaacgctccgcgcacagaacgcgctggacaacctcgtcatgctccacaacagcgagcagggcgggaaggcgtaccggcacgctatggaagagttgcccgacaccatcgagaccctgatgctcctggccttaatcgccgtgctaacgggcggggttaccctgttcttcctgtcaggcaagggcctcgggaagaccagcattggcctcctttgcgtcaccgcgagctcggccctcctgtggatggcgagtgtggaaccgcactggatcgccgcaagtatcatattggagttcttccttatggtcctactgatccctgagcccgaccgccagagaactcctcaggacaaccagctcgcgtacgtcgtgatcggactgctgttcatgatcctcaccgtggccgccaacgaaatgggccttctggagaccaccaaaaaggacctcgggatcggctacgtcgccgcagagaaccaccagcacgcgaccatgctggacgtggaccttcgcccggcttccgcctggacactttatgctgtggccaccaccgtcatcacgccaatgatgcgtcatacaattgagaacaccaccgcgaatatctccctgacggccatagccaaccaggcagcgatcctgatgggccttgacaaggggtggcccatcagcaagatggatatcggcgtgcctctgctggctctcgggtgctactcccaggttaacccgctgaccctgaccgccgccgttctcatgttggtggcccactatgcgatcatcggccccgggctgcaggccaaggcgacccgagaggctcagaagcggacggcggcgggcattatgaagaaccccaccgtcgacggcatcgtcgctatcgacctagaccccgtggtgtatgacgcgaagttcgagaagcagctggggcagattatgttactcatcctgtgcaccagccagatactgctcatgcgaaccacatgggccttatgcgagtccatcaccctggccaccggcccactcaccacgctgtgggaggggagccccggaaagttctggaacaccaccattgcggtctcgatggccaacattttccgcgggagctacctagccggtgccggactagccttctccctcatgaagtcattgggtggcgggcggcgcgggaccggcgcgcaaggagagacgctcggcgagaagtggaagcggcagctgaaccaactgagtaaaagcgagtttaacacctacaagcgctccgggatcatggaggtggaccgatccgaggccaaagagggtctcaagcgtggagagacgaccaagcacgcagtgtcccgaggcaccgccaaattacgatggtttgtagagagaaacctggtgaagcccgagggcaaggtcatcgacctggggtgtggacgcgggggctggtcgtactactgcgcggggctcaaaaaggtcacggaggtcaagggttacacaaaaggtggaccaggccacgaagagccgatccctatggccacatacgggtggaacctggtgaagctgcacagcggcaaggatgtcttctttatgccacccgaaaagtgcgataccctcctgtgcgacatcggggagtccagcccgaaccccacgatagaggagggccggaccctgcgcgtgctcaagatggtcgagccctggctgcggggcaaccagttctgcatcaagattctgaacccctacatgccgtcggtggtcgagacgctcgagcagatgcagcgaaagcacggtgggatgctggtccggaaccccctcagccgcaacagtacccacgagatgtactgggttagctgcgggacagggaacatcgtgtccgccgtcaacatgaccagccggatgctcctgaaccgcttcactatggcgcaccgcaagcccacttatgagcgggatgtagatttaggcgcgggcacgcgccacgtggcggtagagcctgaagtcgcaaaccttgacatcatcggccagaggatcgaaaacatcaagaatgagcacaagagcacatggcactacgatgaggacaacccgtacaagacctgggcgtatcacgggtcttacgaggtgaagccctctggcagcgcctcaagcatggtcaacggggtggtccgtctgctgaccaagccctgggacgtcattcctatggtgacgcagatcgccatgactgacaccaccccgtttggacagcagcgggtattcaaggagaaggtcgacaccagaactccccgggcgaagcgcgggaccacccagatcatggaggtgacggccaagtggctttggggcttcctgtctcggaacaagaaaccaaggatatgcacccgggaggagttcacccgcaaggtgcggagcaatgccgccatcggtgccgtcttcgttgacgaaaatcagtggaacagcgcgaaggaggctgttgaagacgagcgcttctgggacctcgtccatcgggagcgtgagctacacaagcaagggaaatgcgctacctgcgtgtacaacatgatgggcaagagggagaaaaagctgggggaattcggcaaggctaaaggcagccgcgcaatttggtatatgtggctgggggcccggttcctcgagttcgaggccttaggattcatgaatgaggaccactggttctctcgcgagaacagtctgagcggggtcgagggcgaggggctccataagctgggatacatcctgcgagacatctccaaaatcccgggcggcaacatgtacgccgacgacacggccggctgggacacccgcatcaccgaggacgacctccaaaacgaggctaagatcacggacataatggagcctgagcacgccctgctggctacgtcgatcttcaaattaacgtaccaaaacaaggtcgtgcgcgttcagcggcccgccaagaacgggaccgtcatggatgtgatatccaggcgggaccagcggggctccggccaggttgggacatacggtctgaatacgttcaccaacatggaagtccaactggtgagacaaatggagtccgaagggattttcttgcccagtgagctggaaacgccgaatctggccgagagggtgctcgactggctggaaaagcacggcgtcgagcggcttaaacgcatggcgatctccggtgacgattgcgtggttaaacccatcgacgaccgcttcgcaacagccctaactgccctgaacgacatgggcaaggttcgcaaagacataccccagtgggagccgagcaaaggctggaatgactggcagcaggtgcctttttgctcccaccacttccaccagctgatcatgaaagacggtcgcgaaatcgtagtcccctgtaggaaccaagacgagcttgttggtcgggcccgtgtgagtcagggggcgggctggtccctgcgggagaccgcctgtctagggaagagctatgcgcagatgtggcagctcatgtactttcaccggcgggacttgagactggccgccaacgcaatatgctccgccgtccccgtggattgggtaccgacaagccggaccacctggagcatacacgcccaccatcagtggatgacgaccgaggacatgctctccgtctggaacagggtctggatcgaggagaacccttggatggaggacaagacccacgtgtcctcctgggaggaggtcccctacctgggcaagcgcgaggaccaatggtgcggttcgttaatcgggctcaccgcgcgtgccacctgggcaactaacatacaagtggctatcaatcaagtgcgccggcttattggcaatgagaattatctggattacatgacgtcgatgaagcgcttcaagaacgaatctgaccccgagggggccctctggtga

SEQ ID NO: 24682 - RNA, 9879 nt, synthetic construct
  misc_feature 1..9879: note = derived and/or modified CDS sequence (opt11) from DENV-1__KC762649__SS-prME
  source 1..9879: mol_type = other RNA
agcgtgacaatgctgctgatgctgatgcccaccgccctggccttccaccttaccacccgggggggggagcctcacatgatcgtgtcgaaacaggagcgtggcaagagcctgctgtttaagacctcagccggcgtgaacatgtgtaccctaatcgccatggacctgggcgagctgtgcgaagacaccctgacctacaagtgtccccgaatcaccgaggcggagcctgacgacgtggactgttggtgcaacgctaccgacacctgggtgacctacgggacctgtagccagaccggcgagcaccggcgcgacaagcggagtgtggcattggcgccgcacgtgggactggggctcgagacccgcaccgagacgtggatgagctccgagggcgcctggaagcagatccagcgggtcgagacctgggccctgcgccacccgggtttcacggtaatcgccctgttcctggcgcacgccataggcgccagcatcactcagaagggcatcatcttcatcctgctgatgctcgttaccccctcaatggcaatgcggtgcgttggaatcggcagccgcgacttcgtggaggggctgtccggcgccacctgggttgatgtcgtgctggagcacggaagctgcgtgacgaccatggcgaaggataagcccaccctcgacatcgagctgctgaagaccgaggtcaccaatcccgccgtgctccggaagctgtgcatcgaggccaagatctccaacaccaccaccgatagccggtgtccgacgcagggagaggcgacgctggtggaagagcaggacgccaactttgtctgccggcgcaccttcgtggatcggggctgggggaacggctgcggattattcggcaaggggtccctgatcacgtgcgcgaagttcaagtgcgtgagcaagctggagggcaaaatcgtccagtacgagaatctcaagtactccgtcattgtgacagtacatacaggcgaccagcatcaagtcggaaacgagagcaccgagcacggcaccacggccaccataacgccccaggcacccaccacagaaatacagctgacggactacggggccctgaccctcgattgcagcccccggactggcttggatttcaacgagatggtcctgctcaccatgaaggagaaatcctggttagtacacaagcagtggttcctggacctccccctgccctggacgagcggagcgagcaccagccaggagacatggaaccggcaggacctactcgtgacattcaagactgcgcacgccaagaagcaggaggtcgtagtgctgggctcccaggaaggagccatgcataccgccctgaccggggccacagagatccagacgtcaggcaccaccaccatattcgcgggccacctcaagtgtcgcctgaagatggataagctgacgcttaagggcatgtcctacgtcatgtgcaccggtagcttcaagctggagaaggaggttgctgagacccagcatgggaccgtgctggtccagatcaagtacgagggcacggacgcaccctgcaagatccccttctccacccaggacgagaagggggtgacacagaacggccggctaatcacagccaatccgatagtgacagacaaagagaagccagtcaacatcgaggcggagcccccctttggggagagctacatcgtgatcggcgccggcgagaaggccctcaagctgagttggttcaagaaggggagctccatcggcaaaatgttcgaggccaccgcccgcggtgcgcggcgcatggctatacttggcgacaccgcctgggacttcgggagcatcggcggcgtgttcacctccgtcgggaagctcgtgcaccagatcttcgggacggcgtacggagtgctgttcagcggcgtctcctggaccatgaagatcgggattggcgtgttactcacgtggctgggcttgaacagccggagtactagtctctcgatgacgtgcatcgcggtggggctggtcacactgtacctcggtgtgatggtacaggctgatagcgggtgcgtcatcaattggaagggacgggagctgaagtgcgggagcggcatcttcgtgaccaacgaagtacatacctggacggagcagtacaagttccaggccgactccccgaagcgccttagcgcggcaataggcaaggcttgggaagaaggggtctgcggcatccggtccgcgaccagactcgagaacatcatgtggaagcagatcagcaacgagctgaaccacatcctgctcgagaatgacatgaagttcactgtggtagtcggggatgtagccggcatcctggcccaggggaagaagatgatccggccccagccaatggagcataagtactcctggaaatcctggggcaaggccaagatcatcggcgcggacgtgcagaacaccacgttcataatcgacgggcccaacacgccggagtgccccgacgaccagcgggcctggaacatctgggaggtcgaggactacggcttcgggatcttcaccaccaacatctggctgaagctccgggactcttatacccaggtgtgcgaccatcgcctgatgtcggccgccatcaaagactccaaagcagtgcatgcggacatgggctactggatagagagcgagaagaacgagacgtggaaactggcccgggcctccttcattgaggtaaagacctgcatctggcctaagtctcacaccctctggtccaacggcgtgctcgaaagcgagatgatcatccccaagatctatgggggcccgatttcccagcacaactaccgccccgggtacttcacccagacagccggcccctggcacctgggtaaactcgagctggacttcgatttatgcgagggcacgaccgtggtcgtggacgagcactgcggcaaccgggggccgagcttgcgcaccactaccgtgactggcaagataatacacgagtggtgctgccggtcctgcactctgccgcccctgcgcttccgaggagaagacggttgctggtatggaatggagatccgccccgtcaaggagaaggaggagaacctcgtcaagagcatggtgagcgccggctccggcgaggtcgacagcttctccttagggctcctctgcattagcatcatgatcgaggaggtgatgcgttcccgctggagccggaagatgctgatgacgggcaccttggcggtattctttttactgatcatggggcagctgacctggaacgatctcattcgcctgtgcatcatggttggggccaacgcctccgatcgcatggggatgggcaccacttacctggccctcatggccaccttcaagatgcggccgatgttcgcggtgggcctgctgttccgtcggctcaccagccgcgaggtgctgctcctcaccatcggactgtccctggtcgccagcgtggagctccccaattccctggaagagctcggcgacggtctagcaatggggatcatgatcctcaagcttttaaccgacttccaaagccaccagttgtgggccaccctgctctccctgacgttcatcaagaccacgttcagcttgcactacgcttggaagaccatggccatggtcctctccatcgtgagcctgttccccctgtgcctctccacaaccagccagaaaacgacctggctgcccgtgctactagggtccctggggtgcaagccgctgaccatgttcctaatcgcggagaacaagatctggggccgcaagagctggcccctgaatgagggtataatggctgtaggcatagtgtccatactgctctcctctctgctgaagaacgatgtgcccctcgccgggcccctcatcgcgggcggcatgctgatcgcgtgctacgtcatatccggtagctccgccgacctgagcttggagaaagcagccgaggtgagttgggaggaggaggccgagcatagcggggcctcccacaacatcctggtggaggtccaggatgacggcaccatgaagatcaaggacgaggagcgcgacgacacgctcaccatcttgttaaaggccaccctcctggccgtatcaggcgtgtacccgctttccatcccagccaccctcttcgtttggtacttctggcagaagaagaagcagcgttcaggggtgctatgggacacccccagcccgcctgaagttgaacgcgcggttctggacgacggcatctaccggattatgcagcgcggtctgctcggtcggagccaggtaggagtgggcgtcttccaggagaacgtgttccacaccatgtggcacgtgactcgcggagccgtcctgatgtaccaggggaagcggttagagccctcctgggccagcgtgaagaaggacctcatctcctatggcggcgggtggagacttcagggcagctggaacaccggggaggaggtgcaggtaatcgccgtagagcccgggaagaatcccaagaacgtgcagactgcccccgggatcttcaagacgcccgagggcgaagtcggagcgattgccctggacttcaagccagggacctccggcagccccatcgttaaccgggaggggaagattgtgggcctctacggcaacggggtcgtgacgacctcaggcacatacgtgtccgccatcgctcaggcaaaggcctcccaggaggggcccctgcccgagatcgaagacgaggtctttcgcaagcggaatctgaccatcatggacctccaccccggctccgggaagacccgccggtacttaccggcaatcgttcgcgaggcaatcaagcggaagctgcgcaccctcatcctggcccctacgcgagtggtagcgagcgagatggccgaggccctgaagggcatgcccatccgctatcagaccaccgccgtaaagtccgagcacaccggcaaggagatcgttgatttaatgtgccacgccacgttcaccatgcgcctgctgagccccgtccgggtgccgaactataacatgatcatcatggatgaggctcacttcaccgaccccagtagcatcgccgcccgcggatacatctccacccgggttggcatgggggaggccgccgccatcttcatgacggccacgccgcccgggagcgtcgaggctttcccgcagtccaatgcggtgatccaggacgaggagcgcgacatccccgagcggagctggaactccgggtacgaatggatcaccgactttcccggcaagactgtgtggttcgtgccgtcaattaagtccggcaacgacattgcaaactgcctccgcaagaacggaaagcgtgtgatacagctgagccgcaagacgttcgacacagagtaccagaagaccaagaataacgactgggattacgtggtaactacagacatctccgagatgggcgctaacttccgggctgacagggtgatcgatccgcggcgctgcctgaaaccagtgatcctaaaagacgggccggagcgtgtcatcctggcaggccccatgccggtgactgtcgccagcgcggcccaacgccggggccgcgtaggccggaatcacaacaaggagggcgaccaatacatctacatggggcagcccctgaacaacgacgaggaccacgcccactggactgaagccaagatgctcctggacaacatcaacaccccggagggcattatccccgccctgtttgagccggagcgcgagaagtctgcggcgatcgacggggagtaccggctccggggcgaggcccgcaaaactttcgtggagctcatgcggcgcggggacctgcccgtctggctgagctacaaggtggccagcgagggcttccagtatagcgaccggcgctggtgcttcgacggcgaacggaacaaccaggtgctggaggagaacatggacgtagaaatctggacgaaggagggagaacgcaagaagctgcgcccccgctggctcgacgcccggacctacagcgaccccttggcgctgcgcgagtttaaggaattcgcggccggccggcgctccgtgagcggtgacttgatcctggagatcggcaagctgccgcagcatctcacccagcgcgcccagaacgctctggacaacctggtaatgctgcacaactccgaacagggcgggcgcgcctaccggcacgcgatggaggagctgcccgacacgatagaaacactgatgttactggccctaatcgccgtcctcaccggcggggtgaccctattcttcctgagcggccgcgggctcggcaagactagcatcggcctgctgtgcgttatggctagctccgtccttttatggatggccagcgtggagccccattggatcgccgcatccattatcctggaattcttcctcatggtgctgctgatccccgaaccggaccgacaaagaacgccccaggacaaccagctcgcctacgttgtgatcgggctgctgttcatgatactcaccgtggcagccaacgagatgggcctgctagagaccaccaaaaaagacctcgggatcggccacgtcgccgtggagaaccaccaccatgcagccatgctggacgtagacctgcatccagcgagcgcctggacgctctatgcagtcgccaccaccataattacgccaatgatgagacacacgatagagaacaccaccgccaacatctccctgaccgcgattgccaatcaggccgcgatcctgatggggctcgacaagggctggcccatcagcaagatggacatcggcgtgcccctgctggcgctcgggtgctactcccaggtgaaccccttgactctgaccgccgccgtcctcatgttggtggcccactacgctatcatcggcccgggtttacaggcgaaggccacccgcgaggcccagaagagaactgcagccggcatcatgaagaaccccacggtggacgggatagtcgcaatcgacctcgatccagtggtgtatgacgccaagttcgaaaaacagctgggccagatcatgctgctcatcttgtgcacctctcagattttactcatgcggaccacctgggcgctgtgcgaaagtattacgctggccaccggccccctcacgaccctatgggaggggagcccaggcaagttctggaacactactatcgccgtctccatggcgaacatcttcagagggagctacctggcaggcgcgggcctcgcattcagccttatgaagtccctcgggggcgggcggcgcgggacgggggcgcaaggcgagacccttggcgagaagtggaagcggcaactgaaccagctgagcaagtccgaattcaacacgtataaacgcagcgggatcatggaggtggaccggtctgaggctaaggagggactcaagcggggggagacgaccaagcacgcggtgagccggggcaccgcgaagctgcgttggttcgtcgagcggaacctggtgaaacccgagggtaaggttatcgacctgggctgcggtcgtgggggctggtcatactactgcgcggggctcaagaaggtcaccgaggtgaagggctacaccaagggcgggccgggccacgaggagcccatcccgatggcgacctacgggtggaatctggtaaagctgcattccggaaaggacgtcttcttcatcccgcccgagaagtgcgacaccctcttgtgcgacatcggggagtctagccctaatcctacgatcgaggaaggccgtactctgcgtgttctcaagatggtggagccctggctgcgggggaaccagttctgcataaagatcctaaacccttacatgccgtccgtcgtggagacgctcgagcaaatgcagcgcaagcacggtggcatgcttgtgcggaacccgctgagccgcaactcgacccacgagatgtactgggtctcttgtggaacgggcaacattgtcagtgctgtgaacatgacaagccggatgctcctgaaccgcttcaccatggctcaccgaaagcccacctacgagcgagacgtagacctaggggcgggcacccgccacgtggccgtggagcccgaggtcgcgaatctcgacataattggccagcggatcgagaacatcaagcacgagcacaagtccacgtggcactatgacgaagacaacccctataagacatgggcctatcacgggagctacgaggttaagccgagcggcagcgccagctccatggtcaacggggtggtgaagctgttaaccaaaccctgggacgttatccccatggtaacccagattgccatgacggacaccacccctttcggccaacagcgcgtctttaaggagaaggtcgatactaggacccccaaggctaagcgcgggaccacccagatcatggaggtgaccgcgcggtggctctggggcttcctgagccgcaacaaaaagccccgtatctgtaccagagaagagttcacccggaaggtgcgttccaacgccgccatcggcgccgtgttcgtcgacgagaatcagtggaacagcgcgaaggaagccgtcgaggacgaacggttctgggacctggtccaccgcgagcgggaactccacaagcaggggaagtgcgctacctgcgtgtacaacatgatgggtaagcgcgaaaagaagctgggggagtttgggaaagccaaggggagccgagccatctggtacatgtggctgggcgcccgtttccttgagttcgaggcccttggattcatgaacgaagaccactggttcagccgggagaacagtctctcgggggtggagggcgaaggtctacacaagctgggctacattctgcgcgacatctccaagatccctgggggcaacatgtacgccgacgacacggcgggctgggacacacggatcaccgaggatgatctccagaacgaggccaagatcaccgacatcatggagccggaacatgcgctgctggccaaggccatcttcaagctcacctatcagaacaaggtagtgcgcgtgcagcgccccgccaagaacgggacggtcatggacgtgatcagtcggcgcgaccagcgcggttccggccaggtagggacctatggcctgaacaccttcacaaatatggaggcccagctgatccgccagatggaaagcgaggggatcttctcccccagcgagctcgagacgcccaacctggccgagcgggtcctggactggcttgaaaaatacggcgtggagcggctgaaacggatggccatctccggggacgactgcgtggtgaagccgatcgacgaccgcttcgccacagccctgaccgcactaaacgacatgggcaaggtgcggaaggacatcccccagtgggagcctagcaaggggtggaacgattggcaacaggtccccttctgctcccaccatttccatcagttaatcatgaaggacggccgcgagatcgtcgtgccgtgtcggaatcaggacgagctggtggggcgcgcgcgcgtcagccaaggggccggatggagcttacgagagaccgcctgtctgggcaagtcctacgcccagatgtggcagctgatgtacttccaccgaagagacctccggctggcggccaatgcaatatgtagcgccgtgcccgtggactgggtcccgacgtcccgtaccacctggagcattcacgcccatcaccagtggatgaccacggaggacatgctgagtgtctggaaccgggtgtggatcgaggaaaacccctggatggaggacaagacccacattagctcctgggaggacgtcccgtacttaggaaaacgagaggaccaatggtgcgggagcctgatcggcctgaccgcgcgcgctacgtgggccaccaacatccaggtggcgatcaatcaggtgcggcgtctcattgggaacgagaactacctagactacatgacctccatgaagcggtttaagaacgagtccgaccccgagggggccctatggtga

SEQ ID NO: 24683 - RNA, 9879 nt, synthetic construct
  misc_feature 1..9879: note = derived and/or modified CDS sequence (opt11) from DENV-1__KC762625__SS-prME
  source 1..9879: mol_type = other RNA
tcggtcaccatgctgctcatgctgatgcccaccgccctggccttccacctcacgacccggggcggggagccccacatgatagtgagcaaacaggagcgggggaagagcctgctgttcaagaccagcgcaggagtgaatatgtgcaccctcatcgcgatggatctgggggagctgtgcgaggataccctcacctacaaatgcccccgcatcaccgaggccgaacccgacgacgtagattgctggtgcaacgcgacagacacctgggtgacatacgggacctgcagccagactggcgagcaccggcgcgacaagcggagcgtagccctggcgccccacgtgggactaggcctggaaacgcgcaccgagacttggatgagctccgaaggcgcatggaagcagatccagagggtggaaacttgggcgctgcgacaccccggcttcacagtgatcgccctgttcctcgctcatgccatcggcaccagcatcacacagaaagggatcatcttcatcctgctgatgctcgtcaccccctccatggccatgcggtgcgtcggcatcggcagccgcgactttgtggaagggctgtccggcgccacgtgggtggatgtcgttctggagcacggaagctgcgtgaccaccatggccaaggacaagcccacgctagacatcgagctgttaaagacggaggtcaccaatcccgcggttctccggaagctgtgcatagaggccaagatctccaacaccacaacagatagccgctgcccgacccagggcgaggccacgctggtggaggagcaggacgccaactttgtctgtcggagaactttcgtggaccgaggctgggggaacggctgcggcctgttcggcaaggggtccctgatcacgtgcgctaaattcaaatgtgtaagcaagctggagggcaaaatagtccagtatgagaacctcaagtactccgtgatcgtgacagtccacaccggcgaccagcaccaggtggggaacgagagcaccgagcacggcacgaccgcgaccataacgccccaggcccctaccacggagatccagctgaccgactacggggccctgacccttgactgctcaccccggaccggcctggatttcaacgagatggtcctgctgaccatgaaagagaagagctggctggtgcacaaacagtggttcctggacctacccctgccctggaccagtggggcctccactagccaggagacctggaaccggcaagacctgctcgtgacgttcaagaccgcccacgcgaagaagcaggaggtcgtggtgctgggttctcaagagggcgctatgcacaccgccctgaccggcgctacggagatccagaccagcggcacgacaacgattttcgctggtcacttaaagtgccgcctgaaaatggacaagttaactctgaagggcatgtcctacgtcatgtgtaccgggtcgttcaagctggaaaaggaggtggcggagacccagcatggcaccgttctggtccagatcaagtacgaaggcaccgacgccccctgcaagatcccgttctccacgcaggacgagaagggagtgacccagaacggccggctgatcacggccaacccgatcgtaaccgacaaggagaagcccgtgaacatcgaggccgagccgcccttcggggagagctacatcgtgatcggggcgggcgagaaggccctcaagctgtcttggttcaagaaggggagctccatcggcaaaatgttcgaggccaccgctcgcggggcccggcgtatggcgatcctgggcgacaccgcctgggacttcgggagcataggcggcgtgttcacgtctgtggggaagttggtgcaccagatcttcggcacggcctacggagtgctgttcagcggtgtctcctggaccatgaagatcgggattggcgtgctgctcacctggctgggcctgaacagccgctctacgagcttatccatgacctgcatcgccgtggggctggtcaccctatacttaggcgtgatggtgcaggccgacagcggatgcgtcataaactggaagggccgagagctgaagtgcgggagcggcatcttcgtgaccaatgaggtgcacacttggacagaacagtacaagttccaggcggactccccgaagagactgtccgcggccatcggcaaggcgtgggaggagggtgtctgcggcatccggagtgcgactcgcctcgaaaacattatgtggaagcagatcagcaacgaactgaaccacattttactcgagaacgacatgaaattcaccgtggtggtcggggatgtggcgggaatcctggcccaggggaagaagatgattcgaccccagcctatggagcacaagtactcctggaagtcttggggcaaggccaagatcatcggcgccgacgtacaaaacacaacgttcattattgacgggcccaacactccggagtgccccgacgaccagcgagcgtggaacatatgggaggtagaggattatggattcgggatcttcaccactaacatttggctgaagctccgggattcctacacccaggtgtgcgaccaccgcttgatgagcgccgccatcaaggactccaaagccgtgcacgccgatatggggtattggatcgagagcgagaagaacgagacgtggaagctggcccgggcgtcctttatagaggtgaagagctgcatttggcccaagtctcatacgctctggtctaacggcgtacttgagagcgagatgatcatcccgaagatatatgggggcccgatcagccagcacaactaccgccccgggtacttcacacaaacagccgggccctggcatctggggaagctcgagcttgattttgacctctgcgaaggcaccaccgtggtcgtcgacgagcactgcggaaaccgggggccgtccctccgcaccacgaccgtgaccggaaagatcatccacgagtggtgctgccggagctgcaccctcccgccgctgcgcttccgcggggaagatggctgctggtacggcatggaaatccgccccgtcaaggagaaggaggagaacttagtcaagagcatggtgtccgccggcagcggcgaggtcgactccttctctttagggctgctctgcatatccatcatgatcgaggaggtgatgcggagccgctggagtcggaagatgctgatgacgggcacattagccgtgttcttcctgctgataatgggtcagttaacctggaacgacctcatcaggctgtgcataatggtgggcgcgaatgcctcagaccgcatgggtatgggcaccacgtacctggccctcatggccaccttcaagatgcggccgatgttcgccgtgggccttctgttccgccggctcacttcccgtgaggtcctgctgctcaccatcggtctgagcctggtagccagcgtggaactccccaactcactggaggagttgggcgacgggcttgccatgggcattatgatccttaagctgctcacggacttccagtcccatcagctgtgggccaccctgctcagcctgaccttcatcaagaccacgttttcactgcactacgcctggaagactatggcgatggtcctctcgatcgtgtccctgtttccactgtgcctcagcaccacctcccagaagacgacctggctacccgtccttctcggtagcctggggtgcaagccgctgaccatgttcctcatcgccgagaacaagatctggggcagaaagagctggcccctaaacgaggggatcatggccgtcggcatcgtgagtatcctattaagctccctgcttaagaacgacgtgcccctcgccgggcccctcatcgccggcggcatgctgatcgcgtgctacgtcattagcgggagcagcgccgacctctccctggagaaagccgccgaggtgagctgggaggaagaggccgagcactccggtgctagccacaacatcctggtggaggttcaagacgacgggacgatgaagatcaaggatgaggagagggacgacacgctcacaatcctgttaaaggccaccctcctggccgtgtcgggagtctaccctcttagcatccctgcgaccctcttcgtctggtacttctggcaaaaaaagaagcagcgatccggggtgctgtgggacacacccagcccgccagaggtggaacgcgccgtgctggacgacggcatctaccgaatcatgcagcgcggactgctcgggcggtcccaggtgggcgtgggggtcttccaggagaatgttttccacactatgtggcacgtgacccgcggtgcggtcctgatgtaccaggggaagcggttagagccctcgtgggcctccgtgaagaaggacctcatcagttacggcggagggtggcgactgcagggctcctggaacaccggggaggaggtgcaggtcatcgccgtcgagcccggcaagaaccccaagaacgtgcagaccgcccccgggacgttcaagacccccgagggagaggtcggcgccatcgctctggatttcaagcccgggaccagcggcagccccattgtgaaccgggaggggaagatcgtcggcctctacggtaacggcgtcgtgaccacgtccggcacgtacgtgagcgccatcgcccaggccaaggcgtcccaagaggggccgctccccgagatagaggacgaggtcttccgcaaacggaatctgaccattatggacctccaccccggaagcggaaagacgcgccggtacctgcctgccatagtgagggaggccatcaagcgtaagctgcgcacgctcatcctggcccccacccgcgtcgtagcgtccgagatggcggaggcgctgaagggaatgcctattcggtaccagaccactgcagtcaagagcgagcacacgggcaaggaaatcgtggacctcatgtgccacgccaccttcaccatgcgcctgttatcccccgtacgggtgccgaactataacatgatcatcatggacgaggcccacttcaccgacccaagctccatcgcggcgcgtgggtacatcagcacgcgggtgggcatgggcgaggccgccgccatatttatgaccgcgacgcctcccggcagcgtcgaagccttcccgcagagcaatgccgtcattcaagacgaggagcgcgacatccccgagcggtcctggaacagcgggtatgagtggatcaccgatttccccggcaagacggtgtggttcgtcccgtccatcaagagcggcaacgacatagccaactgcctccgcaagaacgggaagcgggtgatccagctctcacgcaagacgttcgacaccgaataccagaagaccaagaacaacgactgggactatgtggttacgactgacattagcgagatgggcgcaaacttccgggcagaccgcgtgatcgacccgaggcgctgcctaaaacccgtgatcctcaaggacgggcccgaacgggtcatcctggccggccccatgccggtgaccgtcgcctccgctgcgcagcgccgagggcgcgtgggccggaaccacaacaaggagggtgaccagtacatctacatggggcaacccttaaacaacgacgaggaccacgcccactggaccgaggccaaaatgctcttagacaacatcaacacgcccgagggcatcatcccagcgctgtttgagcccgagcgggaaaagtccgctgcaatcgacggggagtaccgcctccggggcgaggcccggaagactttcgttgaactgatgcgacgcggagacctgcctgtgtggctcagttacaaggtcgcctcggagggcttccagtacagcgaccggcgctggtgcttcgacggagagcggaacaaccaggtgctggaagagaacatggatgtcgagatctggaccaaggagggggagcgcaagaagcttagaccacgctggcttgatgctcggacctactccgaccccctggctctgcgcgagttcaaggagttcgcggccggccggcgcagcgtctctggggacctcatcctggagatcggtaagctaccgcaacacctcacgcagcgggcgcagaatgccctggataacctggttatgctccacaacagcgagcagggcgggcgcgcgtaccggcacgccatggaagagctgccggacaccatcgagacactgatgctcctggccctgatcgccgtcctcaccggaggggtgaccctgttcttcctgtccggtcgcgggcttggcaaaacctcgatcggcctgctgtgcgtgatggcctccagcgtactcctatggatggcgtccgtggagccccactggatcgcagcctctatcatcctggagtttttcctcatggtgctgctgattcccgagccagaccggcagcgcactccacaggacaaccaactcgcctacgtcgtgatcgggctgttgttcatgatcctcacagtggccgcgaacgagatgggcctgctggagaccacgaagaaggacctcgggataggccatgtagccgtggagaaccatcaccacgcggccatgctggacgtggacctgcaccccgcctccgcgtggacgctatacgccgtggccacgaccatcattacgcccatgatgcggcacactattgagaacaccaccgccaacataagcctgaccgccatcgcgaaccaggcggcaattctgatggggctcgacaagggctggcccatctccaagatggacatcggcgtgcccctgttggcgctcgggtgttacagccaggtgaaccccttgaccctgaccgcggcggttctcatgctggtggcccactatgccatcatcggaccggggctgcaggccaaagctacccgagaggcccagaagcgcacagccgccggcataatgaagaaccccaccgtggatggaatcgtcgccatcgacctcgaccccgtggtatacgacgcgaagttcgagaaacagttaggccagattatgctgctcatcctgtgcacctcccagatcctgctcatgcgcacgacttgggccctgtgcgagagcatcaccctggctaccgggcctctcactacgctgtgggaagggtccccgggcaagttctggaacaccaccatcgcggtcagcatggctaacattttccgcggaagctacttagcgggcgccggcctcgccttttcgctgatgaagtccctcgggggggggcggcgggggaccggggcacagggcgagacgctcggcgagaagtggaagcgccagctgaaccaactgtccaagagcgagtttaacacttacaagcgcagcgggatcatggaggtggaccggagcgaggcgaaggagggcctcaagcgtggggagacaaccaagcacgccgtgtcccggggcactgccaagttacgctggtttgtcgaacggaacctggttaagcccgagggtaaagtgattgacctgggatgcggccgcggaggctggagctactactgcgccgggctcaagaaggtcaccgaggtaaagggctataccaagggcgggcctgggcatgaggagcctatcccgatggcgacctacgggtggaacctggtgaagctgcactccgggaaggacgtcttcttcatcccgccagaaaagtgcgacacgctcctgtgcgacatcggggagtcgagccccaacccgactattgaggagggccggaccctgcgggtgctcaagatggtagagccctggctgcgggggaaccagttttgcataaagattctgaacccctacatgcccagcgtcgtggagaccctcgagcagatgcagcgaaagcacggcgggatgctggtacggaacccgctgtcccgcaacagcacgcacgagatgtactgggtctcctgcggtaccggcaacatagtcagcgcggtgaacatgacctcccgaatgttgctgaacagattcaccatggcccatagaaagccgacctacgagcgggacgtcgacctgggggccgggacgcggcacgtggccgtggaaccagaagttgcgaacctcgacatcatcggccagcggatagagaacattaagcacgagcataagagcacctggcactacgatgaggacaatccctacaagacctgggcgtaccacggctcctacgaggtgaagccgagcggtagtgcctccagcatggtcaacggggtagtgaagcttctgactaagccctgggacgttatccccatggtgactcagatcgcgatgaccgataccacccccttcggccaacagcgcgtgttcaaggagaaggtcgacacgcgaacaccgaaggctaagcgcgggacgacccagatcatggaagtgacggcccggtggctctggggatttctgtcccgcaacaagaagccgcggatatgcacccgcgaggagttcacccggaaggtgcgcagcaacgcggctatcggcgccgtcttcgtggacgagaaccagtggaactccgctaaggaggcggtggaggacgagcggttttgggacctggtccatcgcgagcgcgaactccacaagcaggggaaatgcgcgacctgcgtatacaatatgatgggcaagcgcgagaagaagctgggggagtttggcaaggccaaggggagccgggccatatggtacatgtggctcggcgcccgcttcctcgagttcgaagcgctgggcttcatgaacgaagaccactggttctcccgggagaacagcctgtccggggtggaaggcgaggggctccacaagctgggctacatcctgcgggacatcagcaagatccccgggggcaacatgtacgccgacgacacggcgggatgggacactcggatcactgaggacgacctccaaaacgaggccaaaattaccgacatcatggagccggagcacgcccttctggcgaaagccatcttcaagctgacgtatcaaaacaaagtagtgagagtgcagcgccccgccaagaacgggacagtcatggacgtgatctcccggcgcgaccaacggggcagcggccaggtggggacctacggcttgaacaccttcacgaacatggaggcgcagctgatccgccagatggagtccgaggggatcttcagcccctccgagctcgagacccccaatctggccgagcgggttctggactggctcgagaagtacggggtggagcgcctgaagaggatggcgatcagcggggacgactgtgtggtcaagcccatagacgatcgcttcgctaccgcccttaccgcactcaacgacatgggcaaagttaggaaagacatcccccagtgggaaccctccaaggggtggaacgattggcagcaggtccccttctgtagccaccatttccaccagctgatcatgaaggacggccgagagatcgtggtgccatgccggaaccaggatgagctggttggcagggcacgtgtcagccagggggctggatggtccttacgcgagacggcatgtctgggcaagagctatgcgcagatgtggcaactgatgtactttcaccggcgcgacctccgactggcggcgaatgccatctgctccgccgtgcccgtagactgggtacccaccagccgcacaacctggtccatccacgcgcatcaccagtggatgacgactgaggatatgctgagcgtgtggaaccgggtgtggatcgaagagaacccctggatggaggacaagacccacatctcctcgtgggaggacgtcccgtacctcggaaagcgcgaagatcagtggtgcgggtcactgataggcttaaccgccagagctacctgggccaccaatatccaagtcgctatcaaccaggtgcggcgcctcatcggaaacgaaaactacctggactatatgaccagcatgaagcgtttcaagaacgagtccgaccccgagggagccttatggtga

SEQ ID NO: 24684 - RNA, 9879 nt, synthetic construct
  misc_feature 1..9879: note = derived and/or modified CDS sequence (opt11) from DENV-1__KC762635__SS-prME
  source 1..9879: mol_type = other RNA
tcagtgaccatgctgctcatgctaatgcctacggcgctcgcctttcacctaactacaagaggaggtgaaccgcatatgatagtctcgaaacaggaacggggtaaatccctattgttcaaaacaagcgccggcgtaaatatgtgtacgctaatcgcgatggacctaggagaactgtgcgaagacaccctaacgtacaaatgcccgcgaataacggaagccgaacctgacgatgtagactgctggtgcaacgccaccgacacatgggttacttacggtacttgcagtcaaaccggtgaacacagacgagataaacgctcagtggcgttagcaccacacgtagggctaggattagaaaccagaacagagacatggatgagctcggagggcgcctggagacaaatacaaagggtagagacttgggccctgaggcaccccgggttcaccgtcatcgccctgttcctggctcatgcaattggaacctccataactcagaaaggaattatcttcatcctactaatgctcgtgacaccaagcatggccatgcgctgcgtcggcatcggaagtagagacttcgtagagggcctgtccggagccacgtgggtagacgttgtcctagaacacggcagctgtgtgacgacaatggctaaagataaaccgaccctcgacatagaattgctaaaaacggaagtgaccaaccccgcagtcctacgaaaactctgcatcgaagcaaaaatcagcaacaccaccacagactcgaggtgccccacacagggcgaagcgacacttgtcgaagaacaagatgccaactttgtctgtcgccggaccttcgtcgatagaggctggggaaatggctgtgggctattcggcaaaggatcgctcataacctgcgcgaaattcaaatgtgtaaccaaactagagggaaaaatcgtacagtacgagaacctcaaatacagcgttatcgtaaccgtccacacaggcgaccagcaccaggtggggaatgaaagcacggagcacggaacgaccgcgaccattacgccacaagcgcccaccactgaaatacaactgacagactacggggcacttaccctcgactgtagtccgaggacaggcctagattttaacgagatggttcttctcacaatgaaagaaaagtcatggctagttcacaagcaatggttcctagatctaccgctcccatggaccagcggcgcgtctacctcgcaggagacgtggaacagacaggacctcctggtaacattcaaaacagctcacgctaagaaacaagaggtagtagtgctgggctcacaagagggagcaatgcacaccgcgctcaccggcgcgacggagatacaaaccagcggcacaaccaccatctttgccggccacttaaaatgccgactaaaaatggacaaactcacattgaaaggcatgagctacgtgatgtgcacggggagctttaaactagagaaggaagttgcagaaacgcaacacggaaccgtactcgttcaaattaagtatgaggggacggatgcgccctgcaagatcccgttctccacccaagacgaaaagggcgtcacacagaacggcagactgatcacggctaaccctatcgtaacagacaaagaaaaacccgtaaacatcgaggcggagcccccatttggagagtcctacatagtaataggagcgggtgaaaaggctctgaaactgagctggttcaagaaaggaagttccatcgggaagatgttcgaagccacggcccgcggagcccgaagaatggccatcctcggagacacagcgtgggatttcggaagcattggaggagtattcacatcagtcggcaagctagtacaccaaattttcgggacagcctacggggttctattctccggcgtaagctggacaatgaagataggaattggagtgctccttacgtggctaggcctaaactccaggtcaacctcactatctatgacctgtatcgccgtgggcctcgtaaccctctatcttggagtgatggtacaagccgactcgggctgcgtcataaactggaagggacgagaattaaagtgcgggtccgggatctttgtaacgaatgaagttcacacgtggacggaacaatacaaatttcaagcagacagtccaaaaagactgtctgcagccatcggtaaggcgtgggaagaaggcgtgtgcggcattcgtagcgcaacccgattagagaatataatgtggaagcaaatatcaaacgagctaaatcacattttgttagagaatgacatgaaattcacagtggtagtgggagacgtagcggggattctcgcacagggaaagaaaatgatccgaccacaaccaatggagcacaaatacagctggaagtcatggggtaaagcgaaaatcataggagcggatgtccaaaacacgacattcataatcgatggaccaaacacccccgagtgcccagacgatcaacgcgcgtggaacatatgggaggtagaagactacggctttggaattttcacgacaaacatctggttgaaactaagagattcatatacccaagtgtgcgaccaccgactaatgtctgcggcgattaaggacagcaaagccgtacacgccgacatgggttattggatagagtccgagaaaaatgaaacgtggaagctcgcgcgagcctccttcatagaagtgaaaacatgcatctggccaaaaagccacacgctatggagtaatggcgtgttagagtctgagatgataatcccaaagatatacgggggacctatttcacaacataactacagaccaggatactttacacagaccgccggcccctggcatttaggcaaattggagctagactttaacctgtgcgaaggtacaacagtggtggtagacgagcattgcggcaaccgaggcccgagcctaaggacaacaacagtcacaggcaaaataatacacgagtggtgctgccgaagttgcaccttaccaccgttacgcttccgcggcgaagacgggtgctggtatgggatggagattcgacccgtaaaggaaaaagaggagaacttggtgaagagtatggtcagcgccgggtccggggaagtcgactccttcagtctgggactcctatgcataagtattatgatagaagaggtgatgagatcaagatggagccgcaagatgctgatgacaggaacactagccgtcttcttcctactcattatgggtcagctaacatggaacgacttaatccgcctatgcattatggtaggcgctaacgcgagtgacaggatggggatgggaacgacgtacctagctctaatggcgacattcaaaatgcggccgatgttcgccgttggcttgttgttcagaagactaacttcaagggaggtgttgttactaacaatcggcctatccctggtggctagcgtcgaactgccaaatagtttggaagaactgggggacggactcgcgatgggaataatgatccttaagctactgaccgacttccaaagccaccaactctgggccacgctgctatcgctgacgtttatcaagacgacgtttagcctccactatgcgtggaaaacgatggcgatggtactgagcattgtcagtctcttcccactgtgcctatccaccacctcccagaaaactacctggctcccggtcctgctggggtcactggggtgcaaaccgctgacaatgtttctcatcgcggagaacaaaatttggggccgaaagagctggcccctcaatgaaggcatcatggcagttggaatcgttagtatcctgctgtcatctctactcaaaaacgacgtgcctctcgcgggccccttgatagccggcggaatgctaatcgcctgttacgtaatctctggctcaagcgccgacctaagcctagagaaggcagcggaagtatcatgggaggaagaagctgaacacagcggcgcgtcacacaatatactggtagaggtgcaggatgacgggaccatgaaaatcaaggatgaggaacgagacgacacactcacaatcctccttaaagctacgctactcgccgtatccggggtctatccactaagcatacctgccaccctctttgtgtggtatttctggcagaagaagaaacaaagaagtggagtgctctgggacaccccgagcccacccgaagtagaaagggccgtgctagatgatggaatttatcggattatgcagagaggattgcttggtagatcacaggtcggtgtgggagtattccaagagaacgtgttccacacgatgtggcatgtgacgcgaggggctgtgctaatgtaccaaggtaaaaggcttgagccatcatgggcaagcgtaaagaaagacctaataagctatggcggtggctggcgacttcaagggtcatggaacacaggagaagaggtacaagtcatagccgtggaaccagggaaaaatcctaaaaacgtccagacagccccaggtaccttcaaaacaccagagggtgaagttggcgcgatcgcattggatttcaaaccgggtacgagcggctcgcccatcgtaaatcgagaaggaaaaatagttggtttatacggaaatggggtggtaaccacgagtggtacgtatgtatcggcgatagctcaggccaaggcgagccaggagggaccattacctgagatagaagacgaggtgttccgaaaacgcaatctcactataatggacctgcacccgggtagcggcaagacaaggcgctacctccctgcgatagtccgggaggctatcaaaaggaaactcaggaccctcatactcgctccgacaagagtagtggcgagtgaaatggcagaagccctgaaaggcatgcctataaggtaccaaaccaccgcagtcaagagcgaacataccggcaaagaaatagttgacttaatgtgccacgccacattcacgatgcggctgctcagcccggtaagagtcccgaactataacatgataataatggacgaagctcactttaccgacccgtcgtcaatagcagcccgaggatacatctcaacaagagtaggcatgggcgaagcagcagcaattttcatgactgcgaccccgccaggtagcgttgaggcattcccacaatccaatgctgttatccaggacgaagaaagagacattcccgagcgcagttggaacagcgggtatgaatggataacagatttcccgggaaagacagtctggttcgtccccagcatcaaaagtggaaacgacatagccaactgcctacgtaaaaacgggaaacgcgtcatacaactcagccggaagacctttgacacagaataccagaaaactaagaacaacgattgggattacgtggtaacaactgacatatcggagatgggggcgaacttccgagcagaccgtgtaatagacccccgaagatgcctcaaacccgttattttgaaagacggaccagaacgcgtgatactcgcagggccaatgcccgtcaccgtcgcatcagcagcgcagagacgcggccgagtgggacgcaaccacaacaaggaaggcgatcagtacatatacatgggacaaccccttaataacgacgaggaccacgcccactggacagaggcaaaaatgctcctggataacatcaatacgccagaagggattatccctgcgctattcgagcccgaaagggaaaagagcgcagcaatcgacggggaataccgcctacgtggggaagctcgaaagacgttcgtagaacttatgaggcgcggggacctgcccgtctggctctcatacaaggtggcgtccgaaggcttccagtacagcgacaggagatggtgttttgatggcgaaaggaacaaccaggtgctagaagagaatatggatgtcgagatttggacaaaagaaggagaaaggaagaagctgagaccgcgctggttggacgcaagaacgtattcagatcccctggccttacgagagttcaaagagttcgccgcaggcaggcgctcggtcagcggggacctgatactagaaattggcaaactgccgcagcaccttactcaacgagcccaaaacgcactcgataacctggtcatgctgcacaacagcgaacaagggggacgcgcgtatcgacatgccatggaagaacttccggacaccatagagacgctaatgctactcgccctgattgcagtcctaaccggaggcgtgaccctgttcttcctcagcggcagagggcttgggaaaacgagcatcggcctgctgtgcgtcatggcctccagtgtactcctgtggatggccagcgtagagccccactggatcgcggccagcataattctcgagttcttcctcatggtgctcctcatcccagagccagacagacagcgaacaccgcaggataaccaactggcgtatgtagtgataggtctattatttatgatcctaacagtcgccgcaaacgagatgggtcttctagaaacgaccaagaaggacctagggatcggccacgtagctgttgagaatcatcaccatgctgcaatgctcgacgtggatcttcacccagcatccgcgtggacgctatacgcagtcgcaactacaatcatcacaccaatgatgcgacacacaatagaaaatactacggcaaatataagtctaacagccatcgccaaccaagcagccatccttatggggctagataaaggttggcccatcagcaaaatggacataggggtcccgttacttgcactaggatgctacagccaagtgaaccccctcactctcactgcggctgttctgatgctcgtcgcccattatgcaattataggaccaggtcttcaagccaaagccacccgagaggcgcaaaaacgcacagcagcagggataatgaaaaaccctacagtagacggaatcgtagcgattgacctggaccccgttgtatacgacgcgaagttcgaaaagcagctgggacaaataatgctcctaatcctttgtacaagccaaatactgctcatgaggactacctgggccctgtgcgagagcataacgctggcaaccggcccactgaccaccctttgggagggatcgcccgggaagttttggaacacgaccatagcggtaagtatggccaacatcttcagaggctcgtatctcgcgggcgccggccttgcgttctcactgatgaagtcgcttggaggcggaaggcggggcacaggagcacagggagagaccctaggggaaaaatggaaacgccaactcaaccagctcagcaaaagtgaatttaacacctacaaacgaagcggcatcatggaagtagatcgctcggaggcaaaggaaggactcaaaaggggagagacgacgaaacacgcagtaagccgaggaactgccaagctgcgatggtttgtagagcggaacctcgtaaaacccgaaggcaaggtcatcgacctaggatgcggccggggaggatggagttattactgcgccggccttaagaaagtaacagaagttaaagggtataccaaaggtggccccggccacgaggagccgatacccatggcgacatacggctggaatctcgtgaagctacacagcggtaaggacgtcttctttattcctccggagaagtgcgacacactgctgtgcgacatcggcgagagcagtccaaacccaacaatagaagagggccggaccctccgagtcctaaagatggtagaaccgtggctaagaggaaatcagttctgcatcaaaatcttaaacccatacatgccctcagtggtagaaaccctcgaacagatgcaacgaaaacacggaggcatgctagtacgtaaccctttgtcaagaaacagcacacacgaaatgtattgggtctcgtgcggcacgggtaacatcgtctcggctgtgaacatgaccagccggatgctactcaacagatttacaatggcccaccgcaagccaacatacgagcgcgacgtcgaccttggagcaggtactcggcatgtggcagttgaaccggaggtcgcaaaccttgatataataggtcagaggatagaaaacataaagcatgagcacaaaagtacctggcattatgatgaagacaacccttacaaaacttgggcctatcacgggtcctacgaggtaaagccctccggaagtgccagcagcatggtaaatggagtggtcaaactactgactaaaccgtgggacgtaataccaatggtcacacaaatagcgatgacggacacaaccccattcgggcaacagagggtcttcaaagaaaaggtggacacccgaacgcccaaagcgaagagaggcacaactcaaataatggaggtaacagcgcggtggctctggggctttctaagcaggaataagaagccccgaatttgcacccgagaagaatttaccagaaaagtgagatcaaatgccgcaattggcgcagtgttcgtggacgaaaaccaatggaacagtgcgaaggaggcggtggaggacgaacgcttctgggatctcgtacaccgggagagagaactgcacaagcaagggaagtgcgccacatgcgtatacaacatgatgggaaagcgtgagaagaaacttggcgagtttggaaaggccaagggaagtcgggcaatatggtatatgtggctaggtgccagattcctcgaatttgaggcgctcggattcatgaacgaggaccactggtttagtcgcgaaaactctctgtcaggggtagagggcgaaggattacacaagctcggctacatactacgtgatatatcgaaaatacccggcgggaacatgtacgctgacgacactgccggttgggacacgcgcatcaccgaggacgacctgcagaacgaggcaaagattacggacattatggaaccggaacacgccttgctcgcaaaggcaatcttcaaattgacataccaaaacaaagtggtgcgcgtacaaagaccggcaaagaacgggaccgtcatggacgtcatctcacggagggatcaacgagggagcggccaggtcggaacgtacggactaaacaccttcacaaacatggaagcgcagctgattcgccaaatggaaagcgagggaatcttcagcccatcagagctcgagacgccaaacctagcggagcgcgttctggactggctcgaaaaatacggcgttgaacgcctgaaaaggatggcgatctctggtgacgactgcgtagtaaagccgatagacgaccgtttcgcgacggctctaaccgcactgaacgacatgggtaaagtacgaaaagacataccacaatgggaacccagcaagggatggaacgattggcaacaggtacctttctgctcacaccacttccaccaactgattatgaaagatggtcgcgaaatcgtggtcccgtgcagaaaccaagacgagctcgtgggaagggcccgggtgagccagggtgcgggatggtcgctacgggaaacggcatgcctaggtaagagttacgcacaaatgtggcaactcatgtacttccatcgacgtgacctccggctcgctgccaacgcaatatgcagcgcggtaccagtggactgggtccccacgagccgaacgacgtggtcaatacacgcccaccatcaatggatgactacagaagatatgctgtcggtctggaatagagtctggatagaagagaacccctggatggaggataaaacccacattagtagctgggaagacgtcccctacctcggaaaaagagaggaccagtggtgcggctcgctcatcggtctcactgcgagagcaacatgggcaacgaacattcaagtcgccataaaccaagtgcgccggctgataggcaatgagaactatctagattacatgacatcaatgaaacgatttaaaaacgaaagtgacccagaaggggcgttatggtaa

SEQ ID NO: 24685 - RNA, 9879 nt, synthetic construct
  misc_feature 1..9879: note = derived and/or modified CDS sequence (opt11) from DENV-1__KC762650__SS-prME
  source 1..9879: mol_type = other RNA
agcgtgaccatgctgctcatgctgatgccgaccgcccttgctttccacctcacaacacggggcggggagccccacatgattgtatccaagcaggagaggggcaaaagcctccttttcaagacgtccgccggcgtcaacatgtgcaccctaatagcaatggacctgggcgaactgtgcgaggacactcttacgtataagtgccctcggataaccgaggcggagcccgacgatgttgattgctggtgcaacgccactgacacctgggtgacctatgggacatgctcacaaaccggggagcatcgtcgggacaagcggtccgtagctttggcgcctcatgtgggcttaggactcgagactagaaccgagacctggatgagctccgaaggcgcctggcggcagatccagcgggtcgagacctgggccctacggcaccccggttttacggtcatagctctgttcctcgcccacgccatcgggaccagcattacacagaaagggatcatattcatcctgctaatgctcgtgacgccctccatggccatgagatgcgtggggatcggctcgagagatttcgtcgagggactctccggcgccacgtgggtggacgtcgtactggagcatgggagctgtgtaaccaccatggcaaaggataagcccaccctcgacatagagcttctgaagactgaggttaccaatccagcggtcctccgcaagttgtgtatagaggccaagatttccaacacgaccacagactcaaggtgcccaactcagggagaggccaccctggtggaggaacaggacgctaactttgtatgtcgccggaccttcgtcgatcggggctggggtaacggatgcgggctgttcgggaagggctccttaattacgtgcgccaagtttaagtgcgtgacgaagctggaggggaagatcgtgcaatacgagaaccttaagtacagcgtgatcgtaacagtgcacaccggagatcagcaccaggtgggcaacgagtccacggaacacggcacaaccgcgaccattactccccaagctcctaccactgaaatccagctgactgactacggggcactgacccttgactgctctccccggacaggcctggatttcaatgagatggtcctactcacgatgaaagaaaaatcatggttggtgcataagcagtggttcctagacctccccctgccttggaccagcggggccagcacctcccaagagacgtggaatcgccaggatctgctcgttacctttaagaccgcccacgcgaaaaaacaggaggtggtggtgcttgggagccaggaaggcgccatgcacacggcactgaccggagccaccgagatccagacctcgggcaccacgaccatcttcgctggacacctcaagtgtagacttaagatggacaagctgactctcaagggcatgtcctatgttatgtgtaccgggtccttcaagctagagaaggaggtggcggagacgcagcacgggaccgtgctggtccagatcaagtatgaaggcacagacgccccctgcaagatacccttcagcacccaagacgagaaaggggtgacacagaacgggcgcctgatcaccgctaacccgatcgtgactgataaggagaagccggtgaacatcgaggcggaaccgcccttcggtgagtcttacatcgtgatcggcgccggtgagaaagccctcaaactgagctggttcaaaaaggggtcttcgattggcaaaatgtttgaagccaccgcccgcggggcccggcgtatggccatcctgggcgacacggcctgggacttcgggtctataggcggtgttttcactagtgtcgggaagttggtccaccagatattcggcaccgcctatggtgtgctgttctccggagtatcctggaccatgaagatcgggatcggcgtccttctcacgtggctgggactgaactcacggtcaacgagcttgagcatgacgtgtatcgccgtggggctggttaccttataccttggggtgatggtacaggctgattccggatgtgtcataaattggaaaggccgcgagctgaaatgcgggagcggcatcttcgtgacgaacgaggtgcacacctggaccgagcagtacaaattccaggcggactctccgaaacggctgtccgccgcgatcggcaaagcgtgggaagaaggcgtctgcggaatcaggtctgccacccggttagagaacatcatgtggaaacagatctcaaacgagttgaaccacatacttctggaaaacgatatgaaatttaccgtcgtggtcggggacgtggcgggcatcctggctcaagggaagaagatgatccgcccccagcctatggagcacaagtattcttggaagtcctggggcaaggccaagatcatcggcgccgacgtgcagaacaccacattcatcattgatggccccaacacccctgaatgtcccgatgaccagcgggcatggaacatctgggaggttgaggactacggcttcgggatctttacgacgaacatctggcttaagctccgcgatagttatacccaagtttgcgatcaccggctaatgtccgccgccatcaaagatagcaaagcggtgcatgccgatatggggtactggattgagtccgaaaagaacgagacctggaaactggcaagggctagcttcatcgaggtcaaaacctgtatttggcccaaatcccataccctttggagcaacggggtgttagagtccgaaatgataatcccaaagatctacgggggtcccatctcgcagcacaactaccggccagggtactttacacagaccgcgggcccctggcacttagggaaattggaactggacttcaacctgtgcgagggcactacggtagtagtggacgagcactgcggcaaccgcgggccatccctcagaacgaccaccgtgacaggcaagatcatccacgagtggtgctgcagaagctgtaccctgccgcctctgcgtttccgcggggaagacggatgttggtacggaatggaaataagacccgtaaaggaaaaggaggagaacctcgtgaagtccatggttagcgcaggctcaggcgaagtcgactccttcagccttgggctgttatgcatcagcatcatgattgaggaagtgatgcgaagccgttggagtcgcaaaatgctgatgaccggcaccctagccgttttctttctgctgatcatgggtcagctgacgtggaacgacctcatccgcctgtgcattatggtcggcgcgaacgcaagcgacagaatggggatgggaaccacctatctggcccttatggctaccttcaagatgaggccgatgttcgctgtaggactgcttttccggcgcctcacgtcccgtgaagttttgctattaacaatcgggttaagcctggtcgcgtctgtggagttgcccaacagcctggaggagctgggtgacgggttagcgatgggcatcatgatcctgaaactgctcactgactttcagtcccatcagttatgggccaccctgctcagcttgacctttatcaagacaacattctccctgcattacgcctggaagaccatggcgatggtactcagcattgtgtcactgttcccactctgtctctccacgacctcccagaagacaacctggctgccagtgctgcttggtagcctggggtgcaagcctctcacgatgttccttatcgctgaaaataagatctggggccggaagtcctggccactgaacgagggaatcatggcagtaggcatcgtgagcattctgctatcaagcctgttgaagaacgatgtccctctcgccggccctttaattgccggcggtatgcttatcgcgtgctacgtcatcagcggttccagcgcggatctcagcttagagaaggccgcagaggtgagctgggaggaagaggccgagcattccggagcatcgcataacatcctggtggaggtccaggacgacgggaccatgaagatcaaggacgaggaacgggacgacacgctcaccatcctgctaaaggccaccctcctggccgtcagcggcgtgtacccgctctccattcccgcgacattgtttgtgtggtacttctggcagaagaagaaacagagatccggggtgctgtgggataccccgagcccgcccgaggtcgagcgggcggtgctggacgacggcatctaccgcatcatgcagcggggcctcttagggcgcagccaggtgggggtaggtgtttttcaggagaacgtgtttcacactatgtggcacgtgacgaggggcgccgtcctcatgtatcaagggaagcgtctggagcccagctgggcttcggttaagaaggacctcatatcgtacggcggggggtggcggttgcaggggtcctggaacacgggggaggaagtgcaggtaatagcagtggagcccggcaaaaaccccaagaatgtgcagacagcccccgggaccttcaagacccccgagggcgaggtcggcgcaattgctctggatttcaaaccagggacgtccggcagccccatagtgaaccgggaaggtaagattgtgggcctgtacggcaatggggtagtaaccactagcggcacttacgtaagtgctatcgctcaagcaaaggcgagccaagaggggcctctgcctgagatcgaagatgaggtctttcgcaagcgtaatctgacgatcatggacctgcacccgggcagcgggaaaaccaggcggtacttacccgcaatcgtccgtgaagctattaaaagaaagttgcgcactctcatcctggcgccgaccagagtggtagcctccgagatggcggaagccctcaagggcatgcccatccgctatcagacgaccgccgtgaagagcgagcacaccggcaaggagatcgtcgacttaatgtgccacgccaccttcactatgcggctgctctcccccgtccgggtgccaaattacaatatgataatcatggatgaggcccattttaccgacccctcatcaatagcggcccgggggtatatctccacccgcgtgggcatgggtgaggccgcggccatatttatgaccgctacgccccccggatccgtcgaagccttccctcaatctaatgccgtgatccaggacgaggagcgggatataccggagcgctcctggaacagcgggtacgagtggattaccgatttccccgggaagactgtttggttcgtgccgtccatcaagagcgggaacgacatcgctaactgccttcggaagaacgggaagcgcgtgatccagttgtcacggaagaccttcgacaccgagtatcagaaaaccaagaacaacgactgggactacgtggtaacaaccgacattagtgaaatgggcgcgaatttccgtgccgatcgcgttatcgacccgcgccggtgtttaaaacctgtgatcctcaaagacgggccggagcgagtcatcctggcaggtcccatgccggtgacggtcgcctccgccgcccagcggcgcgggagggtaggccgcaaccacaacaaggaaggcgaccagtacatctatatgggccagccactgaacaatgatgaggaccatgcccactggaccgaggccaagatgctcttagacaatatcaacacacccgaagggattatacccgcgcttttcgagccggagcgagagaaatcggcggcgatcgacggggagtaccggttgcgcggcgaagcacggaaaaccttcgtcgagcttatgcgccgcggggatctcccggtctggctttcctacaaggtcgcgtcagagggcttccagtacagcgaccgccggtggtgctttgacggcgagcgcaacaaccaggtgctcgaggagaatatggacgtcgaaatctggacgaaagagggtgagcggaagaaacttcgtccacggtggctcgatgcgcgcacctactccgaccccctggcccttcgggagttcaaagagttcgcagctggtcgcagaagcgtatccggagacctcatcctcgagatcggcaagctgcctcagcatctcacccagcgcgctcaaaatgccctagacaacctggtaatgctccataatagcgagcaaggcgggcgggcgtaccgacacgcaattgaagagctgcccgacactatcgaaacacttatgttactggctctgattgccgtgctaactggcggggtaactttattcttcctttccgggcgagggctcggcaaaaccagcataggactgctgtgcgttatggcatccagcgtcctactatggatggcgtccgtggaaccccattggatcgccgctagcatcatactggagttcttcctgatggtgctgttgattccagagccggacaggcagcggaccccgcaagataaccaactcgcctacgtggtaatcggactactattcatgatcctcacggtggccgcgaacgaaatgggcctgctggaaaccaccaaaaaggacctcggcataggccatgtcgcggtggaaaaccatcaccatgccgccatgctcgacgtggatctgcaccccgctagcgcgtggaccctgtacgcagtcgctactaccattattaccccgatgatgcggcacacgatcgagaacactaccgctaacataagcctgaccgccatcgcgaaccaggctgccatcttgatggggctcgacaagggttggcccatatccaagatggacatcggcgtgcccctgctggccctcgggtgttactcccaggtgaacccccttacactcacggcggcggtcttaatgctggtggcccattacgccataataggcccgggattacaagccaaggcgacccgcgaggcgcagaaacggaccgcggccggcatcatgaaaaatcctaccgtggacggtatagtagccattgacctggaccccgtcgtatatgacgcgaagttcgagaagcaactgggacagatcatgctattaatactgtgcaccagccagatcttactaatgaggaccacctgggcgttatgcgagtctataacactggccactggccccttgaccaccctgtgggaggggtcccctggaaagttctggaacaccacgattgccgtcagcatggccaatatttttcggggctcctacttagcaggcgccggactcgccttcagcctgatgaagtccctcggaggcggccgccggggcaccggggcgcagggagagacgctcggcgagaagtggaaacgtcagcttaaccagctaagtaagagcgagttcaatacctacaaacgttccggaatcatggaggtggaccgcagcgaggccaaggagggcctaaagagaggggagacgacgaagcacgccgtctcccgcggaaccgccaagctgcggtggttcgtggagcgcaacctggtgaagcccgagggcaaggtaatcgatttgggctgcggccgcggagggtggagctactactgcgcagggctgaagaaagtgaccgaggtcaaggggtacaccaagggcggccccggccacgaggaaccgatcccgatggccacctacgggtggaatctggtaaagctgcactcaggcaaggacgtcttctttatcccgccagagaagtgcgacaccctcctgtgtgacatcggggagtccagccccaaccctacaatcgaggagggccgaacgttacgggtgctcaagatggtggagccatggcttcgagggaaccagttctgtattaagatactaaacccctacatgcccagcgtcgtggaaaccttggagcagatgcagcggaagcatggaggcatgctggttcgcaatcctctaagccggaacagcactcacgagatgtactgggtctcctgtggtacgggaaacatcgtgtctgcggtgaacatgacctctcgcatgctgctcaatcgtttcacgatggcccaccgcaaacctacgtacgaaagggatgtcgacctcggggcgggcacccggcacgtagccgtcgagccagaagtcgccaacctcgacatcatcgggcaaagaatcgaaaacatcaaacatgagcataagtcaacctggcactatgatgaagacaacccctacaagacgtgggcgtaccacggtagctacgaggtaaagccgtcgggctcggcctcatcaatggtcaacggggtggttaaattgctgacgaagccctgggacgtcataccaatggtgactcagatcgccatgacagacactacccccttcggccagcaaagagtttttaaggaaaaggtagacacgcgcaccccgaaggcgaagcgggggacgacccagatcatggaggttacggcccgctggttgtggggctttctttctcggaacaaaaaaccacgcatctgcacccgggaggagttcacaagaaaagtgcgcagcaacgcggccatcggcgccgtttttgtggacgaaaaccagtggaactccgccaaggaggcagtcgaagacgagcgcttctgggacctggtacaccgagaacgggagcttcacaaacaggggaagtgcgcgacatgcgtgtataacatgatggggaaacgagagaagaagctgggggaattcggcaaagcaaaggggtctagggccatatggtacatgtggctgggagcccgttttttagagttcgaagcgctgggtttcatgaacgaggaccattggttttctagagaaaacagtctaagtggcgtggagggcgagggtttgcataaactgggttacatcttaagagacatcagcaaaatccccgggggcaacatgtacgccgacgatacggccggatgggacacccgcatcactgaagacgacctccagaacgaagcgaagatcaccgatattatggaaccggagcatgcccttctggcaaaggcaatttttaagctcacctatcagaataaagtcgttcgcgtacagcggcccgcaaaaaacgggacggtcatggatgtcatctctcgccgggaccagagaggcagcggacaagtgggcacgtatggacttaacaccttcaccaacatggaggcccaactgattcgccaaatggagagcgagggcatcttttcaccctccgaacttgagacccctaacctggctgagcgcgtcttggactggctcgagaaatacggtgtggagaggttaaaacgcatggcgatcagtggggatgactgcgtggttaagccgatcgacgatcggtttgcaacggcccttacagcacttaacgatatgggcaaagtgagaaaggacatcccccagtgggagccctcgaaggggtggaatgactggcagcaagtccccttctgcagccaccacttccaccagctgatcatgaaggacggacgggaaatcgtcgtaccgtgcagaaatcaggacgaacttgtgggccgggcccgcgtctcccagggggcgggatggagcttgcgggagaccgcctgcctgggaaaaagctacgcacaaatgtggcagttaatgtattttcatcgccgggacctccgcctggccgctaatgctatctgctccgccgtacccgtcgactgggtccccacatcccgcacgacctggagcatccacgcgcatcatcagtggatgaccaccgaggacatgcttagcgtttggaacagagtatggattgaggaaaacccgtggatggaggacaagacgcacatttccagttgggaggacgtcccgtatctcggcaagagagaggaccagtggtgcgggtccctgataggtcttacggcccgggcgacttgggccactaatatccaggtagcaatcaatcaggttcgccggttaatcggcaatgagaactatctggactatatgacgtccatgaaaaggttcaagaacgagtcggatcccgagggagccctttggtga

SEQ ID NO: 24686 - RNA, 9879 nt, synthetic construct
  misc_feature 1..9879: note = derived and/or modified CDS sequence (opt11) from DENV-1__KC762623__SS-prME
  source 1..9879: mol_type = other RNA
tctgtgaccatgctgctcatgctgatgcccaccgctctggccttccacctcactacccggggcggggagcctcacatgatcgtcagtaagcaggaacggggcaagtcactgctgttcaagacctcagccggggtgaacatgtgcaccttaatcgccatggacctgggtgagctgtgcgaagacaccttaacttacaaatgtccacgcatcaccgaagccgagcccgacgacgtggactgctggtgtaatgccaccgatacctgggtcacctatgggacctgcagccagaccggggagcaccggcgcgacaagcggagcgtggccctagcgccccacgtgggcttagggctcgagacgcgcaccgagacctggatgtcctcagagggcgcctggaagcagatccagcgcgtggagacctgggccctgcgccaccccgggttcacggtgatcgccctgttcctcgcgcacgccattggaactagcatcacccagaaggggatcatttttatcctgctgatgctcgttacgccctccatggccatgcggtgcgtcggcatcggcagcagagacttcgtggaggggctgtccggcgccacgtgggtggacgtcgtgctcgagcacgggagctgcgtgaccaccatggccaaggacaagccgacactcgacatcgagctactgaagacggaagtaaccaaccccgccgtgttgcggaagctttgtatcgaggccaagatctccaacaccacaacggacagccgctgccccacccagggcgaggccactctggttgaggaacaggacgccaacttcgtatgccggcgcacatttgtggaccggggctgggggaacggctgcggactgttcgggaaggggagtcttatcacctgcgcgaagttcaagtgcgtgagcaaattggaggggaagatagtccagtatgagaatctcaagtactccgtgatcgtgaccgtccataccggagaccagcaccaggtagggaacgagagcaccgagcacggcactaccgcgaccatcacgccccaggcccccaccacggagatccagctgaccgactacggggccctgaccctagactgcagcccccgaaccggcctagatttcaacgagatggtactgctcacgatgaaggagaagtcctggctggtccacaagcaatggttcctcgaccttcccttgccctggaccagcggggcctctaccagccaggagacctggaaccggcaggatctgttagttacgttcaagaccgcccacgcgaagaagcaggaggtcgtggtgctggggtcccaggagggcgccatgcacacggccctgacgggggccacggagatccagacctctggcaccaccacgatcttcgctgggcacctcaaatgccgcctgaagatggacaaactgaccctcaaagggatgtcctatgtaatgtgcaccggctcttttaagctggagaaggaagtggcggagacacagcacggcacggtgttagtccagataaagtacgagggaaccgacgccccctgcaagatccccttctccacccaagacgagaagggggtgacccaaaacggccggcttatcacggcaaatccgatcgtgaccgacaaagagaagcccgtcaacattgaggctgaaccgccgttcggtgagagctacatagtcatcggcgcgggcgagaaggccctcaagctgtcctggtttaagaaggggagctccatcggcaagatgtttgaggcaaccgccaggggggcgcgccgcatggcgatactgggcgataccgcctgggacttcggcagcatcggcggcgtattcacgtccgtcgggaagctcgtgcaccagatcttcggaactgcctacggggtgctgttcagcggcgtctcgtggaccatgaagatcgggatcggcgtgctcctgacgtggctgggcctgaacagcaggtcaacgagcctctccatgacctgtatcgccgtgggccttgtcaccctgtacttgggcgtgatggtgcaggctgacagcgggtgcgtcatcaactggaaaggtcgggaattgaagtgcgggtccggtatcttcgtgaccaacgaagtgcacacttggaccgagcagtacaagtttcaggcggactccccgaaacgccttagcgccgccatcggcaaggcctgggaggagggggtgtgcggcatacggtccgccaccaggctcgagaacatcatgtggaagcagatctccaacgagctgaaccacattctcctcgagaacgacatgaagttcaccgtggtggtcggtgacgtggctggcattctggcccagggaaagaaaatgatccggccccagcccatggagcacaaatactcgtggaagtcctggggcaaggcaaagatcatcggcgcagacgtgcagaacaccacgttcatcatcgacgggcccaacaccccggagtgcccggatgaccagcgcgcgtggaacatctgggaggtcgaggattacggctttggaatcttcactacgaacatttggctgaaactccgggactcttatacgcaggtgtgcgaccatcgactgatgagtgccgccatcaaggattccaaagccgtgcacgccgacatgggctactggatcgagagcgagaagaacgagacgtggaagctggcgcgggcctcgttcatcgaggtcaagtcgtgtatctggcccaagtcccacaccctctggtccaacggcgttctggagtccgagatgatcatccccaagatctacgggggcccaatctcacagcacaattaccgccccgggtacttcacccagactgccggcccctggcacctggggaagctcgagctggacttcgacctgtgcgagggcaccaccgtggtcgttgacgagcactgcggcaaccgggggccctccctccgcacgacgaccgtaacggggaaaatcatccacgagtggtgctgcagaagctgtacccttccgcccctgcgcttccgcggggaggacggctgttggtatgggatggagatccgccccgtcaaggagaaggaggaaaatctcgtcaaaagcatggtttccgccggcagtggcgaagtcgattccttcagcctcgggctgctctgcatttccatcatgatcgaggaggtgatgcggtcccggtggtcccgcaaaatgctgatgacaggcaccctggccgtgttcttcctcctgatcatggggcagctgacttggaacgacttgatccgcctgtgcatcatggtcggcgcgaacgccagcgatagaatggggatgggcaccacgtacctggcccttatggccaccttcaagatgcggcccatgttcgccgtggggctcctgttccgccggctcacctcccgagaagtgctgctgctcaccatcgggctgagcctggtcgcgtccgtggagctccccaattccctggaggagctgggtgatgggctcgccatgggcattatgatcctgaagcttctcacggatttccagtcccaccagctctgggcaaccttgctcagcctgaccttcatcaagaccacgttttccctgcactacgcctggaagacgatggcgatggtcctcagcatcgtgagtcttttccccctgtgcctcagcaccacctcacagaagacgacatggctgccagtgctgttaggcagcctggggtgcaagccgctgaccatgttcctcatcgccgagaacaagatatggggccgcaaaagctggcccctgaacgagggaatcatggccgtcgggatcgtatctatcctgctctcgtcccttctgaagaacgacgtccccctcgccgggcccctgatcgccggcggcatgctgatcgcgtgctacgtaatcagcgggtccagcgccgacctgtccctcgagaaggccgccgaggtgagctgggaggaggaggccgagcactccggcgcgagccataacatcctggtggaggtccaggacgacgggaccatgaagatcaaggacgaggaacgcgacgacacgttgaccatcctgctgaaggccaccctcctggctgtctccggcgtctacccgctgagcatccccgccaccctcttcctatggtacttctggcaaaagaagaagcagagatccggggtactgtgggacacccccagcccgcccgaggtggagcgcgccgtgctggacgatgggatctaccggatcatgcagcgcggcctcctggggagatcccaggtcggcgtcggggtcttccaggagaatgtctttcacacaatgtggcacgtgactcgcggagcggtgctgatgtaccaggggaaacggctcgaaccctcgtgggcctccgtcaagaaggacctgatcagctacggcggcggttggcgactgcaaggctcgtggaacaccggggaggaggtccaggtgatagccgtcgagcccggcaagaacccgaaaaacgtgcagacagcccccggaacatttaagacccccgaaggcgaggttggagccatcgcgctcgacttcaagcccgggaccagcggcagcccgatcgtaaaccgggagggcaagatcgtgggcctgtacggcaatggggtggtcactacgtccggcacctacgtgagcgccatcgcccaggctaaggcgagtcaggaggggccgctgcccgagatcgaggacgaggtattccgcaagcgtaacctcacaatcatggacctgcaccccgggagtgggaagacccgccgttatctgccggcaatcgttcgcgaggccatcaagcggaagctcaggacactgatactggccccaacgcgcgtggtggcctcagagatggcagaggccctcaagggcatgccgatccggtaccagaccacggccgtcaagagcgagcacaccggcaaggaaatcgtggacctgatgtgccacgccaccttcaccatgcgcctgctctctcccgtacgggtcccgaactataacatgattatcatggacgaggcccacttcaccgatccgagctccatcgcggcccgcgggtacatcagcacgcgggtgggcatgggggaggccgccgccatattcatgaccgcgacgccgcccggctccgtcgaggcattcccgcagagcaacgcagtgattcaggacgaggagagggacattcccgaacgatcctggaacagcggttacgaatggatcacagacttccccggtaagacggtgtggttcgttccatccatcaagagcggcaacgatatcgccaactgtttgcgcaagaacggtaagcgtgtgatccaactgtcgcgcaagacgttcgacaccgagtaccagaaaaccaagaataacgactgggactacgtggtgacaaccgacataagcgagatgggtgcgaacttccgggccgaccgcgtaatagacccgcggcgctgcctcaagcccgtaatcctgaaggacggacccgagcgagtgattcttgccggccccatgccggtaaccgtggcgtccgcagcgcagcgccgggggagagtaggccggaaccataacaaggagggcgaccaatacatctacatggggcagcccctcaacaacgacgaggatcacgcccactggaccgaggccaagatgctgctggacaacattaacacgccggagggaatcatccccgccctcttcgagccggagcgcgaaaagtctgccgcgatcgacggggagtaccgcttacggggcgaggcccgcaagacttttgtggaactgatgcgtcgaggggaccttcctgtctggctgagctacaaagtagcttccgagggcttccagtacagcgaccggcgctggtgcttcgacggtgaacggaacaaccaggtactggaggagaacatggatgtagagatttggaccaaggagggggagagaaagaaactccggccccgctggctggacgcccggacctactccgaccccctggcgttaagggagttcaaagagttcgccgcgggccgccgcagcgtctccggggacctaatcctagagatcgggaagctcccgcaacatctgacccagcgggcccagaacgccctggacaacctcgtgatgctgcacaacagcgagcaaggcggtcgcgcataccggcacgccatggaggagttgccagacaccatcgagactctcatgctgctggccttgatagccgtgctgacaggcggggtcacgctgtttttcctctccggccgcgggctgggcaagaccagcatcggcctgctctgcgtgatggcctccagcgtgttactgtggatggctagcgtcgagccccactggatcgccgccagcatcatcctcgagttcttcctgatggtgctgctaatccccgaaccggaccggcagagaacgccccaggacaaccaactggcgtacgtggtcatcgggctcctcttcatgatcctcaccgtggcggcgaacgagatgggcctgctcgagacgacgaagaaggacctcgggatcggccacgtggccgtcgagaaccaccaccacgccgcgatgctggacgtggatctccatcccgcaagtgcatggaccctgtacgccgtggcgaccacgatcatcacgccgatgatgcggcacaccatcgagaacaccaccgccaatatcagcctgacggccatcgcgaatcaggccgctatactcatgggactggacaaaggctggcccatatctaagatggacatcggcgtccccctgctggccctggggtgctatagccaagtgaaccccctcaccctcacggccgccgtgctgatgctggtcgcgcactacgccatcatcggaccagggcttcaggcgaaagcgacaagagaggcccagaagcgcacggccgccggcattatgaagaaccccaccgtggacggtatagtcgcaatcgacctggaccccgtcgtttatgacgcgaagtttgagaaacagctgggccagatcatgctcttaatcctgtgcacctcccagatcctcctgatgcggactacctgggccttgtgtgagagcatcaccctcgccaccggcccccttaccacactgtgggaggggagtccgggcaaattctggaacaccaccatcgccgtcagcatggctaacatattccgcggttcgtacctcgcgggcgcaggactggccttctccctgatgaagtctctcgggggagggcggcgaggcactggggcccaaggcgagacgctgggcgagaagtggaagcggcaactgaaccagctctcgaagagcgagttcaacacctacaagcgctccgggatcatggaggtcgaccggagcgaggcgaaggagggcctgaaacgcggggagacaaccaaacacgccgtgtcccggggcacggccaagctgcgctggtttgttgagcggaacttagtcaagcctgagggaaaggtgatcgatctcggctgcggccgcgggggctggagctactactgcgccgggctaaagaaggtgaccgaagtcaagggctacaccaaggggggtcccggacacgaggaacccatcccgatggccacctacggctggaacctcgtgaagctccactctggtaaggacgtattcttcatcccgcccgagaaatgtgacacgctgctgtgcgacatcggtgagagctcccccaaccctacgatcgaagagggccggaccctaagagtcctgaagatggtggagccctggctgcgggggaaccaattctgcatcaagatcctcaacccatatatgcccagcgttgtcgagacgcttgaacagatgcagcgcaagcacggcggaatgctagtgcgtaacccactctcccggaactcgacgcacgagatgtactgggtgtcatgtgggaccggcaacatcgtcagcgcggtgaacatgacctcccggatgctgctgaatcgctttaccatggctcaccgcaagcccacctacgagcgggacgtggacttaggggccggcacgcgccatgttgccgttgagcccgaggtagccaacctggacatcatcggccagcgcatcgagaacatcaagcacgaacataagagcacgtggcactacgacgaggacaacccctacaagacctgggcgtaccacggttcctacgaggtgaagccttcgggcagcgcctcctccatggtgaacggggtggtaaagctgctcaccaaaccgtgggacgtcatccccatggtcacacagatcgcaatgaccgacacgacccccttcggccaacaacgcgtcttcaaggagaaggtggacacgcggaccccaaaggccaagcgcggtaccacccagatcatggaggtcacagcccggtggctgtggggcttcctctcccgcaacaagaaaccccggatctgtaccagagaagagttcacccggaaggtgcgcagcaacgcggccatcggagccgtatttgtcgacgagaaccagtggaattccgccaaggaggcggtagaagacgagcggttctgggacctcgtacacagagagcgggagctgcacaagcaggggaagtgcgcgacctgcgtgtacaacatgatgggcaagcgtgagaagaaactgggggagttcggcaaggccaagggcagccgagccatctggtacatgtggctcggcgcacgcttcctggagttcgaggcgttaggcttcatgaacgaagaccactggttctccagggagaatagcctctcgggagtggagggcgaagggctccacaagttgggctacatattaagggacatcagcaagattcccgggggaaacatgtacgccgacgacacggccggctgggatacgcggatcactgaggacgacttacagaacgaggccaagatcaccgacatcatggagccggagcacgccctgctcgcgaaagccatattcaagctgacgtatcagaacaaggtggttcgagtgcaacgccccgccaagaacgggaccgtcatggacgtcatctcccggagagaccagcggggcagcggccaggtggggacctacggcctaaacaccttcactaacatggaggcccagctcattaggcagatggagtccgaggggatctttagcccctccgagctggagacccccaacctggccgagcgggttctcgactggctggagaagtacggcgtcgaacgcctgaagcgcatggcgatctctggggacgactgcgtggtcaagccgattgacgaccgcttcgccaccgccttaaccgccctaaacgacatgggcaaggtccggaaggacatcccccagtgggagccctctaaggggtggaacgactggcagcaggttcccttctgcagccaccacttccaccagctgatcatgaaggacggcagggaaatcgtggtcccgtgccggaaccaggatgagctcgttggccgcgcccgggtaagccaaggcgcgggctggtctctgagggagactgcctgcctgggcaagagctacgcccagatgtggcagctcatgtacttccaccggcgcgacttacgcttggccgctaacgccatatgctccgccgtccccgtggattgggtgcccaccagccgcaccacctggtccatacacgcccaccaccagtggatgacaacagaggacatgttgagcgtctggaaccgcgtgtggatagaggaaaacccctggatggaagataagacccacatctctagctgggaggacgtgccgtacctgggcaagcgcgaggatcagtggtgcggcagtctaatcggactcaccgcgagagcgacgtgggctaccaacatccaagtcgcgatcaaccaggtgcggcgactgatcggcaacgagaactacctggactacatgacaagcatgaagcggttcaagaacgagtccgaccccgagggggccctgtggtga

SEQ ID NO: 24687 - RNA, 9879 nt, synthetic construct
  misc_feature 1..9879: note = derived and/or modified CDS sequence (opt11) from DENV-1__KC762632__SS-prME
  source 1..9879: mol_type = other RNA
agcgtaacaatgctcctcatgctcatgcccaccgccttagcatttcaccttacgacgcgcgggggcgaaccccacatgatagtttctaaacaagaacgagggaaaagtctcctattcaaaaccagtgctggggttaacatgtgcaccctcatcgcaatggatctcggggaactgtgcgaagacaccttaacctataaatgtcctcggatcacggaggccgaacccgacgacgtagactgctggtgtaacgccacggacacctgggttacctacggtacatgcagccaaacaggggaacatagaagagacaagcgttctgtggcgctcgcgccgcacgttggcctcggcttggaaacccgcacagaaacatggatgagctcggaaggggcatggagacaaatgcaacgagtagagacctgggcactgcgacatcccggctttacagtaatcgcattgttcctcgcccacgcgatagggacctcgatcacgcaaaaagggataatcttcatactacttatgctggttactccttccatggcaatgagatgcgtaggcattggtagccgggacttcgtagaaggtcttagtggggcaacgtgggtcgacgtagtgcttgaacacggttcctgcgtaaccacgatggccaaagacaagccgactctcgacattgagctcctaaagacagaagtcacaaaccccgcagtcctacgaaaactatgcatcgaggcaaagatcagcaacatcaccacagactcgaggtgccccacacagggcgaggcaactttagtggaagaacaagatgccaacttcgtctgtagacgcacatttgtcgacagggggtggggaaacggctgcggattattcggaaaaggcagtctgatcacgtgtgctaagttcaaatgtgtcacgaaactcgagggaaagatcgtccaatacgaaaatctaaagtatagtgttatcgtgacagtccacactggagatcagcatcaggtaggtaacgagtcgacagaacacggcaccacggcaacaattacgccgcaagcgcccaccacggaaatccagttaacggactacggagcactaaccctagactgcagtccgaggacgggcctagacttcaacgaaatggtacttctaacaatgaaggaaaagagctggcttgtccacaaacaatggttcctagacctcccgctcccttggacctcaggggcatcgacgtcgcaggaaacatggaatagacaagacctcctggtaacatttaaaacggcccacgctaagaaacaagaagtcgtagtgcttgggtcgcaagagggggccatgcacaccgcactcacaggagcgacggaaatacaaacttcggggactactacaatattcgcagggcacctaaaatgtcgtctgaagatggacaagttaacgctaaagggaatgagctacgtcatgtgcacaggctctttcaaactcgagaaggaggtagccgaaacccaacacggaacagtcttagttcagatcaagtatgaaggaacggacgcgccgtgtaagataccattttctactcaagatgaaaagggcgtaacgcaaaacggcagactaataacggccaatcccatagtaacggacaaggaaaaacccgtgaacatcgaagcagagccacccttcggcgaaagctacatcgtaatcggggccggggaaaaggctctcaaactctcttggtttaagaaaggatcatctatcggaaaaatgttcgaggcgacggcaagaggtgcccgaagaatggccatcctaggcgatacggcctgggactttgggtccatcggcggcgtattcacttcggtgggtaagctagttcaccaaatattcggaaccgcgtacggggtactcttcagcggcgttagctggaccatgaagataggtatcggcgtactcctcacttggctggggctcaacagccgaagtacttcattaagcatgacctgcatcgcggtcgggctcgtaacactctatctgggagtaatggtccaggccgactcaggatgcgtcataaactggaagggaagggaactgaagtgtggcagtggcatattcgtgacgaatgaggtgcatacgtggacggagcaatacaagttccaggctgatagcccgaagcgacttagtgcggccatcggaaaagcatgggaggaaggcgtctgcggcatccgaagcgcaacaagactcgagaacatcatgtggaaacaaatctcaaacgagctcaaccatatattactcgagaacgatatgaaattcacggtcgtcgtaggcgacgttgcaggaatactcgcgcaaggaaagaaaatgatccggccacagcctatggaacacaagtactcctggaaaagctggggcaaagccaagataataggggcagacgtacaaaatacaacattcattatcgacggcccaaacacaccggagtgccccgacgaccaacgtgcatggaatatatgggaagtcgaagactacggatttggaatcttcacgacaaacatatggctaaagttgagggatagctatacacaagtatgcgatcacagactcatgagtgccgccataaaggacagcaaagcagtccatgcagatatggggtactggatagagtccgaaaagaacgaaacctggaaacttgccagggcatctttcatcgaagtaaaaacatgcatctggcccaagagccacacgctctggagcaatggggtgctagagtccgagatgataataccaaaaatatatggcggacctatcagccagcacaactaccgccccggctactttacgcagacagcaggaccatggcacctaggaaaacttgagctggacttcaatctatgtgagggtactaccgtagtcgtagacgaacattgtgggaacagaggaccctccctacgcaccactaccgtaacgggcaagatcattcacgagtggtgttgcagatcatgcaccctcccacccctcagattccggggcgaggacgggtgctggtacggaatggaaatacggccggtgaaagagaaagaggagaacctagtaaagtcaatggtaagcgccggcagtggggaggtcgactcattctccttgggtctgctctgcataagcattatgatcgaggaggtcatgcgtagtcgatggagccgaaagatgctaatgaccgggacgctcgccgtattcttcctactaatcatgggacaactcacctggaacgacctgataagactctgcataatggtcggcgctaatgcctcagatagaatggggatgggcacgacctacctcgcgttaatggccactttcaaaatgcggcccatgttcgcagtcggactactattccgaagactgacgagcagagaggtcctactcctaacaataggactatccctagtagcatcagtagagctacccaactcgctagaagaacttggagacggactagcgatgggcatcatgatcctcaaactattgacagatttccaatcacatcagctgtgggcgaccctattaagcctaacattcataaaaacgacattcagtcttcattacgcatggaaaacaatggccatggtactcagcatagtcagtcttttccctctctgcctatccactacaagccagaaaacaacgtggctgcccgtgctcttaggatccctggggtgcaaacccctcaccatgttccttatcgccgagaacaagatttggggacggaaaagctggccgctaaatgagggcattatggcagtgggcatagtaagcatattattaagctcactacttaaaaacgacgtgcccctagcaggtccactaatagccggaggaatgctgatcgcatgctacgtaataagtggtagctcggctgacctaagcctcgagaaggccgcggaggtatcatgggaagaagaagccgaacactccggtgcaagccacaatatcctagtagaggtgcaagacgacggcacaatgaaaataaaggacgaggaacgcgatgacacactcacaatattactgaaggctaccctattggcggtgagcggggtctaccctttaagcatccccgccacactgttcgtgtggtacttctggcagaagaagaaacaaagatcgggcgtattgtgggacacgccctccccaccggaagtggaacgcgcggtgctagacgacggcatatatagaataatgcaaaggggcttgctcggacgatcccaagtgggcgtgggggtgttccaggaaaacgtattccacacaatgtggcatgtcacccgcggagcggtcttaatgtaccaagggaaaagattagagccatcatgggcaagcgtgaaaaaggacctgatatcgtacgggggcgggtggagactccaaggaagctggaatacaggggaggaggtacaagtgatcgccgtggagccgggaaagaaccctaagaacgttcagaccgcgccaggaacattcaaaaccccagaaggagaagtaggggcaatcgctctcgatttcaagccgggaaccagcggatcacccatagtcaaccgggaaggcaaaatagtagggttatacggcaacggcgtggttacgacatcgggcacctacgtaagtgcaatcgcgcaggcaaaagcgagccaggaaggtccccttcccgaaatcgaagacgaagtattccgcaaacgcaatcttacaataatggacctacacccaggaagcggcaagacccgacgataccttccggcaatagtgagagaagcgatcaagcgtaagctccgaaccctcattttagcgcccaccagagtggtagccagcgaaatggccgaagcccttaagggaatgcccataaggtaccagacaactgccgtcaaatcagaacacacaggtaaagaaattgtcgatctaatgtgccacgcgacattcacgatgcgtctactctctccagtgagggtgcccaactataacatgataatcatggacgaagcacatttcacagaccccagcagcatcgcagcgaggggatacatatcgacccgtgtcgggatgggagaggcagcagcgatattcatgacagcaacaccacccggttcagttgaggcgttcccgcaaagtaacgccgtcattcaggacgaggaaagggacattccagaacgatcttggaacagcgggtatgagtggatcacagatttcccaggcaagacggtatggtttgtccccagtatcaagagcggcaacgacatagccaattgtctcaggaagaatggcaagcgagtcatccagctctcgagaaaaacattcgacacggaataccagaaaaccaaaaacaacgactgggactacgttgtaaccacggacatttccgaaatgggagcaaacttccgcgcggaccgcgtaatagatccgaggagatgtctcaaaccagtcatcctcaaggatgggcctgagagagtcatcctagcggggcccatgccagtaacagtagcgtccgccgcgcagagacgcggcagggtcggccgaaaccataataaggaaggagaccaatacatctatatgggccaaccactcaacaacgatgaggaccatgcgcactggacggaggccaagatgctactagacaacatcaataccccggagggaatcatccccgccttgttcgagcccgaaagagagaaaagcgcagccatagacggcgaataccggctacgcggcgaagcgagaaaaacatttgtagaactgatgcgccgcggagatctgcctgtgtggctctcatacaaagttgcgagtgaaggtttccaatactcagacagaaggtggtgcttcgacggtgaacgcaacaatcaagtgcttgaggaaaacatggacgtagaaatctggaccaaagaaggggagaggaagaaactccggccccgatggctagacgccagaacctacagtgaccccctagcactaagggagttcaaggaatttgctgctggccggcggtccgtcagcggggacttgatactagaaatagggaagctaccacaacacctgacgcagcgggcacagaacgccttggacaacttagtcatgctgcacaacagtgaacaaggaggcagggcgtaccgacacgccatggaagaactcccagacacaattgaaacgctaatgcttctcgccctaatagcggtcttgacgggcggcgtgacactgttcttcctgagtggacgtggactcggaaaaacgtctatcggactactatgcgtcatggcctccagcgtgctactatggatggcatcagtcgaaccccactggatagccgcatcaatcatactagagtttttcttaatggtgctgctgatccccgaaccggaccgtcagcgcacaccacaagataaccaactagcatacgtcgtaatcggcctattgttcatgatactgacagtcgcagcgaacgagatgggcctcctcgaaacaactaagaaagacttgggcatcggacatgtcgcagtggagaatcaccaccatgcagcgatgctggacgtggatctgcatcccgcctcggcttggacattatacgccgtagcgaccaccataataacgccaatgatgcgacacaccatagagaacacaacagcaaacatcagcctgacagcgattgcgaaccaagccgcaatcctaatggggcttgacaagggatggccgatatcgaagatggacattggggtcccattactagcactagggtgttacagtcaggtgaacccattaacgttgacagcagccgtccttatgctggttgcacactacgcgataatagggccagggctccaggctaaagcgacaagagaagcgcaaaagcgcacagcggcaggtataatgaaaaatccaacggtggacgggatcgtcgcaatagatctagaccccgtggtttacgacgcaaagttcgaaaagcaacttgggcaaataatgctactcatcctgtgcacctcccaaatcctcctaatgaggactacgtgggcactttgcgaaagcataacactggcaaccggcccactcacaacgttgtgggagggcagtcccggaaaattctggaacactactatcgccgtcagcatggccaatatatttagaggcagttacctggcgggcgcggggctcgcattcagtctaatgaagtccctaggaggagggaggcgcgggacgggagcccaaggagagacactgggagaaaaatggaaacgccaactgaaccaactctctaaatctgagttcaacacgtacaaacggtccgggataatggaggtggaccgctccgaagcgaaggaaggcctaaaaagaggggagacaacaaaacacgccgtctctcgaggcacagcgaaactacggtggttcgtggaaagaaacctggtaaagcccgagggaaaagtcatcgacctcgggtgcgggcgcggagggtggagctactactgtgctggcctaaagaaagtaacggaagtaaagggatatactaaaggcgggccgggacacgaggaacccataccgatggcgacctacgggtggaatctggtaaaactgcactctggcaaagacgtgttctttataccacctgagaagtgcgatacgctcttgtgcgacataggcgagtctagccctaaccccaccatcgaagagggccgaacgctccgagttcttaaaatggtcgagccctggctgcgtggtaaccagttttgcataaaaattttgaacccatacatgccgtcagtagttgaaactctcgaccaaatgcaacgcaaacatgggggtatgctcgtgaggaaccccctatcgcgcaatagcacgcacgagatgtactgggtatcgtgcggaacaggaaacatcgtttcagcagtgaacatgacgtcaagaatgctcctaaacagatttaccatggcccacagaaagccgacatatgaacgagacgtcgatctgggcgcaggcacaagacacgtagcggtggaaccagaggtcgccaacctcgacataatcggccaacggatcgaaaacataaaacacgaacacaagtcgacatggcattacgatgaagacaacccttataaaacatgggcgtaccacgggtcatacgaagttaaacccagtggctcggcatccagtatggtcaacggagtagtaaaattgctcaccaagccatgggatgtcattccaatggtcacacaaattgctatgacggacactactccattcgggcaacagagggttttcaaggaaaaagtagacaccaggacacccaaagccaagagaggaaccactcaaataatggaagtcaccgcccggtggctgtggggcttcctatcgcgaaataagaaaccaagaatatgtacccgcgaagagttcacacgaaaggtgcgatcgaatgccgcaataggggccgttttcgtagacgaaaaccagtggaatagcgctaaagaagcagttgaagacgaacgtttctgggacctagtgcaccgtgaaagagagttacacaagcaggggaaatgcgcaacctgcgtatacaacatgatggggaaacgtgagaagaaacttggtgagttcggcaaagctaaaggaagccgagcgatctggtacatgtggttaggtgcgcggtttctcgagttcgaagcactaggattcatgaacgaagaccattggttctcgcgagagaactctctaagtggggtcgagggtgaaggactccataaattgggctacattttaagagatatctcaaagatacccggcggcaatatgtacgcggacgatacggcagggtgggacacaagaatcacagaggatgatctccagaacgaagccaagataacagacattatggaacccgaacatgctctactcgccaaagccatctttaagctgacctaccagaataaagtcgtgagagttcaacgtccggccaaaaatggcacagtgatggatgtgatctcccgacgggaccaacggggaagcgggcaagttggcacatatgggcttaacacattcacaaacatggaagcgcagctaatacggcaaatggaatcggaggggatatttagcccaagtgaactggagaccccgaacctagcggagcgcgtgttagattggctcgaaaagtacggagttgagcgcctcaagagaatggccataagcggagacgactgtgtcgtcaaacccatagacgatagattcgctacggcgctgacagcgctcaacgatatgggcaaagtacgaaaggacattccgcagtgggagccaagcaaaggatggaacgattggcagcaagtacccttctgtagtcaccattttcaccaactcatcatgaaggacgggcgagaaatcgtggttccctgtagaaaccaagacgaactggtcggtcgtgccagggtaagtcaaggcgcgggatggtccttacgtgaaacggcatgcttgggcaaatcatacgctcagatgtggcaacttatgtatttccaccgtcgcgacctcaggctcgccgcgaacgcgatatgcagcgccgtgccggtcgactgggtgccaacttcccgcacaacatggagtatccacgcgcatcaccaatggatgacaaccgaggacatgttatccgtgtggaaccgggtctggatagaagaaaatccctggatggaggacaaaacacatattagtagctgggaagacgttccgtatctagggaaacgagaagatcagtggtgcggatcactcataggccttaccgcccgagcgacctgggcaaccaacatacaggtcgctatcaatcaagtaagacgcctgattggaaacgagaactatttagattacatgaccagcatgaaacgctttaagaacgaatcggatcctgaaggggcattgtggtag

SEQ ID NO: 24688 - RNA, 9879 nt, synthetic construct
  misc_feature 1..9879: note = derived and/or modified CDS sequence (opt11) from DENV-1__KC762637__SS-prME
  source 1..9879: mol_type = other RNA
tcagtgacaatgctgctcatgctgatgcccacagccctggcgttccacctcaccacccggggcggggagccccacatgatcgtgagcaaacaggaacggggcaagtcactgctgttcaagacctctgccggggtaaacatgtgcacgctcatagccatggacctgggcgagctgtgcgaggacacgctaacctacaagtgtccgcgcatcaccgaagccgagcccgacgatgtggactgctggtgcaacgccaccgacacgtgggtgacctacggcacctgtagccagacgggcgagcaccggcgcgacaagaggtccgtggccctggcgccccacgtgggactggggctggagacgcgcaccgagacttggatgtcttccgagggcgcctggaagcaaatccagcgggtcgagacctgggcactgagacacccgggattcacggtgatcgccctgttcctcgcgcacgccattggcacctcgatcacacagaaggggatcatattcattctgttgatgctcgtcaccccgtccatggccatgcggtgcgtcggcatcggcagccgcgatttcgtggagggactgtccggggccacgtgggttgacgtagtgctggagcacgggagctgcgtgaccaccatggccaaggacaagcccaccctcgatatagagctgctgaagacagaggtcaccaaccccgcggtgctccggaagctgtgcatcgaagccaagatctccaacaccaccacagatagccggtgcccgacccagggcgaagccaccctggtggaggagcaggacgcaaacttcgtctgccggaggaccttcgtcgaccggggatgggggaacggctgcgggctgttcggcaaagggtccctgatcacgtgcgccaagttcaagtgcgtaacgaagctggagggcaagatagtccaatacgagaaccttaaatacagcgtgatcgtcaccgtacacaccggcgaccagcaccaagtggggaacgagtccacggaacacggcaccaccgctaccatcacgccccaggccccgacgaccgagatccaactgacggattacggggccctgaccctcgactgtagcccacgcacggggctggacttcaacgagatggtcctgctcaccatgaaagagaagtcctggctggtgcacaagcagtggttcctggacctccccctgccatggaccagtggggcaagcacctcgcaggagacgtggaacaggcaggacctgctcgtgaccttcaagaccgcccacgcgaaaaagcaggaggtcgtggtgctgggctcccaggagggcgccatgcacacggccctgacgggtgccaccgagatccagacctccgggaccacgaccatcttcgccggacacctcaagtgccgcttgaagatggacaagcttacactgaagggcatgagctacgtcatgtgtacggggtccttcaagttagagaaggaggttgccgagacgcagcacggcacggttctggtccaaatcaagtacgagggcaccgacgccccctgcaagatccccttctcgacgcaagacgagaaaggggtgacccagaacggacggctgataaccgccaacccgatcgttaccgacaaggagaaacccgtcaacatagaggccgagccgcccttcggggagtcctacatagtcatcggcgccggggagaaggccctcaaactgagctggttcaagaaggggtccagcatcggcaagatgtttgaagccaccgcccgcggggcccggagaatggcgatcctgggcgacacggcctgggacttcggatctataggcggcgttttcacaagcgtcggtaagctcgtgcaccagatctttggcaccgcttatggggtgctgttctccggcgtgtcatggaccatgaagattgggatcggggtgttgctcacgtggctgggactgaactcccgctctacctccctcagcatgacctgtatcgcggtgggactggtcaccctctacctcggcgttatggtgcaggccgacagcgggtgcgtcatcaactggaagggccgggagctgaagtgtgggtcaggtatattcgtgacgaacgaggtgcacacgtggaccgaacaatacaagttccaggcggacagcccgaagcgcctgtcagcggccattggcaaggcgtgggaggagggggtctgcggcatccggagcgcaacccggctcgagaacatcatgtggaagcagatctctaacgagctgaaccatatcctgctcgagaacgacatgaagttcaccgtggtggtcggggatgtggcgggcatcctagcacaggggaagaaaatgatccgcccccagcccatggagcacaagtacagttggaagtcctggggcaaggccaagatcataggcgccgacgtgcagaacacgaccttcatcatcgacgggcccaacaccccggagtgccccgacgaccaaagggcctggaacatctgggaggtcgaggactacggcttcgggatctttaccacgaacatctggctgaagttacgggactcgtacacccaggtgtgcgaccaccgcctgatgagtgccgccattaaagatagcaaagcagtgcacgcagacatggggtattggatcgagagtgagaagaatgagacttggaagctggcgcgggcgagtttcatagaggtcaagacctgcatctggcccaagtcccacactctctggagcaacggcgtgctggagtcggagatgatcatacctaagatctacgggggccccatctcgcaacacaactaccgccccgggtacttcacacagaccgccggaccctggcacctagggaagctcgagctggatttcgacctctgcgagggaaccacggttgtagtggacgagcactgcggaaaccgggggcccagtctgcgcaccaccaccgtgacgggcaagatcatccacgagtggtgttgccggagctgcaccctgccgcccctgcgcttcagaggtgaggacggctgctggtacgggatggagatccgccccgtcaaggagaaggaggagaacctcgttaagtccatggtcagcgcgggtagcggagaggtagactcattcagcctggggctcttatgcatctccatcatgatcgaagaggtgatgcgcagccgctggtcccggaagatgttgatgaccggcacgctggccgtgttctttctcctgatcatggggcagctcacttggaacgacctcatacgtctgtgtataatggtcggcgcgaatgcgagcgaccggatggggatgggcaccacctacttggccctcatggccaccttcaagatgcggccgatgttcgccgtgggcctgttattccgccggctcacgtcccgcgaggtgttactgctcactatcgggctgagcctggtcgcgtccgtggagctaccgaacagcctagaggagttaggcgatgggttagccatgggaattatgatcctgaaactgctcacagatttccagtcccaccagctgtgggccaccctgctcagcctgacgttcatcaagaccaccttctccctgcactacgcgtggaaaacgatggcgatggtgctcagcatcgtgtccctcttcccactgtgtcttagcacgacctcacaaaagactacctggctgccagtgctgctcggaagcctggggtgtaagcccctgacgatgttcctcatcgccgagaacaagatctggggccgtaagtcctggcccctgaatgagggtataatggctgtaggcatcgtctcgatcctgctcagctccctgcttaaaaatgatgtcccgctcgccgggcccctgattgccggcggtatgctgatcgcgtgttacgtaatctccgggtccagcgccgacctctccttagagaaggctgccgaagtgagctgggaggaggaggccgaacactccggggccagccacaatatcctggtagaggttcaggatgacgggaccatgaagataaaggacgaggagcgcgatgacactttgaccatcctgttaaaggccaccctcttggccgtgtccggcgtgtaccccctgagcatccccgctaccctcttcgtatggtacttctggcagaaaaaaaaacagcggtccggcgtactttgggacaccccctctccgccagaggtggagcgcgccgttctggacgacggcatttaccggatcatgcagcgcggcttgctcgggcgctcccaggtgggggtgggggtctttcaagagaacgtgttccacaccatgtggcacgtgacccgcggagcggtcctgatgtaccaagggaagcggctggagcccagctgggcctccgtgaagaaggacctcatctcttacggcggcggatggcggctgcagggatcctggaacaccggggaggaggtccaggtgatcgcagtggaacccggtaagaatcccaagaacgtgcagaccgcccccgggacctttaagacccccgagggtgaggtcggtgccatcgcgctggacttcaagcccgggacgagcggctcccccatcgtgaaccgggagggcaagatagttggcctctacggaaacggggtcgtgaccacctcgggcacctacgtgagcgccatagcccaggccaaagcttcccaagaggggccactgcccgagattgaggacgaggtcttccgcaagcggaacctgacgatcatggacctccaccccggcagcggtaagacccggcggtacctgccggctatcgtgcgcgaggcgatcaagaggaagctgcgcaccctcatcctggccccgacacgtgtggtcgcctccgagatggccgaggcactgaagggcatgcccatccgataccagacgaccgccgtcaagagcgagcacaccggcaaggagatcgtcgacctcatgtgccacgccacctttacgatgcgcctgctttcccccgtccgggtgccgaattacaacatgatcataatggatgaggcccactttaccgacccaagctccatcgctgcacgcgggtacatcagcaccagagttggcatgggggaggccgctgccatctttatgaccgcgacgccacccggctccgtcgaggccttcccgcagagcaatgccgtgatccaggatgaggagcgcgacatcccagagcggtcctggaacagcgggtacgagtggatcaccgattttcccggcaaaaccgtgtggttcgtcccctccatcaagtccggcaacgacatcgccaactgcttgcgcaaaaacgggaagcgggtcatccagctgtcccgcaagactttcgacacggagtaccagaagaccaagaacaacgactgggactatgtggtcaccaccgatatcagcgaaatgggcgcaaacttccgggcagaccgcgtgatcgacccgcggaggtgcctaaagcccgtgatcttaaaggatggacccgagcgtgtcatccttgccggaccgatgccggtgacggtcgcctccgccgcgcagcgccgggggagagtgggccggaaccacaacaaggaaggcgaccagtacatttacatgggtcagccactgaacaacgacgaggaccacgcccactggaccgaagccaagatgctcctagacaacatcaacacccccgagggcataatcccggccctgttcgagcctgagcgcgagaagtccgccgcgattgacggggagtaccgcctccggggtgaggcccgcaaaacctttgttgagctgatgcggcgcggggacctgcccgtctggttaagctacaaggtggcgtccgagggcttccagtactctgaccggcgctggtgcttcgacggcgagcggaacaaccaggtgctggaagagaacatggatgtagagatctggacgaaggaaggggaacgcaagaagctgcggccccgctggctcgacgcgcggacctactccgaccccctggccttgcgcgagtttaaagagttcgcggcgggtcggcgcagcgtttccggggacctgatcctggaaatcggaaagctgccgcagcatctcacccaacgggcacagaacgccctagacaacctggtgatgttgcacaactctgagcagggcgggcgcgcgtaccggcacgccatggaggagctacctgacacgatcgagacgctgatgttacttgccctgatcgccgtcctcactggtggggtgacgctattctttctgtccggcagagggctcggcaaaaccagcatcggcctactatgcgtgatggcctcctctgtgctcttgtggatggcgagcgtcgagccccactggatcgcggcaagcatcatcctggaattcttcctcatggttctgctgatccccgagccagaccggcagcgcactcctcaggataatcagctcgcctacgtcgtgatcggtctgctgtttatgatacttaccgtcgccgcgaacgagatgggcctgctggagaccaccaagaaggatcttgggatcggccacgtcgccgtggagaaccaccaccacgccgccatgctggacgtggacttacacccagcctccgcgtggactttatatgccgtcgctacgaccatcatcaccccgatgatgcgacacaccatcgagaacacgaccgccaacataagcctaacggctatcgcgaaccaggccgccatcctgatgggtctcgacaaagggtggcccatctccaagatggacatcggcgtgcccctgctggccctagggtgttacagccaggtgaaccccctgaccctgactgcggccgtcctcatgctggtggcccactatgcgatcatcggcccggggctgcaggccaaggcgacccgggaggcccagaagcggacagccgccgggatcatgaagaatcccacagtggacgggatagttgccatcgatttagaccccgtggtgtacgacgcgaagttcgagaagcagctgggccagatcatgctgttaatcctgtgcacgtcccagatcctcctcatgcggaccacctgggccctgtgtgagagcattacactggcaacgggccccttgaccaccttatgggagggttccccgggcaaattctggaacaccacgatcgccgtaagcatggccaacatcttccgcgggtcgtacctggcgggcgccggcctcgcattctccctgatgaagtccttggggggcggccgccgcggaaccggggcccaaggcgagaccctcggggagaagtggaagaggcagctgaaccagctgtccaagtcagagttcaacacctacaagcgcagtgggatcatggaggtggaccggtctgaggcgaaggaggggctcaagagaggggagacgaccaaacacgccgtgagccggggcaccgcgaagctgcgctggttcgtcgagcggaacctggtgaaacccgaagggaaggtgatagaccttggctgcggccggggtggctggagctattattgcgccggtcttaagaaggtaaccgaagtgaaaggctacacgaagggcggacccggccacgaggaacccatccctatggccacatacggatggaacctggtaaagctgcactccggcaaagacgtgttcttcatcccgcccgagaagtgcgacacgctcctgtgcgatatcggggagagctctcccaatccgaccatcgaggaaggccggacgctgcgagtcctcaagatggtggagccctggctgcgaggaaaccagttctgcatcaaaattctgaacccctacatgccaagcgtcgtggagaccctcgagcagatgcagcgcaaacacggcggcatgcttgtacggaatcccctgtcacggaatagcactcacgagatgtattgggtgtcctgtgggaccggaaatatcgtaagcgccgtgaatatgacgtcccggatgctcttaaacagattcacgatggcccacagaaagccgacctacgagcgggatgtcgacctgggcgccggcactagacacgtggctgtggagccggaggtcgccaacttggatatcatcggccagcggatagagaacatcaagcacgaacacaagagcacctggcactacgacgaagataacccctacaagacgtgggcataccacgggtcctacgaggtgaaaccgagtggttccgccagcagcatggtcaacggggtagttaagctgctgaccaagccctgggacgtgatccccatggtgacccagatcgccatgaccgatacgacaccgttcggccagcaacgggtgttcaaggagaaagtcgacaccaggactcctaaggccaagcgagggacgacacagattatggaagtgaccgcccgctggctctggggcttcctgtcccgaaacaagaagccccggatctgcacccgcgaggagtttacgcggaaggtccggagcaacgcggccatcggcgccgtcttcgtggacgagaaccaatggaacagcgccaaggaggcggtggaggatgagcgattctgggacctggtgcaccgcgagcgggagctccacaagcaggggaagtgtgcgacctgcgtgtacaacatgatgggcaaacgcgagaagaaactgggggagttcggcaaggccaaggggagccgggccatctggtacatgtggcttggcgcgcggttcctcgagttcgaggcgctgggcttcatgaatgaggatcactggttctcccgggaaaacagcctgtccggggtggagggcgaggggctccacaagctggggtacatcctgagggacatcagcaagatccctgggggaaatatgtatgcggacgacaccgccggctgggacacccggatcacggaggacgacctccagaacgaggccaaaatcaccgatatcatggaacctgagcacgccctgctggcgaaggctatcttcaagctcacctaccagaacaaagtggtgcgcgtgcaacgccccgctaagaacgggaccgtaatggacgtgatatcccgtcgcgaccagcggggcagcggccaggtggggacgtacggcctgaacaccttcaccaacatggaggcccagcttatacgacagatggagtcggaaggcatcttttctccctccgagctcgagacccccaacctggcagagcgggttctggactggctcgagaaatacggtgttgagcgcctgaaacggatggcgatcagcggggacgactgcgtggtcaaaccaattgacgaccgcttcgccacggccctgaccgccttgaacgacatgggcaaggtgcggaaagacattcctcagtgggagccctcaaaggggtggaacgactggcagcaagttcccttttgcagccaccatttccaccagctaataatgaaggacggccgcgaaatcgtcgtgccttgccggaatcaggacgagttggtgggacgcgcccgggtctcccagggggccggctggagcctccgcgaaaccgcctgcctcggcaagagttacgcccagatgtggcagttaatgtactttcaccggcgagatctccggctggccgcgaacgccatctgctccgcagtgcctgtggattgggttcccaccagtcgcacgacctggtccatccacgcccatcatcaatggatgaccaccgaagacatgctgagcgtatggaaccgcgtgtggatcgaagagaacccctggatggaggacaagacgcacatctcctcctgggaggacgttccgtacttgggcaagagggaggaccagtggtgcgggtccttgatcggactgaccgcccgcgccacctgggcaacaaatatccaggtggctattaatcaggtgcggcgcctcatcggcaacgagaactacctggattacatgaccagtatgaaacggttcaaaaatgagtccgaccccgagggagccctttggtga

SEQ ID NO: 24689 - RNA, 9879 nt, synthetic construct
  misc_feature 1..9879: note = derived and/or modified CDS sequence (opt11) from DENV-1__KC762620__SS-prME
  source 1..9879: mol_type = other RNA
tcggtcaccatgctgtttatgctcctgcccactgccctggcgttccacctcaccacacgcggcggggagccccatatgatcgtgtccaaacaggagcggggcaagagcttgttatttaagacctccgccggggtgaacatgtgtaccctcattgccatggacttgggcgagctgtgtgaggacacgatgacctacaagtgcccccgcataacagagaccgagcccgatgacgtggactgctggtgcaacgccacggagacgtgggtcacctacggtacgtgcagccaaacgggggagcaccggcgcgacaaacggtccgtggctctcgcgccccacgtgggcctggggctagagacccgcacggagacctggatgagctcggagggggcctggaagcagatccagaaggtggagacgtgggccctacggcatcccgggttcaccgtgatagccctgttcctggcccacgcgatcggcacatcgatcacccagaagggtatcatcttcatcctactgatgctggtaacgccctccatggccatgcggtgcgtaggaatcggaaatcgggactttgtagaagggctgagcggcgctacctgggtggacgttgtattagagcacgggtcctgcgtgaccaccatggccaaggacaaacccaccctcgacatcgagctcctgaagaccgaggtcaccaaccccgcagtactgcgtaaactgtgcatcgaagctaagatctcaaacacgacgaccgactcccgttgtccgacgcagggcgaggctacactggtggaagagcaggacacgaatttcgtgtgccgccggacgtttgtggatcgcggctgggggaacggctgcgggctgttcggcaaggggagtctcatcacgtgcgctaagttcaagtgcgtaactaagctggagggcaagatcgtccagtacgaaaacctcaagtactccgtcatagtgacggtccataccggcgatcagcaccaggtggggaacgagaccatcgagcacggcaccaccgccaccatcacgccccaggcccccaccagcgagatccagctcaccgactacggtgcgctgaccctggactgcagcccacggaccggcctcgacttcaacgagatggtcctgctgaccatgaaggagaagtcctggctcgtgcacaagcagtggttcttagacctcccgctcccatggacctccggggcctcgacgagccaggagacctggaacagacaggacctccttgtgaccttcaagacggcccatgcaaagaagcaagaggtcgtggtgctcggatcccaggagggtgccatgcacacagccctgacgggggcgaccgaaatccagacgagcggcacgaccacaattttcgccgggcacctgaagtgccggcttaagatggataaactgacactgaagggcgtcagttacgtaatgtgcactgggagctttaaactcgagaaggaggtggcggagacacagcacggcacagtactggtccaggtgaaatacgaggggaccgacgcaccctgcaagatccccttctccagccaagacgaacgcggcgttattcagaacggccggctgatcacggcgaacccgatcgtaaccgacaaagagaagcccgtgaatatcgaggcggaaccgcccttcggtgagagttacatcgtcgtgggagcaggcgagaaggccctaaagctctcatggtttaagaaggggtcgagtatcggaaaaatgttcgaggcgacggcccgcggggccagacggatggccatcctgggcgacaccgcttgggacttcgggtccatcggcggcgttttcacttccgtcgggaagttggtgcatcagatttttggcactgcgtacggagtgctgttcagtggcgtctcttggaccatgaagatcgggatcggcatactgctgacatggctcggcctaaactcccgaaacacgagcctttcaatgacttgcatcgctgtggggatggtgaccctgtacctgggcgtcatggtgcaagcagatagcggatgtgtgatcaactggaagggccgggagctgaagtgcgggtccggcattttcgtcaccaacgaggtgcacacatggaccgagcagtacaagtttcaggctgacagccccaagcgcctcagtgccgcgatcggcaaggcttgggaggagggggtatgcggtatccggtccgccaccagactggagaacattatgtggaagcagatcagcaatgaactgaaccacatcctcctggagaacgacatgaagttcaccgtggtggtgggggacgtctccggcatcctggcccaaggaaagaagatgatccggccccagcccatggagcataagtacagctggaagtcctggggcaaggcaaagatcattggagcggacgtgcaaaacaccacgttcatcatcgacgggccgaacaccccggagtgccccgacaatcagcgagcctggaatatctgggaagtggaggactatgggtttggggtcttcacaacaaacatttggctcaagctgcgagacagttatactcaggtttgcgaccaccgattaatgtcagccgccatcaaggatagcaaagcggtgcacgccgacatgggctattggatcgagtccgagaagaacgagacttggaagctcgaacgggccagcttcattgaggtcaaaacctgcatctggcccagatcgcataccctgtggagcaacggtgtgctggagtccgagatgatcattcccaagacgtacgggggcccggtcagccagcacaactaccgcccgggttacttcacccagaccgctggcccttggcacctggggaagctagagctggatttcgacctctgcgagggcaccacggtcgtggtggacgagaactgcgggaaccgcgggccgtccttgcgtaccacgaccgtaaccggcaagataatccacgagtggtgctgccgcagctgcactctgcctcccttgcggttcaagggtgaagatggctgttggtacgggatggagatccgccccgtcaaggagaaggaggagaacctcgtgaaatccatggtcagtgccgggtcgggagaggtggactcctttagtctgggacttctgtgcatcagtattatgattgaagaggtgatgcggagccgctggtccggcaaaatgctgatgaccgggaccctcgcggttttcctgctgctcacaatgggccagctgacctggaacgacctgatccgactatgcatcatggtcggggccaacgccagtgacatgatgggcatgggaaccacctacctggccctgatggccacgtttcgtatgaggccaatgttcgcggtcgggcttctgttccggcgcctgacctcccgggaggtgctattactgacggtgggtctaagcctggccgcgtctgtcgagctgccaaacagcctcgaggagctgggggacggcctggcaatgggcatcatgatgctcaagctgctaacggacttccagtcccaccagctctgggccacgctcctgagcttaacctttgtgaagaccaccttctctcttcattacgcgtggaagacgatggctatgatccttagcattgtgtccctctttcccctttgcttgagcactacctcccagaaaaccacatggctccccgttctgctaggatccctcggctgcaagccactgaccatgctgctcattaccgagaacaagatctgggggcgccgttcctggcccatcaacgagggcataatggccattgggatcgtctcgatcctcctgagctcactcctgaagaacgacgtgcccttagcggggccactcatcgctggcgggatgctgattgcctgctatgtgatctctggcagcagcgcggacctgtccttagagaaagccgccgaggtgagctgggaagacgaggcggagcactccggagccagccacaacattctggtggaggtccaggatgacggcaccatgaagattaaagacgaggagcgcgacgacacactgacgattttactcaaagccaccctgcttgccatctccggggtgtacccgatgagcatccccgccaccctgttcgtttggtacttctggcagaaaaagaagcaacggtccggcgtcttatgggatacacccagcccacccgaggtggagcgcgcggtacttgacgatggtatataccggatcctacagcgggggttgctgggcagatcccaggtcggtgtaggcgtgttccaggagggggtttttcatacgatgtggcacgtgaccaggggcgccgtgctcatgtaccagggcaagcggctggaaccctcatgggcctccgtcaaaaaggacttaatcagctacggaggtggttggcgcttccaaggctcctggaacacaggggaggaggtccaggttatagccgtcgagcctggcaaaaatccgaaaaatgtccagaccacgcccgggaccttcaagaccagcgagggggaagtgggggccatcgcgctggacttcaaacccgggacgagcggcagccctatcgttaaccgggagggcaaaattgtggggttatacggcaacggggtcgtcacgacaagcggcacgtacgtatccgctatcgcccaggccaaagcatctcaggagggccccttgccggagatcgaagacgaggtgtttagaaagaggaacttgactatcatggacttgcacccggggtctggaaagacacgccggtatttacccgcgatcctaagggaggccatcaaacggaaacttcgcaccctggtcctcgccccgactcgcgtcgtggccagcgagatggcggaggcactcaaagggatgcctatcagataccagacaacggctgtcaaatccgaacataccgggaaggagatagtggatctgatgtgccacgccacctttacgatgcgcttgttatcccccgtgcgggtccctaactacaacatgatcatcatggacgaggcccacttcacagacccagcgagcatcgccgcccgcgggtacatcagcacgcgggtgggaatgggggaagccgccgcgatctttatgaccgccacgccaccaggctccgttgaggccttcccccagagcaacgcagttatccaggacgaagaacgcgatatccccgagcggtcctggaacagcggctatgactggataacggacttccccgggaaaacggtgtggtttgtaccctccatcaaaagtgggaacgacatcgcgaattgcctgaggaaaaacgggaagagggtagtgcagttatcccgcaagacctttgacacggagtaccagaagacgaagaataacgactgggactacgtggtgaccaccgacatctccgagatgggagccaactttcgggcagaccgcgttatcgacccccggagatgcctgaagcccgtcatactgaaggacggacccgagagggtgatcctcgccggtcccatgcccgtaacagtcgcctccgcagcccagcggcggggccgcatcggtcggaacagcaacaaggagggggaccagtacgtgtacatggggcaacccttaaacaatgacgaagatcacgcccactggacggaggccaagatgctgctcgacaatatcaacacaccagaggggatcatccctgccctgtttgagcccgagagggaaaagtcagcggccatcgacggggagtaccggctgaggggcgaagctcgaaagactttcgtggagttaatgcggcgcggcgaccttccggtctggctgagctacaaggtggctagcgagggtttccagtactccgatcggaggtggtgcttcgatggcgagcgcaataatcaagtcctcgaagagaatatggatgtagagatctggaccaaggagggggagcgcaaaaaactgcggcccaggtggctggacgctcggacgtacagcgaccccctcgctctccgcgagttcaaagagttcgcggccgggcggcgctccgttagcggagacctgatcctcgagataggaaaactgccccagcacctgacacagaaagcccagaacgccctcgacaacctggtgatgttgcacaactccgagcaaggcgggaaggcgtaccggcacgcgatggaggagctccccgacaccatcgaaaccctgatgctgctcgccttaatcgcagtcctgacaggaggtgttaccctcttcttcttgagcggccgcggcttgggaaagacctccatcggcttactgtgtgttatggcgtcttccgctctgctctggatggctagcgttgaaccccactggatagccgcctccattatcctggagttcttcctgatggtgctcttaatccccgagccagaccggcagcgcactccccaggacaatcagctggcttatgtggtcatcgggttactgttcatgatcttgacggttgccgccaatgaaatgggcctgctcgagacgaccaagaaggatctggggatcggacacgccgcggcagagaaccaccaccacgccgccatgctcgacgttgacctgcacccggccagcgcctggactctgtacgctgtggccaccacgattataacgcccatgatgcgtcacaccatcgaaaataccacggccaacatctcgctcacagccatagccaatcaagcggcaatactgatgggcctagataaggggtggcccatcagcaagatggacatcggcgtcccactcctggccctgggctgctactcccaagtgaaccccctcaccttgacagctgcggttctgatgttggtggcccactacgccatcattgggcccgggctacaggctaaggcaacgcgcgaagcacagaagcggaccgccgccggaattatgaagaatccgactgtggacggcatcgtagcaatagacctggacccggttgtatacgacgccaagttcgagaaacagctcgggcaaattatgctgctgatcctctgcaccagccagatcttactgatgcgcacgacctgggcactctgcgaatccatcaccctggccaccggccccctgacaacactctgggaggggagccccggcaagttctggaacaccacgatcgcggtatccatggccaacatttttcgcgggagctacctcgctggggcgggcttagccttcagcctcatgaaatccctcggtggcgggcggcgcgggaccggcgcgcagggggagaccctgggcgagaagtggaagcggcagctcaaccagcttagtaagagtgagtttaacatctacaagcgctcggggatcatggaggtcgaccggtccgaggccaaagagggcctgaaacgcggggagaccacaaagcacgcggtgagccgcggcacggcaaagctccgctggttcgttgagcggaacctggtgaagccggaagggaaagtgattgacctgggatgcgggcgcggaggttggtcctactactgtgccgggttaaagaaagtgactgaggtgaagggatacaccaagggagggcccggccacgaagagccagtgccgatggccacatacgggtggaaccttgtcaaactgcactccggcaaggacgtattcttcacaccacccgagaaatgcgacactttactctgtgacatcggggaatccagccccaaccccaccattgaagagggccgaactctgcgtgtgctgaagatggtggagccgtggctccgcggcaaccagttctgcatcaagatcctgaacccctatatgccctccgtggtggagaccctagagcagatgcagcgcaaacatggcggcatgctcgtccgcaaccccctgagccgaaactccacacacgagatgtactgggtgtcatgtggtacaggtaacatcgtctcagccgtcaacatgaccagccggatgctattaaaccgattcaccatggcacacagaaagccaacgtacgagaaggatgtggacctgggcgccgggacccgccacgtggccgtcgagccggaggtggcaaacctggacatcatcgggcagcgcattgaaaacataaaaaacgaacataagtcgacctggcactacgacgaagacaatccatacaagacctgggcctatcacgggagctacgaggtcaagccgtccggctcggcgtctagcatggtgaatggagtggtccgacttctgaccaaaccatgggatgtaatccctatggttacccagatcgccatgacagacaccacgcccttcgggcagcagcgtgtcttcaaagagaaggtagacacccggacccccaaggctaagcgcggcaccgcccagataatggaagtgacggcaaagtggctgtgggggtttcttagccggaataagaagccgcgcatatgcacgcgggaagagttcacccgcaaggtccggtccaacgcggccatcggcgccgtgttcgtagatgaaaaccagtggaattccgctaaggaggcggtcgaggacgaacgcttctgggacttggtacaccgggaacgtgaattgcacaagcaagggaagtgcgccacgtgcgtgtacaacatgatggggaagcgggagaagaagttgggtgagttcggtaaggccaagggttcccgcgccatttggtacatgtggctgggggccagattcctcgagttcgaggcgctgggcttcatgaatgaggaccattggttcagcagggagaactccttgtcaggggtcgaaggcgaagggttacataagctcggttacatactgcgggatatctccaagatccccggcgggaacctgtatgccgacgacactgccggctgggatacgcgtatcaccgaagacgacctccagaacgaagccaagataaccgatatcatggagccagagcacgccctattggcgacgagcatcttcaagcttacctatcagaacaaggtggtgcgggtccaacggccggccaagaacggtacggtgatggacgtgatatcccggcgcgaccagcgcggcagcggccaggtcgggacctacgggctgaacacgtttacaaacatggaagcccagctgatccggcagatggagagtgaaggaatctttagccccagcgaactcgagactcccaatctggccaagcgtgtgctcgactggttagagaagcatggtatcgagcgactaaaacggatggcgatatcaggggatgactgcgtggtcaagcccattgacgacaggttcgcgacggcgttgaccgccttaaatgatatgggcaaggtgcgtaaagacatcccgcagtgggagcctagcaaaggctggaacgactggcagcaggtccccttctgctctcaccacttccaccagcttattatgaaggacgggcgggagatcgttgtaccgtgcagaaaccaggacgagttgatcggccgagcccgcgtgagccagggggccggctggtccctccgagaaacggcctgcctgggcaagtcatatgctcagatgtggcaactgatgtatttccaccgccgggacctacgactagccgccaatgcgatctgctcagccgtgccggttgactgggtccccacctctcggaccacgtggtccatccacgcccatcaccagtggatgaccaccgaagacatgctgtcggtctggaatcgtgtgtggattgaggaaaacccctggatggaagacaaaacccacgtgtcctcctgggaggacgttccctacctcgggaaaagagaagaccagtggtgcggctcactgatagggctgaccgctcgcgccacgtgggcaagcaacattcaggtggccataaaccaggtgcggcgccttattggcaacgagaactacttagattatatgacttctatgaagcgcttcaagaatgagtctgaccctgaaggggccctgtggtga

SEQ ID NO: 24690 - RNA, 9879 nt, synthetic construct
  misc_feature 1..9879: note = derived and/or modified CDS sequence (opt11) from DENV-1__KC762631__SS-prME
  source 1..9879: mol_type = other RNA
agcgtgaccatgctcctaatgctgatgcccacagcccttgccttccacttaacaacccggggcggggagccacacatgaccgttagcaagcaagaacggggtaagagcttgctgtttaagacgtccgccggggtcaatatgtgcaccttaattgccatggatctgggcgagctgtgcgaagacaccctcacctacaagtgtccccgcatcaccgaggccgagcccgacgacgtggactgctggtgtaatgctacagacacctgggtgacctacggtacctgcagccagaccggcgagcaccgccgtgacaaacgctccgtggccctggcgccccatgtggggctagggctcgagacccgcaccgagacgtggatgagctccgagggcgcctggaagcaaatccaacgggtggagacgtgggctttacgccaccccgggtttaccgtgatcgccctattcctcgcgcacgccatcggtaccagcatcacccaaaaggggatcatcttcatcctgctgatgctggtgacaccctccatggccatgcggtgcgtcggcattggatcgcgcgacttcgttgaagggctgtccggagccacctgggtggatgtcgtgctggagcacggtagctgcgtgaccaccatggctaaggacaagcctacgctcgacatcgagctgctgaagaccgaggtcaccaaccccgcggtgctccggaagctgtgcatcgaggcgaagatctccaacaccacgaccgacagccgctgcccgacccagggcgaggctacactggtcgaggagcaggacgctaacttcgtctgccggcgcacgttcgtggaccgtggctggggaaacggttgtggtctgttcggcaaggggtccctcatcacgtgcgccaagttcaagtgcgtgacaaagctggagggcaagattgtccagtacgaaaatctgaaatacagcgtgatcgtgaccgtccacacgggcgatcagcaccaggtggggaacgagtccaccgagcatgggaccactgcgaccattacgccccaggctccaaccacagagatccaactgaccgactacggggcccttacgctcgactgcagcccccgcaccggcctggacttcaacgagatggtcctgctcaccatgaaggagaagtcctggctggtgcacaagcagtggtttctagacctccccctgccttggaccagcggggccagcacgtcccaggaaacctggaaccgtcaggacctgctagtaacgttcaagaccgcccacgcgaagaagcaagaggtcgtggtgctgggctctcaggagggcgccatgcacacggccctgaccggggccactgagatacagaccagcggcaccacaacgatcttcgctgggcacctaaagtgccgcctgaaaatggataagctgacccttaagggcatgtcgtacgtcatgtgcacgggctccttcaagctggagaaagaggttgcagagacccagcacggcacagtgctggtccagattaagtacgagggcaccgacgcgccctgtaagatacccttctctacgcaggacgagaagggggtgactcagaacggcagacttatcactgctaacccaatcgtaaccgacaaagagaagccagtcaatatcgaggccgagccacccttcggggagtcctacatagtgatcggcgcgggcgagaaagccctcaagctgagctggttcaaaaaggggagtagcatcggcaagatgttcgaggccacggcccgcggtgcccggcggatggcgatcctgggcgataccgcctgggatttcggatcgatcggtggcgtttttaccagcgtagggaagttggttcaccagatcttcggcactgcctatggggtgctgttctccggcgtcagctggacaatgaagatcgggatcggagtgctgctcacctggctgggcctgaactcccgctcgacctccctcagcatgacctgcatcgccgtgggtctggtgacgctgtacctcggcgtgatggtgcaggccgattccgggtgcgtcatcaactggaaggggcgggaactgaagtgcgggagcggcatcttcgtgaccaacgaggtgcacacctggactgagcagtataagttccaggcggacagcccgaagagattatctgccgccatcggcaaggcatgggaggagggggtctgtggcattcggagcgccacccgcctcgaaaatatcatgtggaagcagatctcgaacgagctaaaccacatcctgctcgagaacgatatgaagttcacggtggtggtcggggacgttgcgggtatcctggctcaaggtaagaagatgatccggccccagcccatggaacacaagtacagctggaagagttgggggaaagccaagatcataggggccgacgtgcagaacaccacattcatcatcgacgggcccaataccccggagtgcccggacgaccagcgcgcgtggaacatctgggaggtcgaggactacggcttcggcatcttcacgaccaacatctggctgaaattgcgggacagctacacccaggtgtgcgaccaccgcctgatgtccgccgccatcaaggactctaaggccgtccacgccgacatgggctactggatcgagtccgagaagaacgaaacctggaagctggcgcgggccagcttcatcgaggtcaaaacctgtatctggcctaagtcccacaccctctggagcaatggcgtgctggagagtgagatgatcattcctaagatctacggtggcccgatcagccagcacaactaccgccccgggtatttcacgcagacggccggcccctggcatctcgggaagttagagctggacttcgacctgtgcgagggcacgaccgtggtcgtggacgagcattgcggaaatcgtgggccgtccctccgcaccaccacggttaccggtaagatcatacacgagtggtgctgccgtagttgcaccctgccgcccctgcgcttccgcggcgaggacggatgctggtacgggatggagatccgcccagtcaaggagaaagaagagaacctcgtgaagtccatggtgtctgcgggcagcggcgaggtagactccttcagcctggggctgctctgcataagtatcatgatcgaggaggtcatgcggagtcggtggtccagaaagatgctgatgaccggcacgctggccgtgttcttcctcttgatcatgggccagctgacttggaacgacctcatccgcctgtgcatcatggtcggcgcgaacgccagcgaccgcatggggatgggcacgacttacttggctctcatggccactttcaagatgcgtccgatgttcgccgtgggtcttcttttccgccggcttacctcccgcgaggtattgctgctcacgatcgggctttctctggtggcttcagtggagctcccaaacagcctagaggagctgggcgacgggctcgccatgggcatcatgatcttaaagctgctcaccgacttccaatcccaccagctgtgggccacgctgctcagcctgaccttcatcaagaccaccttctccctccactacgcctggaagacgatggcgatggtcctcagcatcgtctcactgtttcccctgtgcctaagcaccacctcccagaagaccacctggctacccgtactccttggcagcctggggtgcaagccgcttaccatgttcttaatcgccgagaacaaaatctggggccggaagtcctggcccctgaatgaagggattatggccgtcggcatcgtgagcatcctgttgagctccctcctgaaaaacgatgtgcccctagccgggcctctgatcgccggcggcatgctaatcgcatgttacgtcatcagcggatccagcgcggacctctccctcgagaaggctgccgaggtgagctgggaggaggaggccgagcactccggcgcgagccacaacatcctggtggaggtacaggacgacgggaccatgaagatcaaggacgaggaacgcgacgacaccctcacgattctgttgaaggccactctcctggccgtgtccggggtgtacccgctgagcataccggccaccctcttcgtatggtacttttggcagaagaaaaagcaacggtccggtgtgctgtgggacaccccctctccgcccgaggttgagcgcgccgtgctggacgacggcatctaccggatcatgcagcgcgggctgctcggacggtcccaggtgggcgtgggggtcttccaggagaacctgtttcacaccatgtggcacgtgacgcgcggagcggtgctgatgtaccaagggaagcggctcgagccctcgtgggcctccgtcaagaaggacctgatctcatacggcggagggtggcgcctgcagggctcctggaacactggggaggaggtccaggtgatcgcggtcgagcctggcaagaaccccaagaacgtgcagaccgcccccgggaccttcaaaacgcccgagggcgaggtgggcgccattgcgctcgactttaagcccgggacaagcggctctcccatcgtcaatcgggaggggaagatcgtgggcctgtacggcaacggggtggtcaccaccagcggcacgtacgtgtcggccatcgcgcaggcaaaggcgtcccaggagggtccgttacccgagatcgaagacgaggtgttccgcaaacgtaacctcaccataatggacctgcacccaggcagcgggaagacccgccggtatctgccggccatcgtccgcgaggccatcaagcggaagctccgtaccctgatcctggcccccacgcgagttgtggccagtgagatggcggaggccctcaagggcatgcctatccggtaccagaccaccgccgtcaaatcggagcacaccgggaaagagatcgtggacctgatgtgtcacgccacgttcacaatgcgcctgctatcccccgttcgggtcccgaactataacatgataatcatggacgaggcccacttcaccgacccctcttccatcgcggcccgcgggtacatcagtacccgtgtgggcatgggagaggccgccgcgattttcatgacggcaacgccccccggttctgttgaggccttcccgcaaagcaacgccgtcatccaggacgaggagcgcgacatccccgagcgttcgtggaatctgggttacgagtggatcaccgacttccccggcaagaccgtgtggttcgtcccctcgatcaagagcggcaacgacatcgccaactgcctgcgcaagaacgggaagcgcgtcatccaactcagccgcaagacctttgacaccgaataccagaagaccaagaacaacgactgggattacgtggtgacaacagacatttccgagatgggcgccaacttccgagccgaccgcgtcattgacccacggcgatgcctgaagcccgtgatccttaaggacgggcccgagcgggtgatcctcgccggccccatgccagtcaccgtggcctcagccgcgcaaagacgggggcgcgtcggccggaaccacaacaaggagggcgaccaatacatctacatggggcagcccctgaacaacgacgaggaccacgcccactggaccgaagcaaaaatgctgctcgataacatcaacaccccggagggcattatacccgccctgttcgagccggagcgcgagaagtccgccgcgatcgacggggagtaccgcctgcggggcgaagcccgcaagacgttcgtggaactcatgcggcgcggggacctgccagtgtggctgagctacaaggtcgcctccgagggcttccagtactcagaccggcgctggtgctttgacggcgagcggaataaccaggtgctcgaagaaaacatggacgtggagatctggaccaaggagggtgagcgcaagaagctgcggccccgctggctcgacgcccgtacgtacagcgatcccctggccttgcgcgagttcaaagagttcgcggcgggccggcgctcagtcagcggggacttgatccttgaaattggcaagctgccgcagcatcttacccagcgggcccagaacgcccttgacaacctggtgatgctgcacaactccgagcagggcgggcgcgcgtatagacacgccatggaggagctccccgagacgatagaaacactgatgctgctcgccctgatcgccgtactgacaggcggggtaaccctcttcttcctgagcggccgcgggctgggcaaaacctccattggcctcctgtgcgtgatggccagctccgtgctcctctggatggcgtctgtagagccacactggatcgccgcctccataatcctggagttcttcctgatggtcctccttatccccgagccggaccggcaacgcacgccccaggacaaccagctggcctacgtggttatcgggctcctgtttatgatcctgacagtggccgcgaacgaaatggggctcctggagaccaccaagaaggacctcgggatcggccacgtggccgtcgagaaccatcaccacgccgccatgctcgacgtcgacctgcatcccgccagcgcgtggacgctgtacgccgtagccaccaccatcataacaccgatgatgcggcatacgatagagaacaccactgccaatatctccctcactgccatcgctaaccaagccgccatcctaatggggcttgacaaggggtggccgattagcaaaatggacataggcgtcccactgctggccttggggtgttactcccaggtgaatcccctcacgctgacggccgccgtgctgatgttggtcgctcactacgccatcatcggccctgggttgcaagccaaggcgacccgcgaggctcagaagcgcaccgctgccggcatcatgaagaaccccacggtagatgggatagtggccatcgacctggaccccgtcgtctacgacgcgaagtttgagaagcagctcggccaaatcatgctgctgatcctgtgtaccagccagatcctgctgatgcggacaacctgggccctatgtgagtccataacgctggccaccggccccctgaccactctctgggaggggagtcctggcaagttctggaacacgaccatcgccgtgtccatggccaatatcttcagggggagctacttagcgggcgctggcctggccttctccctcatgaagtccctagggggcgggcggcgcgggaccggggcccagggggaaaccctgggcgagaagtggaagcggcagctcaatcagctgagcaagtccgagttcaacacgtacaagcgcagcgggatcatggaggtcgaccggtccgaggctaaggaaggtctgaaacgcggcgagaccacaaaacacgccgtgtcgcggggcacagccaagctccgctggtttgtggagcggaacctcgtcaagcccgaagggaaagtgatcgacctgggctgtggccgcggggggtggtcctactattgtgccggactgaagaaggtcacggaggtcaaaggctacaccaagggaggtcccggccatgaggagcccatcccaatggccacctatgggtggaacctcgtgaaactgcacagcggcaaagacgtgttcttcatccctccggagaaatgcgataccttgctctgtgacatcggagaatccagccccaacccgacgatagaggagggccgaacgctgcgggtcctgaagatggtggagccctggctccgggggaaccaattctgcataaagatactgaacccatacatgccctccgtagttgagaccctggagcagatgcagcgcaagcacggcgggatgctcgtgcggaacccgctgagcaggaacagtacccatgaaatgtattgggtgagttgcgggaccggcaacatcgtctccgcggtgaacatgacgagccggatgctgctaaaccgcttcaccatggcccaccgcaagcctacctacgagcgggacgtggacctgggtgcaggcacccgccacgtcgccgtggagcccgaagtggccaacctggacattatcggccagcggatcgaaaacatcaaacacgagcacaagtccacgtggcattacgacgaggacaacccctacaagacctgggcgtaccacgggtcctatgaggtcaaaccttccggcagcgcttccagcatggtgaatggcgtcgttaagctcctgacgaaaccctgggacgtgattcccatggtcacccagattgccatgactgacactacccccttcggccagcagagagtgtttaaggagaaggtagatacccggacgccgaaggccaagcgcgggaccacccaaatcatggaggtcaccgcccggtggctttggggcttcttaagccgcaataagaaacctcggatctgcacgcgcgaggagtttacgcggaaggttcgcagcaacgccgcgataggggctgtgttcgtcgacgaaaaccagtggaacagcgccaaggaggccgtagaggacgagcgattctgggagctggtgcaccgtgagcgggagttacacaagcaagggaagtgcgcgacctgcgtctacaacatgatggggaaacgcgagaaaaagctcggggagtttggcaaggctaaagggtcgcgggctatctggtacatgtggctgggcgcccgcttcctggaattcgaggcgctcggcttcatgaacgaggaccattggttcagcagagagaactccttgtcgggagtggagggcgaggggctgcacaagctcggctacatcctccgcgacatctccaagatccccgggggcaacatgtacgccgatgacaccgccggctgggatacgcggatcaccgaggacgatctgcaaaacgaggccaaaatcacggacatcatggagccggaacacgcgctcctggcgaaagctatctttaagctgacctatcagaacaaggtggtacgtgtgcagcgccccgccaagaacgggacggtgatggacgtcatcagccggcgcgaccagcggggctctggccaagtggggacttacggcctcaacactttcaccaatatggaggcccagctgatccgccagatggaaagcgaggggatcttctcccccagcgagctggagactcccaaccttgccgagcgggtgttagactggctggagaaatacggtgtcgagcgccttaagcggatggcgatctcaggggacgactgtgtggtaaagccgatcgacgaccgcttcgccaccgccctgaccgccctgaacgacatgggcaaggtacggaaggacattccgcaatgggagcccagcaaggggtggaacgactggcaacaggtccccttctgctcccatcacttccaccagctcatcatgaaggacggccgcgagatcgtggtcccctgccggaaccaggacgagttggtgggccgcgcacgggtgagccagggggcgggatggagcctgcgcgagaccgcctgcttgggcaagagctatgcacaaatgtggcaattgatgtacttccaccggcgcgacctgcgcctcgccgccaacgccatctgcagcgccgtgcctgtagactgggtgccgacgtcccgtaccacctggagcattcacgcccaccaccagtggatgacaactgaggacatgttatccgtctggaaccgggtgtggattgaggagaacccctggatggaggataagacccacatcagttcctgggaggacgtgccttacctgggcaagcgcgaggaccagtggtgcgggagcctcatcggcctgactgcccgcgcgacatgggccacaaacattcaggtagccatcaatcaagtgcggaggttaatcggcaatgagaactatctcgactacatgacgtccatgaagcggttcaagaatgagtctgaccccgaaggggccctgtggtaa

SEQ ID NO: 24691 - RNA, 9879 nt, synthetic construct
  misc_feature 1..9879: note = derived and/or modified CDS sequence (opt11) from DENV-1__KC762621__SS-prME
  source 1..9879: mol_type = other RNA
agcgtgaccatgctgcttatgttgatgcccactgccctggccttccacctcaccacccgcggcggggagccccatatgatcgtgtccaagcaggagcgcggcaagagcctgctgttcaagaccagcgccggggtcaacatgtgtacgcttatagcaatggatctgggcgagctgtgcgaagatacgctcacctacaaatgcccacgaataactgaagccgagccagacgatgtagattgttggtgcaatgccaccgacacctgggtcacctatggaacctgctctcagaccggcgagcaccggcgcgacaagcggtccgttgcgctggctcctcacgtgggcctgggtctcgaaacgcgtaccgagacgtggatgagcagcgagggcgcatggaagcagatccagcgggtcgagacatgggcactgcgccaccccgggttcacggtgatcgccctctttctcgcccacgccatcggtaccagcatcacccagaaggggatcatctttatcctgctgatgctcgtgaccccctccatggccatgaggtgcgtcggcataggcagccgcgacttcgtggagggtctgtccggtgcaacgtgggtagacgtcgtgctggagcacgggtcatgcgttacaaccatggcgaaggacaagcccaccctcgacatagagctgctaaagacggaggtcaccaaccccgctgtgctccggaaactgtgtattgaagccaagatctccaataccaccaccgacagccgctgcccaacccagggagaagccacgttggtggaggagcaggatgccaacttcgtctgccggcgcacctttgtcgaccggggttgggggaacggctgcgggctgttcggcaaggggtctctgataacctgcgccaaatttaaatgcgttaccaagctggagggaaagattgtccagtacgaaaacttgaagtactctgtgatcgtgacggtccacacgggcgaccagcaccaggtggggaacgagtccaccgagcacggaaccaccgccaccattacgccgcaggcccccacgaccgagatccagttgaccgactacggcgcccttaccctcgattgcagcccccggacgggcctggatttcaacgagatggtcctgctcacgatgaaggagaagtcctggctggtgcacaagcagtggttccttgacctccccctgccatggacgagcggggccagcacctcacaagagacatggaaccggcaagacctgctcgtgaccttcaagaccgcccacgcgaagaagcaagaggtcgtggtgctgggcagccaagaaggcgcaatgcacacggccttgacgggcgccaccgagattcagacctccggcaccactaccatcttcgcaggtcacctcaagtgtcgcttaaaaatggacaagctgaccctcaaaggcatgagctacgtcatgtgcaccgggagtttcaagctggagaaggaggtcgccgagactcagcatggcaccgttctagtccaaataaagtatgagggcactgacgcgccctgtaagatccccttctcgacccaggatgagaagggggtgacgcagaacggacgtctaatcaccgccaacccgatcgtgaccgacaaggagaaacccgtcaacatcgaggccgagccgccattcggggagagctacatagtgatcggcgcaggcgagaaagccctcaagctgagctggttcaagaagggttccagcatcggtaaaatgtttgaagccaccgcccgcggggccagacgtatggcaatccttggcgacacggcgtgggacttcgggagtataggcggtgtgttcaccagcgtcgggaagcttgtgcaccagatctttggcaccgcttacggggtgctgttctcaggcgtcagctggaccatgaagataggtattggcgtgctactgacgtggctagggctgaattcccgctctacctcactctccatgacatgcatcgccgttgggttggtcaccctgtatctcggcgtcatggtgcaggccgactccgggtgcgtcatcaactggaaaggtcgggaacttaaatgcgggagcggcatttttgtgacgaacgaggtgcatacatggaccgaacaatacaagtttcaggcggacagccctaagcgcctgtctgcggccatcggcaaggcctgggaggagggggtctgcggcatccgaagcgcgacccgcctcgaaaacatcatgtggaagcagatctccaacgagctgaaccacatcctcctcgagaacgacatgaagttcaccgtggtggtcggggacgttgcggggatcttagctcaggggaagaaaatgatcagaccccagcccatggagcacaagtacagctggaagtcctggggcaaggccaagataatcggcgccgacgtgcagaacacgaccttcatcatcgacgggcctaacacccccgagtgccccgacgaccaacgcgcgtggaacatatgggaggtcgaggattacggcttcgggatctttaccacgaatatctggctaaagctccgagactcttacacccaggtgtgcgaccaccgcctgatgtctgccgcgatcaaggactcaaaggccgtacatgccgacatgggctattggatcgagagtgagaagaacgagacctggaagctggcgcgggcgtcattcattgaggtaaagacctgcatctggcccaagtcgcacacgctctggagcaatggcgtcttagaatcggagatgatcatccccaaaatctacggaggcccgactagtcagcataactaccgccccgggtacttcacccagaccgccggcccctggcacctgggtaagttggaactggacttcgatctgtgcgagggcacgactgtcgtcgtggacgaacactgtggcaatcggggaccatccctccggactacgacggtgacaggaaaaataatccacgagtggtgttgtcggtcgtgcacccttccacccttacgctttcggggtgaagacggctgctggtatgggatggagattcgcccggtaaaggagaaggaggagaatctcgtgaagtcaatggtgagcgccggctcgggcgaggtcgactccttcagcctcgggctactctgcatctccatcatgatcgaggaggtgatgcggagccgctggtcccggaagatgctgatgaccggcacgctggctgtgttctttctcctgatcatggggcagctgacctggaacgacctcatcagactgtgcatcatggtcggcgcaaatgctagtgatcgcatgggaatgggcacaacctacctggccctcatggccacgttcaagatgcgacccatgttcgctgtgggcctgctgttccgccggctcacctcccgtgaggtgttgctgctcacgatcgggctgagcttagtcgcgtcggtggagctccccaactcgctggaagagctgggtgacgggctcgccatgggaatcatgatcctgaagctactcacggactttcagtcccaccagctgtgggcaactctgctcagcctgacctttattaagaccacgttctccctccactacgcctggaagacaatggcaatggtgctcagcatcgtatccctgttccctctatgcctcagcaccacatcccagaagaccacgtggctgcccgtccttctgggcagcctggggtgcaagccgctcactatgtttctcatcgcggagaacaaaatatggggtcggaaaagttggccgctaaacgaggggatcatggcggtcggaatcgtgagtatcctgctaagctccctgctgaagaacgacgtgcccctcgcgggccccttaatcgctggcggcatgctgatcgcctgttacgtcatcagcgggtcgtccgccgatctctcattggagaaggccgccgaggtgagctgggaggaagaggccgagcactccggagctagccacaacatcctggtggaggtccaggacgatggcaccatgaagataaaggacgaggagcgcgacgataccctcacaatcctgctgaaggccacgctccttgccgtgtccggggtgtacccgctgagcatccccgccactctttttgtatggtacttttggcagaagaagaagcaaagatccggggtactgtgggatacacccagcccgcccgaggtggagagggccgtcctggacgatggcatctacagaattatgcagcgcggcctgctggggcggtcgcaggtcggcgtgggggtcttccaggagaatgtgttccacaccatgtggcacgtgacgagaggcgcggtcctcatgtatcaagggaagcggctggagcccagctgggcctcggtgaagaaggacctcatcagctacggcggcgggtggcgcctgcaagggtcctggaacactggggaggaggttcaagtcatcgcggtggagcccggcaaaaaccccaagaatgtgcagaccgcccccggtaccttcaagacgcccgagggcgaggtcggcgccatcgcactggactttaagcccgggaccagtggctcccccatagtcaaccgggaggggaagatcgtgggtttatacggcaacggggtcgtaacaacaagcggcacgtacgtgagcgccattgcccaggcgaaggcgtcccaagaggggccgctgcccgagatcgaagacgaggtcttccgcaagcggaatcttacgatcatggacttgcatcccggcagcgggaagacccgccggtatctgccagctatcgtgcgcgaggctataaagcggaagctgcgcaccctcatcctggccccaactagggtcgtggcctcagagatggcggaggccctgaagggcatgccaattcggtaccagactaccgccgtcaagagcgagcataccggcaaggagatcgtggacctgatgtgccacgccacgttcacgatgcgcctgttatcccccgtacgggtaccgaattataacatgatcattatggatgaagcccacttcaccgatcccagctccatcgcggcccgcgggtacataagcacccgggtgggcatgggggaggccgccgccatcttcatgacggccacgccgcccggctccgtcgaagccttcccgcagagcaacgccgtcattcaggatgaggaacgcgatatccccgagcgtagttggaacagcggatacgagtggatcaccgacttccccggcaagaccgtgtggttcgtcccctccataaagtccgggaacgacatagccaactgcctccgcaaaaacggtaagcgggtgatccagctttcccgcaagacgttcgataccgagtaccagaagactaaaaacaacgattgggactacgtggtcaccacagacatcagcgagatgggcgcgaacttccgggccgaccgcgtgatcgacccgcgtaggtgcctgaagcccgtcatcctcaaggacggacccgaacgagttatcctagccggcccgatgccggtgacggtcgcctccgccgcgcagagacgcgggcgagttggccggaaccacaacaaagagggcgaccaatacatctatatgggccagcccctcaacaacgacgaggaccacgcccactggaccgaggctaagatgctcctggacaacatcaataccccagaaggcatcatccccgccctgttcgagccggaacgcgagaagtccgcggcgatcgacggggagtaccggctccggggcgaggcccgcaagactttcgtggaactgatgcgacgcggggacctacctgtctggctttcctacaaggtcgccagcgagggcttccagtacagcgacagacgctggtgctttgacggcgagcggaacaaccaggttctggaggagaacatggacgttgagatctggaccaaggagggggagcgcaaaaagctgagaccccgctggctcgacgcacggacgtattccgaccccctggcgctaagggagtttaaggagttcgctgccgggcggcggtcagtgtccggggacttaatcctggaaattggcaagctgccgcagcacttgacccaacgggcacaaaacgccctggacaacttagtgatgctccacaactccgagcagggcggccgcgcgtatcggcacgccatggaagagttacccgacacgatcgagaccctcatgctcctggcactaatcgccgtactcaccggcggggtgaccctgttcttcctgtcaggccgcgggctcggtaagaccagcataggcctgctgtgcgtgatggcctccagcgtcctcctatggatggcgtcagtggaaccccactggattgccgccagcatcatcttagaattcttcctgatggtgctgctaatccccgagccggaccggcagcgcacgccccaggataatcagctcgcctacgtcgtgatcgggctgctcttcatgattctcaccgtggcggcgaatgaaatgggcctgttagagactaccaagaaggatctcgggataggctacgtcgctgtggaaaaccaccaccacgccgccatgctggacgtggacctccaccccgcctccgcgtggacactctatgccgttgccaccaccatcataactccgatgatgcggcacacgatcgagaacactactgccaacatcagtctcaccgctatagcgaaccaggccgcgattctaatggggctcgacaagggctggccgatctccaagatggacatcggcgtgcctttgctggccttggggtgctactcccaggtgaaccccctgactctgacagctgcggtcctcatgctggtagcccactatgctatcatcggcccggggctccaggccaaggcgacccgtgaagcccaaaagcgcactgcagccggcatcatgaagaaccccactgtagatgggatagtcgccatcgacctcgacccagtcgtgtacgatgcaaagttcgagaagcagctgggccagatcatgctcttgatcctgtgcaccagtcagattctgttaatgcggaccacgtgggccctgtgcgagtccatcacgctcgctactggcccgctcaccaccctgtgggaggggtccccgggcaaattctggaacacgaccatcgccgtcagcatggccaacatctttcgcgggtcctacttggcgggagccggcctcgccttcagcctgatgaagtccctcgggggcgggcggcgcgggaccggggcgcagggcgagaccttgggcgagaaatggaagcggcagctgaaccagctgtccaagagcgagtttaacacgtacaagcgctccggcatcatggaggtggaccggagtgaggcaaaggagggcttgaagcgcggtgagaccacaaaacatgctgtgtctagaggcacggccaagcttcgctggttcgtcgaacgcaacttggtaaagccggaggggaaagtgatcgacctgggatgcggccgcggggggtggagctactactgcgccggcctcaagaaggtgacggaagtgaagggctacactaagggcggccccggacacgaagaacccatccccatggctacctatgggtggaacttagtgaagctacactccgggaaggacgtcttcttcatccctcccgagaagtgcgataccctcctgtgtgacatcggggagagctcccccaacccgacgatcgaggagggccgaaccttacgcgtgctcaagatggtggagccctggctccggggtaaccagttctgcatcaagatcctgaacccctacatgcccagcgtcgttgagaccctagagcagatgcagcgcaaacacggcggaatgctggtgcggaacccgctttcccggaatagtacccacgagatgtattgggtttcctgcgggacaggcaacatagtgagtgcggtgaacatgacgtcccggatgctcctgaaccgcttcaccatggcacaccgcaagcccacctacgaacgagacgtcgacctgggggccggcacccgccacgtcgccgtggagcctgaggtcgccaacctcgacatcattggccaacggatcgagaatatcaagcatgagcacaagagcacgtggcattacgacgaggacaatccctacaagacctgggcttatcacgggtcctacgaagtgaaaccgtctggctccgccagtagcatggtgaatggtgtggtaaagttgctgaccaagccctgggatgtcatccccatggtaacccagatcgccatgacagacaccaccccctttggccaacagagggtgttcaaggaaaaggtcgacacgcggacgccgaaggccaaaagagggaccacccagatcatggaggtgaccgcccgttggctctggggcttcctgtcccgcaacaagaagccccggatatgcacgagggaggagttcacccggaaggttcgcagcaacgcggccattggcgccgtcttcgtggacgaaaatcagtggaactccgcaaaggaggcggtggaggacgagcggttttgggacctggtccatagggagcgagagctccataagcaagggaaatgcgcgacctgcgtgtacaatatgatgggcaagcgcgagaagaagctcggggagttcggcaaagctaaggggtcccgggcgatctggtacatgtggctgggcgcaagatttctcgaatttgaggcgctgggcttcatgaatgaggaccactggttttcccgcgagaacagcttaagtggggtcgagggcgaggggctccataagcttggttacatcctgcgggatattagcaaaatccccgggggtaacatgtacgccgacgacaccgcaggatgggacacgcgcatcaccgaggatgacctccaaaacgaggccaaaattaccgacatcatggagccggagcacgccctgctggcgaaggccatcttcaagctcacatatcagaacaaggtggttagagtacagcgccccgccaagaacgggacggtcatggacgtgatcagtcggcgcgaccagcgggggagcggccaggtggggacatacggcctgaacacttttaccaacatggaggcccaacttatccgccagatggaatccgaggggatcttctcacccagtgagctggagacacccaacctggccgaacgggtcctggattggttagaaaagtacggggtggaacgcttgaagcggatggcgatcagcggggatgattgcgtggtcaaaccgattgacgatcgctttgccaccgccctgaccgccctcaacgacatgggcaaggtgcggaaggacatcccccagtgggagccctccaaagggtggaacgactggcagcaagtccccttttgcagccaccacttccaccagctcatcatgaaggacggcagagaaatcgtcgtgccgtgccggaaccaggacgagctagtgggccgcgcccgggtctcccaaggggcgggctggagcctcagagagactgcctgccttgggaaaagctacgcccagatgtggcaactgatgtacttccatcggcgcgacctccggctggccgcgaacgccatctgctccgccgttcccgtggactgggtccccacgtcccgcaccacttggtcgattcacgctcaccaccagtggatgactacggaggacatgctgagcgtgtggaaccgggtgtggatcgaagagaacccctggatggaggacaagacccacgtctcctcatgggaggacgtgccgtacctcggcaagcgcgaggatcaatggtgtgggtccctgatcggcctgaccgcccgcgcgacctgggccaccaacatccaggtagccatcaatcaagtccgacgcctaatcggaaacgagaactacctggactacatgacgtcgatgaagagatttaagaatgagtcagaccccgagggggctctatggtga

SEQ ID NO: 24692 - RNA, 9879 nt, synthetic construct
  misc_feature 1..9879: note = derived and/or modified CDS sequence (opt11) from DENV-1__KC762643__SS-prME
  source 1..9879: mol_type = other RNA
agcgtgactatgctgctcatgctgatgccgaccgccttagccttccatctcacgacccggggcggggagccgcatatgatcgtgagcaagcaggagcggggcaagagcctgctgttcaagaccagcgccggggtgaacatgtgtactctcattgccatggacctgggggagctgtgcgaagacacgctcacctataaatgcccccgcataactgaggctgagcccgacgacgtggactgttggtgcaatgccaccgacacctgggtcacctacgggacctgcagccagacaggggaacatcggcgcgacaaacggtctgtggccctagcgccccatgtgggcctggggctcgagacccgcacggagacctggatgagctccgagggcgcatggaaacagatccagcgcgtcgagacctgggcactgcgtcaccccgggttcaccgtgatggcattgttcttggcgcacgccatcggcaccagcatcacccagaagggcattatcttcatcttgctgatgctcgtcaccccctcgatggccatgcggtgcgtcggcatcggaagccgcgacttcgttgaggggctatccggagcaacctgggtggacgtcgtgctggagcacgggtcgtgtgtgacaaccatggcaaaggacaaacccaccctcgacatcgagttgctgaaaacagaggtcaccaacccggcggtgctccggaaattatgcatagaggccaagatttccaataccactacagacagcaggtgcccgacccaaggcgaggcaacccttgtggaggagcaggacgccaatttcgtctgccggcggaccttcgtggaccggggctgggggaacggttgcggcctgttcggaaaagggtccctgatcacgtgcgccaagtttaagtgcgtgactaagctggagggcaaaatcgtgcagtatgagaacctcaaatacagcgtgatcgtgaccgtccacaccggagaccagcatcaggtggggaacgagtccacggaacacggcaccaccgcaaccatcacgccccaggcccccacgaccgagattcagttaaccgactacggggccctgaccctcgactgtagcccccgcacgggactggacttcaacgagatggttttactcaccatgaaggagaagtcctggctggtccataagcagtggttcctggacctccccctgccgtggaccagtggtgcaagcacgtcccaggagacgtggaaccgacaggatctgctggtgaccttcaaaacggcccacgccaagaagcaagaggtagtggtgctgggttctcaggagggcgccatgcacaccgcactgacaggggccaccgagattcagacctctggcactaccacaatcttcgccgggcacctcaagtgcaggttaaagatggacaaactgacgctcaaaggcatgtcatacgtgatgtgcaccgggtccttcaagctagagaaggaggtggcggaaacgcagcacggtaccgtgttggtccagatcaagtacgagggcaccgacgccccgtgcaagattcccttcagtacccaggatgaaaagggggtgacgcaaaacggacggttaatcaccgccaacccgatcgtgacggacaaggagaagcctgtcaacatcgaggccgagccgcccttcggcgagtcatacatcgtcatcggcgctggcgaaaaggccctcaaattgagctggttcaagaaggggtccagcataggaaagatgttcgaggccacagccagaggggcccgtaggatggctatccttggcgacacggcctgggacttcgggtccatcggcggcgtactcacctctgtcggcaagctggtgcaccagatattcggcaccgcctacggcgtgctgttctctggagtcagctggaccatgaagatcgggatcggcgttctcttgacgtggctgggccttaattcccgcagcacctccttaagcatgacctgcatagccgtggggcttgtcaccctgtacctgggggtgatggtgcaagccgattcggggtgcgtcatcaactggaagggacgggagctgaagtgcgggtccggtattttcgtgacgaacgaggtccatacctggaccgagcagtacaagtttcaggctgacagcccgaagcgccttagcgccgctataggaaaggcctgggaggagggggtctgtgggatcaggagcgccacacgcctggagaacatcatgtggaaacaaatctccaacgagttgaaccatatccttttggagaacgacatgaagtttactgtggtggtaggggatgttgcgggcatcttggcccaagggaagaagatgatccgaccacagcccatggagcacaagtacagctggaagtcctggggcaaggccaagatcatcggcgccgacgttcagaacacaacatttataatcgacggtccgaacactccagagtgccctgacgaccagcgcgcgtggaacatctgggaggtggaggactacggctttgggattttcaccacaaacatatggcttaagctgcgggactcttacacccaagtctgcgaccatcgcttgatgtccgccgccatcaaagacagcaaggccgtgcacgctgacatgggctactggatcgagtccgagaagaatgagacctggaagctcgcgcgggcaagcttcattgaggtaaagacctgcatctggcccaagtcccacactctgtggtccaacggcgtcctggaatccgagatgatcatccccaagatctacgggggcccgacctcccagcacaattatcgccccggttacttcacccagaccgccggtccctggcatctcgggaagctggagctggacttcgacctctgcgagggcacgaccgtggtagtggacgagcactgcggcaaccgcggtccctccctgcggaccaccaccgtcaccggcaagatcatccacgagtggtgttgccggagctgcacgctgccgcctctgcgctttcgcggtgaggacggctgctggtacgggatggagatccgtccagtcaaagaaaaggaggagaatctagtaaagtccatggtcagcgccggcagcggcgaggtcgactccttcagcctggggctcttatgcatctcaatcatgatcgaggaggtgatgcggagccggtggtcccggaagatgctgatgaccggcacgctcgccgtgttcttcctgttgatcatggggcaattaacctggaacgacctgatccgcctttgcatcatggtcggcgcgaacgccagcgaccgcatggggatgggcacgacctacctcgccctgatggccacgttcaaaatgcggccgatgttcgctgtgggactcctcttccgccggttaacctcccgtgaggtcctgctcctgaccataggactgagcctagtcgcgtccgtcgagctcccgaacagcctggaggaactcggcgatgggttggcaatgggcatcatgatcctgaagctcctgacggacttccagagtcaccaactgtgggccacgctactgagcctgaccttcatcaagacgaccttctcgctccactacgcttggaagacgatggccatggtgctgagcatagtctccctgttccccctctgcctgagcaccaccagccaaaaaaccacgtggctgcccgtgctcctcggcagcctggggtgcaagccgctcacgatgttccttatagcagaaaacaagatctggggccgtaagtcctggccgttgaacgagggcataatggccgtcggaatcgttagcatactactgagttccctgctgaagaatgacgtgcccctagccgggccactgatcgcaggcggcatgctcattgcgtgttatgtcatttctgggtccagcgccgacctgtccttagagaaagccgcggaagtgagctgggaagaggaagccgagcactccggagcgagccacaacatcctagtcgaggtccaagacgatggcaccatgaagatcaaagacgaggagcgcgacgacaccctgaccatcctgctgaaggccacgctgctggccgtgtctggcgtgtatccgctctctatccccgcgaccctgttcgtatggtacttctggcagaaaaagaagcagcggtccggggtgctgtgggacacgcctagcccgcccgaggtggagcgggccgtgcttgacgacggtatataccggatcatgcaacgcggccttttagggcggtcccaggtaggcgtgggggtgttccaggaaaacgtcttccacaccatgtggcacgtgacgcgcggcgcggtactcatgtaccaagggaagcgcttggaacccagttgggcctccgtgaaaaaggacctgatcagctacgggggcggttggcgcctccagggctcttggaatacgggggaagaggtgcaggttattgccgtcgagcccggcaagaaccccaagaacgtgcagaccgcgccggggacgttcaaaacgcctgagggcgaagtcggcgccatcgctctcgactttaagcccgggacctcaggctcccctatcgtgaaccgtgaggggaagatcgtagggctgtacggtaatggggtggtgaccacatcaggcacgtacgtcagcgcgatcgcccaggcgaaggcgtcccaggaggggcccctaccagaaatcgaggacgaggtctttagaaagcgtaacctcaccatcatggaccttcatcccggctccgggaagacacggcgctacctgccggccattgttagagaagcgatcaagcggaagctccgcactctgatcctggcacccacgcgtgtggtcgcctccgagatggcggaggccctcaagggcatgcccatccgttaccaaaccaccgccgtcaaaagcgaacataccgggaaggaaatagtggacctcatgtgtcacgccacgttcaccatgcgcttattatccccagttcgggtgccgaactacaatatgatcatcatggacgaggcccacttcaccgatcctagctcgatcgcggcccgcggctacatcagcacccgggtcggaatgggggaggcagccgccatcttcatgacggcgacgccgcccggatctgttgaggccttcccgcagagcaacgccgtgatccaggacgaggagcgcgacatccccgagcggtcctggaacagcggatacgagtggatcaccgacttcccgggcaagaccgtgtggtttgtcccctccatcaaaagcggcaacgacatcgcgaactgcttacgcaagaacgggaagcgggtgatccagctttcgcgcaagacgttcgacaccgagtaccagaagaccaagaacaacgactgggactacgtagtcacaacggacataagcgagatgggtgctaacttcagagccgatcgcgtgatcgatccgcggcgctgcctcaagcccgtgatcctgaaagacgggcccgagcgtgtcatcctggccggtccaatgccagtgaccgtagcctccgcagctcagcgccgggggcgcgtgggccggaaccacaacaaggagggcgaccagtacatctacatggggcagccgctcaacaacgacgaggaccatgcccactggaccgaggccaagatgctgctggacaacatcaatacccccgaggggattatccccgcgctcttcgagccggagcgcgagaagtccgccgcaatcgacggggagtaccggctgaggggcgaggcccgcaagacgttcgtggagctcatgcggcgaggggacctgccagtctggctgtcctacaaggttgcgtcagaggggttccagtactcagaccggcgctggtgtttcgacggcgagaggaacaaccaagtgctagaggagaacatggacgtcgaaatatggaccaaggagggtgagaggaaaaagctccggcctcgctggcttgacgctcgaacctactccgaccccctagccctccgcgagttcaaagagtttgcggctggccgaagatcagtatccggggacctgatcctggaaattggcaaactcccgcagcacctgactcagcgggcccagaacgccctggacaatctcgtgatgctgcacaacagcgaacaaggcggccgggcgtaccggcatgccatggaggagctgcccgacacgattgagaccctcatgctactggccctcatcgcggtcctgaccggcggcgtcacactcttcttcttatccgggcgcgggttaggcaagaccagcatcggcctgctctgcgtgatggcctcctccgttttgctgtggatggcctcagttgaaccccactggatcgccgcctcaatcatcctcgagtttttcctgatggtcctgctcatcccggagccggaccggcagcgtacgccgcaggacaatcagctggcctacgtcgtgatcgggttgttattcatgatcctgaccgtggcagcgaacgagatgggccttctcgagaccactaagaaggacctggggatcggccatgtcgccgtggaaaaccaccaccatgcagccatgctggacgttgatctccatcccgcatccgcgtggacgctgtatgccgtcgccacaaccatcataaccccgatgatgcggcacacgatcgagaacacgacggccaacatatcactgacggccatcgcgaaccaggccgccatcctgatgggtctggacaagggctggcccatctccaagatggacatcggagtgcccctgctcgccctgggctgctacagccaggtcaaccccctgacgctaaccgcggcggtattaatgctggtggcccactacgccataatcggcccggggctccaggccaaggcgaccagagaggcacagaagcgcacagccgccggtatcatgaagaaccccacggtggacggtatcgtcgccatcgacctagaccccgtggtgtacgacgcgaagttcgagaagcagttaggccagatcatgctgctgattttatgcacctctcaaattctcctgatgagaacgacctgggccctgtgcgagtccatcaccctggctaccggcccccttacaacactgtgggaagggagtcctggcaagttctggaacactacgatcgccgtctcaatggccaacatcttcagaggcagctatctggcgggcgcaggcctggccttcagcctgatgaagtccctcgggggcgggcggcgagggactggggcacagggtgagaccctgggcgagaagtggaagcgacagcttaaccaactctccaaaagcgaattcaacacgtacaaacgctctggcatcatggaggtggaccggtctgaggcgaaggagggcctcaagcgcggggaaactaccaagcatgccgtgtcccggggcaccgccaagctgcgctggttcgttgagcggaacctagtaaagccggaggggaaggttatcgatcttggctgcggaagaggtggctggagttactactgtgccgggctgaagaaggtcaccgaagtgaagggctacacaaaaggggggcccggccacgaggagcccattccgatggccacatatggttggaacctggttaagctccacagtggcaaggacgtcttcttcatcccgccagagaaatgcgacactttgctgtgcgacatcggggagtcgtcccccaacccgaccattgaggagggccgaaccctccgcgtgctcaagatggtggagccctggctgcgggggaaccagttttgcataaagatccttaacccctacatgcccagtgtggtggagaccctggagcagatgcagcgcaagcacggcggcatgcttgtaagaaacccgctctcccgcaactctacccacgagatgtattgggtatcttgcgggaccggcaatatcgtgtctgcggtgaacatgacgtcacggatgctgctgaatcgcttcaccatggcccaccgcaagccgacttacgaacgggacgtcgatttaggtgccggcacccgccatgtggctgtagagccggaggtcgccaacttggacatcattgggcagagaatcgaaaacatcaaacacgagcacaagagtacttggcattacgacgaggataacccgtacaagacctgggcctaccatggttcctacgaggtgaagcctagcggatcggcatcatccatggtaaacggggtggtgaagctgctcaccaagccctgggacgtcatccccatggtaacccagattgccatgactgacaccaccccgttcggtcagcagagggtgttcaaggagaaggtcgacacccggactccgaaggccaagcgcgggaccacccagatcatggaagtcaccgcccggtggctgtggggattcctttcccgcaacaagaagccgcggatatgcacgagggaggagttcatccggaaggtgcgcagcaacgccgccataggcgccgttttcgtggacgaaaaccagtggaactccgccaaggaggcggttgaggacgagcggttctgggacctcgtccaccgcgagcgggagctgcacaagcaggggaagtgtgcgacctgcgtgtataacatgatggggaaaagggagaagaagctgggggagtttgggaaggccaaagggagccgggccatctggtacatgtggctcggcgcccgtttcctggaattcgaggcgctgggcttcatgaacgaggaccattggttcagtcgagagaacagcctctccggcgtagagggcgaggggctgcacaagctgggctacatcctccgtgacatcagcaaaatccccgggggcaacatgtacgctgacgacactgccggctgggacacacggatcacggaagacgatctccaaaacgaggccaagatcaccgacatcatggagccggagcacgccctgctagcgaaagccattttcaagctgacctaccagaacaaggttgtgcgcgtgcagcgccccgcaaagaacgggaccgtcatggacgttatctcccggcgtgaccagcggggcagcggccaggtggggacgtacggactgaacaccttcacaaacatggaggctcagctcatccgacagatggagtccgaggggatcttcagccccagcgagctggagacccccaatctggcggagcgagtcctcgattggttagaaaagtacggcgtggaaagattgaaacggatggccatcagcggcgacgactgcgtggtcaaaccgatcgacgaccgctttgccaccgccctgaccgcgctgaacgacatggggaaggtccgcaaggatatcccacagtgggagccctccaaggggtggaacgactggcagcaggtacccttttgctcccaccacttccaccagctgatcatgaaggacgggcgcgagatcgtcgtcccatgccggaaccaagacgagctcgtgggtagagcacgggtcagtcagggggcgggatggagcctgcgcgaaaccgcctgtctaggcaagtcttacgcccagatgtggcagctcatgtacttccaccggcgcgacctgcggctggcagcgaacgccatttgctccgccgtgcccgtggactgggttccgaccagccgcacgacctggagcatacacgctcaccaccagtggatgacgacagaggacatgctcagcgtgtggaaccgagtctggatcgaagagaacccctggatggaagataaggcacacgtctccagctgggaagacgtgccgtacttaggaaagcgcgaagatcagtggtgcggatccctgatcggcctgacggcacgggccacctgggccacgaacattcaggtggccatcaaccaggtccggcgcctcatcggcaacgagaactatctggactacatgaccagcatgaaacggttcaagaacgagtccgaccccgagggggctctctggtaa

SEQ ID NO: 24693 - RNA, 9879 nt, synthetic construct
  misc_feature 1..9879: note = derived and/or modified CDS sequence (opt11) from DENV-1__KC762651__SS-prME
  source 1..9879: mol_type = other RNA
agtgtgaccatgctgttcatgctgctgcctactgcccttgccttccatttgacaacccggggcggggagccccacatgatcgtgtccaagcaggagcggggcaagtcactcctgttcaagacctccgccggggtgaacatgtgcaccttgatcgccatggacctgggcgagctgtgcgaagacaccatgacctacaagtgcccacggatcaccgagacagagccggacgacgtggactgctggtgtaacgccaccgagacatgggtcacctatgggacctgcagccagaccggagaacaccggcgtgacaagaggtccgttgccctagcgccccatgttggcctggggctggaaacccgcaccgagacctggatgtcatccgagggagcctggaagcagattcagaaggtcgagacgtgggccctccggcatcccggtttcaccgtgatcgccttattcctggcccacgcgatcgggaccagcatcacccagaagggaatcatctttatcctactcatgctggtgacgccgagtatggccatgcgctgcgtcgggatcggcaaccgagatttcgtagagggattgagcggcgccacttgggtggatgtcgtgttggagcacggtagctgcgtgaccaccatggccaaggacaagcccacgctggacatcgagctgttgaagactgaggttaccaaccccgctgtgctgcgcaagctctgtatcgaagcgaagatcagcaacaccacgaccgactccagatgccccacacagggcgaggcaaccctggtggaggagcaggacacgaatttcgtatgccgccggaccttcgtagaccgcggctgggggaacggctgcggactgttcggcaaggggagcctcatcacttgcgccaaattcaagtgcgtgacaaagttagagggcaagatcgtccagtatgagaacctgaagtactccgttatcgtgactgtccacaccggcgatcagcaccaggtggggaacgagaccacggagcacggcaccacggcgactatcacgccccaggcccccaccagcgagatccagctgacggattacggagcactgaccctggactgcagccctcggacgggcttggacttcaacgagatggtcctgttaaccatgaaggagaagtcctggctcgtgcacaagcaatggttcctggatctgccgctcccctggacgtccggggccagcacgtcacaggagacatggaacagacaagacctgttggtgaccttcaagacggcccacgccaagaaacaggaggtcgtggtgctcggcagccaggagggcgctatgcacacagctttaaccggggccaccgagatccagacgagcggtaccaccaccatcttcgcaggccacctgaagtgtcggttgaagatggacaaactgacacttaagggcgtctcctacgtaatgtgcaccgggagtttcaagctcgagaaggaagtggctgagacgcaacacggcaccgtcttggttcaagtgaagtacgaaggcacggacgccccctgcaagatccctttctccagccaggacgagcgcggggttatacagaacggccgtctgattactgcgaatccgatcgtgaccgacaaggagaaacccgtgaacatagaggccgagccgccctttggggagtcctatatcgtcgtaggggcaggcgagaaggctctgaagttgagctggttcaagaaggggagcagcatcggcaagatgttcgaggcgaccgcccgcggggcccggcgtatggcaatcctgggcgacacggcttgggacttcggctccatcggtggggtattcaccagcgtcgggaagctggtgcaccagatcttcggaactgcgtacggggtgctgttctcgggtgttagctggaccatgaagatcgggatcggcatccttttaacttggctcggcctcaactcgcgctcgacctccctgagtatgacctgcatagccgtggggatggtgaccttatacctgggagtcatggtgcaggctgactccgggtgcgtgatcaactggaaaggcagagaattgaaatgcgggagcggcatcttcgtcacaaatgaggtgcacacgtggaccgaacagtacaagtttcaggctgatagcccgaagcgtctcagtgccgcgatcggtaaggcctgggaggagggtgtgtgcggcatccggtcggctacccggctggagaacatcatgtggaagcaaatcagtaacgagctgaaccacatcctcctggagaatgacatgaagttcaccgtcgtggtaggggacgtaagcggtattctggcccaggggaagaagatgattcggccccagccaatggagcacaaatacagctggaagtcctggggtaaggctaaaataattggcgcagacgtgcaaaatacaactttcatcatcgacgggcccaatacacctgagtgccccgacaaccagagggcctggaacatctgggaggtggaggactatggtttcggggtattcactacgaacatatggttaaagctgagagactcatacacgcaggtgtgcgatcaccgcctgatgagcgccgcaatcaaggactccaaggctgtgcacgccgatatgggttactggatcgagagcgagaaaaacgagacctggaagctcgagcgagccagcttcatcgaggtcaagacctgcatatggccccgttcgcatacgttgtggtcgaatggcgtgctggagagcgagatgatcatccccaagacctacgggggtccggtctcccagcacaattatcgacccggctacttcacccagaccgccggcccctggcacttggggaagctcgagctggacttcaacctctgcgagggaactaccgtagtcgtggacgagaactgcggtaaccgggggccgtcgttacgaaccaccacggtcactgggaagattattcatgagtggtgctgccgttcatgtaccctgccgcccctgcggttcaagggggaggacggctgctggtacggcatggagatccgccccgtcaaggagaaggaggagaacctggtcaaaagcatggtcagcgccggcagcggcgaggtggacagcttctccttagggctcctgtgcatttcaatcatgatagaagaagttatgcggagtcgatggagcggtaagatgctgatgaccgggacgctcgctgtcttcctgctgcttaccatgggccaactcacttggaacgacctgatccggctctgcatcatggttggggccaatgcctccgacatgatgggcatgggcaccacgtatctggccctgatggcgaccttccgtatgcgcccgatgttcgcggtcgggctcttatttcggagactgacctcccgggaggtgcttctgctgaccgtcggcctgagcctcgttgcttccgttgaactgccaaattccctcgaggagctaggggacggcctagcaatgggaatcatgatgctcaaattactgacagacttccagagccaccagctgtgggccacgctgctgtccctcacgtttgtgaagaccgccttctccctgcactacgcatggaagacgatggccatgatcctgtccatagtctccctcttccccctgtgtctgtccacgaccagtcagaagaccacatggttgcccgtgcttctgggaagtttaggctgtaagccgctgaccatgctgctcatcaccgagaacaagatctgggggcgccggtcgtggcccctgaacgagggaattatggccatcggcatcgtgagcatcctgctttccagcctactgaaaaatgacgtaccccttgccggccctctgatcgcgggcggtatgcttatcgcctgctacgttatctccggcagctccgccgacctctcgctggagaaggccgcagaagtgagttgggaggacgaggcggagcacagcggggcctcacacaatattctggtggaggtgcaggacgacggcaccatgaaaatcaaggacgaggagcgcgacgacaccctaacgatcctgctgaaggccaccctcctggccatctccggggtgtacccgatgtcgatccccgcgaccttgttcgtctggtacttctggcagaagaagaaacaaaggagcggcgttctctgggacacgcccagcccgcccgaggtggagcgcgcggtcctagacgacggcatttatcggatactgcagcgcgggctgctcggccggagccaggtgggggtgggcgttttccaggagggggtgttccacacgatgtggcacgtgaccagaggcgccgtactgatgtaccagggcaagcgactggagccctcctgggctagcgtgaagaaggacctcatctcttatgggggcgggtggcggttccagggcagctggaataccggggaggaggttcaggtcattgccgtggaacccggaaagaatcctaaaaacgtgcagaccactccgggcaccttcaaaacttccgagggggaggtcggtgccatcgcgctggacttcaagcctgggaccagcggctcccccatcgttaaccgggagggcaagatagtcgggctgtacggcaacggagtcgtgacgacctccggcacctacgttagcgcaatcgcccaggccaaggcctcccaggaggggcccctcccggagatcgaagatgaggtcttcaggaagcggaacctgacgatcatggacttgcaccccggctccggcaagacccgcaggtacctccccgcgatcctgcgggaggccataaaacggaaactgcgcacgttggtgctggccccgactcgcgtggtcgcctccgagatggcggaggccctgaaggggatgcccatccggtaccagaccacggccgttaaatctgagcacactggcaaagagatagtggatctcatgtgccacgccaccttcaccatgcgcctgctgtcccccgtccgggtgcccaactataacatgatcatcatggatgaagcccactttacggacccggcgagcatcgccgcccggggttatatctctacccgggtgggtatgggggaagccgcagcgatcttcatgactgccacaccgcccggctctgtcgaggctttcccccagtccaacgccgtgatacaggacgaggagcgagacatcccggagcgaagctggaactccggatacgactggatcacggactttcctggcaagaccgtgtggttcgtccccagcattaagtccggcaacgacatcgcaaactgcctccgcaaaaacgggaagcgggtggtgcagctgagccgcaagaccttcgacacagagtaccagaaaacgaagaacaacgactgggactacgtcgtgaccaccgatatctccgagatgggcgcgaacttccgggccgaccgcgtcattgacccccggcggtgcttaaagcccgtgatcttgaaggacgggcccgagcgggttatcctggccggccccatgcccgtcaccgtggccagcgctgcccagcgtcggggccgcatagggcggaatccgaataaggaaggcgaccagtacgtgtatatggggcagcccctgaacaacgacgaggatcacgcacactggacagaggccaagatgctcctggacaacatcaacacccccgagggaatcatccccgcactattcgagccagaacgcgagaaatccgctgccatcgacggggagtaccgccttcggggcgaggccagaaagaccttcgtggagcttatgcgccgcggtgatctgcccgtgtggttaagctacaaggtggcgagcgaggggttccaatactccgatcgtcgctggtgtttcgacggcgaacgtaacaaccaggtcttagaggagaacatggacgttgagatctggaccaaggagggggaacgcaaaaagctgcgcccccgctggcttgacgcccggacgtatagcgaccccctggcactgcgcgaattcaaggaattcgccgccggccgccgctccgtgagtggcgatctaatcctggagatcgggaagctgccgcagcacctcacccagaaagcgcagaacgctttagacaatttggttatgctccataactccgagcagggtggtaaggcgtaccggcacgcaatggaggagctgcctgacaccatcgaaaccctcatgctactggccctcatcgccgtgctgaccggtggggtgacgctgttttttctgagcggacgagggctcgggaagacctctatcggcctactgtgtgtcatggctagcagtgccctgctatggatggctagcgtggagccccactggatcgccgcctccattatcttggagttcttcctaatggtgctgctgatccctgagccggaccgccagaggactccccaggacaaccaactcgcgtacgtcgtgatcggactgctctttatgatcctcaccgtcgccgctaacgagatgggactgctggaaacgaccaaaaaggatctaggtattggccacgccgcggcggagaaccaccaccacgcggccatgctggacgtcgacctgcaccccgccagcgcttggaccctctacgcggtggccaccacgatcatcacgccgatgatgaggcacactatcgagaacactacggctaacatctccctgaccgccatcgcgaaccaggcggccatcctcatggggctcgacaaggggtggcccatcagcaagatggacattggcgtacccctgctagccctcgggtgctactcccaggtcaaccccctgaccttaaccgcagcggtattgatgctggtcgcacattacgccatcatcggcccggggctgcaagccaaggccacgcgagaagcgcagaagcggaccgccgccggcataatgaaaaaccccacggtggatggcatcgtggccatcgacctcgaccccgttgtttacgatgccaaatttgagaagcaactggggcagatcatgctgcttatcttatgcaccagccagatcctgctcatgcgcactacctgggcgttatgtgagtccatcaccctggccaccggtcccctcacgacactgtgggaggggagccctggcaagttctggaatacgaccatcgcagtgtcgatggccaacattttccggggcagctacctggccggggcgggcctcgccttctccctgatgaagtcactcgggggcggtcggcgcgggactggcgcccagggggaaaccctcggcgagaagtggaaacggcagctcaaccagctgtccaagtccgagttcaacatctataaacgcagtgggatcatggaggtggaccggtctgaagcgaaggagggcctcaagcgaggggagaccaccaaacacgccgtctcccggggcacggccaagcttcgctggtttgtggagcgtaacctcgtgaagccagaaggcaaagtcatcgacttggggtgcggaaggggaggctggtcctactactgcgccggactcaagaaggtgaccgaagtgaaggggtacacaaaaggtggacccggtcatgaggagcccgtcccgatggccacctacggatggaacctggtgaagctgcatagcggcaaggacgtgttcttcacgccgcccgagaaatgcgacaccctcctgtgcgacatcggggagtcaagccccaacccgaccattgaagagggccggactctgcgcgtcctcaagatggtggagccgtggctgcgaggcaaccagttctgtatcaagattttgaacccctacatgccctcggtagttgagaccctcgagcagatgcaacgcaagcacgggggcatgctggtacgaaacccgctgagccggaactccacccatgagatgtactgggtgagctgcgggaccggcaacatcgtctccgcggtcaacatgaccagccggatgctcctgaatcgcttcaccatggcgcaccgaaagcccacgtacgagcgcgacgtggacctgggagcgggtacccgccacgtcgccgtggagcccgaagtagccaacctcgacatcattgggcagcgtatcgagaacatcaagaatgagcacaaatccacatggcactacgacgaagataacccctacaagacctgggcataccacgggagctacgaggtgaagccgtctggcagcgcgtcttccatggtgaacggggttgtacgcttgctgacgaagccctgggacgtgatccccatggttacccagatcgccatgaccgacaccactccattcggccagcaacgggtgtttaaagagaaagttgacacccgcaccccgaaggccaaacggggcaccgcccagattatggaggtcacggcgaagtggctctgggggttcctgagccgcaacaagaagccccgcatctgcacccgcgaggagttcacacggaaggtccgcagtaatgcggccatcggggccgtgttcgtggacgagaatcagtggaacagcgccaaggaggccgtcgaggacgaaaggttttgggacctggtgcatcgcgagcgggagctccataagcaggggaaatgcgcaacctgcgtctacaacatgatgggcaaacgagagaagaagctgggagagttcggcaaagctaagggatcccgggccatctggtacatgtggctcggtgcccgcttcttagagttcgaggcgctaggcttcatgaacgaggaccactggttttctcgggagaactctctgtcgggggtggagggcgagggactccacaagctgggctacatcctccgcgacatctccaagattcccggcgggaacctctacgctgacgacacggcaggctgggacacccggattaccgaagatgacctgcagaacgaggccaagatcaccgacataatggagcctgaacacgccctgctcgcgacgagcatcttcaagctgacctaccagaacaaggttgttcgggtgcagcggcccgctaaaaacggaacagtgatggacgtaatcagtagaagggaccaacgcggctcgggccaggttgggacctacggactgaataccttcaccaacatggaggcacagttaataagacagatggagtccgaggggatctttagcccttccgagcttgagacccccaacctcgcaaagcgggtgcttgactggctagaaaagcacggcatcgagcgcctgaagcggatggccataagcggcgacgactgcgttgtgaagcctatcgacgaccgcttcgcaaccgcgcttactgccctgaacgacatgggcaaggtacggaaggacatcccccaatgggaaccctcaaagggctggaacgactggcaacaagtgcctttctgctcacaccacttccatcagctgatcatgaaggacgggcgcgagattgttgtaccgtgccggaatcaagacgaactcatcggccgcgctcgggtgagccaaggggccggctggtccctgcgagagaccgcgtgcctgggcaagagctacgcccagatgtggcagctaatgtacttccatcggcgcgatctccggctggccgccaacgcgatctgctccgcggtgccggtagattgggtgcccaccagccgcaccacgtggtccatccacgcccatcaccagtggatgaccaccgaagacatgctctcagtctggaaccgggtgtggatcgaggagaacccctggatggaagacaagacccacgtctcgagctgggaggacgtgccctatctgggtaagcgcgaggatcagtggtgcggctccctgataggccttaccgcgcgcgccacgtgggcgagcaacatccaggtagccatcaaccaggtccgccgacttatcgggaacgagaactacttagactacatgacctccatgaagcggttcaagaacgagagcgaccccgagggggccctttggtga

SEQ ID NO: 24694 - RNA, 9879 nt, synthetic construct
  misc_feature 1..9879: note = derived and/or modified CDS sequence (opt11) from DENV-1__KC762653__SS-prME
  source 1..9879: mol_type = other RNA
agcgtcaccatgctgctcatgctgctacccacggccctcgccttccacctgaccaccaggggaggggaaccccacatgatagtgagcaagcaagagcggggtaagtcgttactctttaaaacttccgccggggtgaatatgtgtaccctaattgccatggacctcggcgagctctgcgaagacacgatgacctacaagtgcccacgcatcaccgagaccgagcccgacgatgtggactgttggtgcaacgccaccgagacctgggttacctacgggacctgctaccagaccggcgaacacaggcgggataagcggtctgtggcactggctccccacgtgggcctgggactcgagacccgcaccgagacttggatgtccagcgaaggtgcgtggcgccagatccagaaagtagagacctgggcactgcgacaccccgggttcaccgtgatcgccctattcctcgctcacgcgatcggtacgagtatcacccagaaagggatcatcttcatcttactgatgctagtgacgcccagcatggccatgcggtgcgttggcatcgggaatcgcgatttcgtcgagggactgtccggcgctacttgggtggacgtcgtgctggaacacgggagctgcgtgactaccatggcaaaggacaagcccacgctagatatcgaacttctgaagaccgaggtcacgaaccccgcggttctgcgtaaactttgtatagaggccaagatctccaacaccacgacggactcgcgctgccccacccaaggagaggccaccttagtggaggagcaggacacgaacttcgtttgccggcgcaccttcgtggaccgcggctgggggaacggctgcggactcttcggcaagggaagcctgatcacgtgcgctaagttcaaatgcgtgaccaaactggagggcaaaattgtccagtacgaaaatctcaaatactcagtgatagtgacggtccacactggggatcagcaccaggtcggaaacgagacaaccgagcatggtactacggcaactattactccccaggctccaacctccgaaatccaactgacggactacggcgcccttaccttggattgcagtccgagaaccggcctggacttcaacgagatggtcctattgaccatgaaagagaagtcgtggctggtccacaaacagtggtttctggacctccctttaccctggacgagcggcgcctccacaagccaggagacgtggaaccggcaggacctgctcgtcacgttcaaaacagcgcacgccaagaagcaggaggtggtggttctgggctcgcaggagggcgccatgcacaccgccctgacgggagccaccgaaatccagacttccggtaccactaccatcttcgcagggcacctcaagtgcaggctaaaaatggacaagctgactttgaagggaatgagctacgtgatgtgcaccggttccttcaaactggagaaggaggtggccgagacccagcacggaaccgtgctggtacaggtgaagtatgagggaactgacgccccctgcaagatccccttctcttcccaggacgagaagggggtgacccaaaacgggaggctaatcaccgctaacccaatcgtcaccgacaaggagaagcccgtgaacatagaggccgagcctcctttcggggagtcctacctcgtggtgggcgccggggagaaagccctgaagctgtcgtggtttaagaagggtagcagcataggcaagatgttcgaggcgacagcccgaggggccagacgcatggcaatactcggggacaccgcatgggacttcgggagcattggcggtgtttttacctccgttgggaagctgatccatcagattttcggcaccgcatacggggtactgttcagcggcgtgagttggactatgaagataggaatcgggatactcctgacctggctgggcctaaactctcgctccacaagtctgtccatgacgtgcatcgccgtcgggatgatcacgctgtatctcggcgtcatggttcaggctgacagtgggtgcgtgatcaactggaaggggagggaactgaagtgcggttccggcatcttcgtcacaaatgaagtgcacacatggaccgagcagtacaaattccaggcagacagcccgaagcggctgagcgccgccatcggaaaggcttgggaggagggggtatgcggcatccggtccgctacacgcctcgagaacataatgtggaaacagatcagcaacgagctgaaccacattctcctcgagaatgacatgaagttcacggtcgtggtcggggaggtcaacggcatcctggcccagggcaaaaagatgatccggccacagcctatggagcacaagtactcctggaagtcctggggaaaggccaaagtgatcggcgcagacgtgcagaacaccacctttattatcgacgggcccaacaccccggagtgtcccgacaaccagcgcgcgtggaacatctgggaggtcgaagattacgggttcgggatctttacgaccaatatctggctgaagctccgggactcctatacccaggtatgcgaccaccgcctgatgagcgcggctataaaggactccaaggccgtccatgccgatatggggtactggatagagagcgaaaagaacgagacatggaaactggcccgggcctccttcatcgaggtcaagacgtgtatttggcccaagtcccacaccctctggtccaatggtgtgctggaaagcgaaatgatcatcccaaaaatatacgggggcccgatttcccagcataactaccgccccgggtatttcacacagacagcgggcccctggcacttaggcaagctcgaattggacttcgagctgtgcgagggaacgaccgtagttgtcgacgagcattgcggcaaccgtggtccgtccttacgcaccacgacggtgaccgggaagatcatccacgagtggtgctgccggagttgcaccctgcctcccctgcgcttcaagggagaggacggctgctggtacggaatggagatacggcccgtaaaggagaaagaggagaacctcgtcaagagtatggtgagtgccggcagtggcgaggtcgatagcttcagcctggggctgctttgcatcagcattatgatcgaggaagtgatgcgatcccgctggtctcggaagatgttaatgaccggcactctggccgtattcctccttctgactatggggcagcttacctggaacgacctgatccggctgtgcatcatggtcggcgcgaacgcctccgacaagatggggatggggactacctacttggccctgatggccacattccgaatgagaccgatgctggccgtgggcttgctgttccgtcgcctaaccagccgggaagtactcttgctcaccgtaggtctctcgttagtcgccagcgtcgaactgcctaattcccttgaggaactgggtgacgggttagccatgggaatcatgatgctgaagctgctgacggactttcagagccaccagctctgggccgcactgctttccctcaccttcgtgaagacgacgctgagcctgcattatgcctggaagacgatggccatgattctgagcatcgtgagcctatttcccctatgcttatcgaccaccagccagaaaaccacatggctgcccgtcttactcggctccttagggtgcaagccgttaaccatgttcctgattaccgagaacaaaatctggggccgcaagagctggcctctgaacgaggggattatggccgtcggcatcgttagcatcctcttaagctcccttctcaagaacgacgtccctctcgcgggaccgctgatcgccggcggcatgttgatcgcctgctacgtgatatccggatcgagtgcggacctcagcctggagaaagccgcggaggtgtcatgggaagaggaggccgaacacagtggggcctcacacaacatcttggtcgaggtgcaggacgacgggaccatgaaaattaaggacgaggaacgggacgataccctcaccatactgctgaaggcaactctcctggcgatctctggcgtatatccgatgtccatccctgcaacgctgttcgtttggtacttctggcaaaagaagaagcaacgcagcggagtgttatgggacacccccagcccaccagaggtggagaaggccgtcctagacgacggtatctaccgtatcctgcagcgcggcttactcggcaagtcacaggtgggcgtaggggtctttcaggagggcgtttttcacactatgtggcacgtaacccgcggggccgtcctcatgtaccagggcaagcgcctggaaccgtcctgggccagcgtgaaaaaggacctaatctcgtacggtggtggctggcgattccagggcagctggaacaccggcgaggaggtgcaggtcatagccgtggagccggggaagaaccccaaaaacgtgcagacggcgcccggaacgttcaaaactcccgagggcgaggtcggggccatcgctctggacttcaagccgggcacctccgggagccccatagtgaatcgggagggtaagattgtagggttatacggaaacggcgtcgtaactacttccggcacctacgtgagcgccatcgcacaggctaaagccagccaagaaggcccgctccccgagatcgaggacgaggtttttcggaagcgcaacctaaccatcatggacctgcatcccgggagtggcaagactcggcgctatctcccggccatcgtccgggaggcaattaagcgcaagctgagaacgctggtactcgctcccactcgcgtcgtggcctccgagatggccgaggcactcaagggcatgcccattaggtaccagaccactgccgtgaaaagtgagcacacgggaaaagagatcgtcgatctcatgtgccatgctaccttcaccatgcgcctcctgtcgccggtccgcgtaccgaattacaacatgatcatcatggacgaggctcatttcaccgaccccgccagcatcgccgcccggggctatataagcacgcgagtcgggatgggcgaggcggccgccatattcatgactgccactccacccgggtccatggaggcctttccgcagagcaacgcggccatccaggacgaggaacgcgacatacccgagaggtcgtggaactctggttacgactggattaccgacttccccggcaagacagtttggttcgttccctctattaagagtgggaatgacatcgccaactgcttgcgcaaaaacggcaagcgcgtaatccagctatccaggaagacttttgacaccgagtaccagaagaccaagaacaacgactgggattacgtagtaacgaccgacatcagcgaaatgggtgcgaactttcgggcagaccgggtcatagatccgaggaggtgccttaaaccggtgatactgaaggatggcccggagcgcgtcattttagccggtcccatgccggtcacagtcgcatccgcggcccagcgtcgcggccggatcgggcgaaaccaaaacaaagagggggaccagtacatttacatgggccagccccttaacaacgatgaggaccacgctcactggaccgaggccaagatgctgctcgataatattaacacgcccgaagggatcatccccgctctgtttgagccggaacgggagaaatctgccgccatcgatggcgaatatcgcctgcgcggagaagcgcgcaagacatttgtcgaacttatgcgacgaggagatctgcctgtttggctctcctataaagtggccagcgagggcttccagtacagtgaccgccggtggtgcttcgatggggagaggaacaaccaggtcctcgaagagaacatggacgttgagatctggaccaaggagggcgagagaaagaaattacgcccccggtggctggacgccagaacctacagcgacccgttggcgctgcgtgagttcaaagagtttgccgctggacgcagaagcgtcagcggcgatttgattctcgagatcggtaagctgcctcagcatctgacgcaacgggcccaaaatgcccttgacaatctggtcatgctgcataattcagaacagggaggaaaagcgtacaggcacgccatggaggagctccccgacactattgagaccctgatgctgttagccttgatcgccgtgctgaccggcggcgtgaccctcttcttcctgagcgggagaggcctgggcaagacctcgatagggctcctatgcgtcatggcttccagcgccctgctctggatggcgtccgtggaaccccactggatcgccgcctcgatcatccttgagttcttcctgatggtgctattaattccggagcccgatcgacagagaacaccccaggacaaccaattggcctacgtcgttataggcctcttattcatgatcctgaccgtggccgcgaacgagatggggctcctggagacgacgaaaaaggacctgggaatcgggcacgccgccgcagagaaccaccatcatgccgctatgcttgacgtggatctacaccccgcctccgcctggactctgtatgccgtggccaccacgatcatcacgccaatgatgaggcacaccatcgagaatactaccgccaacatctcgctcacggccatcgccaaccaggctgcaatcctgatgggtctggacaagggctggcccatctctaagatggacatcggggtgcctttgctggccttgggctgctatagccaggtcaatcctctcaccctcactgccgctgtgctgatgcttgtggcccactacgcgatcatcgggccgggactgcaggcaaaagccacgcgcgaggcccaaaagcggacggccgcgggaatcatgaaaaacccgaccgtcgacggtatcgtggccattgacttagatcccgtggtctacgacgccaagttcgagaaacagttgggccagatcatgctgttaatcctctgcacctcacagatacttctaatgcgcaccacgtgggccctctgcgagagtatcaccctcgctacggggccactgacgactctgtgggagggttcgccggggaagttttggaacaccaccatcgcggtgagcatggccaacattttccggggctcctacctggccggcgcggggctcgcattctccctaatgaagtccctgggcggcgggcgccgcggtaccggcgcacagggcgagacgctaggtgaaaagtggaaacgacaactaaaccagttaagtaagagcgagttcaatacctacaagcgctccggcataatggaagtggataggtccgaggccaaagaggggctgaagcgcggcgagaccaccaagcacgccgtctcccgcgggacagccaaacttcgctggttcgtggagcggaacctcgttaagccagagggaaaggtcatcgaccttggctgcgggcgtggagggtggtcgtactactgcgcgggtctgaagaaggtgacggaggtgaagggctacaccaagggcggccccggccacgaggagccgatcccaatggccacttacggctggaacctcgttaaacttcattccggtaaggatgtgttctttacgccgcccgagaagtgcgacaccctcctgtgcgacatcggagagtcgtcccccaatccgaccattgaggaagggcggaccctgcgcgtgctgaagatggtcgagccctggctccggggcaatcagttctgcatcaaggttctgaacccctatatgccatctgtgatcgagacactagagcagatgcagcgcaagcacggcgggatgcttgtacggaaccctctgtctcgtaattccacgcacgagatgtactgggtatcctgcggcaccgggaacattgtttcggcggtcaatatgacctccaggatgcttcttaaccgttttaccatggcccaccggaagcctacgtatgagcgcgatgtggacctgggagcgggcacccggcacgtggcggtcgagcccgaagtggccaacctggatataatagggcagcgaatcgagaacattaaaaatgagcacaagtccacctggcattatgacgaggataatccctacaagacgtgggcctaccacggttcctatgaagtgaagccttccggctccgcttcgtccatggtcaatggcgtggtgcggttgctaactaagccttgggacgtcatccccatggttacccagatcgccatgaccgacacgacacctttcgggcaacagcgggtcttcaaggagaaggtggatacccgtacaccgaaggcgaagaggggcaccgcacagatcatggaggtcacggcccgatggctgtgggggttcctttctcggaataagaaacctcgcatctgcacacgcgaggagttcaccaggaaagtccgaagcaacgccgcaatcggggccgttttcgttgacgaaaatcagtggaactcagctaaagaagccgtcgaggacgaacgcttctgggatctggtgcaccgggagagggagctgcacaagcagggtaagtgtgcgacctgtgtgtacaacatgatggggaaacgcgagaagaagctcggcgagttcggcaaggcgaaaggcagccgcgccatatggtacatgtggctgggcgccaggttcctggaatttgaggccctagggttcatgaacgaggaccactggttctcgcgcgaaaattccctctccggcgtagagggggagggcctgcacaagctcgggtacatcttacgggacatcagcaagatcccgggaggtaatatgtatgcagacgacacggccggatgggacactcgcataaccgaggacgatctgcaaaacgaggccaagatcaccgacatcatggaaccggagcacgcgttgctggccacttcgatctttaaactcacataccaaaacaaggttgttcgggtacagagacccgcaaagaacggaaccgtcatggacgtaatcagtcggcgcgaccagcgggggtcaggccaagtgggcacctatgggcttaatacgttcacaaacatggaggcgcaactgatccggcagatggagagcgagggcatcttcacccccagtgaactggaaactcctaatctcgcagagcgggtcctggactggctggagaagcacggcattgaacgtctcaagcgcatggctatcagcggcgacgactgcgtggtcaaaccgatcgacgatcggttcgcgacggctttaacggcgctgaacgacatgggaaaggtgcgaaaggacatcccccagtgggagccctccaagggctggaacgactggcaacaagtccccttctgcagccaccacttccaccagttgataatgaaagatggacgggagatcgtcgtaccgtgtcgcaatcaggacgagctggtggggcgggcccgcgtcagtcagggcgccgggtggtcattacgggagaccgcctgcttaggtaagtcctatgcacagatgtggcagctgatgtatttccacagacgcgaccttcgactcgccgccaacgccatctgctccgccgttcccgtcgattgggtcccgacatcccggacgacctggtccatacacgcgcaccaccaatggatgacaactgaggacatgttaagtgtgtggaaccgagtgtggatagaggagaacccctggatggaagataagacacatgtctcctcgtgggaggacgtgccgtatctcgggaagagagaagaccagtggtgcggctcactcatcggcctaacggcccgagcaacctgggctactaacattcaagtggccataaatcaggtccggcgcctgatcggaaacgagaactacctcgactatatgacttctatgaaacgctttaagaacgagtccgaccctgagggcgcgctttggtga

SEQ ID NO: 24695 - RNA, 9879 nt, synthetic construct
  misc_feature 1..9879: note = derived and/or modified CDS sequence (opt11) from DENV-1__KC762640__SS-prME
  source 1..9879: mol_type = other RNA
agtgtcaccatgctgctcatgcttctgcccactgctctcgcctttcacctgaccacccggggcggggaaccccatatgatcgtgtccaagcaagagaggggcaagagcctcttattcaaaacctccgccggggtgaacatgtgcaccctgatcgctatggacctgggcgagttatgcgaagacactatgacctacaagtgcccccgcatcaccgagaccgagcccgacgacgtggactgctggtgcaacgctaccgagacctgggtgacttacggaacctgctcacagaccggggaacaccgtcgtgataaacgttccgtggccctagcgccccacgtgggtctggggttggagacccgcacggagacctggatgagcagtgagggcgcgtggcggcagatacaaaaggtggagacgtgggccctgcgccatccggggttcaccgtgatcgccctgttcctcgcccacgccatcgggaccagcattacccagaaggggatcattttcattctgctgatgctcgtgacgccctcaatggccatgcggtgcgttggcatcggcaaccgcgacttcgtggagggcctgagcggagccacctgggtggacgtcgtgcttgagcacggctcctgcgtaaccaccatggccaaggacaagcccacgctggacatcgagctgctgaagaccgaagtcaccaaccccgcggtgctccggaagctgtgcatcgaggcaaaaatctctaacaccacgacggactcccgctgccccactcagggcgaggccaccctcgtagaggaacaggacacgaacttcgtctgcaggcgcaccttcgtggaccggggttgggggaatgggtgcggccttttcggaaaggggagcctgatcacgtgcgccaagttcaagtgcgtcaccaagctggaaggaaagatcgtccagtatgagaacttgaaatactccgtcatcgtaacggtccacaccggcgatcagcaccaggtcgggaacgagaccaccgagcacggcaccacggccaccattacgccccaggcccctacctcggagatccagctgacggactacggggcgcttaccctcgactgtagtccccggaccggcttagacttcaacgaaatggtgctcctcaccatgaaagagaaatcctggcttgtgcacaagcagtggttcctagacctgccgctgccgtggacgtccggggcaagcaccagtcaggaaacctggaaccggcaggatctgttggtcacgttcaaaacggcccacgcaaagaagcaggaagtcgtagtgctgggctcccaggagggcgcaatgcacaccgcgttaaccggggcaaccgagatccagacgtcaggcaccaccacgatcttcgccgggcatctcaagtgccgcctgaaaatggacaagctgacgctaaagggcgtttcctacgtgatgtgtaccggatccttcaaactggagaaggaggtggccgaaacccagcacggcaccgtcctggtccaggtgaaatacgagggcactgacgccccctgcaagataccattctcaagccaggacgagaaaggggtaactcagaatggccggctaatcacagcgaacccgatcgtaaccgacaaggagaagcccgtgaatatcgaggctgaaccaccattcggggagagttacttggttgtgggagccggagaaaaggccttaaaactgagctggttcaagaaggggtccagcatcgggaagatgtttgaggcgacggcgcgcggagcgcggcgcatggccatcctcggcgacaccgcctgggactttggctccatcggcggcgtgttcacttccgtcggtaagctaatacaccagatcttcggcaccgcgtatggggtgctgttcagtggcgtgagctggacgatgaagatcggtatcggcatactacttacatggttaggcctcaactcccgctcaacctccctgagcatgacctgcatcgccgtcggtatggtaacgctgtaccttggagtaatggtccaggccgattccggatgcgttatcaattggaagggcagagagctgaagtgtgggagcggcatattcgtaaccaacgaggtccacacatggaccgaacagtacaagttccaggccgacagcccgaagcgcttaagtgctgcaatcggcaaggcctgggaggagggggtatgcggcatccgaagcgccaccaggctcgagaacataatgtggaagcagatctccaacgaattgaaccacatcctgttggagaatgacatgaagtttaccgtggtcgtgggggaggtgaacggcatcttagctcaggggaagaaaatgatccggcctcagcccatggagcataaatacagctggaagtcctggggcaaggctaaggtcattggcgctgacgttcagaacactacgttcataatcgacgggcccaacacccccgaatgtccggataaccagcgcgcctggaacatctgggaggtggaggactacggtttcgggatctttacgactaacatctggctgaagctccgggactcctacacacaggtatgcgaccaccgccttatgtccgccgccataaaggacagtaaggcggtccacgcggacatgggttactggatcgagtccgagaagaacgagacctggaagttggcccgggcaagtttcatcgaggttaagacgtgcatatggcccaagtcccataccctgtggtccaacggcgtcctggagtccgaaatgattatccccaaaatctacgggggtccaatcagccagcacaactaccgcccagggtactttacccagaccgccgggccctggcatttagggaagttggagctcgacttcgaactatgcgagggcactaccgtggtggtcgatgagcactgtggcaacagagggccgtcactccgcaccaccacggtgaccggcaagatcatccacgagtggtgctgtcggagctgcacattgcctccgttacgattcaagggggaggacggctgctggtacggtatggagatccgtccagtgaaggagaaggaggaaaacttagttaaatccatggtgagtgctggcagcggcgaggttgactctttctctctggggctgctctgcatttccataatgattgaggaagtcatgcgcagccggtggtcgagaaagatgctgatgaccggcacgctggccgtgttcctccttttgaccatggggcagctcacctggaacgacctgatccggctttgcatcatggtgggggctaacgccagcgacaaaatggggatgggcacgacctaccttgccctgatggccaccttccgcatgcgcccgatgttcgccgtcggcctcctgttccggagattgacaagtcgggaggttctgctcttaaccgtcgggctgagtctagtagcatccgtagaattgcctaactcactggaggaactcggcgacggtctggccatgggaataatgatgttaaagctcctcacggatttccagtcgcatcagctctgggccgcactcctgtcgcttaccttcgtcaagaccaccctctccctacactacgcgtggaagacgatggccatgatactgagcatcgtgtccctctttcccctgtgtctgagcacaacctctcagaaaaccacgtggttgcccgtcctgcttggcagtctggggtgcaagccgctgacgatgttcctgatcaccgagaacaagatctggggccgaaagtcctggccgctcaatgaggggatcatggctgtcgggatcgtgagcatcctgctgagctccctcctgaagaacgacgtgccgctggcgggtccccttatcgccggtggcatgctgatcgcctgttatgtgatcagcgggtccagcgcagacctgtcccttgagaaggccgcggaggtgagctgggaagaggaggccgagcattccggcgcctcgcacaacatcctggtggaagtccaggacgacggtactatgaagatcaaggacgaagagagagacgacactctgactatcctcctgaaagccaccctgctcgctatcagtggcgtgtacccgatgagcatccccgcaacactcttcgtgtggtacttctggcagaagaagaagcagcgttcgggggtcctgtgggacacccccagcccgccggaggtggaaaaggccgtgctggatgacggaatctaccggatcctccagaggggcctgctgggtaagtctcaggtgggcgttggggtgttccaggagggtgtttttcacaccatgtggcatgtgacccgaggggctgtgctcatgtaccaggggaagcgcctggagccgagctgggcgtctgtcaagaaagacttaatatcatacggtggtggttggcggttccaggggtcctggaacaccggcgaggaggtccaggtgattgccgtcgagcccgggaagaacccgaagaacgtgcagaccgcgcccggtacgttcaagacccccgaaggcgaggttggcgccatcgccctcgacttcaagcccggcacctcagggtcccccatcgtcaacagggaggggaagatcgtcggcctgtacggtaacggcgtggtcactacgagcggtacgtacgtctccgccatcgcccaggcgaaggcctcccaggagggcccgctgcccgaaatcgaggacgaggtgtttcggaaacgcaatctcaccatcatggacctgcaccccgggagcggcaagacccggcgctacctgccggccatagtccgggaagccataaagcgcaaactccggacgctcgtgctggctcccaccagagtggtcgcctcggaaatggccgaggccttgaagggcatgcccattaggtaccagaccacagccgtaaagtctgagcacactgggaaggagatagtggatctaatgtgccatgcgaccttcaccatgcgccttttatcccccgtccgcgtgccaaattacaacatgatcatcatggacgaggcccacttcaccgaccccgccagcatcgccgctcggggttacatctcgacgcgagtgggaatgggcgaggctgccgccatcttcatgaccgcgacgccgccagggagcatggaagccttcccgcagtccaacgccgccatccaagacgaggagcgggacatccccgagcgctcgtggaactctggctacgattggataaccgactttcccgggaagacggtctggttcgtgcccagcatcaaatccgggaacgacattgccaattgccttaggaagaacggcaagcgcgtgatccagctttcgagaaagacttttgacacagagtaccaaaagaccaagaataatgactgggactacgtcgtgacaaccgacatctccgagatgggcgccaacttccgcgcggaccgggtgatcgacccacgccggtgtctcaaaccagtcatactgaaggacggtcccgagcgcgtgattttggccgggcccatgccggtgaccgtggccagcgccgctcaacggcgcggcagaatcggccgcaatcaaaacaaggagggcgaccaatacatctacatgggtcagccgctcaacaacgacgaggaccacgcgcactggaccgaggccaagatgttgctggacaacatcaacacgcccgagggcatcatccccgctctcttcgagccggagcgggagaagtccgcggccatcgacggcgagtaccgcctgcgcggagaggctcgcaagacattcgtggagctaatgcgtcggggcgacctccccgtctggctgtcctacaaggtggccagtgaggggttccagtatagcgaccgtaggtggtgcttcgacggggagcgaaacaaccaggttttagaggagaatatggatgttgagatctggaccaaggaaggagaacgaaagaagttgcgcccccggtggctggacgcccgcacctacagcgacccgctggcactccgggagttcaaggagttcgccgcgggaaggcggtccgtgtccggcgacctgatactggagatcggcaagctcccacagcatttgactcagcgcgcccagaacgcgctcgataacctggttatgctgcacaattctgagcagggcggcaaagcctatcggcacgcgatggaggagctgcccgacaccatcgagaccctcatgttgctggccctcatcgccgtccttaccggtggcgtaaccctcttcttcctgtcggggcgcggactgggcaagacgagcatcggattgctatgcgtaatggcaagtagtgccctgttatggatggcgagcgtcgaaccccattggatcgcggcctccatcatcctcgagttcttcctgatggtgctgctcatacccgagcccgatcggcagcgcacaccccaggacaaccagttggcctatgtggtgatcggcctcctcttcatgatcctgaccgtggcagcgaacgagatgggcctgcttgaaaccacaaagaaagacctgggcatcggacacgccgccgcagagaaccatcaccatgccgctatgctagatgttgacctccaccctgccagcgcttggactttatacgctgtcgcgactaccataatcacgccgatgatgcgtcacaccatcgagaacaccaccgcgaatatctccttaaccgctatcgccaaccaggccgcgatacttatgggcctggacaagggctggcccatcagcaagatggatatcggggtgccactgctcgccctgggctgctactcccaggtgaaccccctgaccctcacggccgccgtcctgatgctggtggcccactacgcgatcatcgggccgggcttgcaagccaaggctacccgcgaggcccagaagcggacggccgcggggatcatgaagaaccccaccgtggacggcatcgtcgccattgacctggaccccgtcgtgtacgacgccaagttcgaaaagcagctgggccagattatgctcctgatcttatgcacatcgcaaatcctcctgatgcggaccacctgggcactgtgtgaatccatcacgctcgccaccgggcccctaaccacgctgtgggaggggagcccagggaagttctggaatactacgatcgccgtctccatggccaacatattcaggggcagctacctcgccggggccggcctggcgttctcactcatgaagtccctcgggggcggccgccgcggtaccggcgcacagggcgagacgctgggggagaagtggaagcggcagctgaaccagctcagtaagtccgagttcaacacctacaaacgcagcggcattatggaggttgaccgttccgaggccaaggaggggctaaagcggggtgagacgaccaagcacgccgtgagccgggggacggccaagctgcgctggttcgtcgagcgaaacttggtgaagcccgagggtaaggtgatcgatctcggctgcgggcgcggcggatggagctactattgcgccggcctgaaaaaggtcaccgaagtgaaggggtacaccaagggcggccccggacacgaagaacctatcccgatggccacttacggttggaatctagtgaagctgtacagcgggaaagacgtcttcttcacgccgcccgagaagtgcgatactctgctgtgcgacatcggcgaatccagcccaaatccgaccatcgaggaggggcggaccctccgcgtgctgcggatggtggagccatggctgcgcggcaaccagttctgcataaaggtcctcaacccctacatgccctccgtgatcgagaccctggagcagatgcagaggaagcacggcgggatgctggtgcggaatccgctgagccggaacagcacgcacgaaatgtactgggtcagctgcggcaccgggaacatcgtctccgccgtgaacatgacctcacgcatgttactgaaccggttcaccatggcccatcgcaagcccacgtatgagcgggacgtagacctcggtgccggcacacgccacgtggcggtggagcccgaggtggccaaccttgagatcatcgggcagcggatagagaatatcaagaacgagcacaaatccacctggcactacgatgaggataacccctacaagacctgggcctaccacggcagctacgaggtgaagcccagtggtagcgcatcaagcatggtaaacggcgttgtgcggttattgacgaagccctgggacgtcatccccatggtgacacaaatcgcgatgactgacacgacccccttcgggcagcagcgcgtgtttaaggaaaaggtcgacacccggacccccaaagcgaagcgcggcactgcccagatcatggaggtgactgcacgatggctgtgggggttcctgtcgcgtaacaagaagccccggatctgtacgcgcgaggagtttactcgtaaggtgcgctccaacgccgcgatcggggccgtcttcgtggacgagaaccagtggaactccgcaaaggaggccgtggaagacgagagattctgggacctcgtccatcgtgagcgggagctgcataagcagggcaagtgcgcgacatgcgtgtacaacatgatggggaagcgggaaaagaagctgggcgagtttggcaaagcgaagggctcccgggctatctggtacatgtggctcggcgctagattcctggaatttgaggccctgggtttcatgaacgaggaccactggttcagccgcgagaactccctgtcaggtgtggagggggaaggcctgcacaagctggggtatatcctaagagacatttctaaaatccccggcggcaacatgtacgccgacgacacggcggggtgggacacccggatcacggaagacgacctgcagaatgaggcgaaaatcaccgacataatggagcctgagcacgccctgctcgccacgagcatcttcaagctgacctaccaaaacaaggtcgtacgcgtgcagcggccagccaagaacggcaccgtcatggacgtgatctcccgccgcgatcagcgggggagcggccaagtgggcacttacgggctgaacacgttcactaacatggaggcccagctcatcagacagatggagtccgagggtatcttcactcccagcgagctagagacccctaacctggccgagcgggtccttgactggctggagaaacacgggatcgagcgcctgaagcggatggcgatctccggcgacgactgcgtggtgaagccgatcgatgaccgtttcgccacggcacttaccgcgttaaacgacatgggcaaagtccgaaaggacatcccccagtgggagcccagcaaggggtggaatgactggcagcaggtcccattctgttcccaccacttccaccagctgatcatgaaggacggcagagagatcgtagttccgtgccgcaatcaggatgaactcgttgggcgcgcccgggtgagccaaggcgccgggtggtccctgcgcgagaccgcctgcctgggcaagtcttacgcgcagatgtggcagttgatgtacttccaccggcgcgacctgcggttggccgccaacgccatctgcagcgccgtccccgttgactgggtgccaacttcccgcacgacctggagcatccatgcgcaccaccaatggatgaccaccgaagacatgctctcagtctggaatcgtgtttggatcgaagagaacccctggatggaagacaagacccatgtgtcgtcatgggaggacgtgccgtacctgggcaagagagaggaccagtggtgcggctcgctgatcggcctcacagcccgggcaacctgggccaccaacatccaagtggccatcaaccaggtgcgtcgcctgatagggaacgaaaactatctagactacatgacctccatgaagcggttcaagaacgagagcgaccccgagggcgcactctggtaa

SEQ ID NO: 24696 - RNA, 9879 nt, synthetic construct
  misc_feature 1..9879: note = derived and/or modified CDS sequence (opt11) from DENV-1__KC762645__SS-prME
  source 1..9879: mol_type = other RNA
agcgtgaccatgctgctgatgctcatgccgaccgcgctggccttccacctcaccacccggggaggtgagccccatatgatcgtgagcaagcaggagcggggcaagagcctgcttttcaagacctctgcaggggtgaacatgtgtaccctaatcgccatggacctgggcgagctgtgtgaggacacgctcacctataagtgcccccggatcaccgaggccgagccggacgacgtggactgctggtgcaacgcaaccgacacatgggtaacctacgggacctgctctcagaccggtgagcaccggcgcgacaagcggagtgtggccctggcgccgcacgtaggcctggggctcgagacgcgcaccgaaacatggatgagctcggagggcgcgtggaggcagattcagcgggtagaaacctgggccttgcggcaccccgggtttacggtgatcgctctattcctggcgcacgcaatcggaaccagcatcactcagaaagggataatcttcatattgctgatgctcgtgaccccatccatggcgatgcgctgcgtcggcatcggcagccgggatttcgtggagggactgtcgggcgccacgtgggttgacgtcgtgctggagcacgggtcttgcgtaacgaccatggcgaaagacaagcctaccttagatatcgagctgttgaagacggaagttaccaatcctgcggtgctccgcaagctatgcatagaggccaagatctccaacaccactacggactcgaggtgcccgacccaaggcgaggccactctcgtcgaagagcaggacgccaacttcgtctgccgtcggacattcgtggaccgcggctgggggaacggctgtgggctgttcggcaagggaagcctgatcacgtgcgccaagttcaaatgcgtgacaaagctggagggcaaaatagttcaatacgaaaacctcaaatactccgtgattgtgacagtccacaccggcgaccagcaccaggtggggaacgagtccacggagcacggcaccaccgcgaccatcacgccccaggcccccactacggagattcagctgacagattacggcgccctgaccctcgattgctctcccagaacaggcctggacttcaatgagatggtcctgctcaccatgaaggaaaagtcttggctggtgcacaagcagtggttcctggatctccccctgccctggacgagtggggccagcaccagtcaggagacgtggaaccgccaagacctgttggtgacgttcaagaccgcgcatgcgaagaagcaggaagtcgtagtcctcggcagccaggagggagccatgcataccgctctgacgggggccaccgagattcaaaccagcggcaccacgaccatcttcgccgggcacctcaaatgccggttgaaaatggataagctgaccctcaagggcatgagctacgtcatgtgcaccgggtcctttaagctggagaaggaggtagcggaaacgcaacacggcacagtgctggtccagatcaaatacgagggcacagacgcaccctgcaaaatccccttcagcacccaagacgagaaaggggtgacacaaaatggtcgcttaatcactgccaacccgatcgtaactgacaaggagaagcccgttaacattgaggccgagccgcccttcggcgagtcttacatcgtaattggcgcgggcgaaaaggcgctaaagctgagctggttcaaaaagggttccagcatcggcaagatgttcgaagccacagcccgcggggcacgccggatggcgatactgggagacactgcctgggacttcggctccattggcggcgttttcacatctgtcgggaaactcgtgcatcagatcttcggcaccgcctatggcgtgctgttctcaggcgttagctggaccatgaagatcgggatcggcgtgctgctaacgtggctggggctgaacagcaggagcacaagtttatcaatgacctgtatcgctgtggggctggtcaccctttacctcggcgtgatggtgcaggctgattccgggtgcgtaataaactggaaaggacgagagctgaagtgcgggagcggcatcttcgtaaccaacgaggtgcacacgtggaccgagcagtacaagttccaggcagatagcccgaaacggctttccgctgccataggcaaggcctgggaagaaggggtatgcggcatccgcagcgccacgcggctcgagaacatcatgtggaagcagatctccaatgagctgaaccacatcctgctcgagaacgacatgaagtttacagtggtagtcggtgacgtggcgggcatcctggcccaagggaagaagatgatccgcccccagcctatggagcacaaatacagctggaagtcctggggcaaggccaagatcatcggggccgacgtgcaaaacacgacctttatcatcgacgggcccaacacccctgagtgccctgacgaccagagagcgtggaatatctgggaggtggaggactacggattcggcatcttcaccacgaacatatggttgaaactccgagactcttacacccaggtgtgcgaccaccggctgatgtccgccgccattaaggacagcaaggccgtgcacgctgacatggggtattggatcgagtccgagaaaaacgaaacctggaagctggcccgcgccagcttcatcgaggtaaagacctgcatctggccaaagtctcacacgctttggagcaacggggtgctggagtcagagatgatcatcccaaagatctacggaggtccgatcagccagcacaactaccggcccgggtacttcacccagactgcaggtccttggcacctggggaagctcgagctggacttcaacctctgcgaaggaaccacggtcgtcgtggatgagcactgtggtaaccgcgggccgtccctccggaccaccaccgtgacgggcaagatcatacacgagtggtgctgccgttcttgcaccctgccgccactgcggtttcgcggcgaggacggctgctggtatgggatggagatccggcccgtcaaggagaaggaggagaacttggttaaatccatggtcagcgccggctcgggcgaggtcgactccttcagcctgggactgctctgcatctcaattatgatcgaggaggtgatgagaagccgatggtcacggaagatgttgatgaccgggactctggccgtgttcttcctcctgatcatgggccagttgacgtggaacgacctcatccgcctgtgtatcatggtaggcgcgaacgccagcgatagaatggggatgggtaccacctacctggccctcatggcgaccttcaagatgaggccgatgttcgcagtaggtctgctgttccggcgcttgacgtcccgggaggtgctactgctcaccattggtctgagcctggtcgcgtccgtggagcttcccaactccctggaagagctgggcgacgggctggccatggggatcatgatcctgaagcttctcaccgacttccagagtcaccagctgtgggccactctgcttagcttgacgttcatcaagaccactttttccctacactacgcctggaaaaccatggcgatggtactcagcattgtgtccttgtttcccctgtgcctaagtacaacctcccagaaaaccacctggttacccgtgttgctcggcagcttgggatgcaagccgttgacgatgttcctcatcgccgaaaacaagatctggggccgcaagtcctggccgctgaatgaagggatcatggcagtcggaatcgtcagcatcctgctcagctccctgctgaaaaacgacgtacccctcgccgggcccctgatcgcggggggaatgctgatcgcgtgctacgtaattagcgggagcagcgcagacctatcccttgagaaggccgccgaagtaagctgggaggaggaggccgagcactctggcgctagccacaacatcctggtggaggtccaagacgacgggactatgaagataaaagacgaggagcgggacgacacgctcaccatcctgctgaaggccaccctcttggccgtttccggcgtgtacccgttaagcatccccgcgaccctcttcgtgtggtacttctggcagaagaagaagcagcgctcaggggtgttgtgggacaccccgtccccccccgaggtggagagagctgttctggatgatggcatatatcggatcatgcagcggggcctgctcgggcgctcccaagtgggcgtgggggtcttccaggagaacgtgtttcacaccatgtggcacgttacccggggcgccgtgctgatgtaccaaggcaaaagactggagcctagctgggcctccgtcaaaaaggacttgatcagctacggcggagggtggcggctacagggctcctggaacacgggggaggaagtgcaggtcatagcagttgagcccggcaagaaccctaagaacgtgcagaccgcccccgggaccttcaagacccccgagggcgaggtcggtgccatcgcgttagacttcaagcccggaactagcggctcccccatcgttaaccgcgaggggaagatagtgggtttgtacggcaacggggttgtgacgacaagcggcacctacgtgagcgcaatcgcgcaggccaaggcttcccaggaagggccgctgcccgagatcgaggacgaggtcttccggaagcgcaacctgacgatcatggacctgcaccctgggagcgggaagacacggcgctaccttccggccattgtgcgggaagccatcaagcgcaagctgcgcaccctcatcctggcccccacgcgggtggtcgcctccgaaatggctgaggccctgaagggcatgcctatccgctatcagacgaccgccgtcaagtcggagcacacgggcaaggagatcgtggacctcatgtgtcatgcgacattcaccatgcggctgctctctcccgtgcgcgttccgaattacaacatgatcataatggacgaggcgcacttcaccgaccccagctccatcgcggcccgggggtacatcagcacccgagtgggaatgggggaggcagccgcaatctttatgactgcaacgccgccaggctccgtcgaggccttcccgcaaagcaacgccgtgattcaggacgaggagagagacataccggagcgctcctggaacagcgggtatgagtggataaccgacttccccggcaagacagtctggtttgttccctccatcaagagcggcaacgacatcgccaactgtttgcggaagaacgggaagcgagtgattcagctaagtcggaagaccttcgacacggagtaccagaagaccaagaacaatgactgggactacgtggtcacgaccgacatcagcgagatgggcgcgaacttccgcgccgaccgggtgatcgaccctaggaggtgcctgaagcccgttatcctcaaggacgggcccgagagagtcatcctggcaggccccatgccggttaccgtcgcctccgccgcccaacggcgcggcagggtgggccgcaatcacaacaaggagggcgaccagtacatctacatgggccagcccctgaacaacgacgaggaccacgcccactggactgaggccaagatgctcctggacaacatcaacactcccgaggggatcatccccgccctgttcgagccggagcgcgagaagtccgccgcgattgacggtgagtaccggctccgcggcgaggccagaaagacattcgtagaactgatgcgccgcggggacctccccgtctggctctcctacaaggtggccagcgagggcttccagtacagcgaccgcaggtggtgcttcgacggcgagcgcaacaaccaggtgttggaggagaacatggacgtcgagatttggacgaaggagggcgagcggaaaaaactgcgcccccgttggttagacgcccgcacctactccgaccccctggcgctgcgggaattcaaggagttcgcggccggccgccggagcgtgtccggtgacctcattctggagataggcaaactgccgcagcacctaacccaacgcgcccaaaacgctctagataacctggttatgttacacaactcagagcagggcgggcgtgcttaccgccacgccatggaggagctgccagataccatagagacgctgatgttgttagccctgatcgccgtcctcaccggtggggtgaccttgttcttcctgtccggccggggactcggcaagacgtcaatcgggctgttatgcgtgatggccagcagcgtcctcctgtggatggcgtccgtccagccccactggattgctgcctcaatcatcctggaattctttctgatggtcctgctaattcccgagccggaccggcagaggacgccccaagataaccagctggcctacgtcgtgatcggtctgcttttcatgatcctcactgtggcggcgaacgagatgggcctgctggagaccaccaagaaggacctcggaattggccacgtcgccgtcgagaaccaccaccacgccgccatgttggatgtagacctgcaccccgccagtgcgtggacactctatgccgtagccacgaccataattactccgatgatgcgccacactatcgagaacactaccgccaatatatcattgaccgccatagcgaatcaggcagctatattgatggggctcgacaaaggctggcccatctcgaagatggacatcggtgtgcctctgctggcactcggttgctattctcaggtgaatcctctgaccctaacggctgccgtcctcatgctggttgcccattacgcaatcatcggtccggggcttcaggcaaaagcgactagggaggcccaaaagcggaccgctgcgggcatcatgaagaatcctacagttgacggaatcgtcgccattgacctcgaccccgtcgtgtatgacgcgaagttcgaaaaacaactgggccagatcatgctgctcattctgtgcacatcccaaatcctactcatgcgcaccacctgggcactatgcgagagcatcaccttagccacaggccccctgacaacgctgtgggagggaagcccgggcaagttctggaacacaacgatcgccgtcagcatggcgaacattttccgtggctcctacctggcgggcgcaggactcgctttcagcctgatgaagtccctcggtggtggccgtcgggggaccggggctcagggcgagaccctcggcgaaaaatggaagcgtcagctgaaccaactgtcaaagagcgagttcaatacctacaagcggtcgggcataatggaggttgaccgatccgaggccaaggagggcttgaagcgcggggagacgaccaagcatgcggtatcccgcggaaccgccaaactgcgatggttcgtcgagcgcaacctggtaaagcccgaggggaaagtgatcgacttaggctgcggcagaggtgggtggtcttactattgtgccgggctcaagaaagttactgaggttaagggatacaccaaaggcggaccgggtcacgaggaacccatcccgatggcaacctacggttggaacctggtgaagctgcactccggcaaggacgtgttcttcataccgcccgagaaatgtgacacgctcctgtgcgacatcggggagagctcccccaacccgaccatcgaggaaggccgcaccctgagggtgctcaagatggtggaaccctggctacgcgggaaccagttctgcatcaagatcctgaacccctacatgccctcagtcgtggagactctcgagcaaatgcagcggaagcacggcggcatgctcgtgcggaatccgctgtcccggaatagcacccacgagatgtactgggtctcctgcgggaccggcaacatagtgagcgcggtgaatatgacctcccgtatgctcctgaaccgtttcacgatggctcaccggaagcccacatacgaaagagacgtcgacctgggggccggcacccgacacgtggccgtcgagcccgaggtcgccaacctggacatcatcggtcaacggatcgagaatatcaaacacgagcacaagagcacctggcattacgacgaggataacccctacaagacgtgggcgtaccacggatcctacgaggtcaagccgagcggctctgccagctcgatggtcaacggcgtagtaaagctgctgacgaagccttgggacgtcatccccatggtaacccagatcgccatgaccgacacgaccccattcggccagcagcgggtgtttaaggagaaggtcgatacccgcaccccgaaggccaagcgtgggacgacccaaataatggaggtcaccgcccgctggctctgggggttcctatcccggaacaagaaacctcgcatatgtacgcgggaggaattcacgcgcaaggttcggagcaacgctgccatcggcgccgtattcgttgacgagaaccagtggaactccgcaaaggaggcggtggaggacgagcgcttctgggacctggtacaccgggagcgcgagctgcataagcaggggaagtgcgcgacctgcgtatacaatatgatgggcaagagagagaagaagctgggggagtttggaaaagccaaggggagccgcgccatctggtacatgtggcttggagcccggttcctcgagttcgaggcgctgggcttcatgaacgaagatcactggttctcccgcgaaaacagcttatccggggtggagggcgagggcctccataagctcggctacatcctgcgagacatcagcaagatccccgggggcaacatgtacgcggacgacaccgccggatgggacactagaatcactgaggacgacctccagaacgaggccaagatcaccgacatcatggagccagagcacgcgctgctagcgaaggccatctttaagctcacataccagaacaaagtcgtgcgcgtgcagcggcccgctaagaatgggaccgtgatggatgtgatctcccgccgggaccagcgcggcagcggccaggtgggcacgtacggcctgaacaccttcaccaatatggaggcccaactgattcgccagatggagagtgaggggatcttctctccttccgagctagagacccccaatctcgccgagagggtcctagactggttagagaaatacggcgtcgagcggctgaagcgcatggcgatcagcggggacgattgtgtggtcaagcctatcgacgaccggttcgccacggccctgaccgccctcaatgacatgggcaaggtgcggaaggatatcccccagtgggaaccctccaaggggtggaacgactggcaacaggtacctttttgctcccaccacttccaccagctcatcatgaaggacggccgggagatcgtcgtgccgtgccgcaaccaggacgagctggtcggcagagcgcgcgtctcccagggggcgggttggagcctccgggagacggcctgtctgggcaagtcgtacgcccagatgtggcagctgatgtattttcaccgccgggacttacgtctggccgcaaatgccatctgctcggccgtgcccgtagactgggtacccaccagccggacgacctggtccatacacgcccaccaccagtggatgaccactgaagacatgctgtcggtttggaatagagtgtggatcgaggaaaacccctggatggaggacaagacgcacatcagtagctgggaggatgtcccgtacctcggcaagcgcgaagatcagtggtgtgggtccctgatcggtctgacagcccgggcgacctgggcgaccaacattcaggttgcgatcaaccaagtgcgccggctcataggcaacgaaaactacctggactacatgaccagcatgaaacgcttcaagaacgaatccgaccccgagggtgcactgtggtga

SEQ ID NO: 24697 - RNA, 9879 nt, synthetic construct
  misc_feature 1..9879: note = derived and/or modified CDS sequence (opt11) from DENV-1__KC762628__SS-prME
  source 1..9879: mol_type = other RNA
agcgtgaccatgttgctcatgttgctgcccacggccctcgccttccacctgaccacccggggcggcgagccccacatgatcgttagcaaacaggagcggggcaagagcctcctgttcaaaacgagcgctggggtgaacatgtgcacactgatcgctatggacctgggcgaactctgcgaggacaccatgacctacaagtgcccccgcatcactgagaccgagcccgacgatgtagactgctggtgcaacgccaccgagacatgggtgacctacgggacctgcagccagaccggagagcaccgaagggacaagcggtccgtggccctggcgccccacgtgggcctgggtctcgaaacccgcaccgagacctggatgagctccgagggcgcgtggcggcagatccagaaggtagagacgtgggccctccgccaccccgggttcaccgtgatcgccctgtttctcgcccatgcgatcggcaccagcatcacccagaaggggattatcttcatcctgctgatgctcgtgacgccctccatggccatgcggtgtgtcggcataggcaaccgcgacttcgtggaggggctgagtggcgccacgtgggtggacgtcgtgctggagcacgggagctgcgttaccacaatggccaaggacaagccgacgctcgacatcgagctgctgaagacagaggtcaccaaccccgccgtgctacggaagctgtgcatcgaggcgaagataagcaacaccacgaccgactcccgctgccccacccaaggcgaggccaccctggtcgaggagcaggacacgaacttcgtctgccggcgaacattcgtagaccggggctggggcaacggctgcggccttttcggcaaggggagtctgatcacctgcgccaagttcaagtgcgttacgaagctggagggcaagatcgtccagtacgagaacctcaaatactccgtgatcgtcacagtccataccggagatcagcaccaagtggggaacgagaccaccgagcacggaacaacggcgaccatcacaccccaggcccccacatcagagatacagttaaccgactacggcgcgctgaccctcgattgcagccccaggaccggcctggacttcaacgagatggtcctactcaccatgaaggagaagtcctggttggtgcataagcagtggttcctggacctcccactgccatggacgagtggggcctcgacctctcaggagacctggaaccggcaagacctgttagtgaccttcaagacggcccatgctaagaaacaggaggtggtggtattgggctcccaggagggcgcgatgcacaccgcgttgaccggggcaaccgagatacagacgtctggcactaccaccatcttcgccgggcatctcaagtgccgcctgaagatggacaagcttacactaaagggagtctcatacgtaatgtgcacgggtagcttcaagctggagaaggaggtggccgagacgcagcacggcaccgtcctggtccaggtgaagtacgaggggacggacgccccctgcaagatccccttctccagtcaggacgagaagggagtaacccagaacggcaggcttatcaccgcgaacccgatagtgaccgacaaggagaagcccgtaaacatcgaagccgagccgccgttcggggagtcctacctcgtcgtaggcgccggcgagaaggccctgaagctgagctggttcaagaagggctcttcgatcggcaagatgttcgaggcgactgcccgcggagcccggcgcatggccatcctcggcgacaccgcttgggactttggatccatcgggggagtgttcaccagcgtcgggaagctgattcaccagatctttggcaccgcgtacggggtgctgttctcaggcgtatcatggacgatgaagatcgggatcggcatcctcctgacctggcttggcctcaactcccgaagcacctccctatccatgacctgtatcgccgtcgggatggtgacgctttacctcggcgtgatggtccaggcagattcagggtgcgtgattaactggaaagggcgggagctgaagtgcgggagcggcatcttcgtgaccaacgaggtgcatacctggaccgaacagtacaagttccaggccgacagccccaagaggctgtccgctgcaatcggtaaggcgtgggaggagggggtgtgcgggatcagaagcgccacccgccttgaaaacataatgtggaagcaaatctccaacgaactgaaccacatcctgctcgagaacgacatgaagttcacggtggtcgtgggcgaggtgaacggcatcctagcgcagggaaagaagatgatccggccccagcccatggagcacaagtacagctggaagtcctggggcaaggccaaggtcatcggcgctgacgtgcagaacaccaccttcatcatcgacgggcccaatactccggagtgccccgacaaccaaagggcatggaacatctgggaggtggaggactacggcttcgggatctttacgacgaacatctggctgaagctccgggatagttacactcaggtctgcgatcaccgtctgatgtccgcagcaattaaggacagcaaggccgtgcacgccgacatgggctactggatcgagtcggagaaaaacgagacctggaagctggcccgggcatcattcatagaggtgaagacgtgcatctggcccaaatcccataccctatggagcaacggcgtcctggaatcagagatgataattccaaagatctacgggggaccgatcagccagcacaactatcgccccgggtactttactcagaccgccggcccctggcatctggggaagctcgagctggacttcgagctgtgcgagggcacgaccgtggtggtcgacgagcactgcggctcccgggggccgagcctccggaccaccacggtgactggtaagattatccacgagtggtgctgccggtcctgtaccctgccgccgctgcgcttcaagggggaggacggctgctggtacgggatggagatccggcccgtgaaagaaaaggaggagaacctcgtcaagagcatggtgagcgcgggctccggcgaggtggactccttctccctggggctgctctgcatgagcatcatgatcgaagaagtcatgcgctcacggtggagccgcaagatgctgatgaccgggacattagctgtgttcctcctgctgactatgggtcagctcacatggaacgacctgattcggctgtgtatcatggtgggcgccaacgcctccgataagatggggatgggtaccacccacctagccctgatggccaccttccgcatgcgcccgatgttcgcggtcggactcctgttccggcgcctgacctcgcgggaggtgctgctgctgacggtggggctgtccctcgtagcgagcgtagagctgcccaactccctggaggagctgggcgatggtctagccatgggcatcatgatgttaaagctcctgacggacttccagagccaccagctgtgggctgcgctcctgtcactgactttcgtcaagaccaccctcagcctgcactacgcctggaagacgatggcgatgatcctgtctatcgtcagcctcttccccttgtgcttgtcgaccactagccagaagacaacgtggctccccgtgctgctcgggtccctcgggtgcaagccgctgaccatgtttctgatcaccgagaacaagatctggggccgcaagtcgtggccccttaacgaggggatcatggccgtcgggatcgttagcatcctgctgtcctcgctcctgaagaacgacgtgcccctggccgggcccctcatcgccggcggcatgctgatcgcctgctacgtcatcagcgggtcatctgccgacctgagcctggagaaggcggcggaagtgtcgtgggaggaagaggcagagcacagcggcgcctcccacaacatactggtggaggtccaagacgacgggaccatgaagatcaaggacgaggagcgggacgacaccttgacgatcctcctgaaagccaccctactcgccatcagtggcgtgtacccgatgtccatccccgcgacgctgttcgtttggtacttttggcagaagaagaagcagcgcagcggtgtcctatgggacacccccagcccgcccgaggtggagcgggccgtgctggacgacggcatctaccgcatcttacagcggggcttgctggggaagtcccaggttggcgtcggggttttccaggagggcgtttttcacaccatgtggcacgtgacccgcggggccgtgctcatgtaccagggtaagcgcttggagccctcctgggccagcgttaaaaaggacctaatctcctacggcgggggctggaggttccaagggagctggaacaccggcgaggaggtccaggtgatcgctgtcgagcccgggaagaaccctaagaacgtgcagaccgcgcccggcacgttcaaaaccccagagggcgaggtgggggccatcgccctcgacttcaagcccggtacctccgggagccccatcgtcaatcgcgagggcaagatcgtgggcctgtacgggaacggcgtagtcaccaccagcgggacctacgtgagtgccatagcccaagcgaaggcaagccaagagggtccgttacctgaaattgaggacgaagtgtttaggaaaagaaaccttaccatcatggacctccaccccggctctggaaagacccgacggtacctcccggccatcgtccgcgaagccataaagcggaagctccgcaccttggtgctggcccccacccgggtcgtcgccagcgaaatggccgaggccctcaagggaatgcccatccgttaccaaaccaccgcggtgaagtccgagcacaccggcaaggagattgtggacctgatgtgccacgccaccttcactatgcgcctgctctctcccgtccgcgtgccgaactataacatgatcatcatggacgaggcccacttcaccgaccccgcgtccatcgccgcgcgtggttacatttcgacgcgtgtgggaatgggcgaggcggccgccatcttcatgacggcgacgccgcccggctcaatcgaggccttcccgcagagtaacgcggcaatccaggacgaggagcgggacatccccgagcggtcttggaacagcggctatgactggatcacggacttccccggcaagacggtctggttcgtgccctctataaagtccgggaacgacatcgccaactgccttcggaagaatggcaagcgggtgatacaactgtcccggaaaacattcgataccgagtaccagaagacgaagaacaacgactgggactacgtcgtgacgaccgatatcagcgagatgggggcgaacttcagagcggaccgcgtgatcgaccctcgacgctgcctcaagcccgtaatcctgaaagacggtcccgagagagtgatcttggcggggccgatgccggtcaccgtggcctccgccgcccaacgccggggcaggatcggccggaaccagaacaaggagggggatcaatacatctacatgggccagcccctcaacaacgacgaggaccacgcgcactggaccgaggccaagatgctgctggacaacatcaacacgcccgaggggatcataccggccttgttcgagcctgagcgcgagaagtccgccgccattgacggcgaataccggctgcgcggggaggcgcgcaagacgttcgtggagctgatgaggcgcggcgacctccctgtctggctgtcctacaaggtggccagcgagggattccaatatagcgaccggcgctggtgcttcgacggggagcgaaacaaccaggtcctggaggagaacatggacgtggagatctggactaaagagggcgagcgcaagaagctcaggccccgctggctggacgcacggacctactccgatcctctcgccctccgcgagttcaaggagttcgccgcggggaggcgctcggtgtccggagacctgatactggagatcgggaagttgccgcagcacctgacgcagcgggctcaaaacgccttagacaacctcgtgatgctgcacaacagtgagcagggcgggaaagcctatcgccacgcgatggaggagcttcccgacaccatcgaaaccctcatgctgctggcactcatcgccgtcttaaccgggggcgtgacccttttctttttatccgggagaggcttaggcaagacgagcatcggtctgctctgcgtgatggcctctagcgccctgttatggatggcgtcagtcgagccccactggatcgccgcatccataatcctcgagttcttcctgatggtgctgctcatccccgagccggacaggcagcggactccccaagataaccaactggcctacgtcgtaataggtctcctcttcatgatcctgaccgtggccgcgaacgagatggggctgctcgaaacgacgaagaaggacctgggcatcgggcatgccgccgcggagaaccatcaccatgccgcgatgctggacgtagacctccaccccgcctcggcttggaccctgtacgccgtcgccaccaccatcatcacgccgatgatgagacacaccattgaaaataccacagcgaacatcagcctgacggccatcgccaaccaagcagcgatcctcatgggcttggacaaaggctggcctatttccaagatggacatcggggtgcccctgctcgccctcggctgctacagccaggtgaaccccctgaccctcaccgccgccgtcttgatgctggtcgcccactacgccatcatcgggcctggcctccaggcgaaggctaccagggaggctcagaagcgcacggccgccgggatcatgaagaaccccacagtggacggcatagtcgccatcgatctcgatcccgtggtgtacgacgccaagtttgagaagcagctaggccagattatgctcctgatcctgtgtacctcccagatcttactcatgcggaccacgtgggccctgtgtgagagcattaccctcgccacggggcctctgacaacgctgtgggaaggctccccgggcaagttctggaacactactatcgcggtcagcatggcgaacatcttccgcggctcctacctcgccggcgccgggcttgcgttcagcctgatgaagtccctcggcgggggccgccgggggaccggagcgcagggcgagaccctgggggagaaatggaagcgccagctaaaccagctctccaagagcgagttcaacacatataagcggagcggcatcatggaggtggaccgcagcgaagcgaaggaggggcttaagcgtggcgagaccaccaagcatgccgtgtcccgtggcacggccaagctgcggtggtttgtcgagcgcaacctggtgaaacccgagggcaaggtgatcgacctcggctgcgggcgcggcggctggagctactactgtgcgggactaaagaaggtcacggaggtgaagggatacaccaagggcggccccgggcacgaggagcccatcccaatggccacctacggctggaacctggtgaagcttcatagtggtaaggacgtctttttcacgcccccggagaagtgcgataccctgctgtgcgacatcggtgaatcatctcccaatccgaccatagaggaggggcggaccctcagagtgctgcgcatggtggagccctggttgcggggcaaccagttttgcatcaaagtcctcaacccctacatgcccagcgtgatcgagaccttagagcagatgcagcggaagcacggcggcatgctggtgaggaacccgctctcccgcaatagcacgcacgaaatgtattgggtctcctgcggcaccgggaacatagtcagcgccgtaaatatgacatcccggatgctgcttaaccgctttaccatggcccaccggaagcccacttacgaacgcgacgttgacctgggagccggcacccgccacgttgcagtggagcccgaggtcgccaacctcgacattattggtcagcggatcgagaacatcaaaaacgaacacaagtcgacctggcactatgacgaagataacccctacaaaacctgggcctatcacggctcctatgaggtgaagccgagcgggtcagccagtagtatggtgaacggcgttgttcgcctgctcacgaaaccctgggatgtgatacccatggtgacacagatagccatgaccgacaccacgccctttggccagcagcgcgtgttcaaggagaaggtcgacaccagaaccccgaaagcgaagcggggcaccgcacagattatggaagtgacggccagatggctgtggggcttcctgtcccggaacaagaagccccgcatttgcacacgggaggagttcaccaggaaggtccggtccaacgccgcgatcggggcagtcttcgtcgacgaaaaccagtggaactccgccaaggaggccgtggaggacgaacgcttctgggacctcgttcatcgggagcgcgagctgcacaagcagggcaagtgcgcgacttgcgtgtacaacatgatggggaagcgggagaaaaagctcggagagttcgggaaggcgaagggcagccgcgcaatctggtacatgtggctcggcgcccgattcctcgaattcgaggccctggggttcatgaatgaagatcactggttctcccgcgagaatagcctctccggcgtggaaggggagggcctgcacaagctggggtacatcctcagggacatcagcaagatcccaggcggtaacatgtacgccgacgacacagcggggtgggatacccgcataacagaggacgacctgcagaatgaggccaagattaccgacattatggagccggagcacgccctgctcgccacctccatcttcaagctgacctaccagaacaaggtcgtgcgggtgcagcgccccgccaaaaacggaaccgtcatggacgttatcagccgccgggaccagcgggggagtggccaggtggggacctatggcctgaacactttcaccaacatggaggcgcagctcatccggcagatggagagcgaaggcatcttcaccccctccgagctggagacccccaaccttgccgaacgcgtcctcgactggctggagaagcacgggatcgagcggcttaagcgcatggcaatatccggcgacgactgcgtggttaagccgatcgacgaccggttcgctaccgcgttaaccgcgctaaacgatatggggaaggtccgcaaggacatccctcagtgggagccgtccaagggctggaacgactggcagcaggtccccttctgcagccaccacttccaccaactgattatgaaggacgggagggagatcgttgtgccgtgtaggaaccaggacgaactcgtggggcgggcccgcgtgtcccagggggcaggctggtccctgcgggaaaccgcttgcctgggcaagagttacgcacaaatgtggcagctcatgtacttccaccgccgggacctgcgcctggcagccaacgcaatctgcagtgccgtccccgtggactgggtgcctaccagccggacgacgtggtccatacacgcgcaccaccagtggatgaccaccgaggacatgctcagcgtatggaaccgagtgtggatagaggagaatccctggatggaggacaagacgcatgtgtccagctgggaggacgtgccctacctggggaaacgggaggaccagtggtgcggctccctgatcggcctcacggccagagcgacctgggcaaccaacatccaggtggccattaaccaggtgaggcgcctgatcgggaatgagaactacctggattacatgaccagcatgaagcgctttaagaacgagtcagaccccgaaggcgcgctctggtga

SEQ ID NO: 24698 - RNA, 9879 nt, synthetic construct
  misc_feature 1..9879: note = derived and/or modified CDS sequence (opt11) from DENV-1__KC762624__SS-prME
  source 1..9879: mol_type = other RNA
agcgtgactatgctgctcatgctgatgcccaccgccctggctttccacctaaccacgcggggcggggagccccacatgatcgtgagcaagcaggagagaggcaagagcctgttatttaagaccagcgccggggtgaacatgtgcactctcattgccatggatctgggcgagctgtgtgaggatacgctcacctacaagtgcccacgtatcaccgaggccgagcccgacgacgtagactgctggtgtaacgcgaccgacacctgggttacctatggaacctgctcccaaaccggagagcaccggcgagacaaacggtccgtggccctggctccccacgtgggccttgggcttgagacacgcaccgagacctggatgagctccgagggcgcctggaagcagattcaacgcgtcgagacctgggccttaagacacccaggtttcacggtgatcgccttattcctcgcgcacgccatcggcaccagcataacccagaaggggatcatcttcatcctgctgatgctcgtcaccccctccatggccatgcggtgcgtagggataggcagcagggacttcgtggagggtttatctggcgccacgtgggtggacgtcgtactggagcacggcagctgcgtcacaaccatggcaaaggataaacccacgctcgacatcgagctgctgaagacggaggttaccaaccccgctgtgctccggaagctgtgcatagaagccaagatctcgaacacaaccacggattcgcgctgcccgacccagggcgaggccaccttggtggaggagcaggacgccaattttgtctgccggcgcaccttcgtggacagaggttgggggaacggctgcgggctgttcggcaaggggtccctgatcacgtgcgccaagttcaagtgcgtgacgaagttagagggcaagatcgtccagtacgaaaacctcaagtacagcgtaattgtaaccgtccacaccggcgaccaacaccaggtggggaacgagtccacggagcacgggaccacggcgaccatcacgccccaggcacccactaccgagattcaactcacggattacggcgctctgaccttagactgcagcccccgcaccggcctggacttcaacgagatggtcctgctaaccatgaaggaaaagagctggctggttcacaaacagtggttcctggacttacccctaccctggacctctggcgccagcacgtcccaggaaacgtggaatcggcaggatctactcgtgacgttcaagaccgcccacgcgaagaagcaagaagtcgtcgtgctgggtagccaggaaggcgctatgcacaccgccctgacgggtgccaccgagatccaaaccagcggcacgacgactatcttcgccggacacctcaagtgccggctgaagatggacaagctaactctaaaaggcatgagctacgtgatgtgcaccgggtccttcaagctggagaaggaggtggctgagacacaacacggcaccgtgctggtccagatcaagtacgagggcaccgatgccccctgtaaaatccctttcagcacccaggacgaaaagggggtgacgcagaacggacggctgatcaccgccaatccgattgtgaccgacaaggaaaagcccgtcaacatcgaggccgagccgccctttggtgagtcctatatcgtcatcggcgcgggcgagaaggctctcaagctgagctggttcaagaagggatccagcatcggcaagatgttcgaggccacggcccgcggtgcccgacgcatggcgatcctgggcgatacagcttgggacttcggatccatagggggcgtctttaccagcgtcggaaaactcgtgcaccagatatttggcaccgcctatggggtgttattctcaggcgtgtcctggaccatgaagatcggaatcggcgtgttgctcacgtggctgggtttgaactcccgcagcacttccctcagcatgacctgcatcgccgttgggctggtcaccctgtacttgggagtgatggtgcaggccgactccgggtgcgtcataaactggaagggccgtgagctgaagtgcggaagcggcatcttcgtaacaaacgaggtacacacctggaccgagcagtacaaattccaggcggatagcccgaagaggctatctgccgccatcggcaaggcctgggaggaaggcgtgtgcggcatccgctccgctaccaggctggagaacatcatgtggaagcagatctccaacgagctgaaccacatcctgctcgagaacgacatgaagttcacagtggtagtcggggacgtcgcgggaatcctggcccaggggaaaaagatgatccggccacaacccatggagcacaagtacagctggaagtcgtgggggaaggcaaagatcatcggggccgatgtgcagaatacgaccttcatcatcgatgggcccaacacgccggagtgccctgacgaccagcgagcatggaatatctgggaggtagaggactacggcttcgggattttcaccacgaatatttggctaaagctacgggacagctacacccaggtctgcgaccaccgtctgatgagcgcggccatcaaggacagcaaagccgttcacgccgacatgggctactggatagagtcggagaagaacgagacttggaagctggctcgggcgagcttcatcgaggtgaagacatgcatctggcccaagtcccacactctctggtccaacggcgtgcttgaatctgagatgatcatccctaagatctacgggggcccgacgtcacaacacaactaccgccccggttactttactcagactgcgggcccctggcacctggggaagctcgagctggacttcgacctgtgtgagggcacgaccgtggtcgtggacgagcactgcggcaaccgggggccgtcactccgtaccaccactgtaactggaaagatcatacacgagtggtgctgtcggagctgcaccctgccgcccctgcgcttccgcggggaagacggatgctggtacgggatggaaatcaggcccgtaaaggagaaggaggaaaatctcgtaaagtctatggtgagtgccggcagcggcgaggtcgactccttcagcctggggctgctctgcatcagtataatgattgaggaggtgatgaggagtaggtggtcccgtaaaatgctgatgaccggcacactggcagtgtttttcctcctgatcatggggcagttaacctggaacgatctgatccgcctgtgcatcatggtcggggcgaacgctagcgaccgcatgggtatgggcaccacctacctggccctcatggccacgtttaagatgcggcccatgtttgccgtaggcctgctgttccgccgtcttaccagtcgcgaggtgctgctgttaacgataggtttgtcgcttgttgcgtccgtggagctccccaacagcctggaggagctgggcgacggtctcgctatgggcattatgatcctgaagctcctcaccgactttcaatcccaccaactgtgggccactctgctcagcctaacctttatcaagaccaccttctcgctgcattacgcctggaagacgatggcaatggttttgagcatcgtctccctatttcctctgtgtctcagcaccacgtcgcagaagacaacgtggctgcccgtactgctcggcagcctaggctgcaagccgctgaccatgttcctaatcgcagagaacaagatctggggccggaagtcctggcccctgaacgagggaatcatggccgtcggcatagtcagcatcctgctcagctccctgctgaagaacgacgtgcctcttgccggccccctgatagccggtggtatgctgatcgcatgctacgtcatcagtggctcctccgcggacttatccctggagaaagccgcggaggtgagctgggaggaggaggccgagcactccggcgcgtcgcacaatatcctggtggaggtccaggacgacgggacaatgaaaatcaaggacgaggagcgcgacgacaccctcacgatcctgctgaaagccacgttactggcggtgtccggagtgtacccgctgagcatccccgccactttgttcgtctggtacttttggcagaagaaaaagcaacggtccggggtgctttgggacacccccagcccacccgaggtggaacgggctgtcttggacgacgggatctaccggataatgcagcgggggctcctcgggcggagccaggtgggcgtgggggtcttccaagagaacgtgttccacactatgtggcatgttacacgcggcgcagtcctgatgtaccaggggaagcggctggagccaagctgggcctccgtgaagaaggacctgatcagttacggcggagggtggcgcctgcaggggtcctggaacaccggagaggaggtgcaagtcatagccgtcgaacccggaaagaaccccaagaacgtacaaacagcccccgggacatttaaaacacccgaaggcgaggttggcgccatcgcactggacttcaagcccggcaccagcggctcccccatcgtgaatcgggaggggaagatagtcggcctctacggcaacggggtcgtaacgaccagcggcacctatgtgagcgccattgcccaggccaaggcgtcacaggaggggccgctgcccgaaatcgaggacgaggtcttccgcaagcggaatctgaccattatggacctgcaccccggcagcgggaagacccgcagatacctcccggccatcgtgcgcgaggcaatcaaacggaagctgcgtacattgatcctggctcccactcgtgtggtagcatccgagatggcggaggccttgaagggcatgcccattcgctatcagaccacagctgtaaagtcagagcatactggcaaggagatcgtagacctcatgtgccacgccacgttcaccatgcgcctgctgagccctgtccgggtgccgaactacaacatgatcatcatggatgaggcccacttcacagaccccagcagcatcgcggcccgcggttacatcagcacgagggtgggaatgggagaggccgcagccatcttcatgactgctacgccgcctggctccgtagaagcctttcctcaaagcaacgccgtgatccaggacgaggaacgtgacatcccagagcggtcttggaacagcgggtacgagtggatcaccgacttccccggcaagaccgtatggttcgtcccctcaatcaagtccggcaacgatattgccaactgcctccgaaagaacgggaagcgggtgatccaactgtcacgcaagactttcgacaccgagtaccaaaagaccaagaacaacgactgggactacgtggtaacgacggatatcagcgagatgggagcgaacttccgggccgaccgtgtcatagacccacggcgctgccttaagcctgtcatactcaaggatgggcccgagcgggtcatcctggccggccccatgcccgtgaccgtcgcctccgctgctcaacgcagagggcgcgtaggccgaaaccacaacaaggaaggcgaccagtacatttacatgggtcagccgctgaataatgacgaggaccacgcccactggactgaggccaagatgttgctagacaacatcaacacccccgagggcattattccagccctgttcgagccggagcgcgaaaagagcgccgcgatagatggggagtaccgcctccggggcgaggcccgcaagacgttcgtcgagcttatgcggcgcggggacctgcccgtctggctttcctacaaggttgccagtgaaggcttccagtactccgaccggcgctggtgcttcgacggcgagcggaacaaccaggtgcttgaggagaatatggacgtcgagatctggaccaaggagggtgagcgcaaaaagctgaggccccgctggctcgacgcgcggacctactccgatcccctggctctgagagagttcaaggagttcgcggccggacgtcgcagcgtgtccggtgacctcatcttagagatcggcaagctgcctcaacacctcacacaaagagcccagaatgccttagacaacctggtgatgcttcacaactcggagcaaggagggagggcgtaccggcatgccatggaggaactgcccgacacgatcgagaccctgatgctcctggcccttatcgccgtcctcactggcggcgtcactctgttcttcctgtccggccgcggactcggaaagaccagcatcggtctgctgtgcgtcatggcctccagcgtccttctgtggatggctagtgtggagccccactggatcgccgccagcataatcctggagttctttctcatggtgctgttgatccccgagccggaccgtcaacgaacgccacaggacaaccagctcgcctacgtcgtgatcggtttgctgtttatgatactcacagtggcagcgaacgagatgggcctgctggaaacaactaagaaggatctcgggatcggccatgtggcggtagagaaccaccaccacgccgccatgctggacgtggacctgcacccggcatccgcttggacgctttacgccgtcgcgaccactatcatcacgcctatgatgaggcacacgattgagaacacaaccgccaacatcagccttaccgctatcgcaaaccaggccgccatcctcatgggtttagacaaggggtggcccatctccaaaatggacatcggcgtgcctctcctcgctttgggatgttacagccaggttaaccccctgaccctgaccgcggccgtactcatgctagttgcccactacgcaattatcggtccgggactgcaggctaaggccacccgggaggcccagaagcggaccgccgcaggcatcatgaagaaccccacggtggacggcatagtcgccatcgacctcgaccccgtggtgtacgacgcgaagttcgagaaacagttggggcagattatgctgctaatcctgtgcaccagccagatcctgctcatgcgcaccacctgggccctgtgcgagagcatcacgcttgccaccggccccctcaccacactgtgggaggggagtcccggaaagttctggaacacgaccatcgccgtcagcatggccaatatcttccgcgggtcctacctggcgggcgctggcctagctttcagcctgatgaaatccctcggtggcgggcgtcgcgggaccggcgcccagggcgagactctaggggagaagtggaagcggcagctgaaccagctgtccaagtccgagttcaacacgtacaagcgctccggaatcatggaggtggatcggtctgaggcgaaggaagggctcaagcgcggggagaccaccaagcacgccgtctcccggggcacggcaaaactgcgctggttcgtggagcggaacctggtgaagcccgaggggaaggttatcgacctgggctgcggccgcgggggctggagctactactgcgccggtctcaagaaggtaaccgaagtgaagggctataccaaaggcgggcccggccacgaggaacccataccgatggccacatatgggtggaacttggtgaagttgcactccggcaaggatgtcttcttcattccgcccgagaagtgcgataccctgctatgtgacatcggtgagtcttccccaaatccgacaatcgaggagggccggaccctgcgcgtgctcaagatggtggagccctggttgcggggcaaccagttctgtatcaagatcctgaacccctacatgccatcagttgtggagacgctagagcagatgcaacgcaagcacggcggcatgctggtccggaatccgctgtcccgcaacagcacccatgagatgtactgggttagctgtgggaccggaaatatcgtcagcgccgtaaatatgacgtcccgcatgcttctgaaccgctttaccatggcccacaggaagcccacctacgagcgggacgtcgacttaggtgccggcacccgccacgtggccgtggaacctgaggtggccaacctcgacatcattgggcagcggatcgagaacattaagcacgaacacaagagcacgtggcactacgacgaggataacccttacaagacctgggcgtaccacggatcctacgaggtaaagcctagcggctccgcctcgagcatggtcaacggggtggtgaagctgttaactaagccctgggacgtcattcccatggtgacccagatcgccatgacagacacaacccccttcggtcagcagcgcgtgttcaaggagaaggttgacacccggacgccgaaggccaagcgcgggaccacccaaattatggaggtgaccgcgcggtggctctggggcttcttaagtcgcaacaagaaacccagaatttgcacgcgcgaggagttcacccgtaaagtgcgcagcaacgcggccatcggggccgtcttcgttgacgagaaccagtggaactccgccaaggaggcggtggaagacgagagattctgggacctggtccaccgcgagcgggagctccacaagcaggggaagtgcgcgacttgcgtgtacaatatgatgggcaagcgcgagaaaaagctaggtgagttcggcaaggccaaggggagccgggccatctggtacatgtggctgggtgcccgcttcctcgagtttgaggcgctgggcttcatgaacgaggaccactggttctcccgggagaactctctttccggggtggagggcgaggggttgcacaagctgggctacatccttcgcgacatcagcaagatccccgggggcaatatgtatgccgacgacacggccggctgggacacgcggattaccgaagacgacctccagaacgaggccaagatcaccgacattatggagccggaacacgccctgctggccaaagcgatcttcaagctcacctaccagaacaaggtcgtgcgcgtgcagcgtcccgccaagaacgggacggttatggacgtgatctcccggcgcgaccaacggggctcaggccaagtgggtacctacgggctgaacaccttcaccaatatggaggcccaactgatccgccagatggagtcggaggggatcttcagcccctccgagttggagacgccaaacctagccgaacgggtcctggactggctcgaaaaatacggcgtcgagcgccttaagcggatggccatcagcggggacgactgcgtagtcaaaccgatcgacgaccggttcgcaaccgctctgaccgccctcaacgacatgggaaaggtgcgcaaggacattccccagtgggagccctccaaggggtggaatgactggcaacaggtcccgttctgtagccaccacttccaccagctgatcatgaaggatggaagagagatcgtcgtgccgtgccggaaccaggacgaactcgtcggccgcgcccgagtctcccagggggcaggctggagcctccgcgagaccgcctgcctgggcaagagctacgcccaaatgtggcagctgatgtacttccaccggcgcgacttgcggttagccgcgaacgccatctgctcggccgtgcctgtagactgggtccccacgagccgcaccacttggtccatccatgcccaccaccagtggatgaccacagaggatatgcttagcgtatggaaccgggtgtggatcgaggagaacccctggatggaagataagacccacgtctccagctgggaggatgtgccatacctcggcaagcgtgaggaccagtggtgcgggtccctgataggcctgaccgcccgcgcgacctgggccaccaatatccaggtggccatcaaccaggtccggcgcctcatcggcaacgagaactacctggactacatgacgagcatgaagcgcttcaagaacgagtctgaccccgagggggccctctggtga

SEQ ID NO: 24699 - RNA, 9879 nt, synthetic construct
  misc_feature 1..9879: note = derived and/or modified CDS sequence (opt11) from DENV-1__KC762644__SS-prME
  source 1..9879: mol_type = other RNA
tctgtgacgatgctgttaatgttaatgcccaccgccctagcattccatctcaccaccagggggggggaaccccacatgatcgtatccaaacaggagcggggcaaaagcttattgttcaagacatccgccggggtgaacatgtgtaccctcatcgccatggacttaggcgaactgtgtgaggacactctcacgtacaagtgcccgcgcataactgaagccgagccggacgatgtggactgctggtgtaacgctaccgacacctgggtgacatacggtacctgcagccagaccggagagcaccggcgcgacaaaaggtccgtggccctggcccctcatgtgggactagggcttgagacgcgcacagagacctggatgtcttccgagggagcctggaagcaaatccaacgagtcgagacctgggccctccgccatccggggttcacggtgattgccctgttcctcgctcacgcaatcggcaccagcatcacccaaaaggggataatcttcatcttgctgatgctcgtgaccccgtctatggctatgagatgcgttggcatcggctcccgcgacttcgtcgaggggttgtctggtgccacgtgggtggacgtcgtcctggaacacgggagctgcgtgactaccatggccaaggacaagcccaccttggacatcgagctgctgaagactgaggtgacaaaccccgcggtgttaagaaagctgtgcatcgaggccaagatcagtaacaccacaacagacagccgttgcccgacacagggagaggccaccttggtggaggagcaggatgcaaacttcgtctgccggcgcacctttgttgaccggggctgggggaacggctgcgggttatttggcaaagggagcctcataacgtgcgccaagttcaaatgtgtgacaaagctggaggggaagatcgtccagtacgaaaatctcaaatacagcgttattgtaaccgtccacaccggagaccaacaccaggtcggcaacgagtccaccgagcacggtaccaccgccaccataacaccccaggcccccacgactgaaatccagctgaccgactacggagcgctgaccctcgactgctcgccacgcactgggctggacttcaacgagatggtcctgctcaccatgaaggagaaatcctggctggtgcataagcagtggtttctggatctccccctgccgtggacctccggggcctctacctcccaggaaacatggaaccggcaggacctgctcgtgaccttcaaaaccgcccacgcgaagaagcaggaggtcgtggttttaggctctcaggagggcgccatgcacaccgccctgacgggggccaccgagatacagacctcgggcaccacgaccatcttcgcggggcacctgaaatgccgcctgaaaatggataaactgacgctcaaggggatgagctatgtgatgtgcaccgggtccttcaagctggaaaaagaggtggctgagacgcagcacggcacggtcctggtccagatcaagtatgagggaaccgacgccccctgcaagatcccatttagcacccaggacgagaaaggtgtgacacagaatggcagactgatcacggccaacccgatagtgactgacaaagaaaagcctgtcaacatcgaggccgaaccgccattcggggagtcctatatagtaataggcgcgggcgagaaagccctcaagctgtcatggttcaagaagggatcctcgatcggcaagatgttcgaggccaccgcccgaggagctcggcgcatggcgatactgggcgacacggcatgggacttcgggtccatcggtggcgtcttcacgagcgttgggaagttggtgcatcagatcttcggcaccgcttatggcgtcttgttcagtggcgtcagctggacgatgaagatcggtatcggagtactgctcacgtggctgggtctgaactcccgctccacctccctctctatgacctgcatcgccgtaggtctggtcacactgtacctgggcgtgatggtgcaggcggactccgggtgtgtaataaactggaagggcagagaactgaaatgcgggagcggcattttcgtgacaaatgaggtgcacacctggaccgagcagtataaattccaggcagacagcccaaaacgcctgtccgccgccatcggcaaggcctgggaggagggggtttgtggcattcggagcgcgaccagattagagaacatcatgtggaaacaaatcagcaacgagcttaaccacatactgctcgagaacgacatgaaattcaccgtggtggttggggatgtggcggggatcctggcccaggggaaaaagatgatccggccccagcccatggagcacaagtatagctggaagtcctggggcaaggccaagatcatcggtgccgatgtgcagaacacgaccttcatcatcgacgggcccaacaccccggagtgtcccgacgaccaaagagcgtggaacatttgggaagtagaagactacggctttggaatattcaccacgaatatctggctgaagctccgggactcatacacacaggtatgtgatcatagactcatgtccgccgccatcaaggactcgaaggccgtgcatgccgacatgggctactggatcgagagtgaaaagaacgagacctggaagctggcgcgggcgagcttcatcgaggttaaaacctgcatctggcccaagtcccacacactctggtctaacggcgtgttagagtcggagatgattattccgaagatctacggaggcccgatctcgcaacacaactatcgcccaggatacttcacacagactgccggcccctggcacctggggaagctcgaactcgacttcgacctgtgcgagggcaccaccgtggtcgtggacgagcactgcggcaacaggggcccctccctgcgaacaactacggtgacgggcaaaattatccatgagtggtgctgccgtagttgcactttgcccccactgcgctttaggggcgaggatggctgctggtatgggatggaaatcaggcccgtcaaggagaaggaggaaaacctcgtgaaatcgatggtctcggccggtagcggagaggtcgactcattttccctggggctcctatgcatctccatcatgatagaggaggtgatgcggtcgcgttggagtcggaagatgctgatgaccggcaccctggccgtgttcttcctcctgatcatggggcagcttacatggaacgacttaattcgcctctgcatcatggtaggcgctaatgccagcgaccgcatggggatgggaacgacgtacttagccttaatggctacattcaagatgcgcccaatgtttgcggtgggcctattattccgccggttaacgtcccgcgaggttctgttgctgactatcgggttaagcctggttgcaagcgtggagctccctaactcgctggaagagctcggagacggtctcgcaatgggcatcatgatcctcaagctgctcaccgacttccagtcccaccagctctgggccacgctgctcagcttgacgtttattaagaccaccttctcattgcactacgcctggaagaccatggcgatggttcttagcatcgtgtccctcttccccctgtgcctctcaacaacctcccagaaaaccacctggctccccgtgctgctcggcagcctggggtgcaagcctctgacgatgttcctcatcgccgagaacaaaatttggggccggaagagctggcccttgaacgaggggatcatggccgtcggcatcgtgtcaatcctgctcagctcactgctgaaaaacgacgtgcccctggctgggccgctgatagcaggcgggatgctgatagcttgctatgttatcagcggatccagcgccgacctctctctagagaaagccgctgaagtgagctgggaagaggaggccgagcactccggtgcaagccataacatcctggtggaggttcaggacgacggtacgatgaagatcaaggacgaggagcgtgacgacactttaaccatactcctgaaggccaccttgctggccgtgtccggcgtgtacccgctgagcattcctgccaccctattcgtttggtatttctggcaaaagaagaagcagcggtccggggtgttatgggacacccccagcccgcccgaggtggaacgcgccgtactcgacgacggaatctaccggatcatgcaacgcggcttgctcggtagaagtcaggtaggcgtgggggtcttccaggagaacgtgttccataccatgtggcacgtgacccggggtgcggtccttatgtaccaggggaagcggctggagccaagctgggcctccgtgaaaaaagatctcatcagctatggcggagggtggcggctgcagggcagctggaatacgggagaagaagtccaggtgattgctgtggagccgggcaaaaacccgaagaacgtacaaaccgcaccggggaccttcaagactcccgagggggaggtaggcgcaatagcgctggattttaagcccgggacgagtggttcccccattgttaatcgggagggcaaaatcgtgggcctctacggaaacggggttgtgaccacctcagggacctatgtgagcgccatcgcccaggcgaaggcgtcacaagaggggccgctgcccgagatcgaagacgaggtttttcgcaagaggaacctgacgattatggatctccaccccggctcggggaaaaccagacgctacttaccggccattgttcgtgaggccatcaagagaaagctgaggaccctcatcctggcccccacccgcgtggtggccagcgagatggccgaagcgctgaaaggcatgcccattcggtaccagacgaccgctgtcaagtcggaacacaccggtaaggagattgtggacctcatgtgccacgccaccttcacaatgcgcctgctgtcccccgtgcgggtgccgaactacaacatgatcatcatggacgaggcccacttcacagaccccagctccatcgcggcccgcgggtatattagcactcgggtgggcatgggggaagctgctgccatcttcatgaccgcgacgccgccaggctccgttgaggccttcccgcagtctaacgctgtgatacaggatgaagagcgagacatccccgaacggtcctggaacagcgggtatgagtggatcaccgactttcccggtaagactgtgtggtttgtcccttccatcaagagcggaaatgacatcgccaactgcctccgcaagaatggcaagcgggtgattcagctttctcgcaagaccttcgatacggagtatcagaagaccaagaacaacgattgggactacgtagtgaccaccgacatctcagagatgggcgcgaacttccgggccgacagggtgatcgacccgcggaggtgcctgaagcccgtaatactaaaggatgggcccgagcgggtcattctggccggccccatgccggtaactgtcgcgtccgcagcacaacgtcgggggcgcgtgggaagaaaccacaacaaggagggcgaccaatacatctacatggggcaacccttaaacaatgacgaagaccatgcccactggaccgaggctaaaatgctcctggacaacatcaacacgcccgaaggcatcatccccgccctgttcgagccggaacgcgagaagtccgctgcgatcgacggggagtatcgccttaggggcgaggcacgcaaaacattcgtggaactaatgcggagaggggacctgccggtatggctctcctacaaggtggcgagcgagggcttccagtactcagaccggcgctggtgctttgacggggagcggaacaaccaggtcctggaggaaaacatggacgttgaaatctggaccaaggagggagagcgaaagaagctgcgcccccgctggctcgacgcccggacctacagtgaccccctggccctgcgcgaatttaaggagttcgcggcgggccggcgaagcgtctccggggacctcattttggagatcggcaagctgccgcagcacctgacacagcgtgcccagaatgccctggacaatctggttatgctccacaatagcgagcaaggcggacgcgcgtatcggcacgccatggaggagcttcccgacaccatagagacgttaatgctcttagccctgatcgccgttctcaccgggggggttacccttttcttcctgagtggccgcgggctcggcaagaccagcatcgggctgctgtgcgtgatggcttcgagcgtactcctctggatggcatccgtggagccccattggatcgctgccagcatcatcctggagtttttcctgatggtgctgctgatccccgagccagaccggcagcgcacgccccaagataaccagctcgcttacgtcgtgatcggcctgctgttcatgattctcacggtggcggcgaacgagatgggcctcctggagacaacgaagaaggacctcgggatcggccacgttgccgttgaaaaccaccaccatgcagccatgctggacgtagacttacaccccgcctcggcgtggacgctctacgccgtcgcaactactataatcacaccgatgatgcggcacaccatcgagaacaccaccgcgaacattagcctcaccgccatcgcgaaccaggcagccatcctgatggggctcgacaaaggctggcccatctccaaaatggacatcggtgtgcctctgcttgcgcttgggtgctactctcaggtgaacccactgaccctaactgcggctgtcctcatgttggtggcacactatgccatcatcggaccagggctgcaggctaaagcgacgcgcgaagcccagaagcgcaccgccgcaggcatcatgaagaaccctactgttgatgggattgttgccatagacctcgacccagttgtgtacgatgcgaagttcgagaaacagctgggacagatcatgctgctaatcctgtgcacttcccagatcttactcatgcggaccacctgggccctgtgcgagtcgatcacactcgccacaggccccctaacaaccctgtgggaggggtccccgggcaagttttggaacactacgatcgctgtcagcatggcgaacatcttccgagggtcctacctggctggggccggcctcgccttctcactgatgaaatccctcgggggcgggcggcgcggaaccggtgcccagggtgagaccctcggagagaagtggaaacggcagctgaaccaactgtccaagagcgagttcaatacttacaagcgctccgggattatggaggtggaccgttctgaggcgaaggagggcctcaaaaggggggagacgacaaagcacgccgtctccagaggcaccgcaaaactgaggtggttcgttgagaggaacctggtgaagcccgaggggaaagtcatagaccttggatgcggccgcgggggctggagctactactgtgccgggctgaaaaaggtcaccgaggtaaaaggatacacgaagggcggtcccggccatgaagaacctattccgatggccacttacgggtggaatctggtgaagctgcatagtggtaaggacgtattctttattccacccgagaagtgcgacaccctcctgtgtgacattggggaaagctcccctaacccgaccatagaggagggacggacactgcgcgtgctgaagatggtggagccctggttacggggcaaccaattctgcataaagatcctgaacccctacatgccgagcgtcgtggagaccttggagcaaatgcaacgcaagcacggcggcatgttggtacggaacccgctatctcgcaacagcacccacgagatgtattgggtgtcctgcgggaccggcaacatcgtcagcgcagtgaacatgaccagtcgaatgctcctgaatcgcttcacgatggcccaccggaagccgacttacgagcgtgatgttgatctgggggccgggacccgccacgttgccgtagagcccgaggtcgcgaacctcgacatcatcggccaacggatcgagaacatcaagcatgaacataagagcacctggcactacgacgaagacaacccttacaagacgtgggcataccatggatcctacgaggtgaagccaagcggctctgccagttctatggtcaatggagtagtgaagttgctcaccaaaccctgggacgttattcccatggtgactcaaatcgcgatgaccgacacgacccctttcggccagcagagagtgttcaaggagaaggtggatacacggaccccgaaggccaagagagggacgacccaaatcatggaggtaaccgcgcggtggctctggggcttcctgtcccgaaacaagaaacccagaatttgcactcgcgaggagttcacgcggaaggtgcgcagcaatgctgccatcggcgcggtgttcgtggatgagaaccagtggaactcagcgaaagaagctgtcgaggatgagcggttttgggatctagtacaccgcgagcgcgaactccacaagcaggggaagtgtgcgacctgtgtgtacaacatgatgggcaagcgagagaagaagttgggcgagttcggaaaggcgaaaggaagccgggccatctggtatatgtggctgggcgccagattcctcgagttcgaggcgttaggatttatgaacgaggaccactggttctcccgagaaaacagcctgtccggggtggagggtgaaggtcttcacaagctgggatacatcctgcgcgacattagcaaaatccccggggggaacatgtatgccgacgataccgcggggtgggacacgcggatcacggaggacgacctccaaaacgaggccaagataactgatattatggagccggagcacgcactgctggcaaaggccatcttcgagctgacctaccagaataaggtcgtgcgcgtccagcgccccgccaagaacgggacagtcatggacgtgattagcaggcgcgaccagcggggcagtggtcaggtcgggacctacggcctgaacaccttcacaaacatggaggcccagctgatccgtcagatggaatccgaggggatcttcagcccctctgagctagaaacccccaacctggcagagagggtccttgactggctcgaaaagtacggcgtggaacgcctaaaacggatggcgatcagcggagacgactgcgtcgtcaagccgatcgacgaccgattcgcgaccgcccttacggcactcaacgacatgggcaaggtgaggaaagatatccctcaatgggagccaagcaaggggtggaacgattggcagcaagtacccttctgcagtcaccacttccaccaactcatcatgaaagacgggcgcgaaatagtcgtcccgtgccggaaccaggacgagctggtgggccgcgcccgggtctcccagggtgctggctggagcctccgcgagacggcctgcttaggcaagagctacgcacaaatgtggcagcttatgtacttccaccggcgcgacctccgactggccgcgaatgccatatgctcggccgtgcctgttgactgggtcccgaccagccgtacgacctggtccatccacgcccaccatcaatggatgaccacggaggatatgctgagtgtgtggaaccgggtgtggatcgaggagaacccctggatggaggacaaaacgcacatctcaagttgggaggatgtcccgtacctcggcaagcgcgaggaccagtggtgcgggtccctgatcggcctaacagcccgggcgacctgggccacaaacatccaagttgccattaatcaggtgcggcgcctcatcgggaacgagaactacctggactacatgactagcatgaagcggttcaaaaacgagtccgatccagagggggccctgtggtga

SEQ ID NO: 24700 - RNA, 9879 nt, synthetic construct
  misc_feature 1..9879: note = derived and/or modified CDS sequence (opt11) from DENV-1__KC762630__SS-prME
  source 1..9879: mol_type = other RNA
agcgtgaccgtgctgttcatgctgttgcccaccgcactcgccttccacttaaccactcgaggcggagagccccacatgatcgttagcaagcaggagcgcggcaagagcctgctattcaagaccagcgccggggtgaacatgtgcaccctcatcgccatggacctgggcgaactgtgcgaggacactatgacctacaagtgcccccgcattacggagactgagcccgacgatgtggactgctggtgtaatgccactgagacctgggtgacctacggaacctgcagtcagacgggcgagcaccggcgcgacaagcgatccgttgccctcgcgccacacgtgggcttggggctagagacccggaccgagacctggatgagctccgagggcgcctggaagcagattcagaaggtggagacgtgggctctccgccaccccggattcaccgtgatcgctctcttccttgcccacgcgattggcacctccattacccagaaaggcatcatcttcatcctcctgatgctggtgaccccctccatggctatgcgttgcgtgggcatcggcaaccgagatttcgtggagggactcagcggcgctacctgggtcgatgtggtgctggagcacggtagctgcgtgaccacgatggccaagaataagcccacgctggacatcgagcttctgaagaccgaggtgaccaaccccgccattctccggaagttatgcatcgaggcgaagatatctaacaccacgacagactccaggtgcccgacccagggagaggccaccctggttgaggagcaggacaccaacttcgtctgtcgccggacctttgtggaccgcggctgggggaacggttgcgggttgttcggaaaaggtagcctaatcacatgcgccaagttcaagtgtgtcacgaaactggagggtaaaatcgtccagtacgaaaatctgaagtactccgtgatcgtgactgtccataccggcgaccagcatcaggtggggaacgagaccaccgagcacggcacgacagccatcatcacgcctcaggcccccacctcagagatccaactcaccgactacggggcgcttacgttggactgcagcccccggaccggtctcgattttaacgagatggtcttgttgaccatgaaggagaagtcctggctcgttcacaagcaatggttcctcgatctgccgctcccgtggacctccggcgccagcacgtctcaggagacatggaaccgccaggacttgcttgtcacgttcaagaccgcccacgccaagaagcaggaggttgtggtgctcggctcccaggagggcgccatgcacacagctttgactggggccaccgaaatccagacctctggcaccaccaccatcttcgccggccacctgaaatgtcgcctcaagatggacaaactgacattgaagggcgtctcctatgttatgtgcacgggttcgttcaagctcgagaaagaggtggccgagacccagcacggtaccgttctggtccaggtgaaatacgagggcaccgacgccccctgcaagatcccgttctccagccaggatgagaagggcgtcatccaaaacggacgcctaatcacggcgaacccgatcgtgaccgataaggagaagcctgtaaatatcgaggccgagccgcccttcggggaatcttatatcgtcgtgggcgccggggagaaggccctgaagctcagctggttcaagaaagggtccagtatcgggaagatgttcgaggcgaccgcccgcggcgcccgccggatggcgatcctgggagacaccgcctgggacttcgggtccatcggcggcgtgttcacgagcgtcggaaagctagtgcatcaaatcttcggcacagcgtacggggtcttattctccggcgtctcgtggaccatgaagattgggatcggaatcctgctgacgtggctaggcctgaactctcgcagtacgtcgttgagcatgacctgcatagctgttgggatggtgacattgtacctgggtgtcatggtgcaagccgattccgggtgcgtgataaactggaagggccgcgaacttaaatgcgggtccggcatcttcgtcactaacgaggtgcatacgtggaccgagcagtacaagttccaggccgacagcccgaagcgcctctccgccgcgatcggtaaggcctgggaggagggtgtgtgtggcatcaggagtgccacccgcctagagaatatcatgtggaagcagatctccaacgagctgaaccacattctcctagaaaacgacatgaagtttaccgtcgtggtgggcgacgtctcaggcatcttggcccaggggaagaagatgatacgaccccagcccatggagcacaagtactcctggaaatcctggggcaaggccaagatcatcggtgcggacgtccagaacaccactttcatcatcgacgggcctaacaccccggagtgcccggataatcagcgtgcatggaacatctgggaggtggaggactacggtttcgggatcttcaccactaacatctggttaaagctgcgcgactcctacacgcaggtctgtgaccaccggctgatgtccgccgccatcaaagactccaaggcggtgcacgcggacatgggttattggatagagagcgagaagaacgaaacgtggaagttagcccgagcctcctttatcgaggtgaagacctgcatatggccgaagagccacacgctgtggtccaacggcgtgctcgagtcggagatgatcatccctaaaatctacgggggacccgtttcccagcacaactatcggccagggtacttcacgcaaaccgccggcccttggcacctcgggaagctggaacttgacttcgatctctgcgagggcaccaccgttgtcgtggacgaaaactgcggcaatcgcgggccgagcctccgaacgaccaccgtaaccggcaagacgatccacgaatggtgctgccgctcctgcaccctgccgcccttgagattcaaaggggaggacggttgctggtacggtatggagattcgccccgtcaaggagaaggaagagaatctggtcaaatctatggtgagcgcgggctccggcgaggtcgatagcttctccctggggctcctgtgcatcagcatcatgattgaggaagtgatgcgctcccgctggagccgcaaaatgctgatgacaggcaccctcgccgtcttcctgctgctcacgatgggccagctgacatggaacgatctgatccgtttatgcatcatggtcggcgccaacgcatccgacatgatgggtatgggaaccacatacctggcgctgatggccactttccggatgcgccccatgttcgccgtgggcctactgtttcgccgactgacctctagggagattctcttgttgaccgtcgggttatcgctggtagccagcgtggagctgccgaactccctcgaggagctgggcgacgggctggccatgggcatcatgatgctcaagctactgaccgactttcagccccaccagctctgggccacgctgctgagcctcactttcgtcaagaccaccctgtccctgcactacgcgtggaagacgatggccatgatcctcagcatcgtgtccctgctgcctctctgtctaagcaccacttcacagaagaccacctggctgccggtgctcctgggcagcctggggtgcaagcccctcacgatgttcctgataaccgagaacaagatctggggccgacgttcctggcccctgaatgaggggatcatggccatcggcatcgtcagcatcctcttaagctccctgcttaagaatgatgtgccactggccgggcccctgatcgcaggcggaatgttgatcgcctgctacgtgataagcgggtccagcgcggatctatcgctggagaaagccgccgaggtcagctgggaggacgaggccgagcactccggcgcctcacacaacatcctcgttgaggtgcaggacgacggcaccatgaagataaaggacgaagagcgggatgataccctcacgatcctcctaaaggccacactgctggtcatttctggcgtttatcccatgagcgtgcccgcaaccctcttcgtctggtacttctggcagaaaaagaagcagcgttccggggtgctgtgggacacccccagcccgcccgaggtggaacgggcggtcctggacaatggaatataccgcatactgcagcggggccttttagggcgcagtcaggtgggagtgggggtattccaggagggcgtgttccatacgatgtggcacgtcacccgcggggccgtcctgatgtatcaaggcaagcggttggagcccagctgggcctcggtgaaaaaggacctcatctcttatggcgggggctggcggttccaggggtcctggaacacgggcgaggaagtgcaggttatcgccgtggagcccgggaaaaacccgaagaacgtgcagaccacgcccggaaccttcaagacccccgagggcgagatcggggccatcgccctggacttcaagcccggtacaagcgggtcccctatcgttaaccgcgagggcaagatcgtgggcctatatgggaacggcgtggtcacaacgagcgggacttacgtgagcgcgatcgcacaagccaaagtgtcccaggagggccccctccctgagatcgaggacgaggtctttaggaagcgcaacctgaccatcatggacctccacccggggtcgggcaagacgcggcgatatctgcccgcgatcgtccgtgaggccatcaaacgcaagctccggaccctcgtgctggcgcccacgcgagtcgtggcttctgagatggctgaggccctgaagggcatgcccataaggtaccagaccacggcggtcaagagcgagcacaccgggaaggagatcgtcgacctcatgtgccacgccactttcaccatgaggctgctgtctccggtgcgcgtgcctaactacaacatgatcatcatggacgaggcccacttcacggaccccgcctccatcgctgcgcgcgggtacatctccacccgcgtcggcatgggagaagccgccgctatcttcatgaccgccacgccgcctgggtcagtggaggcgtttccacagtccaacgctgtcattcaggacgaagagcgggacatcccggagcgcagctggaactccggatacgagtggataactgatttccctggcaagaccgtctggttcgtccccagcatcaaatccgggaacgacatagccaattgcctccggaagaacggcaagcgcgtagtacaattgtcacgcaagaccttcgacaccgaataccagaagacaaagaataacgattgggactacgtagtcaccacggacatctccgaaatgggtgccaatttcagggccgaccgtgtgatcgacccacgccgttgcctcaagcctgtgatcctcaaggatggccccgagcgtgtcatcttggcggggccgatgcctgtgaccgtggccagcgccgcccaaagacgcggtcggatcggccgtaaccccaacaaggagggggaccagtacgtctacatgggccagcccttaaacaacgacgaggaccacgcgcattggacggaggccaagatgctcctggataacatcaacaccccggaagggattatccctgcactgttcgagccagaacgtgagaagtcggccgccatcgacggtgagtacaggctccgcggggaggcccggaaaaccttcgtggagttaatgcgccggggtgacctacccgtctggctcagctacaaggtcgccagtgagggcttccaatacagcgacagacgttggtgcttcgatggggagcgcaacaaccaggtgctggaggaaaatatggacgttgagatctggaccaaggagggcgagcggaagaagctgcgccctcggtggctcgacgcccgaacgtacagcgacccccttgccctgcgggagtttaaggagttcgccgcggggaggaggtccgtgagcggcgacttgatcctggaaattggtaagctgccccagcacctcacgctgaaggcccagaacgccctggacaatttagtgatgctgcacaactccgagcaaggcgggaaggcctaccgccacgccatggaggagttacccgacaccatcgaaaccctcatgctgctcgcgctcatcgcagtactgaccgggggagtcaccttatttttcctgagcggtcgaggcctgggtaaaacatccatcgggctcctttgcgtaatggcctcgtccgccctgttatggatggcaagcgtggaaccccactggatcgccgcttcaatcatactcgagttcttcctgatggtcctgctgatccccgagccggaccgccagcggaccccgcaggataaccagctggcatacgttgtgattggcctcctcttcatgattctgaccgtcgccgcgaacgaaatggggctgctcgaaactaccaagaaggacctgggcatagggcacgccgcggccgaaaaccaccaccacgccgcgatgctggatgtggacctccaccccgcgagcgcctggaccctgtacgccgtagccacgactatcatcacacccatgatgcggcacacaatcgagaacacaacggcgaatatatccctgaccgccatcgccaaccaggcagcgatcctcatgggcttggacaaagggtggccgatcagcaagatggacataggagtcccgctgctcgccctgggctgttattctcaggtgaaccccctgacactcaccgcagccgtgctgatgctggtcgcccactacgccattattggccctggcctccaggccaaggccacgcgggaggcccagaagcgcaccgccgcggggataatgaagaacccaaccgtggacggcatcgtagccatcgacctggacccggtcatatacgacgccaagtttgagaagcaactgggccagatcatgttgctgatcctttgcactagccagatcctcctgatgcggacgacctgggccctgtgcgagtccatcaccctcgccactgggcccctgactaccctctgggagggctcccccgggaaattctggaacaccacaatcgcagtgtccatggccaacattttccgcggcagctacttagccggcgccgggcttgccttttccttaatgaaatccttgggcgggggaaggcggggaactggcgcgcagggcgagaccctgggtgagaaatggaagaggcagctcaaccagctttccaagtccgagttcaacatttataagcgttccggcatcattgaagtcgaccggtccgaggccaaggaagggctgaagcggggcgaaaccacaaagcacgcggtcagccgcgggacagccaagctgcggtggtttgtcgagcgcaacctggttaagcccgaaggcaaggtcatcgacctcggctgcgggcgggggggttggtcctattactgtgctggcctgaagaaggtgacagaggtaaaggggtacaccaagggcggcccggggcacgaggagccgatcccaatggccacctacggttggaacttagtcaagctccacagtggtaaggacgtgttctttacgccgccggagaagtgcgataccctgctgtgcgacatcggtgaatcgagccccaacccgaccatagaggagggccgcactctccgcgtgctgaagatggtcgaaccctggctgcgtggaaaccaattctgcattaagatcctcaatccttacatgcccagtgtggtggagaccttggaacagatgcagcgcaagcacggcggaatgctggtccgaaaccccctcagcagaaactccactcatgaaatgtactgggtcagctgcggcaccggtaacatagtgtccgccgtcaacatgaccagccggatgctcctgaatcggttcaccatggcccaccgcaagcccacgtacgaacgggacgtggacttgggcgccggcaccagacacgttgcggtcgagcccgaagtcgccaacctggacatcatcgggcagcgcatcgagaacatcaagaacgagcacaagtcgacctggcactacgacgaagacaacccctacaagacctgggcataccacggcagctacgaggtcaagccctccggatcggcttcaagcatggtgaacggggtggttcggctgctcactaagccctgggatgtcatcccgatggtgacccagatcgcaatgacagacaccacaccatttgggcagcagcgcgtcttcaaggagaaagtggacacacggacccccaaggcgaagcgcggcacagcccagatcatggaggtgacggcacggtggctgtggggcttcctgagccgcaacaagaagccgcggatctgcacccgcgaggagttcacgcggaaggtccgctccaatgccgccatcggcgcggtgttcgtggacgagaaccagtggaactctgcgaaggaggccgtcgaggacgagcggttctgggacctcgtgcatagagagcgggagctgcacaagcagggaaaatgcgccacttgcgtctacaacatgatggggaagcgcgagaagaagctgggtgagttcggtaaggcaaagggctcccgggccatttggtacatgtggctcggggcgcggttcctggagttcgaggccctggggttcatgaacgaggaccactggtttagtagagagaactccttaagcggcgtcgaaggcgagggcctgcataagttaggttacatcctccgcgacatctcgaagatccccggtggcaacatgtacgccgacgacacagccgggtgggatacccggatcaccgaggacgacctgcagaacgaagccaagatcacggacatcatggagcccgaacacgccttactcgccacaagcatcttcaaattaacctatcagaacaaggttgtgcgcgtccagcgacccggcaaaaatgggaccgtcatggacgtgatctcccgccgcgaccagcggggcagcggccaagtcggtacctacggcctgaacacgttcaccaacatggaggcacagctcatcagacagatggagtccgagggtattttttccccgtccgagttagagacgcctaacctggcggagcgtgtgtttgactggttggagaagcacggcatcgagcgcctgaagcggatggccatcagcggggacgactgcgtggtcaagcccatcgacgaccgcttcgccaccgccctgacggccctcaacgacatgggcaaggtgcggaaggacatcccccaatgggagccatccaagggttggaacgactggcagcaagtcccattctgcagccaccatttccatcagctgatcatgaaggatgggcgcgagatcgtggttccttgccgtaatcaggacgagctggtgggcagagcgcgggtctcccagggggcgggctggagccttcgcgagactgcctgcctgggcaaaagctacgcacagatgtggcagctgatgtacttccatcggcgcgacctccggctggctgcgaacgccatttgttccgccgtgccggtggattgggtgccgaccagccgtaccacgtggtcgattcacgcccaccaccagtggatgaccactgaggacatgctgagcgtctggaaccgggtatggatcgaggaaaacccctggatggaagacaagacccacgtctcctcctgggaggacgtgccttatctcggaaagcgcgaggatcagtggtgcggctccctgatcgggctgaccgcgcgggctacgtgggcaacaaacatccaggtggccatcaaccaggtccggcgcctcatcggtaacgagaactacttggactacatgacctccatgaagcgcttcaagaacgagtccgaccccgagggggcattatggtga

SEQ ID NO: 24701 - RNA, 9879 nt, synthetic construct
  misc_feature 1..9879: note = derived and/or modified CDS sequence (opt11) from DENV-1__KC762641__SS-prME
  source 1..9879: mol_type = other RNA
agcgtgaccatgctgctcatgctgatgcccaccgccctcgccttccacctcaccacccggggcggagaaccccacatgatcgtgagcaagcaagagcggggcaaaagcctgttattcaagacaagcgcgggggttaacatgtgcaccctcatcgcaatggacctgggcgagctgtgcgaagacacactcacctacaagtgtccccgtatcaccgaagccgagcctgacgatgtggactgctggtgcaacgccactgacacgtgggtaacctacggtacctgcagccaaaccggcgagcaccggagggacaagcgcagcgtagccctggcgccccatgtcggcctggggctcgagacgcgcaccgaaacctggatgagctccgagggtgcttggaagcagattcagcgggtggaaacctgggcactccgccaccccgggttcacggtgattgccctgttcctcgcgcacgccatcggcacctccatcacgcagaaagggatcatcttcatcctgctgatgctagtgaccccttccatggccatgcggtgcgtcggcatcggcagccgcgacttcgtggaggggctgtccggcgcaacgtgggtggacgtcgtgctggagcacgggagctgcgtgaccaccatggccaaggacaagcctaccctcgacatcgagctgctgaagacggaggtcactaatccggcggtgctccggaagctgtgcattgaggccaagatcagcaacacaaccacggatagccgttgcccgacgcaaggcgaggccaccctggtcgaggagcaggacgcgaatttcgtctgccggcgcaccttcgtcgaccggggctggggtaacggctgcgggctgttcggcaaagggtcgcttatcacgtgcgccaagtttaagtgcgtgaccaagctggagggcaagattgtccagtatgagaacctcaagtacagcgtcatagtgacagtacacaccggcgaccagcaccaggttgggaacgagtccacggagcatggaaccaccgcgaccatcaccccgcaagcccccacgaccgagattcagttgaccgactatggggccctgaccctcgactgtagcccacgaacgggcctggacttcaacgagatggtgctgctcaccatgaaggaaaagtcctggctggtccataagcagtggttcctggacctccccctcccttggacctcaggggccagtacctcccaggagacgtggaacagacaggacctgctcgtgacgttcaagaccgcccacgcgaagaagcaggaggtcgtggttctgggcagccaggagggcgcaatgcacaccgccctgacgggggccaccgaaatccagacctccggcaccacgaccatctttgccgggcacctcaagtgccgcctgaagatggacaagttaaccctcaagggcatgagctacgtcatgtgcacggggagtttcaagctggagaaggaggtggcggagacgcagcacggcaccgtcctggtccagatcaagtacgagggcaccgacgccccgtgcaagatccccttcagcacacaggacgagaagggggtgacgcagaatggccggctaatcaccgccaaccctatcgtgaccgacaaggaaaagcccgtcaacatcgaggccgagccgcccttcggggagtcatacatcgttatcggcgccggcgagaaggccctcaagctgagctggttcaagaagggttccagcatcggcaaaatgttcgaggccaccgcccgcggggcccgccgcatggcgatcctgggcgatacggcctgggactttggtagcatcggcggcgtgttcactagcgtcggaaagctcgtgcaccagattttcggcaccgcctacggtgtgctattctccggggtgtcttggaccatgaagatcgggatcggagtgctgctcacgtggctgggcctcaacagccgcagcacctccctcagcatgacgtgcatcgccgttgggctggtcaccctgtatctaggcgtcatggtgcaggccgacagtggatgcgtcatcaattggaagggccgcgagctgaagtgcgggagcggcatcttcgtgacgaacgaagtgcacacctggaccgagcaatacaagttccaggcggacagccccaagcgcctgtctgccgccatagggaaggcctgggaggagggagtctgcggcattcgcagcgccacccgcctggaaaatatcatgtggaagcaaatctccaacgagctgaaccacattctgctcgagaacgacatgaaattcacggtggtggtcggggacgtcgcgggcatcttagcccaagggaagaagatgatccggccccagcccatggagcacaagtactcttggaagtcctggggcaaggccaagatcatcggcgccgacgtgcagaacacgaccttcatcatcgacgggcccaataccccggagtgtcccgacgaccagcgcgcgtggaacatctgggaggtcgaggactacggcttcgggatcttcaccacgaacatctggctaaagctccgggacagctacacccaggtatgcgaccaccgcctgatgagcgccgcaattaaagacagcaaggccgtgcatgccgacatgggctactggatcgaatctgagaagaatgagacctggaagctggcgcgggccagctttatcgaggtcaagacctgcatctggccaaagtcccatacgctgtggagcaatggggtgctggagtccgagatgatcatccccaaaatctatggaggcccgatcagccagcacaactaccgccctgggtacttcacccagaccgccggcccatggcacctggggaagctcgagctagacttcgacctgtgtgagggcaccacggtcgtcgtggacgagcattgcggaaatcgggggccctcgttgcgcaccaccaccgtgacaggcaaaatcatccacgagtggtgctgccgaagctgcaccttaccgcccctgcgcttccgtggggaggacggctgctggtatgggatggagatccgaccggtgaaggagaaggaggaaaacctcgtgaagtccatggtgagcgccggctcgggcgaggtcgactccttcagccttgggctgctctgcatcagcatcatgattgaagaagtgatgagaagcaggtggtctcggaagatgctgatgaccggcaccctggcagtgttcttcctccttataatggggcagctgacatggaatgacctcatccgcctgtgtatcatggtcggcgcgaatgcgtccgaccgcatggggatgggcaccacctacctggccctcatggccaccttcaagatgcggccgatgttcgcagtgggcttgctgttcaggcggttaacgtcccgtgaggtgctgctcctaaccattgggctgtcactggtcgcgtccgtggagctcccaaacagcctggaggagctgggcgacgggctcgccatgggcatcatgatccttaagctgctcaccgacttccagtcccaccagctgtgggcgaccctactgagcctgacgttcatcaagaccaccttctccctgcactacgcctggaagaccatggctatggtcctcagcatcgtatctctgttccccctgtgccttagcacgacctcacagaagaccacctggctgcccgttctgctcggcagcctggggtgcaaaccgttgactatgttcctcatcgccgagaacaaaatctggggccggaagtcctggccattgaacgaggggatcatggccgtcggcatcgtaagtatcttactgagctccctgctgaagaacgacgtgcccttggctgggcccttaatcgccggcggcatgctgatcgcgtgttacgtcataagcgggtcctctgcggacctctcccttgaaaaggccgccgaggtgagctgggaggaagaagccgagcactccggcgcgagccacaacatcctcgtggaagtccaggacgatgggacgatgaagatcaaggacgaggagcgcgacgacacactcaccatcctgctgaaagccaccctcctggccgtgtccggtgtgtacccgctgagcatccccgctaccctcttcgtctggtacttctggcaaaagaagaagcagcggtctggcgtcctgtgggacactcccagcccgcccgaggttgagcgagccgtcctggacgatggcatatatcggataatgcagcgcgggctgctcgggagatcccaagtgggcgtgggcgtcttccaggagaacgtgttccacaccatgtggcacgttacccgaggcgcggtcctgatgtatcaggggaagcgtctggagcccagctgggcatccgtgaagaaggacctcatctcatacggcggggggtggcgcctgcagggctcctggaatacgggggaggaggtgcaggtaatagccgtggagccaggcaagaaccccaagaacgtccaaaccgcccccgggaccttcaagacgcccgagggggaggtcggcgccattgcgctggacttcaagcccgggacgagcggttcccccatcgtgaaccgggaggggaagatcgtgggcctctacggaaacggggtcgtgaccaccagcggcacctacgtgagcgccatcgcccaggctaaggcctcacaggaagggcctcttcctgagattgaggacgaagtcttccgcaagcggaatctgacgatcatggatctccaccccggcagcgggaaaacccgtaggtacctgccggcaatcgttcgggaggcgatcaagagaaagctgagaaccctcatcctggccccaacacgcgtggtggcctccgagatggcggaagccctgaagggcatgcccatccggtaccagacgacagccgtcaaaagcgagcacactggcaaggagatcgtggacctcatgtgccacgccactttcacaatgcgcctgttaagcccagtcagagtaccgaactataatatgatcatcatggatgaggcccacttcaccgacccctcgtccatagcggcccgcgggtatatctctacccgggttggcatgggcgaggccgcggccatctttatgaccgcgacgcctcccggctccgtcgaggccttcccgcagagtaacgcggtgatccaggacgaggagcgcgacattcccgagcggagctggaacagcgggtacgagtggatcacagacttcccgggcaagaccgtgtggtttgtcccgtccatcaagagcggcaacgatatcgccaactgtctgcgcaagaatggtaagcgtgtgatccagctgtccagaaagaccttcgataccgagtatcagaagaccaagaacaatgactgggactatgtggtcaccaccgacatttctgagatgggggcgaatttcagggccgaccgcgtgatcgatccgcgacgctgcctgaaacccgtaatcttgaaggacggaccagagcgggtcatcctggccggccccatgccggtaacggtcgcatcggccgcgcagcgcagagggcgcgtgggccggaaccacaacaaagaaggcgaccagtacatatacatggggcagccactaaataacgatgaagaccacgcccactggaccgaagccaagatgctcctggacaacatcaatacaccggagggcatcattcccgccctgttcgagccggagcgcgagaagagtgccgcgattgacggagagtaccgcctacgcggcgaagcccgcaagaccttcgtcgagctgatgcggcgcggggacctcccggtctggctctcctacaaagtggctagcgagggtttccagtacagcgaccggcgctggtgcttcgacggcgagaggaacaaccaggtgctggaggagaacatggacgtcgagatctggacgaaggagggggagcgcaagaagctacggccccgctggctcgacgcacgtacctactccgaccccctggccctgcgcgagttcaaggagttcgcggccggacggagatcagtgtcgggggacctcatcctggagatcggcaagctgccccagcacctcacccagcgggcccagaacgccctggacaacctagttatgctgcacaacagcgagcagggcgggcgtgcgtaccggcacgccatggaagagctgcccgacaccatcgagacactgatgctcctagccctgatcgccgtcctcaccggaggggtgacgctgttcttcctgtccggacgcgggttgggcaagaccagtatcggtcttctgtgtgtgatggcttccagcgtccttttatggatggcgtccgttgagccccactggatcgccgccagcatcattctggagttcttcctcatggtgctgctgatccccgagccggatcggcagcgcacgccccaggacaaccagcttgcgtacgtcgttatcgggctgctgttcatgatcctcacggtgacggccaacgaaatgggcctgctggagaccaccaaaaaagacctcgggatcggccacgtcgcggtggagaaccaccaccacgccgccatgctggacgtggacctgcaccccgcctccgcttggacgctgtacgcggtcgccaccaccatcatcaccccgatgatgcggcacacgatcgagaacaccacagccaacatcagcctgaccgccatcgccaaccaggctgccatcctaatgggcctcgacaagggctggcccatctccaagatggatatcggcgtgcccttactggccctcgggtgctacagccaggtgaaccccttaaccctgactgcggcggtgttaatgctggtggcccactacgccatcatcggcccagggctgcaagctaaggcgactcgcgaagctcagaagcgcacggccgccggcattatgaaaaacccgacggtggatggcatcgtagccatcgacctcgacccggtggtgtacgacgccaagttcgagaagcaactggggcagatcatgctactcattctctgcacctcccaaatcctgctcatgcggaccacctgggcgctgtgcgagtccatcacgttagccaccggccccctaaccaccctctgggaggggtccccgggcaagttttggaacaccaccatcgccgtcagcatggccaacattttcagggggtcctacctcgctggcgcaggtctcgccttcagcctcatgaagtccttggggggggggcggcgcgggaccggggcccagggagagaccctgggcgagaagtggaagcgccagctgaaccagctgagcaagagtgagttcaacacgtacaagcgcagcgggataatggaggtggatcggtcagaggccaaggagggcctgaagcgcggggaaaccaccaaacacgccgtttcccgcggcaccgccaagctgcggtggttcgtcgagcggaacctggtgaagcccgaggggaaggtgatcgacttaggctgcggtcgcgggggctggtcttactactgcgcagggctcaagaaggtaacggaggtaaagggctacacgaagggcgggcccggccacgaggagcccataccgatggccacctacgggtggaaccttgtgaagctgcattccggcaaggacgttttcttcatccctcccgagaaatgcgacaccctcctgtgcgacatcggggagagctcccccaacccgacgatcgaggaggggaggaccctgcgcgtgctcaagatggtggaaccctggctgcgggggaaccagttctgcatcaagatcctgaacccgtacatgccctcagtcgtggaaacccttgagcaaatgcagcgcaagcacggcggcatgctcgtgcggaatccgctgtcacgcaatagcacccatgaaatgtactgggtctcctgtgggaccggcaacatcgtgagcgccgtgaacatgacgtcccggatgttgctgaatcgcttcaccatggcgcaccgcaagcccacatacgaacgggacgtcgacctgggggccggcacacgccacgtggccgtagaacccgaggtcgccaatttagacatcatcggccagagaatcgagaacatcaagcacgaacataaaagcacatggcactacgacgaggacaacccgtacaagacctgggcctatcacgggtcatacgaagttaagccatcgggttccgctagcagcatggtcaacggcgtggtgaagctgttaaccaagccctgggatgtcataccaatggtgacccagatcgcgatgacggacaccacccccttcggccagcagagagtgttcaaagagaaagtcgacacgcggacgccaaaagccaaacgcgggactacgcagatcatggaggtgaccgcccggtggctctggggcttcctgagtcgcaacaagaagccccggatttgcacgcgcgaggagttcacccggaaagtgcgctccaacgccgcgatcggcgccgttttcgtggatgagaaccagtggaactccgctaaggaggccgtggaggacgagcggttctgggacttggtccatcgcgagcgggagctccacaagcaagggaagtgcgcgacctgcgtgtacaatatgatgggtaagcgcgagaagaagctgggggaattcgggaaggccaaaggtagccgggccatctggtacatgtggctgggcgcccgcttcctcgagttcgaagccctgggcttcatgaacgaagaccactggttttcgcgggagaacagcctgtccggggtggagggcgaggggctgcacaagctgggctacatcctacgcgacatcagcaagatcccggggggcaacatgtacgcggacgacaccgccggctgggacacgagaatcaccgaggacgacttgcagaacgaggccaagatcaccgatatcatggagccggagcatgccttgttagccaaggcgatcttcaaactcacctaccagaataaagtcgtacgcgtgcagcgtcccgctaagaacgggacggtcatggacgtgatcagtagacgggaccagcggggcagcggccaggttggaacctacggattaaacacgttcaccaacatggaagcccaactgattcggcagatggaatccgaggggatcttctcgccgtcagagctcgagacgcccaacctggccgagcgcgtactggactggctcgaaaagtatggcgtggagcgcctgaagcggatggccatctccggggacgattgcgtggtaaagccgatcgacgaccgcttcgcgaccgctctgactgccctcaacgacatgggcaaggttcggaaggacatcccccaatgggagcccagtaagggatggaacgactggcagcaggtccccttctgcagccaccacttccaccagctgatcatgaaagatggccgcgaaatcgtggtgccgtgccggaaccaggatgagctggtgggccgcgcccgggtcagccagggggcaggctggagcctaagggagaccgcgtgcctgggcaagagttacgcccagatgtggcagctgatgtatttccaccggagggacctccggctggcagcgaacgcgatctgctccgccgtgccggttgattgggtccccaccagccgcaccacctggagcatccatgcccaccaccagtggatgacaacggaagacatgctgtcagtctggaaccgggtgtggatcgaagaaaacccctggatggaggacaaaacccacatctcatcatgggaggacgtcccatacttgggtaagcgcgaggaccagtggtgcgggtcccttatcggccttaccgcccgcgccacctgggcgaccaacatacaggtggccatcaatcaagtacggcgtctcatcggtaacgagaactacctggactacatgacgagcatgaagcggttcaagaatgagtccgacccagagggggccctgtggtga

SEQ ID NO: 24702 - RNA, 9879 nt, synthetic construct
  misc_feature 1..9879: note = derived and/or modified CDS sequence (opt11) from DENV-1__KC762648__SS-prME
  source 1..9879: mol_type = other RNA
agcgtgaccatgctgctcatgctgatgcccaccgccctggccttccatcttacaacccggggcggagaaccccacatgatcgtgagcaagcaggagcgaggcaaatcgctgctgttcaagacctccgccggggtgaacatgtgcaccctcatcgccatggacctgggcgagctttgtgaagacacgttgacctataagtgtccccgcatcacggaggccgagcccgacgacgtggactgttggtgcaacgctaccgacacgtgggtgacctacgggacatgctcgcagaccggcgagcaccggcgagacaaacggtcggtggccctggcaccgcacgttggcctggggttagagacgcgcaccgagacctggatgagctcggagggcgcctggaagcagattcagcgggttgaaacctgggccctacgccaccccgggttcacggtgatagccctcttcctcgcgcacgccatcggcacgtcaatcactcagaaggggatcatcttcatcctgttaatgctcgttaccccctctatggctatgcggtgcgtcgggatcggcagccgcgacttcgtggagggcctgagcggcgcaacctgggtggacgtggtgctggagcacgggagctgcgtgaccaccatggccaaggataaacccaccctcgacatcgagctgctgaagacggaggtcaccaatcctgcggttttacggaagctgtgcatcgaggccaagatcagcaacaccaccacggacagccgttgcccgacccaaggcgaagcgaccctggtggaggagcaagacgcaaattttgtctgccggcgcaccttcgtggaccggggctggggaaacggctgcgggctatttggcaagggatcgctgattacgtgcgccaagttcaagtgtgtgaccaagttagagggcaagatcgtacagtacgaaaaccttaagtacagcgtgatcgtgaccgtccacaccggcgaccagcatcaagtggggaatgagtccacagaacacggcaccaccgcgaccatcacgccccaggccccgaccacggagattcagctgaccgactacggggccctgaccctcgactgcagcccgcgtacgggcttagacttcaacgagatggtcctgctcaccatgaaggagaagtcctggctggttcacaagcagtggtttctggatttacccctgccctggacctccggggcctcgacatcccaggagacgtggaaccggcaggacctgctcgtgaccttcaagacagcccacgccaagaagcaggaagttgtggtcctgggaagccaggagggcgccatgcacaccgccctgacgggggctaccgaaatccagacatccgggaccactactatcttcgcggggcacctcaagtgccgtttaaagatggacaaattgaccctcaagggcatgagctacgtcatgtgtaccggttccttcaagctggagaaggaggtggcggagacccagcacggcaccgtgctggtccagatcaaatacgagggcaccgacgccccctgcaagattccctttagcacccaggatgagaagggggtgacacaaaacggcaggctgatcaccgccaacccgatcgtgaccgacaaagagaagcccgtcaatatcgaggctgagccgcccttcggcgagtcatacatcgtgatcggcgcgggcgagaaggcactcaaactgagctggttcaagaagggctcctctatcgggaagatgttcgaggccacggcccgcggggccaggcgcatggcgatcctgggcgacacggcatgggacttcgggtccatcggcggcgtgttcaccagcgtggggaagctggtgcaccagatattcgggacggcctacggtgtactgttcagcggcgtctcttggaccatgaagatcgggatcggcgtgctgcttacgtggctgggcttgaactcccgcagcacatctctcagcatgacctgtatcgccgtggggctggtcacgctttacctcggcgtgatggtgcaggccgactccgggtgcgtcatcaattggaaaggccgggagctgaagtgcggcagcggcatttttgtcacgaatgaagtgcacacctggaccgaacagtataagtttcaggcggactccccgaagcgcctgtccgctgccatcggaaaggcctgggaggaaggggtatgcggcatccggagcgccacgcgcctggagaacataatgtggaagcaaatctccaacgagctgaaccacatattactggagaatgacatgaagttcaccgtagtggttggggacgtggcgggtatcctggcccaggggaaaaagatgatccggccgcagccgatggagcacaagtactcctggaagtcctggggcaaagccaaaataataggcgctgacgtccagaacaccaccttcataatcgacggccccaacaccccggagtgccccgacgaccaaagggcgtggaacatatgggaggtcgaggactacggctttgggatcttcaccacgaacatctggctgaagttacgagacagctatacccaggtgtgcgatcaccgcctgatgtccgccgccataaaagacagcaaggccgtgcatgcggacatgggctactggatcgagtccgagaagaacgaaacctggaagctggcgcgggccagctttatcgaggtcaaaacatgcatctggcccaagtcccacacgctctggagcaatggggtccttgagtccgagatgatcatccccaagatctatggaggcccgatttcgcagcacaactatcgccctggttacttcacccagaccgccggcccctggcacctagggaagctcgaactggacttcgatctgtgcgagggcaccacggtggtcgttgacgagcactgcggcaatcgggggccctcactcagaaccactactgtcacgggaaaaatcatccacgaatggtgctgtcggagctgcacgctgccgcccctccgcttccgcggtgaagacggctgctggtacggaatggaaattcgccccgtgaaggagaaagaggagaacctcgtaaagagcatggtgagcgcggggagcggcgaggtcgactctttcagtctggggctgttatgtatctccatcatgatcgaggaagtgatgaggagccgctggagccggaagatgctaatgaccggcacactggccgtattctttttgctgattatggggcagttgacgtggaacgacctcatacgtctgtgcattatggttggcgcgaatgccagcgaccgcatgggcatgggcaccacctatctggccctgatggccacatttaagatgcggccgatgttcgccgtgggtcttctgttcaggaggctcacgtcccgtgaagtgctgctgctcaccattgggctgtccctggtcgcgtccgtggagttacccaatagtctggaggagctaggcgacgggctcgccatgggcatcatgattctgaagctgctcaccgactttcagtcccaccaactgtgggccaccctgctcagcctcacgttcatcaagactactttcagcctgcactacgcctggaagaccatggcgatggtcctctcaatcgtgtcccttttccccctgtgcttaagcactacctcccagaaaactacctggctgcccgtgctcctcgggagtttagggtgcaaaccgttgaccatgttcctgatcgcagagaacaagatctggggccggaagtcctggcccctgaacgaggggattatggccgtcgggatcgtgtctatcttgctcagctccctgctgaagaacgacgttcctctcgcagggccgctgatcgccggcggcatgctcatcgcgtgctacgtgataagcggctcaagcgctgatctctccctggagaaggcggccgaggtttcttgggaggaggaggccgaacactccggtgcgtcacacaacatcctggtggaagttcaggatgacgggaccatgaagatcaaggacgaggagcgcgacgacaccctaaccatcctactgaaggccactctactggccgtgtccggcgtgtacccgctgtcgatccctgcaaccctcttcgtctggtacttctggcaaaagaagaagcaaaggtccggggtgttgtgggacacccccagcccacccgaggttgaacgcgccgtcctggacgacggcatctaccgtatcatgcagcgcggcctgctcggaaggtcccaggtgggcgtgggtgtctttcaggagaatgtattccacaccatgtggcatgtgacccgcggcgcggtcctcatgtatcaaggcaaaagactggaaccctcctgggcatctgtgaagaaagacctcattagctacggtggagggtggcgacttcaaggctcctggaacactggggaggaggtgcaggtcatcgccgtggagcccggcaagaaccctaagaacgtgcaaactgcaccagggacgttcaagacccccgagggggaggtcggcgccatcgcgttagatttcaagcccgggacgagcggctcccccatcgtgaatcgagagggtaagatcgtgggcttgtacggaaacggggtcgtaacgaccagcggcacctacgtgagtgccatcgcgcaggccaaggcgtcccaggaagggccgctgcccgaaatcgaggatgaggtctttcgcaaacggaacctaacgattatggacctccatcccggcagcgggaagactcgccgctacctgcctgccatcgtgcgcgaggccatcaaacgtaagttgcgcaccctcatcctagcgcccacccgcgtggtcgcctccgaaatggcggaggccctgaagggcatgccgatccggtaccaaactaccgccgtcaagagcgaacacaccggcaaggagatcgtggacctcatgtgccacgccaccttcacaatgagactgctttcccccgtccgggtaccgaactacaacatgatcatcatggacgaagcacacttcaccgacccgagctctatagcggcgcgcgggtacatcagcactcgggtgggcatgggggaagcggcggccatattcatgaccgcgacaccgccaggatcagtcgaggccttcccgcagagcaacgcagtgatacaggatgaggaacgggacatccccgagcggtcctggaacagcgggtacgagtggatcaccgactttcccggcaagaccgtgtggttcgtcccctccatcaagagtggaaacgacatcgctaactgcctacgcaagaacgggaagcgggttattcagctgtcccgcaagaccttcgatacggaataccaaaagaccaagaataacgactgggattacgtggtcaccactgacatctcggaaatgggcgcgaacttcagggccgaccgcgtcattgacccgcggcgctgcctgaagcccgttatcctcaaggacggtcccgagcgggtcatccttgccggccctatgccggtgactgtcgcctccgccgcgcagcgtcgggggcgcgtgggccggaaccacaacaaggagggcgaccagtacatatacatggggcaacccctgaacaacgacgaggaccacgcccactggaccgaggccaagatgctcctagacaacattaacacccccgagggaatcatccccgccctgtttgagcccgagcgcgagaagtctgccgcgatcgacggtgaataccgcctgcggggcgaggcccgcaagacctttgtggaattgatgcggcgcggggacctgcccgtctggttgtcatataaggttgcttcggaaggcttccaatatagcgaccgacgatggtgcttcgacggcgagcgaaacaaccaggtgctggaggagaacatggatgtggagatctggactaaagagggggagcgtaagaaactgaggccccgctggttagacgcccgtacatactccgaccccctggccctgcgcgagtttaaggagttcgcagcaggccgccgctctgtatcaggggacttaatcctggagatcggcaagctgcctcagcacctcacccagcgagcccaaaatgctttggacaacctggtgatgctccataattcggaacagggcggccgcgcgtaccgacatgcaatggaggagttacctgacaccatcgagacgctgatgcttctggccctcatcgccgtcttgacaggaggggtcaccctgttctttctttccggccgagggctcggcaagaccagcataggcctgctgtgtgtgatggcctccagcgcgctcctgtggatggcctccgtcgaaccgcactggatcgccgcctcgatcatcctggagttcttcctcatggtgttactgatccccgagccggatcggcagcgcacgccacaggataaccagctcgcgtacgtggtcattgggctgctgttcatgatactcacggtggcggccaacgaaatgggcctgctagagaccaccaagaaggacctcgggatcggtcacgtggccgtcgaaaaccatcaccatgccgccatgctggatgtggatttgcaccccgcctccgcgtggaccctctacgccgtggccacgaccatcatcaccccgatgatgcggcataccattgagaacacgaccgccaatatcagcctgaccgcgatagccaaccaagccgccattctgatggggctcgacaagggctggcctatctccaagatggacatcggcgttcccttgttagctcttggatgttacagccaggtgaacccactgaccctgacggctgctgtgctgatgctggtcgcccattacgccataattggcccggggctacaggccaaggccactcgcgaagcccagaagaggaccgccgctggcataatgaaaaaccctaccgttgacgggatcgttgccatcgacttagaccccgtcgtttacgatgccaagttcgaaaagcagttaggccagatcatgctgctcatactttgcacttcccaaattttgctaatgcggaccacctgggccttatgcgaaagcatcaccctggccacgggtcccctaacgaccctgtgggaggggtccccgggcaagttctggaacaccacgatagccgtgagcatggcgaatattttccgggggtcttacttggccggcgccggtctggccttcagtttaatgaaatccctaggaggagggcggcgcgggaccggggcgcagggtgagaccctcggggaaaagtggaagcggcagctgaaccagctgtccaaaagcgagttcaatacctacaagcgctccgggatcatggaggtcgaccggagtgaggccaaggagggactaaagagaggggaaactaccaagcacgccgtgtcccgcggcaccgccaagctgagatggtttgtcgagcggaacttagtgaagcctgaggggaaggtaatcgacctgggatgtggcaggggaggctggagttactactgcgctggcctcaaaaaggtaaccgaggtcaagggctacacgaaaggcggccccggccacgaggagcccatcccgatggcgacgtatgggtggaacctggtaaagctgcactccggcaaggacgtgttcttcataccacccgagaaatgcgacaccttgctgtgtgacatcggggagagctcccctaaccctacaatcgaggaggggcggacgttacgcgttctcaagatggttgaaccctggctgcgggggaaccagttctgcatcaagatcctgaacccttacatgcccagcgtggtcgagactttagagcagatgcagaggaagcacggcggcatgctggtgcggaatccgctgtccagaaactcaacgcacgaaatgtattgggtctcgtgcgggaccggcaatatagtctcggctgttaacatgacgtcacggatgctcctgaacagatttacgatggcccacaggaaacccacctacgagcgggacgtggacctgggggccggcacccgccacgtcgcggtcgaacccgaggtggcgaacctcgacattatcggccagcggattgagaatatcaagcacgagcacaagagcacctggcactacgacgaggacaatccatacaagacgtgggcctaccacggatcctacgaggtcaagccgtccggttccgccagcagcatggtgaacggggtcgtgaagctgctcaccaagccctgggacgttatccccatggttacccagatcgccatgaccgacacgacaccctttggccagcagcgcgtgtttaaggaaaaggtagacacccgaacccccaaggccaaacgcgggacgacccagatcatggaggttaccgcgcgttggctctggggattcctgtcccgcaacaagaaaccccggatctgcacgagggaggagttcacgcggaaggtgagaagcaacgccgccatcggcgccgtgttcgtcgacgagaatcagtggaactcggcgaaggaggccgtggaggacgagcggttctgggatctagtgcacagagaaagagagctccacaagcaggggaagtgcgccacctgtgtatacaacatgatgggcaagagggagaagaaactgggggagttcggcaaggccaaagggtcacgggcgatctggtacatgtggctaggcgcgcgcttccttgagttcgaggccctcggcttcatgaacgaggaccactggttttcccgggagaatagcctgagtggggtggagggagagggcctacacaagctgggctacatactgcgtgacatcagcaagatacccgggggcaatatgtacgccgacgacaccgccggctgggacaccagaatcacggaggacgacctccagaacgaggccaagataaccgatatcatggagccggagcacgcgctactcgccaaggccatcttcaagctcacctaccagaacaaggtggtccgtgtgcagcgccccgccaaaaacgggaccgtgatggacgtcatctctcgtcgcgaccagagaggcagcggccaggtggggacgtatggcctgaacaccttcaccaacatggaggcccagcttatccgccagatggagtccgaggagatcttcagcccctcggaattagagacccccaacctggcggagcgggtgctagactggctcgaaaaatacggtgtcgagcgcctgaagcgcatggccatcagcggggatgactgtgtagtgaaaccaatagacgaccgctttgcaacggccttaacagcccttaacgatatggggaaggtcagaaaggacataccccagtgggagccgagcaagggctggaacgactggcagcaggtacccttctgcagccaccacttccaccagctgatcatgaaggacgggcgcgagatagtggtcccgtgccggaaccaggacgagttagttggccgcgcgcgagtgtcccagggcgccggctggagcctgcgcgaaaccgcgtgcctgggcaagagctacgcccagatgtggcagcttatgtattttcaccggcgcgacctccggctggcggccaacgccatctgctcggccgttcccgtggactgggtccctaccagccgcactacctggagcatacacgcccaccaccagtggatgacgacggaggacatgttgtcggtctggaaccgggtgtggatcgaggaaaacccctggatggaggacaagactcatatctcatcctgggaggacgtgccatatctcgggaaacgcgaggaccagtggtgcggctccctcatcgggctgaccgcgagagccacctgggcgaccaacatccaggtagccataaatcaggtgcggcgcctaatcggtaatgagaactatctggattatatgactagcatgaaacggttcaaaaatgagtccgatccggagggcgccctgtggtga

SEQ ID NO: 24703 - RNA, 9879 nt, synthetic construct
  misc_feature 1..9879: note = derived and/or modified CDS sequence (opt11) from DENV-1__KC762622__SS-prME
  source 1..9879: mol_type = other RNA
agcgtgaccatgttactcatgctgatgcccaccgcgctggcctttcacctcaccaccagaggcggggaaccgcacatgatcgtgagcaagcaagagcgagggaagtcactacttttcaagacgagcgccggggtcaatatgtgcaccctgatagcgatggacctgggcgagctgtgtgaggacacgctaacgtacaaatgtcccagaatcactgaggccgaacccgacgacgtggactgctggtgcaacgccactgatacctgggtgacatatggtacctgcagccaaaccggcgagcaccggcgagataagcgatctgtagccctggcgccccacgtggggctggggctcgaaacacgcaccgagacatggatgtcatccgagggcgcgtggaagcagatccagagggtcgaaacctgggccctgcgccaccccgggttcacagtgatggcgctgtttctcgcgcacgcgatcggcacttcgattacccagaaggggatcatcttcatactgctgatgttggtgaccccctccatggcgatgcggtgcgttggcatcggcagcagagactttgtggaggggctgtccggcgcgacgtgggtggacgttgtgcttgagcatgggagttgcgtgacaaccatggccaaggataagccaaccctcgacatcgagctgctaaagacggaggtcactaacccggcggtgttgcggaaactgtgcatcgaggccaagatttcgaacaccaccacggatagccgctgcccgacgcagggcgaagccacactggtggaggagcaagacgcaaacttcgtctgtcggaggacgtttgtggaccgtggctgggggaacggctgtgggctgttcggaaaaggatccctgatcacatgcgccaagttcaagtgcgtgactaagctggagggaaagattgtacagtatgagaacctcaaatactcggtgatagtcaccgtccataccggcgaccagcaccaggtgggaaatgaaagcacggagcacggaaccaccgcgacaatcacgccccaagcccccacgaccgagatccagctgactgactacggggccctgacactagattgttcgccccgcacgggcctggacttcaacgagatggtcctcctaaccatgaaggagaagtcctggttggtacacaagcaatggttcctcgacttacccttgccctggaccagcggggcaagcaccagccaagagacgtggaacaggcaggatctgctcgtgacgttcaagaccgctcacgcgaagaagcaggaggtagtggtgctgggcagccaagagggcgccatgcacaccgcgctgaccggagccaccgaaatccagacatccggcactaccacaatcttcgccgggcatttgaagtgccgcctaaagatggacaaactgaccctcaagggcatgagctacgtcatgtgcaccgggtcgttcaagctcgaaaaggaggttgcggaaacgcagcacggtaccgtgctggtccaaataaaatacgagggcaccgatgcaccctgcaaaatccccttctcgacgcaggatgagaagggggtgacgcaaaatggcagactaatcaccgccaacccgatcgtaacagacaaggagaagccggtaaacatagaggccgagccgccgttcggggaaagctacatcgtcatcggcgcaggcgagaaagcgttaaagctgtcgtggtttaagaaaggctcaagcatcggaaagatgttcgaggccacagcccgcggggcgcggcgcatggcgatcttaggcgacactgcctgggacttcgggtccatcggcggtgtgttcacaagcgtcgggaaacttgtgcaccagatcttcggcaccgcatacggggttctgttttccggcgtaagctggaccatgaagatcggtatcggcgtgctgttgacgtggctgggcctgaactcccgcagcacctccctcagcatgacgtgtatcgcagtggggctggtcaccttatatttgggcgtgatggtgcaagccgattcgggttgcgtaataaactggaagggccgggaactgaagtgcgggtcggggatcttcgtgacgaacgaagtccatacctggaccgagcagtacaagtttcaggctgactccccgaagcgcctttccgccgccatcggcaaggcgtgggaggaaggtgtgtgtggcatccgttcggccactagacttgaaaatatcatgtggaaacagatctccaatgagctgaaccacattctgctcgagaacgacatgaagtttaccgtggtggtcggagacgtggcaggcattctggcccaagggaagaaaatgattaggccccagcctatggagcataagtatagctggaagtcctggggcaaggccaagatcatcggggccgatgtacagaacacgacctttataatcgacggtcctaataccccagagtgtcctgacgatcagcgagcgtggaacatatgggaggtcgaagactacggcttcggtatcttcaccactaacatctggctgaaactccgggatagctatacccaggtgtgcgaccatcgcttaatgtccgcagcaatcaaggacagcaaagccgttcacgccgacatgggctactggatcgagtccgagaagaatgaaacctggaaacttgcgagggcctcgttcatagaggtaaagacttgcatatggcctaaatcccatactctgtggagcaatggcgtacttgagtccgagatgatcattcccaagatctacggcggccctaccagccagcacaactaccgccccgggtattttacccaaacggccggcccctggcatttggggaaactcgagctggacttcgatctctgcgagggtacgaccgtggtcgtcgacgagcactgcggcaaccggggtccctcgctccgcacaaccacggtgaccggcaaaataatccacgagtggtgctgccgcagctgtaccttaccgccgctgcgctttcgcggggaagacggctgctggtacgggatggaaatcagacccgttaaagagaaagaggagaacctcgtgaagagtatggtgtcagccggcagcggggaagtcgactcctttagtctagggctcttatgcatctccatcatgatcgaggaggttatgcggagccggtggtctcggaaaatgctgatgactggcacactggccgtgttctttctattgatcatggggcagttgacctggaacgacctcatccgcttgtgcatcatggtaggagcgaacgccagcgaccgtatggggatgggtaccacctacctggccctcatggcaacgttcaaaatgcggcctatgttcgccgtgggcctgctgttccggcggttgacctcccgcgaagtgctgttactaaccatcgggctgagtctggtagcgtctgttgagctcccgaacagcctggaggagctgggcgatggactcgccatgggcataatgatcctgaagctgctcaccgactttcagtcccatcagctgtgggccacgctgctcagcctgacattcatcaaaaccaccttcagtttacactacgcctggaagaccatggcgatggtgttgagcatcgtgtccctattcccgctgtgtctcagtacgacctctcagaagaccacgtggctacccgtacttctaggtagcttagggtgcaaacccttgaccatgttcctcatcgccgagaacaagatctggggccggaagtcctggcccttgaacgaagggatcatggcagtcggtatcgttagcatcctgctcagctccctgctgaaaaacgacgtgccactcgctgggccgctgattgccggaggcatgctgattgcatgctacgtcattagcgggtccagcgctgatttgtccctggagaaggccgccgaggttagctgggaagaagaagccgagcactctggagcgagccacaacatcttggtagaagtccaggatgatgggactatgaagatcaaggacgaagaacgcgatgacaccctaaccattctgctgaaagccacgctcctggcggtctcaggggtctacccgcttagcatccccgccacactcttcgtgtggtatttctggcagaaaaagaagcaacggagtggggtactttgggatacgccctctccgcccgaggtagagcgcgccgttctggacgacggcatctaccggatcatgcaacgcggactgctcgggcggagccaggtgggggtgggagtctttcaagagaacgttttccacaccatgtggcacgttacgcgcggtgctgtcctgatgtatcaggggaagcggctggagcccagctgggcctccgtgaagaaggacctcatcagctacggcggagggtggcgactgcagggttcgtggaacaccggtgaggaagtgcaggtcattgcggtggaacccggcaagaatccaaagaatgtgcagaccgcccccgggacgttcaagacgcccgaaggcgaggttggcgccattgccctggacttcaaaccggggacgtccggatcgcccatagtgaaccgagagggtaagatcgtgggcttatatggcaacggcgtcgtcacgacgagcggcacctatgtcagcgccatcgcccaagccaaggcgtctcaggagggcccgttgcccgagatcgaggacgaggtgttccgcaagcggaacctgaccatcatggatctccaccccgggagcgggaagaccagacggtatctgcctgccatcgtgcgcgaggccataaagcggaagctgcgaacactcatcctggcccctacgcgcgtcgtcgcctccgagatggctgaggccctgaagggcatgcccatccggtaccagaccacagccgtgaaaagcgagcataccggcaaggagatcgtggatcttatgtgccacgccacattcaccatgcgcctgttgtctcccgtacgagtgccgaactacaacatgatcatcatggacgaggcacacttcacggaccccagctcgatcgccgcgagagggtacatttccactcgggtgggcatgggggaagcggccgccattttcatgacagccaccccgccaggcagtgtggaggcattcccacagagcaacgccgtgatccaggatgaggagcgcgacatacccgagcgatcctggaacagtgggtacgagtggatcactgactttcccggcaagaccgtgtggttcgtgccttccataaagagcggaaacgatatcgcaaactgtctccgcaagaacgggaagcgagtaatccagctgtcacgcaagacttttgacaccgagtatcaaaagaccaaaaacaatgactgggactacgtggtgacgacagatatcagcgaaatgggtgcgaacttccgggcagacagagtcatagatcctcggcgctgtctcaagcctgtgatcttgaaggacgggcccgagcgggtcattctggccggccccatgcctgtcactgtggcgtccgccgctcagcgccgcggtcgcgtggggcgtaaccacaacaaggagggcgaccaatacatctatatggggcaaccactgaacaacgacgaggaccacgcccactggaccgaggccaagatgctcctggacaacatcaatacacccgagggcatcatccccgcgctttttgagcccgagcgcgaaaagagtgccgcgatcgacggtgagtaccgcctcaggggcgaagcgcgcaagacgttcgtggaactgatgaggcgaggggacttaccagtatggctctcttacaaagtggccagcgagggctttcaatatagtgaccggcgctggtgctttgacggcgaacggaacaaccaggttctggaagaaaacatggatgtcgagatatggaccaaggagggtgagcgcaagaaattacggccgcgctggttagacgcccgcacctacagcgaccctctagcgctgcgcgagttcaaggagtttgcggccggaagacgcagcgtgtccggagacctcatcctggagatcggcaagctacctcagcatctcacgcagcgtgcacagaacgctctggacaacctggtgatgctccacaacagcgagcagggagggcgggcgtaccggcacgccatggaggagttacccgacacgattgagaccctgatgctcctggcactgattgccgtactcacaggcggggtgaccttatttttcctatcgggccgcggcctcggaaagacaagcatcggcctactgtgcgtaatggcatcctcagtccttctgtggatggcgtcagtggagccccattggatcgccgccagcataatcttagagttcttcctgatggtgctgcttatcccagaacccgatcgccagcgcacgccccaggataaccagctcgcctacgtagtgatcggattactgttcatgatcctcaccgtggccgcgaacgagatgggccttctggagactacgaagaaggacctcggcattggccacgtggccgtggagaaccaccatcacgccgccatgcttgacgtcgacctgcacccggcgtccgcatggaccctatatgccgtagcgaccacaataatcaccccgatgatgcggcatacgatcgagaacaccaccgccaacatcagcctgacagccattgcgaaccaagcggctatcctgatggggctcgacaagggctggccaatctccaagatggacatcggcgtgccgttgctggccctcgggtgctactcccaagtgaaccccctaaccctgaccgcagccgtcctcatgctggtggcccactacgcaatcataggtccggggctacaagccaaggcaacccgcgaggcccagaagcgcacagcggctggtatcatgaagaacccaacggtggacgggatcgtcgccatcgacctcgaccccgtggtttatgacgcgaagttcgaaaaacagttgggccagattatgctgctcatcctgtgtacctcacagatcctcctcatgagaaccacctgggcgctgtgcgagagcattacgctggccaccggccccctcaccaccctgtgggagggttcccccggcaagttctggaatactacgatagccgtaagcatggcgaatattttccgcgggtcctaccttgcaggcgccggcctcgcattcagcctgatgaagagtctcgggggtgggcggcgcgggaccggtgctcaaggagagactttgggggaaaaatggaagcggcaattaaatcagctgtccaagtcggagttcaacacgtacaagagatccgggatcatggaggtggaccgcagcgaagcaaaggagggcctcaagcgcggggagaccaccaagcacgccgtgtcccgtggaaccgcgaagttacgctggttcgtggaacgtaacctcgtgaaacccgagggcaaagttatcgatctgggttgcgggcgcggtggctggagttactactgcgcgggcctgaagaaagtcacggaggtgaaaggatacaccaagggcggccctggccatgaagaaccgatcccgatggccacctatgggtggaacctggttaagttacactctggcaaggacgtcttcttcatcccgccagagaagtgcgacaccctcctgtgcgacatcggggagagcagtcccaacccgacgatcgaggagggtcggacccttcgagtgctcaagatggtggaaccctggctgcgggggaatcagttttgtatcaagatcctgaacccatacatgcccagcgtcgtggagactctcgagcagatgcagcgcaaacacggcggcatgttggtgaggaacccgctatcgaggaacagcacgcacgaaatgtactgggtgtcctgcggaaccggcaacatcgtgagcgcggtcaatatgacgagtcgcatgctccttaaccgcttcaccatggcccacaggaagccaacttatgagcgagacgtcgatctgggagcgggcacccggcacgtggcagtagagccggaggttgccaacctcgacatcatcggacagcggatcgagaatattaaacacgaacataagagcacatggcactatgacgaggacaacccttataagacctgggcataccatggctcttacgaggtgaagcctagcggatccgcctcttcgatggtaaatggtgttgttaagctactgaccaagccctgggacgtcatcccaatggtaacgcagatcgcaatgacggatactaccccctttggccagcagcgtgtgttcaaggagaaggtggacacgcgaacgcctaaagccaaacgcgggactacccagatcatggaggtgaccgcccggtggctctggggtttcctttcccgcaacaagaagccccgaatctgcacacgcgaagagttcatccgaaaggtgagaagcaacgcggccataggcgccgtttttgtggacgaaaaccagtggaactctgcaaaagaggcggtggaagacgagcgattctgggacctggttcaccgcgagcgggaactccacaaacaaggaaagtgcgcgacctgcgtctacaacatgatgggtaagcgcgagaagaagctgggggagtttgggaaggccaaggggagccgggccatctggtacatgtggttgggcgcacggtttctcgagtttgaggccctaggctttatgaatgaggatcattggttctcccgagaaaacagcctgagcggggtggaaggggaggggctccataagctgggctacattctgcgcgacatttccaaaatccccgggggcaacatgtacgccgacgacaccgccggatgggacaccagaataaccgaggacgacctgcaaaacgaagccaagatcaccgacatcatggaaccggagcacgcccttctggcgaaggcaattttcaagctcacctaccaaaacaaagtagtaagagtgcaacgccccgcaaagaacgggaccgtaatggacgttatctccagacgcgaccaacggggcagcgggcaggtcgggacgtacggcctgaacaccttcacaaacatggaagcccagctgatcaggcagatggagtccgaggggatcttcagcccctccgaactcgaaacaccgaaccttgctgagcgggtgctggactggctcgagaagtacggcgtagagcgcctgaagcggatggctatctcaggcgatgactgtgtggttaagccaatcgacgaccgattcgccactgcccttaccgccctcaacgacatggggaaggtgcggaaggatattccccagtgggagccgagtaaaggttggaatgattggcagcaggttcccttctgcagccaccactttcatcagctgatcatgaaagacggtcgcgaaatcgtcgtgccgtgccgaaaccaggacgaactggtgggcagggcccgggtttcccagggggcaggctggtccctccgcgaaaccgcctgcctcggcaagtcctatgcacagatgtggcagttgatgtacttccacagacgcgaccttcgtctcgccgcgaatgccatctgcagcgccgtgcccgtggactgggtacctacgtcacgaacgacctggtctatccacgcccaccatcagtggatgaccaccgaggacatgctgagcgtgtggaacagggtgtggatcgaggagaacccctggatggaagataaagcccacgtctctagctgggaggacgtgccgtacttgggtaagagagaggaccagtggtgcgggtccctgatcggcctgacagcgcgcgctacctgggcgactaacatccaggttgccatcaatcaggtcaggagactgattggcaacgagaattatctggactacatgacctctatgaagcggttcaagaacgagtccgacccagagggagccctgtggtga

SEQ ID NO: 24704 - RNA, 9879 nt, synthetic construct
  misc_feature 1..9879: note = derived and/or modified CDS sequence (opt11) from DENV-1__KC762629__SS-prME
  source 1..9879: mol_type = other RNA
agtgttacaatgctcctgatgctcatgccgactgcactggcattccaccttaccactagagggggagaaccacatatggttgtaagcaaacaagaacgcgggaaatccttgcttttcaaaacaagcgcaggggtaaatatgtgtacacttatcgcaatggacctaggagaactctgcgaagacacgctgacgtataaatgtccccgaattacggaagccgaacccgatgatgtcgactgctggtgtaacgcgactgacacctgggttacatacggaacctgcagccaaactggtgagcaccgcagggacaagcgttcagtcgcactcgcgccgcacgtcgggctaggattggagacacgtacggaaacctggatgagttcagagggggcgtggcgacaaatccaacgcgtagagacctgggctctccgacaccccgggttcacagtcatagcactgttcctagcacacgccatcgggacaagtatcactcagaaggggataatatttatcctcttaatgctggtcacaccgtcgatggccatgagatgcgttgggataggaagcagggatttcgtggagggactgtcgggcgcgacctgggtcgacgtggtgctagaacacgggtcgtgcgtcacaacaatggcaaaggacaaaccgaccctcgacatagaattactaaagacggaggtaaccaatccggccgttctgcggaagctgtgcatcgaagcaaaaatttcgaacacaaccaccgactcccggtgccccacccagggcgaggcgacgcttgtggaggaacaagacgcaaatttcgtgtgcagacggacgttcgtggacaggggatgggggaacggctgcggactattcgggaaaggatctttgattacgtgcgcaaaattcaagtgtgtgaccaaactcgaaggcaagattgttcaatacgaaaacctaaaatacagtgtcatagtaactgtccacacgggagaccaacatcaagtaggaaacgaatcgacagagcatggcacaacagctacaatcacaccccaagcgcccacgaccgaaattcaactaacggactacggtgcccttacactagattgctccccgcgaaccggactagacttcaacgaaatggtactccttacaatgaaagagaagtcatggctagtacacaaacaatggtttctggatctcccgctcccctggacatcgggggcatcgacttcccaggagacgtggaaccgacaagacctattagtaactttcaaaacggcacatgccaagaagcaggaagtcgtggtactaggatcccaagagggcgcgatgcacaccgctcttacaggcgccaccgaaatccaaacgtcgggtacaaccacaatctttgcgggccacctaaagtgccgcctgaagatggataagttgaccctgaaaggaatgtcctacgtaatgtgcacagggtccttcaagctagaaaaagaggtagctgaaacgcaacacggcaccgtcctagtacaaattaagtacgaaggaaccgatgcgccttgcaaaatacccttctcaacccaggatgagaagggagttacgcagaatggcaggctaataaccgcaaaccccatagtaacagacaaagaaaaaccagtaaacatagaagcagagccaccatttggggagtcgtacattgtcataggagccggtgagaaaaccctaaagttatcctggttcaagaaaggcagcagcatagggaaaatgtttgaagcgactgcgagaggcgcacggagaatggcaatcctaggcgacacagcatgggacttcggcagcataggtggcgtatttacaagcgtaggtaaacttgtgcaccagatattcggtactgcctacggcgtacttttcagcggtgtaagctggacaatgaagataggcataggagttcttttgacttggttagggctcaactcccgcagcacatcactgtccatgacctgtatagcggtcgggctcgtcaccctctatctaggcgtaatggtgcaggcagacagcggctgcgtcatcaactggaaaggccgcgaactcaagtgcggaagcggtatcttcgtaacaaacgaagtacacacttggacagagcagtacaaattccaggccgactcccccaaaaggcttagtgcggcaatcggaaaagcgtgggaagaaggagtgtgcggcataagaagcgccaccaggctagaaaacataatgtggaaacaaatctccaacgagctgaaccacatcctactggaaaacgatatgaagtttactgtcgtagtaggggacgtcgcgggcattctggcacaaggcaagaaaatgattagaccccaacccatggagcacaaatactcttggaaaagctgggggaaagctaagataataggcgccgacgtccaaaacacaaccttcattatagacgggccgaacacaccagaatgccccgacgatcaacgtgcgtggaatatctgggaggtggaagactacgggttcgggatattcacaaccaacatttggctcaagctacgggactcctacacgcaagtttgtgaccatcgtttaatgtcagcagccataaaggattccaaggcggtacacgcggacatgggatactggatcgaatcagaaaagaacgaaacgtggaagctcgcgcgagcttccttcatagaagttaagacgtgtatatggccaaagagccacaccctctggagcaacggtgttctagaaagcgagatgatcatccccaaaatatacgggggcccaatctcacaacacaattaccgaccaggctatttcacacaaaccgccgggccttggcacctcgggaagctagagttagacttcaacctctgcgaaggtaccaccgttgtagttgacgaacactgcggaaacaggggcccatcactgagaaccaccacggtaacaggcaaaatcattcatgaatggtgctgccgcagctgcacgctaccgccgctgcgcttcaggggcgaggacggttgctggtatgggatggaaatccgaccagtcaaggagaaagaagagaacctcgtgaaaagtatggtatcagccgggtctggagaagtcgattccttcagtcttggtctactgtgtatttcaataatgatagaagaggtgatgcgctctaggtggagcagaaagatgctaatgaccgggacactcgccgtatttttcttactcatcatgggacaactaacctggaacgacctgataagattatgtataatggtgggggccaatgccagcgaccgaatgggaatgggcaccacttacctggcgttgatggcgacattcaaaatgcgcccgatgtttgcggtaggactattgttcaggcgcttaacaagtagggaggtactactcctaacaataggtcttagtctagttgcaagtgtcgaactccccaactccctggaggaattgggagacggactagcaatgggaatcatgatcctaaaactgttaacggacttccaaagccaccaactttgggcgacattactcagcttgacattcattaagaccactttctcgctgcactacgcatggaagaccatggccatggtactatcgatcgtgtcgctattccccctgtgtcttagtaccactagccaaaagacaacatggctccctgttctgttaggtagccttggctgcaagcctctgacaatgttccttatagctgagaataaaatatggggccgaaagagctggccgttaaatgaaggaattatggccgtcgggattgtttcaatactcttatcctccttactcaaaaacgacgtgcccttagcaggaccactcatcgccgggggcatgttgatagcctgctatgtcataagcgggagctcagcagaccttagcttggaaaaagccgccgaggtgagttgggaggaagaagcggagcattccggcgcgtctcacaacatcctagtagaagtccaagacgacggtactatgaaaatcaaggacgaagaacgagacgacacgctaacgatcctactaaaagccacactgctcgcggtaagcggcgtatacccactaagcatcccagcgactttattcgtgtggtacttctggcagaagaagaagcaaagaagtggagtattatgggacacccccagcccgccagaagtagagcgagccgtcctcgacgacggaatctaccgaataatgcaaaggggtctcctaggaaggagccaggtaggggtaggagtattccaagaaaacgtttttcacactatgtggcatgtaaccaggggtgcagtcctcatgtaccaagggaagcggcttgaaccgtcgtgggccagtgtcaagaaagaccttataagctacggcggagggtggcgcctccaggggtcgtggaacactggggaagaagttcaagtaatagccgtcgagcccggcaaaaatccgaaaaacgtacaaactgcaccaggaacctttaaaacaccagagggggaagtaggcgccatagcattagacttcaagcccgggaccagtgggagtccgatagtgaacagagagggcaaaatcgtcgggctttacggtaacggggtagtcacgactagcggtacctatgtcagtgcaatagctcaagctaaggcatcacaagaaggaccgctcccggaaatcgaggacgaagtcttccgaaaaaggaacctcacgataatggacctgcacccaggcagcggcaagacgaggcgatacctaccagcaatcgttcgagaagcgattaaacgaaaactgcggacgttaatcctggcaccgaccagggtggtagcgtctgaaatggcagaggccctgaaggggatgccaattcgataccagacaaccgcagtgaagtcagagcatacaggtaaggaaatagtagacctgatgtgccacgccaccttcacaatgcgccttctcagccccgtaagagtcccaaactacaatatgataatcatggacgaagctcattttactgacccctccagcatcgcggcacgcgggtacatcagtacacgagttggaatgggagaggccgccgcaatcttcatgactgcaacgccgcccggatccgtagaggcctttcctcaatcaaacgctgtcatacaggacgaagaacgcgacatcccagaacggtcgtggaactctggatatgagtggatcacagacttccctgggaaaacagtatggttcgttccgtccataaagagcggcaacgatatcgcaaattgcctccggaaaaacggcaaacgggtgattcaactctcacgaaagaccttcgacacagaataccagaaaaccaaaaataacgattgggactacgtggtcacaaccgacattagcgaaatgggcgcaaacttcagggcagacagagtaatagacccaagaagatgcctcaagccggtaatactaaaagatggacccgagcgagttatattggccggccctatgccagtgaccgtggccagcgcggctcaacggcgagggcgcgtcgggcggaaccacaataaagaaggagaccagtatatatacatggggcaacctctaaacaatgacgaagatcacgcgcactggacggaggcgaaaatgttgctcgacaatatcaacaccccagaagggatcatacccgcactgttcgaaccagagcgagagaagagtgcagctatagatggggaataccgactacgtggcgaagcccgtaaaacattcgtcgagttaatgcgacgaggagacctacccgtctggcttagctataaagtggcatccgaaggcttccaatactcagacaggcgttggtgtttcgatggggaacgtaacaaccaagtattagaagaaaacatggatgtagagatatggaccaaggaaggcgagcgaaagaagctacgaccacgatggttggatgccagaacctactccgacccgttggccctaagagagtttaaagagttcgctgccggaagacgatcggtttcaggcgacctaatcctagaaatcggcaaactgccccaacacctgacgcaacgagcacagaacgctctcgataacctggtgatgctacacaacagcgaacaaggcgggcgagcctaccgacacgcaatggaagaattgccagacaccatcgaaacactaatgctgttggcactaatagccgtgctgaccgggggagtcaccctctttttcctctcaggacgcggtctagggaaaacgtcgatcggccttctgtgcgtcatggcctctagcgtcctcctgtggatggcgagcgtggagcctcactggatcgcggcaagcataatactagagttcttcctcatggtcctgctaatacccgagcccgatagacaaagaacaccacaagacaatcaactcgcatacgtagttatcggactgttatttatgatcctaacagtcgccgcgaacgagatgggcctcctagagaccacgaaaaaggacctcggcattgggcacgtggcggtcgaaaaccatcatcacgccgcaatgcttgacgtggaccttcacccagcgagtgcatggaccctctatgccgtggcaaccacgatcataacccccatgatgcgccacacgatcgagaataccacggcaaatatatcgctcacagcaatcgctaaccaagcagcaatcctaatgggactagacaaggggtggccaatttccaaaatggatatcggggtacccctattggcgctaggatgctactcccaggtgaaccccctcaccctaacagccgctgtacttatgctagtagcacactatgccattatcggaccaggcctacaggcaaaagcaacgcgggaagcacagaaaagaactgccgccgggatcatgaaaaacccgacggtcgatggcatagtagccatagacctggaccccgtcgtgtatgacgcaaagtttgagaaacagttgggacagataatgctactgatactctgcacatctcaaatcctactaatgcgtaccacctgggccctgtgtgaaagcattacactcgccacgggaccactcacaactctctgggaaggcagccctgggaagttctggaacaccactatcgcggtatcaatggcaaatatatttcgaggtagttacctggccggcgcagggctcgccttctccttgatgaaaagcctgggcggaggacgtcgaggcactggcgcacaaggcgaaacgttaggagaaaagtggaagcgacagctaaaccaactaagcaagtcagagttcaacacatataagcgctcgggcataatggaggtagaccgaagcgaggccaaggaagggctcaaacgaggggagaccacgaagcacgcagtatcaagagggacagcaaagctacgatggtttgtagaacggaacctagttaagcccgaaggcaaggtgatagacctaggctgtgggcgtggcggctggagctattactgcgcaggcctaaagaaagtaacagaggtaaagggatacaccaaaggagggcccggacacgaggaacccatcccaatggcaacatacggatggaatttagtcaaactacacagcggaaaggatgtattcttcataccgccggagaaatgcgacactctattgtgcgatattggggaatcaagcccgaacccgaccatagaagagggccggaccctccgagtcctaaagatggtagaaccctggctgcggggtaaccagttctgcataaaaatcctcaacccgtatatgccgtccgtcgtcgagacactagaacaaatgcaaaggaagcacggcggcatgttagtacgaaatccgctatcccgaaatagcacacacgaaatgtactgggtgagctgcggaacaggcaacatagtatctgcagtcaacatgacctctagaatgcttctgaatcgcttcacgatggcacatcgcaaaccgacctacgaacgcgacgtagatctaggagcgggaaccaggcacgtcgccgtcgagcctgaagtagcgaacttagacatcatcggccaaaggatagagaatatcaagcacgaacacaagagcacctggcattacgacgaagacaatccctacaagacatgggcgtaccacggaagttatgaagtcaaaccttccggaagcgccagctcaatggtcaatggagtggtaaaattactaaccaaaccgtgggacgtgataccaatggtcacccagatagccatgaccgacacaactccatttggccaacagagagtcttcaaagaaaaagtagatacacgaacccccaaagcgaagagaggaactacacagataatggaagtcacggcccggtggctgtggggctttctcagccgaaataagaaaccaaggatttgcacacgggaggagttcacgagaaaagtgaggagtaacgcggcgataggggcggtcttcgtcgacgaaaatcaatggaactcagcgaaagaagcggtggaagacgaaaggttctgggacctcgtgcacagggaacgagaactacacaaacaaggcaaatgtgcaacgtgcgtatacaacatgatgggcaagagagagaaaaagttaggcgagttcggcaaagccaagggcagccgcgccatttggtacatgtggcttggagcacgctttctggaatttgaggccctgggcttcatgaacgaagaccactggttctcccgcggaaacagcctgagcggagttgaaggagaaggcctgcacaagctcggctatatactgcgggatatttccaagataccgggcgggaacatgtacgccgacgatacggcaggatgggatacccgcatcaccgaagatgacttacagaacgaagctaaaatcacagacatcatggaaccagaacacgctctcctggctaaggcgatattcaagctcacataccagaataaggtcgtccgagtccaaagaccggctaaaaatgggaccgttatggacgtgatcagccgccgggaccaaaggggcagcgggcaagttgggacctacggactcaataccttcactaacatggaagcccaactgatcagacagatggaaagcgaagggatcttctcccccagtgaattagaaacaccaaacctcgccgagcgggtgctagattggctagaaaaatacggcgtcgaacgcctcaagcgcatggctataagcggagacgattgcgtagttaagccaattgatgacagatttgcaactgcgcttacagccctaaatgacatgggtaaggtgcgcaaagacatccctcaatgggaacctagtaagggctggaacgactggcaacaagtcccattctgcagccaccacttccatcagctcataatgaaggacggacgagaaatcgttgtcccctgtagaaaccaagacgaattggtaggtcgagcccgagtcagtcagggagcgggttggagcctgagagaaacggcgtgcctcggcaagagttacgcccagatgtggcagctcatgtacttccaccgacgggatctccgacttgctgctaacgcaatatgttcggcagtaccagtagactgggttccgacatccagaacaacgtggagcatacatgcacaccatcaatggatgacaacagaagacatgctgagcgtctggaaccgtgtctggatcgaagaaaatccatggatggaggacaagacgcatatcagctcgtgggaggacgtcccatacctaggaaaacgcgaagatcaatggtgcggttccctcataggcctgaccgcacgtgccacatgggccacgaatatccaagtggccattaaccaagtacgccgcctaataggtaacgagaattatctggactacatgacctccatgaagagattcaaaaatgagtctgacccggagggcgcgctgtggtaa

SEQ ID NO: 24705 - RNA, 9879 nt, synthetic construct
  misc_feature 1..9879: note = derived and/or modified CDS sequence (opt11) from DENV-1__KC762627__SS-prME
  source 1..9879: mol_type = other RNA
agcgtgaccatgctgctcatgctgatgcccaccgccctggcattccacctcaccacccggggaggggagccccacatgattgtgagcaagcaggagcggggcaagagccttctgttcaagaccagcgccggggtgaacatgtgtacgctcatcgccatggacctgggcgaactgtgcgaggacaccctgacgtataagtgcccccgcatcaccgaggccgagcccgatgatgtggactgctggtgtaatgccaccgacacgtgggtgacatacgggacttgcagccagacgggggagcacaggcgcgacaagcggtcggtggcacttgccccccatgtgggcctggggctcgagacgcgcaccgaaacctggatgagctccgaaggcgcctggaagcagattcagcgggtggagacctgggccctgcgccaccccgggttcacggttatcgcgctgttcctcgcgcatgccataggaacaagtatcacccagaaagggatcatcttcattctgctgatgctggttaccccatccatggccatgcggtgcgtcggcatcggctcccgcgactttgtggaaggattatccggggcaacgtgggtagacgtcgtgctagagcacgggtcatgcgttacgaccatggccaaggataagcccaccctcgacatcgagttgttaaagacggaggtgaccaaccccgcggtgttgcggaaattatgcatcgaggcgaagatctccaacaccactacggatagccggtgcccgacccaaggggaggccaccctcgtggaggagcaggacgccaacttcgtctgccggagaaccttcgtggatcggggctgggggaacggctgcggactgttcggcaaagggtccctgatcacgtgcgctaagttcaagtgcgtgaccaagcttgaaggaaagatcgtccaatacgagaatctcaagtacagcgtgatcgtgaccgtccacaccggcgaccaacaccaagtggggaacgaatccaccgagcacggtactaccgcgactatcacgccccaggcccctacgaccgagatccagctgaccgactacggggcgctgaccctcgactgcagcccccgcactggcctggacttcaacgagatggtcctgctcaccatgaaggagaagtcttggctggtccataagcagtggttcctagacctccccctaccctggaccagcggggccagcacctctcaggagacgtggaaccggcaggacctgctcgtgaccttcaagaccgctcacgctaagaaacaggaagtcgtggtgctgggcagccaggagggcgccatgcacaccgccttaacgggggccaccgagatccagacctccggcaccacgacgatcttcgccgggcacctcaagtgtcgtctgaagatggacaagcttaccctcaagggtatgagctacgtcatgtgtaccgggtccttcaagctagagaaggaagtggcggagactcagcacggcaccgtgctggtccagatcaaatacgaaggcaccgacgccccttgcaaaatcccctttagcacccaggatgagaagggggtgacgcagaacggccggctgattaccgctaaccccatcgtgaccgacaaggagaagcctgtcaacatcgaagccgagccgccctttggggagtcctacattgttataggcgcaggggaaaaggccctcaagctgagctggttcaagaaggggtccagtatcggcaagatgtttgaagccaccgcccgcggggcccggcgcatggcgatcctcggcgacacggcctgggacttcgggtctattggcggcgtgttcaccagcgtcgggaagctcatccatcagatcttcggcaccgcctacggggtgctgttttcgggggtaagctggaccatgaagatcgggattggagtcttgctcacatggctgggactgaactcccgctcgacctccctctctatgacctgcatcgccgtggggctggtgaccctgtacctcggcgtcatggtacaggccgactctgggtgtgtgatcaactggaagggcagggagctgaaatgtgggagcggaatctttgtcacgaacgaggtacacacctggaccgagcagtacaagtttcaggcggacagccccaagcgcctgtccgccgccatcggcaaggcgtgggaagagggagtgtgcggtatccggagcgccactcgcctcgagaacatcatgtggaagcaaatctccaacgagctgaaccacatccttctcgagaacgatatgaagttcaccgtagttgtgggggatgtcgcgggcatcctggcccaagggaaaaagatgatccggccccagccaatggagcacaagtactcctggaagtcctggggtaaggctaagataatcggcgcggacgtgcaaaatacgaccttcatcatagacggccccaataccccggagtgccccgatgaccagcgcgcgtggaacatctgggaagtggaggactacggctttgggatctttaccacgaatatctggctcaagctccgggacagctacacccaagtgtgcgaccaccgcctgatgtccgccgcgataaaggacagcaaggccgtgcacgccgacatggggtactggatcgagtctgagaagaacgagacctggaagcttgcccgtgcgagcttcatcgaggttaagacctgcatctggcccaaatcccacaccctctggagcaatggtgtcctggaatccgagatgatcatccccaagatctacgggggcccgatctctcagcacaactatagaccggggtacttcacacagaccgcagggccctggcacctggggaagctcgagctcgatttcgacttgtgcgagggcaccacggtggtggtagacgagcactgtggcaaccgggggccgtccctccgcactaccaccgtgacgggaaaaataatacacgagtggtgctgtcggagctgcaccctgccgcccctgcgcttccgcggagaggacggctgctggtacgggatggagatccgccccgttaaggaaaaggaggagaacctcgtcaagtccatggtgagcgccggctccggcgaggtagactccttcagcttagggctgctttgtatttccatgatgattgaggaggtcatgcgtagccggtggtcgcggaagatgctgatgacaggcaccctggccgtgttcttcctcctgataatggggcagctgacatggaacgacctcatccgcctgtgcatcatggtcggagcgaacgcaagtgaccgcatggggatgggcaccacttacctagccctcatggctaccttcaaaatgcggccgatgttcgccgtcgggctgctgttccgccggctgacgtcccgcgaggtgctgctgctaaccatcgggctgagcctggtggcttcggtagagcttcccaacagcctggaggagctaggcgacgggctcgccatgggcatcatgattctgaagctgctcaccgacttccagtcccaccaactgtgggcgaccctgctcagcctgacgttcatcaagaccaccttctcactgcactacgcctggaaaaccatggcgatggtgctcagcattgtttctctgttccccctatgcctttccacgacctcccagaagaccacctggctgcccgttctgctcggcagcctggggtgcaagccgctgacgatgtttttaatcgccgagaacaagatctggggcaggaagtcctggcccctgaatgaggggatcatggcagtgggcatcgtaagcatcctgctgagctcgctgctgaagaacgacgtccctttagccgggcccctgatcgcgggcggcatgctgatcgcctgctacgtgatcagcgggtccagcgcggacctcagcctggagaaggccgcagaggtgagttgggaggaggaggccgaacactccggcgcgagtcacaacatcttggtggaggtgcaggacgacgggacgatgaagatcaaggacgaagagcgcgacgacaccctcaccattctgctgaaagccaccctactggccgtctctggcgtttacccgctgagcatcccggccacattgttcgtctggtatttttggcagaagaagaagcagcggtcgggggtcttatgggacactcccagccctcccgaggttgagcgcgccgtgttggacgacggcatctaccggatcatgcagcgcggcctgctcgggcggtcccaggtcggcgtgggggtgttccaagagaacgtcttccacaccatgtggcatgtgaccaggggcgcggtcttaatgtaccaggggaagcggctggagccctcgtgggcctccgtcaagaaggacctaatatcgtacggtggagggtggcgcctgcagggctcctggaatacgggggaggaggtccaggtgatcgcggtcgagccaggcaagaatcctaagaacgtgcagaccgccccagggacttttaagaccccagagggcgaggtgggcgccatcgcgctggatttcaagcccggcacgtcaggctcacccatcgtcaaccgggagggtaaaattgtgggcctctatggcaacggggtggtcacgacctcaggcacatacgtcagcgccatcgcccaggccaaggcgtcccaggaagggccgctgcccgaaatcgaggacgaggtgtttcgcaagcggaacttgacgataatggacctccaccccggaagcgggaagacccgccggtacttgccagccatcgttcgcgaggccattaagcggaagctgcgcaccctcatcctggcccccacacgcgtggtggcctctgagatggcggaggccctgaagggcatgccaattcggtaccagaccacagcggtcaagagcgagcacaccggtaaggagatcgtggatctcatgtgccatgccaccttcacgatgcggctgctgtcccctgtacgtgtcccgaactacaacatgatcatcatggacgaggcccactttaccgaccccagctccatcgcggcccgggggtacatcagcacgcgggtgggtatgggggaggccgccgccatctttatgacggcgacgcctccaggctccgtggaggccttcccgcaaagcaacgccgtcatccaggacgaggagcgcgacattcctgagcggtcgtggaacagcgggtatgagtggatcacggacttccccggaaagaccgtatggttcgtgccctctatcaagagcggaaacgacatcgcgaactgcttacgcaagaacgggaagcgggtaatccagctgtcccgcaagaccttcgacacggagtatcaaaagaccaagaacaacgactgggactacgtggtgaccaccgacatcagcgagatgggcgccaacttccgagccgatcgcgtaatcgatccgcgacgctgcctgaagcccgtaatcttaaaggacgggccggagcgggtgatcctggccgggcccatgccggtcacggtggcctccgcggcgcagaggcgcggccgcgtgggccggaaccacaataaggagggcgaccagtacatctacatggggcagcccctgaacaacgacgaggaccacgcccactggaccgaggccaagatgctgcttgacaacatcaacacgcccgagggcattatacccgcccttttcgagccggaacgcgaaaagagcgccgcgatcgacggggagtaccgtctccggggcgaggcccgcaaaaccttcgtggaactgatgcggaggggggacctgcctgtgtggctctcctacaaggtcgcgagcgagggcttccagtacagcgaccggcgctggtgttttgacggcgagcggaataaccaggtgcttgaagaaaacatggacgtagagatctggacgaaggagggggagcgcaaaaagttacggccccgctggctcgacgcccgcacctactccgaccccctggccttgcgcgagttcaaggagttcgccgccggccggcgcagcgtctccggggacttgatattagagatcggaaagttaccgcaacacctcacccagcgggcccagaacgcactggacaaccttgtgatgttacacaactcggagcagggcgggcgcgcataccggcacgcgatggaagagcttcccgacaccatcgagacgctgatgttactggccctgatcgccgtgctcacaggcggcgtcacactgttcttcctgtccggccgcgggctcggcaagaccagcatcggcctcctatgcgtaatggcctccagcgtgctcctgtggatggcgtccgttgagccacactggattgcagctagcatcatcctggagttcttcctcatggtgctgcttatcccagaaccggatcgtcagcgcactccccaggacaaccagctcgcctatgtggtcattgggctgctgttcatgatcctcacggtcgccgcgaacgaaatgggcctgctggaaaccaccaaaaaggacttgggcatcggccacgtggccgtcgagaaccaccaccacgccgctatgctagacgtggacctgcaccccgccagcgcgtggaccttatacgccgtggcaacgaccatcatcaccccgatgatgcggcacaccatcgagaacacgaccgccaacataagccttaccgccatcgcgaaccaggccgccattctgatggggctcgacaaaggctggcccatctccaaaatggacatcggcgtccctctgctagccctcggttgctacagccaggtgaaccccctgactctcacggcggccgtgttaatgctggtagcccactacgccatcataggcccggggctacaggccaaagcgacccgcgaggcccagaagcgtacggccgctggcatcatgaagaaccccactgtggacggtatcgtggccatcgacctcgaccccgtcgtctacgacgcaaaattcgagaagcagctgggccagattatgcttctcatcctgtgcacgtctcagatcctgctcatgcggacaacgtgggcgctgtgcgaatcaattaccttggccacgggccccctcaccaccctgtgggaggggagcccaggcaagttctggaacaccacgattgccgtgagcatggccaacatcttccgcgggtcctacctggcgggggccgggctcgccttcagcctgatgaagtcgctcgggggcgggcgacgcgggaccggtgcccagggcgagaccctcggcgagaagtggaagcggcagctgaaccagctgtccaagagcgaattcaacacctacaagcgctctggtatcatggaggtcgaccggagcgaggcaaaggagggcctaaaacgcggggagactaccaagcacgccgtgtccaggggcactgcaaagctgcgctggttcgtggagcggaacctggtgaagcccgaagggaaggtgatcgacctgggctgtggtcgcgggggctggtcatactactgcgccgggctcaagaaagtgaccgaggttaagggctacaccaagggcggcccaggccacgaggaacccatccctatggccacgtacggctggaatctggtgaagctgcacagcggcaaggacgtgttcttcatcccgcccgagaagtgcgacaccctcctttgcgacatcggagagagctcccccaacccgaccatcgaggaaggccggacgctgagggtcctcaagatggtggagccatggctgcgggggaaccagttttgtatcaaaatcctgaacccctacatgcccagcgtggtcgagaccctcgagcagatgcagcgcaagcacggcggcatgctggtgcggaacccgctgtcacgcaacagcacccacgagatgtactgggtgtcctgcgggaccggtaacatcgtcagcgctgtgaacatgacctcccggatgttgctgaaccgcttcacgatggcccacagaaagcccacctatgagcgggacgtagacctgggcgccggcacccgccacgtggccgtggagcccgaagtggccaaccttgacatcatcggtcagcgtatcgaaaacatcaagcacgagcacaagagcacctggcactacgacgaggacaacccttacaagacgtgggcgtaccacgggagctacgaggtcaaaccgagcggctccgcctcctccatggtgaatggggtcgtgaagcttctgaccaaaccctgggacgtgatccctatggtgacccagatcgccatgaccgacacgaccccctttggccagcaacgcgtgttcaaggaaaaggtggacaccagaaccccaaaggccaagcgcgggactacccagatcatggaggtcaccgcccggtggctctggtccttcctaagccgcaacaagaagccaagaatctgcacccgcgaggaattcacgcggaaggtgcgctctaacgcggctatcggagcagtatttgtcgacgaaaatcagtggaacagcgccaaggaggccgtggaggacgagcggttttgggacctggtgcaccgcgagcgggagttacacaagcagggcaagtgcgcaacttgcgtctacaatatgatggggaagcgcgagaagaagctgggagagttcgggaaggcaaagggctcccgggccatctggtacatgtggctgggagcccgctttcttgaattcgaggcgctgggcttcatgaacgaggatcactggttcagccgggagaactccctgagtggggtggagggggaaggcctgcataagcttgggtacatcctgcgcgatatctccaagatccccggcgggaacatgtacgccgacgacaccgccggctgggacaccagaatcacggaagacgacctccagaacgaggctaagatcaccgacattatggagccggagcacgccctcctggcgaaggccatcttcaagttgacctaccagaataaggtggtacgcgtgcagcgccccgccaagaatgggaccgtgatggacgtcataagccggcgcgaccagagggggagtggccaggtcgggacttacggcctgaacacgttcaccaacatggaggcccagttaatccgccagatggagagcgaaggcatcttctcccctagcgagttagagacctccaacctggccgagcgggtgctggactggctcgaaaagtatggggtcgagcgcctgaaacggatggcgattagcggcgacgactgcgtggtgaagcccatcgacgatcgcttcgccacggccctgactgccctcaacgacatgggtaaggtccggaaggacatcccgcagtgggagcccagtaaggggtggaatgactggcagcaggtccccttctgcagccatcacttccaccagctgatcatgaaggacggacgcgagatcgtagtcccctgccggaaccaggatgagctggtgggccgcgcaagggttagccagggcgcaggctggtccctccgcgagaccgcctgcttgggcaagagctacgcccaaatgtggcagctgatgtacttccaccggcgcgacctgcggctggccgcgaacgccatatgctctgccgtcccggtcgactgggtgccgacatccaggacgacctggtccatccacgcacaccaccagtggatgaccactgaggacatgctgagcgtctggaaccgggtgtggatagaggagaacccctggatggaggataagacgcacatctccagctgggaggacgtgccgtatctcgggaagcgcgaggaccagtggtgcggctccctgatagggctgaccgctcgcgcgacatgggccacgaacatccaggtcgccatcaaccaggtgcggcgcctgatcggcaatgagaactacctggactacatgaccagcatgaagcggttcaagaacgagtctgacccggaaggcgccctgtggtga

SEQ ID NO: 24706 - RNA, 9879 nt, synthetic construct
  misc_feature 1..9879: note = derived and/or modified CDS sequence (opt11) from DENV-1__KC762647__SS-prME
  source 1..9879: mol_type = other RNA
agcgtgacaatgctgctcatgttgacgcccacggcccttgcgttccacctaacgacccgcggaggggaaccccatatgatcgtgagtaagcaggaaaggggaaagagcttgctgttcaagacctccgccggtgttaacatgtgcacgctcatcgcgatggatctgggcgagctgtgcgaggacaccctcacctacaagtgcccccgaataacggaagccgaacccgacgacgtggactgctggtgtaacgcgacggatacatgggtgacctacgggacctgtagccaaacgggcgagcaccggcgcgataaacgctctgtggcgctggcgcctcatgtggggctgggcctagagacccgcaccgagacctggatgagctccgagggcgcctggaagcagatccagcgggtcgaaacgtgggcgctgcgccatcccgggttcaccgtgatcgccctattcctcgcgcacgccatcggcaccagcataactcagaaggggatcatcttcatactgttaatgctagtgacgccctctatggctatgcggtgtgttggcataggcagccgggacttcgtggaggggctctccggtgccacctgggtggatgtcgtgctggagcacgggtcctgtgtgaccaccatggccaaggacaagcccaccctagacatcgagctgctgaaaacggaggtaaccaaccccgctgtgctccggaagctgtgtatcgaggcaaagatatctaacactaccaccgactcacggtgcccgacgcagggtgaggccacattggtagaagaacaggatgccaacttcgtctgccggcgtacattcgtggaccggggatgggggaatggctgcgggctgttcggcaaggggtccctgatcacttgcgccaagttcaagtgcgtgaccaaactggagggcaaaatcgttcagtacgagaatctaaagtactctgtgatcgttaccgttcatacaggggaccagcaccaggttggtaatgagtccacggaacacggcaccacagcgacgatcacgccccaggctcccactaccgagatacagctgactgactatggggccctgacgctagattgcagcccacgcaccggcctggacttcaacgagatggtcttgttaaccatgaaggaaaagtcctggcttgtacataaacagtggttcctggacctccccctgccttggacaagcggggccagcacgagtcaagagacctggaatcgacaggacctcctcgtcaccttcaagactgcccacgcgaagaagcaggaggtagtggtcctaggatcgcaggagggagccatgcacacggccctaaccggtgccaccgaaatacagacgtctgggacaaccaccattttcgccgggcacctgaagtgccgcctgaaaatggacaaactcaccctcaaaggaatgagctacgtcatgtgtacggggtccttcaagctggagaaggaggtggcggagacccagcacggcaccgtgttagtccaaataaagtacgagggcaccgacgccccctgcaaaatccccttcagtacgcaagacgagaagggcgtcacccagaacggccgtctgatcaccgccaaccctatagttaccgacaaggagaaacccgtcaacatcgaggcggagcccccattcggggagagttatatcgtaatcggcgcgggagaaaaggcgctcaaacttagctggtttaagaaggggtcctcgatcggaaagatgttcgaggctacggctcgcggagccaggcgcatggctattctgggcgacaccgcctgggacttcgggtccatcggcggagttttcacaagcgtgggaaagttagtccaccaaatctttggcaccgcctacggagtgctgttttccggcgtatcctggacaatgaagataggtatcggtgtgttacttacctggctgggtttaaactccagaagcacctccctctccatgacctgcatcgccgtgggactcgtcaccctttacctcggcgtaatggtgcaggctgactcggggtgcgtcattaactggaaaggacgggagttaaagtgcgggtccggcatttttgtgaccaacgaggtgcacacctggacagagcagtacaagttccaggcggacagccctaagaggctctcagcggccataggtaaggcctgggaagaaggggtttgcggcatccggtccgccacccgtttagaaaacatcatgtggaaacagatctccaacgagctgaaccacatcctgctcgagaacgatatgaagtttaccgtggtggtgggggacgtggctggcatactggcccaagggaaaaagatgatccgaccccagcctatggagcacaagtatagctggaagtcttggggaaaggccaagataatcggcgctgacgtccagaacaccaccttcatcatcgacgggccgaataccccggagtgccccgatgaccagcgcgcgtggaacatctgggaggtggaagattacggcttcgggatcttcacgaccaacatatggctgaagctccgcgatagctacacccaggtctgcgatcatcgcctgatgtccgccgccattaaggactcgcgggctgtgcacgcggacatgggctactggatcgaatccgagaaaaacgagacttggaagctggcccgcgcctccttcatcgaggttaagacgtgcgtctggccgaaatcccacaccctctggagcaacggcgtgttagagtccgagatgatcatccccaagatttacgggggcccgatctctcagcacaactaccggcccgggtacttcacccagacagccggcccatggcacctcgggaaattggagctggactttgacttatgcgaaggcacaaccgtcgtggtggacgagcactgtggcaatcgcgggccctcattgcgtaccacgacagtcaccggcaagatcatccacgagtggtgctgtagaagctgcaccctgccgcccctccggttccgcggagaggacggctgttggtacgggatggagatccggcccgtgaaggaaaaggaggagaacctcgtgaagtccatggtcagcgccgggagcggggaggttgattccttcagcttggggctgctttgcattagtattatgatcgaggaggtgatgcgcagcagatggtcccggaaaatgctgatgacaggcactctggccgttttcttcctactgatcatgggccagttaacctggaacgacctcatccgtctctgcattatggtcggcgctaacgccagcgaccggatgggtatgggcactacgtatctggctctcatggcaactttcaagatgcgcccaatgttcgccgtggggctgctgttccggcgcttgacctcccgtgaggtgctgctgctcactattgggttgagcctggtagcgagtgtcgagctccccaactctctggaggaactgggcgacggcctcgccatgggcatcatgattttaaagctgcttaccgatttccagtcccatcagctgtgggctacgttattgtcgctgaccttcataaaaacaactttcagtctgcactacgcctggaagacgatggcaatggtgttgagcatagtgtcactgttcccgttatgcctcagcaccacctctcagaagaccacgtggctgcccgtcctactcgggagcctgggatgcaaacctctgacgatgttcctgatcgccgagaacaagatctggggccgcaagtcttggccactaaacgaggggatcatggccgtgggcatcgtgtctattctgttgagctccctgctgaaaaacgacgtcccactagcagggcctcttatcgccggtggtatgctgattgcttgctacgtgatcagtgggtcctcagccgacctctcattagagaaagccgcggaggtgagctgggaggaggaggccgaacactccggcgcgagtcacaacatcctggtggaagtgcaggatgatggcactatgaagatcaaggacgaagagagagacgacacgctcactatcctgctaaaagcgacgctgctggccgtgtcaggggtatacccgctatcgatccccgcgaccctcttcgtttggtacttctggcagaagaagaagcagcgctcgggtgtgctgtgggacacgcctagcccgccggaggtagagcgggcagttctagacgacggcatctaccgcatcatgcagcggggcctgctcggtcggtcccaggtgggagtcggggtgttccaggaaaacgtattccacaccatgtggcacgtaacgcggggcgctgtgctgatgtaccaggggaagcgcctcgagccttcgtgggcctccgtcaagaaagacttaataagctacggcggagggtggcggttgcagggctcctggaacaccggggaggaggttcaggtaatcgccgtcgagcccgggaagaaccctaaaaatgtccaaaccgcccccgggaccttcaagactcctgagggcgaagtaggcgcgatcgcactggacttcaagcccggaaccagcggctcccccattgtgaaccgcgagggaaagatcgttggcctctacggcaacggagtggtgacaacaagcggcacgtacgtcagcgccatcgcccaggcaaaagcaagtcaggagggtccgttacccgaaatcgaggatgaggtgttccggaaaaggaatctgactattatggacttacaccccggctcaggaaagacccggcgctaccttccggcgattgttcgggaggcaattaagcgaaagttacgcaccctgatcctggcacccaccagggtcgtggcctcagagatggcggaggcccttaagggcatgcccattcgctaccagaccaccgcggtcaagtctgagcacacgggaaaagagatcgtcgatctcatgtgccacgccacgttcaccatgcggctcctatcccccgtgcgagtgccgaattacaatatgataatcatggatgaggcccatttcaccgacccctcatcgatcgcggcccgcgggtatattagcacccgcgtaggcatgggagaggcggcagccatcttcatgaccgcgactccgccaggctcagtggaggccttcccgcagtcgaacgccgtgatccaggacgaggaaagggatatccccgaacgcagttggaacagtggatacgagtggatcaccgacttccccggcaagaccgtctggttcgtgccatccattaagagcggcaacgatatagccaactgcctgaggaagaacggaaagcgcgttattcaattgtcccggaagacgttcgacacagagtaccagaagacgaaaaacaacgactgggattatgtcgtcaccacggacatttccgaaatgggcgcgaacttccgcgctgaccgggtgatcgacccaaggcgctgcctgaaacccgtcattctcaaggatggtcccgaacgcgtgatcctggccggacccatgccagttaccgtggcttccgcagcgcagagacgcggtagggttgggcgcaaccataacaaggagggggaccagtatatttacatggggcaacccttaaacaacgacgaagatcacgctcactggaccgaagccaagatgctcctggacaacatcaacacccccgaaggcatcatccccgccctgttcgagccagaacgcgaaaagtctgcagcgatcgacggggaataccggctccgcggcgaggcccggaagacgtttgtggagctgatgcgtagaggggatctgccggtgtggttatcctacaaggtggccagcgagggattccagtacagcgatcgccgatggtgcttcgacggcgagaggaacaaccaagtgctggaggagaacatggacgtggagatctggaccaaggagggggagcggaagaagctccgccccaggtggctagatgcccgcacctattcagaccccctagccctgcgggagttcaaggagttcgccgccggccgacggtctgtgtcaggggacctcattctagagattggtaagctccctcagcacctcactcagaaggcacaaaacgccctggacaacctggtaatgctccacaacagcgagcaaggcggtagggcgtaccgacacgccatggaggaattacccgatacgatcgaaaccttgatgctcttagccctgatcgccgttctcaccggtggcgtgaccctcttctttctttccgggaggggtctgggcaagacgagcatcggcctactgtgcgttatggcgtcctctgttttgctgtggatggctagcgtggagccccattggatcgcagcaagcattattctggagtttttcttaatggtccttctgatccccgagccggaccggcagcgcacgccccaagataatcagttagcctatgtagtaatcgggttattattcatgatcctcaccgtcgccgcgaacgagatgggtttactggagacaaccaagaaggacctcgggattggccacgtggctgtggagaaccatcaccacgcagccatgctggacgtcgacctgcaccccgcctctgcatggaccctctacgccgtggccaccaccatcatcaccccgatgatgcggcatacgatcgagaacaccacggcgaatatttcgctgactgccatcgcgaaccaggccgccatactcatggggcttgacaaaggctggcccattagtaagatggatatcggtgtgccgctgctggcactcggttgctatagtcaagtgaacccgttgacgctaaccgcggctgtccttatgctcgtggcccattacgcgattatcggcccagggttacaagccaaggcaacccgcgaagcccagaagcgcaccgccgccgggatcatgaaaaaccctacggtcgacgggatagtggccatcgacctcgaccccgtggtctatgatgctaagttcgaaaaacagctggggcagatcatgctccttatcttgtgtacgtcccagatcctgctcatgcggaccacctgggcactctgcgagagcatcacgctggccaccggtccacttaccaccttatgggaggggtccccgggcaaattctggaatactaccatcgccgtgagcatggccaatatctttcgcgggtcgtacctcgcaggcgccggcctcgcgttcagcttgatgaagtccctcgggggaggtcggcgcgggaccggggcgcagggtgagaccctcggcgaaaaatggaagcggcagcttaaccaactgagcaagtccgagttcaacacgtacaagagaagcgggatcatggaggtcgaccggtctgaggctaaggagggtcttaagagaggggagactaccaaacacgcggtctctagaggcaccgccaaactgcgatggttcgtagaacggaacttagtgaagcccgaggggaaggtcatcgatctcggctgtggacgcggtgggtggagctactactgtgccggtctcaagaaagtgaccgaagtgaagggctacacaaagggcggtcccggacacgaggagccgatcccgatggccacctacggctggaacctggtcaaactgcattccggcaaggacgtgttcttcataccgccggagaaatgtgacaccctcctgtgcgacatcggggagagcagtcccaacccaacgatcgaggagggccggaccctccgcgtgctcaaaatggtcgagccctggctacgggggaaccagttctgcatcaaggtcctgaatccgtacatgccctccgtggttgagaccctcgagcagatgcaacgcaagcatggcggcatgctggtgcggaacccgctgtcccgcaattccacccacgagatgtactgggtctcttgtgggactggcaacatcgtctcggctgtgaacatgacgtcccgaatgttgctgaacagattcaccatggcccacagaaaacccacatatgaacgggatgtcgacctgggggccggcacacgccacgtagccgtggagcccgaggtggcgaaccttgacataatcggacaacggattgaaaatatcaagcacgagcacaagagcacgtggcactacgacgaggacaatccctacaagacgtgggcgtaccacgggagttacgaggttaagccgtctggctccgctagctctatggtgaacggagtcgtaaaacttctgaccaagccctgggacgtgatacccatggtcacccaaattgccatgacagacactacacccttcggccagcaacgcgtttttaaggagaaggtcgatactcggacgccgaaggcgaagcgcgggaccacccagatcatggaggtcaccgcccggtggctttggggcttcctttcccgcaacaaaaagccccggatctgcacccgggaggagttcacccgaaaggtgagatctaacgctgcaatcggcgcggtgttcgtcgacgaaaaccaatggaactccgccaaggaagccgtagaagacgagcggttctgggacctggtccaccgcgaacgggaactccacaagcagggcaagtgcgcgacctgcgtctacaacatgatgggaaagagagagaagaagttgggcgagttcgggaaggccaaagggagccgggccatatggtacatgtggctgggcgcccggttcctagagttcgaggcgctgggcttcatgaacgaggaccactggttctcacgggaaaattctctcagcggggtggagggcgaaggactccacaaactgggctacatcttgcgcgacatcagcaaaatccccggagggaacatgtacgccgacgacactgcgggctgggatacgagaatcaccgaagatgacctccaaaatgaggccaagataaccgatataatggaaccggagcacgctctccttgctaaggcaatattcaagctcacctaccagaacaaggttgttcgcgtccagcgaccagccaagaatgggaccgttatggacgtcatctcacggagagaccagcgggggtctggtcaggtgggcacctacggtctgaatacgtttaccaacatggaggcccagctaattcgccagatggagtctgaggggatcttttcaccctccgagttggagactcccaacctggcggagcgggtgctggactggctcgagaagtacggcgtcgagcgcctgaagcggatggcgatcagcggcgacgactgcgttgtgaagccgatcgacgaccgcttcgctactgccctgactgcactcaacgatatgggcaaagtccggaaggacatcccgcagtgggaaccctccaagggctggaatgattggcagcaggtcccgttctgctcgcaccacttccaccagctgataatgaaggacggccgcgagatcgtggttccctgccggaatcaagacgagctggtgggtcgcgcccgggtctcccagggggccggctggagtcttcgcgaaccggcctgtctgggtaagagctatgcacagatgtggcagctgatgtacttccaccgccgcgacctccgactggcagctaacgccatatgctccgctgtacctgttgactgggtgcccaccagccgcacgacctggtccatacacgcacaccatcagtggatgaccacagaggacatgctaagcgtctggaaccgggtatggatagaagagaatccgtggatggaggacaagacccacatctcctcgtgggaggacgtaccttatctcggcaaacgagaggaccagtggtgcgggtcgctgattggactgactgcccgcgcgacctgggccactaatattcaggtcgccatcaaccaggttcggcgcctcatcgggaacgagaactacttggactacatgacttctatgaaacggtttaagaacgaaagcgatcccgaaggggcactctggtaa

SEQ ID NO: 24707 - RNA, 9879 nt, synthetic construct
  misc_feature 1..9879: note = derived and/or modified CDS sequence (opt11) from DENV-1__KC762639__SS-prME
  source 1..9879: mol_type = other RNA
agcgtgaccatgctgctaatgttgacccccaccgccctggctttccatctcactacccggggcggagagccccatatgatagtgtcaaagcaggagcggggcaagagcctgctctttaagacgagcgccggggtgaacatgtgcaccctcatcgccatggacctgggcgagctatgcgaggacaccctcacctacaaatgcccccggatcactgaggccgagcccgacgacgtggactgttggtgcaacgccacggacacctgggtcacctacggtacctgctcgcagactggggaacaccggcgcgacaagcggagcgttgcactcgcgccccacgtgggcctggggctcgagacccgcactgagacctggatgagctccgagggcgcatggaagcaaatccagagggtcgagacgtgggccctgcgccatcccggatttaccgtgatcgccctgttcttagcacacgctataggcacctcaatcacccagaaaggcatcatcttcatcctcctgatgctcgtcacgccctcaatggctatgcggtgtgtcggcataggtagccgcgacttcgttgaggggctgagtggcgcaacctgggtggacgtcgtgcttgaacatgggagctgcgtgactacaatggccaaggacaaacccactctcgacatcgagttgctgaaaactgaggtcaccaaccccgcggttctccggaagctatgtatagaggccaagatctccaatactacgacagacagccgctgtccgacccagggcgaggccacactggtggaggagcaggacgcaaattttgtatgccggcgcacgttcgtggacagagggtgggggaacggatgcgggctgttcggcaagggctccctgataacgtgcgccaagttcaagtgcgtgaccaagctggagggcaaaatcgtacaatacgagaaccttaagtacagcgtaatcgtgaccgtccacactggcgaccagcaccaggtgggtaacgagtccacggagcacggtaccaccgcgactattacaccccaggcccccacaacggaaatccagctaaccgactacggggccctgactctcgactgcagtccccgcaccggcctagacttcaacgagatggtactgctcacaatgaaggaaaaatcttggctggtgcacaagcagtggtttctggaccttccgctgccctggacaagcggggcctcaactagccaagaaacatggaaccgccaggacctgctcgtgaccttcaaaacagcccacgccaagaagcaggaggtagtagtgctcggcagccaggagggcgccatgcatacggccctgaccggggccaccgaaatccagacctccggcacgacaaccatctttgccggccacttgaagtgccgtcttaaaatggacaagctcactctcaaaggcatgagctacgtcatgtgtacggggtctttcaagctggagaaagaggtggccgagacccagcacggcaccgtgctggtccagataaaatacgagggaactgacgccccgtgcaagatccccttctccacgcaggacgagaagggggtgacacagaacggccgtctgatcaccgccaacccgatcgtgacagacaaggagaagcccgtcaacatcgaggcggagcctcctttcggggagtcctacatcgtgatcggcgctggcgagaaggccctcaaactgagctggttcaagaagggttccagcatcggcaagatgttcgaggccacggcccggggcgcccggcgcatggctattctgggcgacaccgcctgggacttcgggtcgatcggcggagtattcaccagcgttgggaaactggttcaccaaatcttcggcaccgcctacggagtgctgttctcaggcgtctcttggacaatgaagatcgggatcggtgtgctgctcacctggctgggactgaacagtcgcagtacctccctctctatgacctgcatcgccgtggggcttgtcacgctgtacctcggtgtgatggtgcaggccgactccgggtgcgtcatcaattggaagggacgggagctcaagtgtgggtctggcatcttcgtgaccaacgaggtgcacacctggacagagcagtacaagtttcaagcggacagcccgaaacgcttgagtgccgccataggcaaagcctgggaggagggtgtttgcggcatccggagcgccacccgccttgagaacatcatgtggaaacaaatctcaaacgagctgaaccacatcctgctcgagaacgacatgaagtttacggtggtggtcggggatgttgccggcatcctcgcgcagggcaagaaaatgatacggccccagcccatggagcacaaatacagctggaagtcctggggcaaagcgaagatcatcggcgccgacgtgcagaacaccaccttcattatcgacgggcctaacactcctgagtgtccggacgatcagcgcgcttggaacatctgggaggtcgaagattacggcttcgggatctttactaccaacatctggctgaaacttcgggactcgtatacccaggtgtgtgaccaccgcctgatgtccgccgcgatcaaagatagcagggccgtccacgccgatatgggctactggatcgaatccgagaagaacgaaacctggaagctggcgcgagccagcttcatcgaggtcaaaacttgcgtgtggcccaagtcccacaccttatggagcaacggcgtgctggaatccgagatgatcatccccaagatttacgggggcccgatctcgcaacacaactaccggcccgggtatttcactcagaccgccggcccttggcacctcgggaagctagagttagacttcgacctgtgcgagggcacgaccgtcgtggtcgacgagcattgcggcaaccgcggcccaagcctccggaccactacagtcaccggcaagatcatccatgagtggtgctgccgctcatgcaccctgccacccttgcggttcagaggggaggatggatgctggtacggtatggagatcaggcccgtgaaggagaaagaggagaacctcgtgaagtccatggtcagcgcagggtctggcgaggttgatagctttagcctggggctgctatgtatcagtatcatgattgaggaagttatgcggtctcggtggtcccgcaagatgctgatgactggtactctggccgtctttttcctattaatcatggggcagcttacttggaacgacctcatccgcctgtgcatcatggtgggcgccaacgcgagcgaccggatgggcatgggcaccacctacctggcgctcatggccacattcaaaatgcgccccatgttcgccgtgggtctgttgtttcgcaggctaacctcccgggaagtcctgctgttaacgatcgggctgagcctggtggcatccgtcgagctccccaacagcttggaggagctgggcgacgggttggccatgggcataatgatcctgaagctgctcaccgactttcaatcacaccagctgtgggccacgctgctcagtctcaccttcatcaagaccaccttcagtcttcattacgcctggaagaccatggccatggtactcagcatcgtgtccttattccccctgtgcctcagcaccacatcccaaaagacgacctggctgcccgtcctgctcggcagcctaggatgtaaaccgctgaccatgttcctaattgccgagaacaagatctggggccgcaagtcctggcccctgaacgagggaatcatggccgtgggcatcgtgagtatcttactcagctccctgcttaagaatgacgtccccctcgccggtcccctgatcgcgggtggaatgttaatcgcatgttacgtgataagcggttccagcgcagatctctccctggagaaggctgccgaggtgagctgggaggaggaggccgagcactccggtgccagccacaacatcctggtcgaggtgcaggatgacgggaccatgaagatcaaggatgaggaacgggacgataccttgaccatcctgctgaaggccacgctcctggccgtgtcgggcgtgtacccgctgagcatccccgccactctcttcgtgtggtatttctggcaaaagaagaaacagcggagcggggtactgtgggacacccccagccctcccgaagttgaacgggctgtgctggacgacgggatttaccgaatcatgcagcgtggcctgctgggcaggtcccaggtgggcgtcggagtgttccaggagaacgtgttccataccatgtggcacgtcacgcggggcgcggtcctaatgtaccaggggaagcgcctcgagccgagctgggcctccgtgaagaaagacctcatctcgtatgggggcggttggcggctgcagggctcatggaacacaggggaggaggtgcaagtgatcgccgtggaacccggcaagaaccccaagaacgtgcagaccgcccccgggaccttcaagacgcccgaaggcgaggtaggcgccatcgcgttggactttaagcccgggacctctggctcgcccatcgtgaaccgcgaggggaagatcgtcggcctgtacgggaacggggtggtgaccaccagcggcacgtacgtcagcgccatcgcccaggcgaaggcgtcgcaagaggggccgctgcccgagatcgaggacgaggtgttccggaaacgcaacctgactattatggacctccaccccggcagcgggaagacccggcgatatctccctgccatcgtgcgggaggcaatcaagcgcaaactgcgcaccctcattctggctccgacgcgggtggtggcctccgagatggcggaggcactgaagggcatgcccattcgctaccagaccaccgccgtcaagagcgagcacaccggtaaggagatcgtcgatctcatgtgccacgccacgttcaccatgcggctgttatcgcccgtgcgtgtgccgaactacaacatgatcatcatggatgaggcccacttcaccgacccctcctcgatcgcggccagggggtacatttcgacgcgggtcggcatgggagaggccgctgcaatttttatgacggcgactccgcccggctcggtggaggcctttccgcagtcaaacgcagtgatccaggacgaggagcgtgacatcccggagcgctcttggaacagtgggtacgagtggatcaccgacttcccgggcaagacagtttggttcgtgccctccatcaaaagcggcaacgacatcgccaactgcctcaggaaaaacgggaagcgcgtgatccagctttcacgaaagacgtttgacaccgagtaccagaagaccaagaacaacgactgggactacgtcgtgactacggatatcagcgagatgggcgcgaacttcagggccgaccgggtgatcgatccgcgccggtgcttaaagcccgtcatcctcaaggacgggccagagcgcgtaatcttagcagggcccatgccggtcaccgtagcctccgccgcgcagcggcgcgggcgggtgggccggaatcacaacaaggagggcgaccagtacatctacatggggcagcccctgaacaacgacgaagaccatgcccactggaccgaggccaagatgctcctggacaacataaacactcccgaaggtatcatccccgcccttttcgagccggagcgcgagaagtccgccgctatcgacggtgaataccggctccgcggcgaggccaggaagactttcgtcgagctgatgcgtcgcggggacctgcctgtgtggctctcctacaaggtggcaagcgaggggttccagtacagcgaccgcagatggtgcttcgacggtgagaggaataaccaggtcctggaagagaacatggacgtggagatctggacgaaggagggggaacggaagaaactgcgcccgcggtggctcgacgctcgcacctactccgacccactagcccttcgggagttcaaagagtttgcggccggccgccggagcgtatccggcgacctcatcctggagatcggcaagctgccgcaacacctgacccagaaggcgcagaatgccctggacaacttagtcatgctccacaacagcgagcaaggcggacgggcgtacagacacgccatggaggagcttcctgacacgatcgagaccctgatgctcctggcgctgatcgccgtgttaacaggcggggtcaccctattctttctgtccggccgcgggctcggcaagaccagcatcggcctgctgtgcgtcatggcctccagcgtgctcctgtggatggcgtccgttgaaccccattggatcgcggctagcatcatcctggagttcttcttgatggttctgctcatcccggagccagaccggcagcgcactccgcaggacaaccagctcgcctacgtcgtgatcgggctgctgttcatgatcttgacggtcgccgcgaacgagatgggcctactggagactacaaagaaggacctcgggatcggccacgtggctgtggagaaccaccaccacgcggctatgttagacgtagacctgcatcccgcctccgcgtggactttatacgccgtggccacaacgatcatcactccgatgatgaggcatacgatcgagaacaccactgccaacatcagcctgactgcgatagccaatcaagccgccattttaatggggctcgataagggctggcccatctccaagatggacatcggtgtgcccctgctggccctcggctgctatagccaggtaaaccccctgacgttgactgcagcggtgttaatgctggtggcccactacgccatcattgggccggggctgcaggccaaggcgacccgagaggcccagaagcgcaccgccgcaggcatcatgaaaaaccccacggtcgacgggatagtggcgattgacctagaccccgtggtctacgacgcgaagttcgagaagcagctgggccagatcatgctgctcatcctgtgcacctcccagatcttgctcatgcggaccacctgggctctttgtgagagcatcacgctggctacgggccccctcaccaccctgtgggaggggtccccgggcaaattttggaacaccaccattgccgttagcatggccaacatcttccgcgggtcctacctcgccggcgccggcctcgctttctccctgatgaagtcccttgggggcgggcggcgcggcaccggggcccagggcgaaacactcggtgagaagtggaaacgccagctaaaccaactgagcaagagcgagttcaacacctacaagcggtccggtatcatggaggtggaccggagcgaggctaaggaaggcctcaagcgcggggaaaccacaaagcacgctgtgtccaggggcacggctaagctgcgctggttcgttgagcggaacctggtgaagcccgaggggaaggtcatcgatctggggtgtggcagagggggctggagctactactgcgccgggctcaaaaaggtgacagaggttaagggctacaccaagggcgggcccggccacgaggagccaatccccatggcaacctatgggtggaacctggtcaagctgcacagcggcaaggacgtgtttttcatcccgcccgagaagtgcgacaccctcctctgcgatatcggggagagttcccctaacccaacgatcgaagagggcagaaccctgcgcgtcctcaagatggtggaaccctggctgcggggtaaccagttctgcatcaaggtgctgaatccctacatgccaagcgtggtcgagaccctcgagcagatgcaacgcaaacatggcgggatgctagtgcggaacccgctgtccaggaacagcacccacgagatgtactgggtgtcgtgcgggaccggcaatatcgtaagcgcggtgaacatgacaagtcggatgctcctcaaccgattcacgatggcccaccgcaaacccacctatgagcgggacgtggatctaggcgccggcacccgccacgtcgccgtggagcccgaagtcgcgaacctagacatcatcggccaacgcatagagaacatcaagcacgagcacaagtccacgtggcactacgacgaggacaacccctataagacctgggcgtaccacgggtcgtacgaggtaaaaccgagcggcagtgccagctctatggtcaacggggtcgtgaagctgttgaccaaaccatgggacgtgattcctatggttacacaaatcgctatgactgacacgactcctttcggtcagcagcgcgtgttcaaggagaaggtcgacacgaggacgccgaaagccaaacgcgggaccacccagattatggaggtcaccgcacggtggctctggggcttcctctcccgcaacaagaagcctcggatttgcacccgcgaagagttcacgcggaaggtccgcagcaacgcggccatcggcgccgtcttcgtcgacgagaatcagtggaacagcgccaaggaggcggtggaggacgagcggttttgggacctggtgcaccgcgagcgggagctacacaagcaggggaagtgcgcgacctgtgtatacaacatgatgggcaagcgggagaaaaagctgggggagttcggaaaagcaaaggggagccgggccatctggtacatgtggctcggcgcccgcttcttggagttcgaggccctgggcttcatgaacgaggaccattggttctcccgggagaacagcctgagcggggtcgaaggagagggtctccacaagctgggctatatactgcgggacatcagcaagatacccggtggcaacatgtacgccgacgataccgcggggtgggatacgcgtatcaccgaagacgacctccaaaacgaggccaagatcaccgacattatggagccagagcacgccctgctggcgaaggcgatattcaagctcacctaccagaacaaagtggtccgcgtgcagcggcccgccaagaacgggacggtgatggatgtcatatcccggagggaccagcgcgggagcggccaggtgggaacctacggactgaatacgttcaccaacatggaagcccagcttatccgccaaatggagtccgagggcatctttagtccctccgagctcgagacacccaacctggctgagcgggtacttgactggcttgagaagtacggcgtcgaacgcttaaagcggatggccatcagcggggacgactgtgtggtgaaacccatcgacgaccgcttcgccaccgccctaaccgccctcaacgacatgggcaaagtccggaaggacatcccccagtgggaaccgtccaaagggtggaatgactggcaacaggtgcccttctgtagccatcacttccatcagttgattatgaaagacggccgcgaaatcgtagtcccgtgccggaaccaggacgagctggttggccgggcccgggtgtcacagggggcgggctggtcgctgcgcgagaccgcatgcctgggcaagagttacgcccagatgtggcaactcatgtactttcaccggcgcgaccttcggctggccgcgaacgccatctgttccgcggtgcccgtggattgggtgcccactagccgcaccacctggagcatccatgcgcaccaccaatggatgactacagaggacatgctcagcgtctggaaccgggtgtggatcgaagaaaacccatggatggaggataagacccacataagcagctgggaggatgtgccatacctcggaaaacgcgaggaccaatggtgcgggagtctcatcggcctgacagcccgcgccacctgggccaccaatatccaggtcgccatcaaccaggtacggcgcctcatcggcaacgagaactatctggactatatgacgagtatgaagagattcaagaacgagtccgaccctgagggggccctgtggtga

SEQ ID NO: 24708 - RNA, 9879 nt, synthetic construct
  misc_feature 1..9879: note = derived and/or modified CDS sequence (opt11) from DENV-1__KC762642__SS-prME
  source 1..9879: mol_type = other RNA
agcgtgaccatgctgctcatgctgatgcccaccgctctggccttccacttgaccacccggggcggggaaccccacatgatcgtcagcaagcaggaacgggggaagagcctgctgttcaaaacctccgccggcgtgaacatgtgcacgctaatcgccatggacctgggcgagctgtgtgaggataccctcacctacaagtgcccccggatcaccgaggccgagcccgacgatgtggactgctggtgtaacgccaccgacacctgggtcacctacgggacctgcagccagaccggcgagcaccggcgggacaagcggtcagtggccctggcaccccacgtgggcctggggctcgagacacggacagagacgtggatgagctccgagggcgcctggaagcagatccagcgggtcgaaacctgggcactgcggcaccccgggttcacggtgatcgctctgttcctcgcgcacgccatcggcaccagcatcacccagaaaggcatcatcttcatcctgctgatgctcgtgaccccctccatggctatgcggtgcgttggcatcggcagtcgcgacttcgtggaggggctgagcggcgccacgtgggtggacgtcgtcctggagcacgggagctgcgtgaccaccatggccaaggacaagcccaccctcgacatcgagctgctgaagactgaggtcaccaaccctgcggttttacggaagctgtgcatcgaggccaagatcagtaacactaccacggacagccgctgcccgacccagggcgaggccaccttggtggaagagcaggacgccaacttcgtctgccggcgcaccttcgtggaccggggctgggggaacggctgcgggctattcggcaagggttccctgatcacgtgcgctaagttcaagtgcgtgaccaagctggagggcaagatcgtccaatacgaaaacttgaaatacagcgtgatcgtgacggtccacaccggcgatcaacaccaggtgggtaacgagtcgacagagcacggtaccaccgcgaccatcactccccaggctcccacgaccgagatccaactgaccgattacggggctctgaccctcgactgcagcccgcgcacgggcctggacttcaacgagatggtcctgctcaccatgaaggagaaatcctggctggtgcacaagcagtggttcctggatctgcccctgccctggaccagcggggccagcaccacgcaggagacctggaaccgacaagacctgctcgtaaccttcaagaccgcgcacgcgaagaagcaggaggtagtggtgctgggctcccaggagggcgccatgcacacggcgcttaccggggccaccgaaatccaaaccagcggtacgacgaccatcttcgccggacacctcaagtgccgtctgaagatggacaagctgacccttaagggcatgtcctacgtcatgtgcacggggagcttcaagctggaaaaggaggtggcggagacccagcacggcaccgtgctggtccagataaagtacgagggcaccgacgcgccctgcaaaatccccttctccacccaagacgagaagggggtgacccagaacggccggctgatcaccgccaatcccatcgtgacggacaaagaaaagcccgtcaacatcgaggccgagccgcctttcggggagagctacatcgtgatcggagcgggcgagaaggccttgaagttatcctggttcaaaaagggctcatccatcggcaagatgttcgaggccacggcccgcggagctcggcgcatggcgatcctgggagacaccgcctgggacttcgggagcataggcggcgtgttcacctccgtcgggaagctcgtccaccagatcttcggtaccgcctacggggtgctgttctccggggtctcctggacgatgaagatcgggatcggcgtgctgctcacctggttgggcctaaacagtcgctccaccagtctctccatgacctgcatcgccgtggggctggtcacactgtacctcggcgtgatggtgcaggccgacagcgggtgcgtcatcaactggaagggccgggagctgaagtgcgggtccggcatcttcgtgaccaacgaggtacacacctggaccgagcagtataaattccaggcggacagtccaaagcgcctgagcgccgctatcggtaaggcctgggaggagggggtctgcggcatccggtccgcgacccgcctcgagaatatcatgtggaagcagatcagcaacgaactgaaccacatccttctcgagaacgacatgaagttcacggttgtggtcggtgacgtggcgggcatcctggcccaagggaagaagatgatccggccccagcctatggagcacaagtactcttggaaatcctggggcaaggccaagatcatcggggccgacgtgcagaacaccaccttcattatcgacgggcccaacacaccggagtgccccgacgaccaacgcgcgtggaacatctgggaggttgaggactacggcttcggtatcttcacgaccaatatctggctgaagctccgggactcctacacccaggtgtgcgaccaccgcctgatgagcgccgccattaaggactccaaggccgtgcacgcggacatgggctactggatcgagagcgagaagaacgagacctggaagttagcgcgggcctccttcatcgaggtcaagacgtgcatatggcccaagtcacacaccctctggtctaatggagtgctggagagcgagatgatcatccccaagatctacgggggcccgatctcccagcacaactaccgccccggatacttcacccagaccgccggcccgtggcacctggggaaactcgagctcgactttgacctgtgcgagggcacgaccgtggtcgtggacgagcactgcggcaaccgggggccgagcctccgcaccaccacggtcaccggcaagatcatccacgagtggtgctgccggtcctgtaccctgccgcccctgcgcttccgcggggaggacggatgctggtacgggatggagatccgccccgtcaaggagaaggaggagaatctcgtcaagagcatggtgtccgccggaagcggagaggttgacagcttcagcctggggctgctctgcatctcgatcatgatcgaagaggtgatgcggtcccgctggtcccggaagatgctgatcaccggtacgctggccgtgttcttcctcctgatcatggggcaggtcacttggaacgacctgacccgcctctgcatcatggtgggcgcgaacgcctccgaccgcatggggatgggcaccacatacctggccctgatggccaccttcaagatgcgaccgatgttcgccgtgggcctcctgttccgccggctgactagccgcgaggtgctcctgctgaccattggcctctccctggtggcgagtgtggagctgcccaactcgctcgaggagttgggcgacgggctggccatgggcataatgatcctcaagctgctgacggacttccaaagccaccagctctgggccaccctgctgagcctcacctttatcaagaccacttttagcctgcactacgcctggaaaacgatggcgatggtgctgtcaattgtgagcctcttccccctgtgcctgtccacgaccagccagaagacgacctggctccccgtcctgctgggctccctcgggtgcaaaccactgaccatgttcctgatcgctgagaacaaaatctggggccgaaaaagttggcccctcaacgagggtatcatggccgtgggcatcgtaagcattctgctgagcagcctcctgaagaacgacgttcccctggccgggcccctcatcgcgggcggcatgctgatcgcgtgctacgtgatctccgggagctctgccgacctgtctctcgagaaagccgccgaagtatcctgggaggaggaggccgagcacagcggcgcgtcccacaacatcctggtggaagtgcaggacgatgggaccatgaagatcaaggacgaggagcgcgacgacacgctgacgatactactgaaagccaccctgctcgccgtaagcggagtctaccccctgtccatcccagccaccctgttcgtgtggtacttttggcagaagaagaagcagcggagcggggtgctttgggacacccctagcccgcccgaggtcgaacgcgccgtgctggatgacggcatctaccggatcatgcagcgcggcctgctggggcgcagccaggttggcgtcggggttttccaggagaatgtattccacacaatgtggcacgtaacccggggcgccgtgctcatgtaccaggggaaacggctggagccctcctgggccagcgtgaagaaggacttgatctcctatggcggcgggtggcgcctccagggcagctggaacaccggggaagaagtccaggtgatcgccgtggagcccggcaagaaccccaagaacgtccagaccgcccccgggacgttcaagaccccggagggcgaggtgggcgccattgcgctggacttcaagcccgggacctccggcagcccaatcgtaaaccgggaagggaagatagtcggcctgtacgggaacggggtggtgaccacgtccggcacctacgtctcagccatcgcccaggccaaggcgagccaagaggggccgttaccggagatcgaagacgaagtgttcaggaagcggaatctgactatcatggacctgcacccaggcagtggtaagacccgccggtacctcccggccatcgtgcgcgaggccatcaagaggaaacttcgcacgctgatcctcgcccccacccgcgtcgtggcaagcgagatggcggaggccctgaagggtatgccgatccggtaccagacaaccgccgtgaaatccgaacacacgggccgggagatcgtggatctgatgtgccacgccaccttcaccatgcggctcctgagccccgtgcgcgtgccgaattataatatgatcatcatggacgaggcccactttaccgacccctccagcatcgcggcccgggggtatatctcaacacgcgtcggcatgggggaggccgccgctatcttcatgaccgcgaccccgcccggcagcgtggaggccttcccgcagtccaacgccgttatccaagacgaggagcgggacatccccgagcggtcgtggaactccgggtacgagtggatcactgacttccccggcaagacggtctggttcgtgcccagtattaagtccggtaacgacatcgctaactgcctgcggaagaacgggaagcgcgtgatccagctctcgcggaagaccttcgacaccgagtaccagaagaccaagaacaacgactgggactacgtcgtgacgacagacatctccgagatgggcgcgaacttccgcgccgaccgtgtgatagacccgaggcggtgcctgaagccagtcatcttaaaggacggtcccgagcgcgtgatcctcgcaggccccatgccggtcacagtagcctcggcagcgcagcggcgcgggcggatcggccgtaaccacaacaaggagggagaccagtacatctacatggggcagccactcaacaacgacgaggaccacgctcactggaccgaggctaagatgctgctagacaatataaacacccccgagggcatcatacccgccctgttcgagccagagcgcgagaagtccgccgcgatcgacggggagtaccggctgcgcggcgaggcccggaagaccttcgtggagttgatgcgccggggggaccttcccgtctggctgagctataaggtcgcctccgaaggcttccagtacagcgaccgccggtggtgcttcgacggagagcgcaataatcaggtgctcgaggagaatatggacgtcgagatctggaccaaggagggggagcggaagaagctgcgcccccgctggttagacgcccgcacctacagcgaccccctcgctctgagggaattcaaggagttcgccgccggccgccggtccgtgagcggggacctgatactcgagatcggcaagctgccgcagcacctcacgcagcgcgcccagaacgccctcgacaacctggtcatgctgcacaactccgagcagggcgggcgggcatatcgccacgccatggaggagctccccgacaccatcgagaccctgatgctgctcgctttaatcgccgtcctgaccggcggggtgaccctcttcttcctgagcggccgggggctgggcaagacgtccatcggcctcctgtgcgtgatggccagctccgtcctgctctggatggctagcgtggagccccactggatcgccgcctctatcatcctggagttcttcctgatggtattactgatccctgagccggaccgccagcggacgcctcaggacaaccaactggcctacgtcgtgatcgggctcctgttcatgatcctgaccgtggccgcgaacgagatgggcctcctggaaacgacgaaaaaagacttgggaatcggccacgtcgccgtggagaaccaccaccatgccgccatgctcgacgtggacctgcaccccgccagcgcgtggaccctgtacgccgtcgccaccaccatcatcactccaatgatgcgccacaccattgagaacactaccgccaacatttcactcacggcaatcgcgaaccaggccgccatcctgatggggctcgacaagggttggcccatcagcaagatggacatcggcgtccccctcctggccctggggtgctactcccaggtcaaccccctcacgctgaccgcggccgtgctgatgctcgtggcacactacgcgatcatcggcccagggctgcaggccaaggcgacccgcgaggcccagaagcgaacggccgccggtatcatgaagaaccccaccgttgacgggatcgtcgccattgacctggaccccgtcgtgtacgacgcgaagttcgagaagcagctcgggcagatcatgctgctgattctctgcaccagccagatcctgctgatgcgcacaacgtgggccctctgcgagtccataaccctggccaccggccccctcaccacgctctgggaagggtcgccgggcaagttctggaacaccaccatcgccgtgtccatggccaacatcttccgggggagctacttggcgggtgccggcctagccttctccttaatgaagtccttggggggcggccgccggggaaccggggcccagggcgaaacgctcggcgagaagtggaagaggcagcttaaccagctgagcaaatcggagttcaacacatacaagcggagcggcatcatggaggtggaccgctccgaagcgaaggagggactgaagcgcggtgagacgaccaagcacgccgtgagccgcggtacggccaagctccgttggttcgtcgagcgtaacctggtgaagcccgaggggaaggtgatcgacctgggctgcgggcgcggcgggtggtcctactactgcgctggtctgaaaaaggtcaccgaggtgaagggttacaccaagggcggccccggccacgaagagcccataccaatggccacctacgggtggaacctcgtgaagctccacagcggcaaggacgtctttttcataccacccgagaagtgtgacaccttactttgcgatatcggggagtccagccccaacccgaccatcgaggagggccgcaccctgcgggtgctgaagatggtagagccctggctccgcgggaaccagttctgcataaaaatcctgaacccctacatgccatccgtcgtggagaccctggaacagatgcagcggaagcacggcggcatgctcgtgcgcaacccgttaagcaggaactccacccacgagatgtactgggtcagctgcggaacgggcaatatcgtgtcggcggtaaacatgaccagccgcatgctactcaaccgcttcaccatggcccaccggaaacccacctacgagcgcgacgtcgacctgggggcgggaacgagacacgtggccgtggagcccgaggtcgcaaaccttgacatcatcggccagcgcatcgagaacatcaagtatgagcacaagtccacctggcactacgacgaggataatccctacaagacctgggcgtaccatgggagctacgaggtgaagccgtccggcagcgcctccagcatggtgaacggcgttgtgaaactcctgaccaagccctgggacgtcatccccatggtgacacagatcgccatgaccgacaccacccccttcggtcagcagcgggtgttcaaagagaaagtcgacacgcggaccccgaaggccaagcgggggaccgcacagataatggaggtgaccgctcgctggctgtggggcttcctcagccggaacaagaagccgcgcatttgcacgcgagaagagttcacccggaaggtgcgctcaaacgcagcgatcggggccgtcttcgtggacgagaaccagtggaatagcgcgaaggaggcggtggaggacgagcgcttctgggacctggtccaccgggagcgcgagctgcataagcaggggaagtgcgcgacctgtgtgtacaacatgatgggaaagcgggagaagaagctgggggagttcggcaaggccaagggaagccgcgctatctggtacatgtggctgggagcacgcttcctggagttcgaggcactcggcttcatgaacgaggaccactggttctctagagagaactccctgagcggggtggaaggcgaggggctgcacaagctcggttacatcctgcgggacatttccaaaatcccaggggggaacatgtacgccgacgacaccgccggctgggacacgcgcattaccgaggatgacctgcagaatgaggccaagattaccgacatcatggagccggagcacgcgctcctggccaaggctgtcttcaagctgacctaccagaacaaggtggtgcgcgtccaacggcccgccaagaatggaacggtaatggacgttatcagcaggcgggaccagcgcggctcaggacaggtaggcacctacggccttaacaccttcacgaacatggaggcgcagctgatccggcagatggagagcgaggggatcttctcccccagcgagctggaaacgcccaacctcgccgagcgcgttctatactggttggagaagtatggcgtcgagcggctcaaacgcatggccatctccggggacgactgcgtcgtgaagccgatcgacgaccggttcgccaccgccttgaccgccctgaacgacatgggaaaggtgcgaaaggacatcccccagtgggagcccagcaaggggtggaacgattggcagcaggtcccattctgctcccaccatttccaccagctcatcatgaaggacgggcgggaaatagtagtgccgtgccgcaaccaggacgagctggtcggccgggcgcgcgtgagccagggggccggctggtccctgcgggagaccgcctgcctcggcaagagctacgcccagatgtggcagctgatgtacttccaccgccgggacctgcgcctggcagccaacgccatatgcagcgccgttcctgtcgactgggttcccacgtcgagaactacctggagcatccatgcccaccaccagtggatgaccacggaggacatgctgtccgtgtggaaccgcgtctggatcgaggagaacccctggatggaggacaagacccatatcagctcctgggaggacgtgccgtacctaggcaagcgcgaggaccaatggtgcgggagcctcatcggcctgaccgcgcgagccacctgggccactaacatccaggtggccattaaccaggttcgccggctgatcggcaatgagaactacctcgattacatgacgtccatgaagcgcttcaagaacgagagtgaccccgagggggccctgtggtag

SEQ ID NO: 24709 - RNA, 9879 nt, synthetic construct
  misc_feature 1..9879: note = derived and/or modified CDS sequence (opt11) from DENV-1__JQ915077__SS-prME
  source 1..9879: mol_type = other RNA
agcgtgactatgctgctcatgctgctgcccaccgtgctcaccttccacctgacgactcggggtggtgaaccccacatgatcgtgagcaagcaggagaggggaaagagcctcctgttcaagacctccgccggggtgaacatgtgcaccctgatcgcaatggacttgggcgaactctgcgacgacaccatgacctacaagtgcccccgcatcaccgagaccgagcccgacgacgtggactgctggtgtaacgcaaccgaaacctgggtgacctacggcacgtgctcacaaaccggcgagcaccggcgcgacaagcggtccgtggcgctggcgccccacgttggcttggggctcgagacccgcaccgaaacgtggatgtcgtccgagggcgcatggcggcaaatccaaaaagtggagacttgggccctgcgccaccccgggttcacggtgatcgcgctgttcctggcccatgcgatcggtaccagcatcacgcaaaaggggataatcttcatcctgctgatgctcgttaccccctccatggccatgcggtgcgtagggataggcaaccgcgacttcgtggaggggttaagcggcgcgacctgggtcgacgtggtgctggagcatggttcctgcgtaactacgatggccaaggacaaacccaccctcgacatcgagctgctcaagactgaggtgaccaacccggccgtgctccggaagctgtgcatcgaggccaaaatctcaaacacgaccaccgactcccggtgcccgacccagggcgaagccacgctggtggaggagcaggacaccaactttgtgtgccggcgcacattcgtcgaccggggctgggggaacggctgcggcctcttcggcaaggggagcctgatcacgtgcgcaaagttcaagtgtgtcacgaagctggagggcaagatcgtgcagtacgagaacctcaagtactcggtgattgttaccgtgcacacgggcgaccagcaccaggtcgggaacgagaccaccgagcacggcacgatcgccaccattacaccccaggcccccaccagcgaaatccagctgacggattacggggccctaactctcgactgtagcccccggaccgggctagacttcaatgagatggtgctgctcacgatgaaggagaagtcctggctggtgcacaagcagtggttcctggatctccccttgccctggacatccggggccagcacaagccaggaaacctggaaccggcaggacctgctcgtcaccttcaagaccgcgcacgccaagaagcaggaagttgttgttctggggtctcaggagggggccatgcataccgcccttacaggggccacggagatccagacaagcggaaccaccaccatcttcgcggggcacctcaagtgccgactgaagatggacaagctgacgctcaaggggatctcctacgtgatgtgcaccgggagcttcaagctggaaaaagaggtggccgagacccaacacggcaccgttctcgtccaggtgaagtacgagggaacggacgccccctgcaagatccccttctccagccaggacgagaagggggtcacacagaacggccggctggtgaccgccaacccgatagttaccgacaaggagaagccagtcaacatcgaggccgagccacccttcggggagtcctacatagtggtcggcgcgggcgagaaggccctcaagctgagctggtttaagaaggggtccagcatcggcaagatgtttgaggccaccgcccgcggggcgcggaggatggccatcctcggcgacacggcctgggacttcgggtccatcggtggcgtcttcaccagcgtggggaagctcgtgcaccagatcttcggcaccgcctatggggttctgttctccggggttagctggacgatgaagatcggaatcggcatcctcctaacctggctaggcctaaattcccgctccacctccctcagcatgacatgcatcgccgtggggatggtcacgctttacctgggcgtgatggtgcaggcggacagtggttgcgtaatcaactggaaaggccgggagctcaagtgcgggagcggtatattcgttaccaacgaggttcacacctggaccgagcaatacaagttccaggccgacagccctaagcgcctgtccgccgccatcggaaaggcctgggaggagggggtatgcggcatccggagcgcgacccgcctggagaacatcatgtggaagcagatctccaacgagctcaaccacatcctgctggagaacgatatgaagttcactgttgtggtcggagacgttagcggcatcctcgcccaggggaaaaagaccatccggccccagccaatggagcacaagtattcctggaaatcttggggcaaggccaagatcatcggcgccgacgtccagaacaccactttcattatcgacgggcctaatacgccggagtgcccggatgaccagcgtgcctggaacatctgggaggtcgaggactacggattcggaatcttcacgaccaacatctggctgaagttacgggactcctacacccaggtgtgcgaccataggttaatgagcgcggccatcaaggactcaaaggccgtgcatgccgacatgggatactggatcgagagcgagaagaacgagacgtggaagctggcgcgcgcctccttcatcgaggtcaagacgtgcgtctggcccaagagccacacgctgtggtccaacggcgtgttagagagcgagatgatcatccccaagatctacgggggacccatatcccagcacaactaccgcccagggtacttcacccagaccgccggtccttggcacctggggaagctggagctggacttcgacctgtgtgagggcactaccgtcgtggtggacgagcactgcggcaaccgggggccttcgctgcgcaccacgacagttaccggcaagatcatccacgagtggtgctgccggtcctgcaccctgccgcccctccgcttcaaaggggaggacggctgttggtacggaatggagatccggcccgtgaaggagaaggaggagaacctggtcaaaagcatggtgagcgccggctccggggaggtggactccttctccctcgggcttctgtgcatcagcataatgatagaggaagtgatgcgctcccggtggagccgcaagatgctcatgacgggcaccctggtcgtgtttctgctcctgactctgggtcagctcacctggaacgacctgatccggctgtgcatcatggttggcgccaacgcgtcggacaacatgggcatgggcacgacctatctcgccttaatggccaccttccgcatgcgccctatgtttgccgtggggctccttttccggcggctgaccagtcgggaggtgcttctcctgacggtcgggctgagcctcgtcgccagcgtggagctgcccaacagtcttgacgagttaggagatggcttggccatgggcatcatgattctgaagttactgaccgacttccagagccaccagttatgggccatcctgctgtccttaaccttcgtgaagaccacgcttagcctgcactacgcctggaaaaccatggcaatgatcctgtccatcgtgagcctcctgcccctgtgcctatcaacaacaagccagaagacgacctggctgcccgtgctgctcggctccctagggtgcaagccgctgaccatgttcctcattaccgagaataaaatctggggcagaaagagctggcccctgaacgaggggataatggccgtaggtatagtctcaatccttctatccagtctgctgaagaacgacgtgcccctcgcagggccccttatcgccggcggcatgctgatcgcctgttacgtcatctccgggagctccgccgatctcagcttggagaaggcggccaaggtgtcctgggaggaggaggccgagcatagcggcgcatcccataacatcctggtggagatccaggacgacggcaccatgaagattaaggacgaggagcgggacgatacgatcaccatcctcttaaaggccaccctgctagcaatcagcggcgtctacccgatgtccattcccgccaccctgtttgtgtggcacttctggcagaagaagaagcagcgaagcggagtgctgtgggacactcccagcccgcccgaggtggaaaaggccgtactggacgacggcatttaccggatcctccagcgcggcctgctggggcggagccaagtaggcgtcggggtgtttcaggagggcgtgtttcacaccatgtggcacgtcacccgcggggccgttctcatgtaccaggggaagcggcttgagccgtcctgggccagtgtgaagaaagatctaatctcctatggcgggggctggcgcttccaggggagctggaacacaggcgaggaggtacaggtgatcgcggtggagcccgggaagaaccccaagaatgtacagactgcccccggcacgttcaagacctcagaaggcgaagtgggagcgattgccctagacttcaagcccggcacatctgggagccccatcgtgaatagggaaggcaaaatagtcggactgtacggaaacggcgtggtgacgacctcgggcacctatgtcagtgcaatcgcgcaggccaaggcctcccaggagggccctctgccggagatcgaggacgaggtattccgcaagcggaacctcacaattatggacctgcaccccgggagcggcaagactcgccggtacctgcctgccatcgtgcgcgaggccatcaagcggaagctccgcactctggtcctggccccgacccgggtggtagcgtctgagatggcagaggcactcaagggcatgcccatccgctatcaaacaacggcggtcaagagcgagcacaccggtaaggagatagtggacctgatgtgtcacgccaccttcaccatgcgcttactctctcccgtgcgggtcccgaactacaatatgatcatcatggacgaggcccacttcacggacccggctagcatagccgcgagaggctacatatccacccgggtggggatgggcgaggcggccgccatctttatgacggccacgccgcccgggagcgtggaggctttcccccagagcaatgccgtcatacaggacgaagagaaggacatcccggagcgtagctggaactccggctacgattggataaccgacttccccggcaagaccgtgtggttcgtgccatctatcaagtccgggaacgacatcgccaactgcctgcggaagaacggcaagcgcgttatccagctgagcagaaagacctttgacaccgagtaccagaagactaagaacaacgattgggactacgtggtcaccactgatatttccgagatgggggccaacttccgcgcggaccgggtgatagacccccgccggtgcctcaagcctgtgatcttgaaggatggccccgagcgcgtcatccttgcggggcccatgcccgtgaccgtggccagcgccgcccagcggcgagggcggatcggccgaaatcaaaacaaggagggggaccagtacatctatatgggccagccgctcaacaacgacgaggaccacgcgcactggacggaggccaagatgttactggacaacatcaacacccccgaggggatcatccccgccctcttcgagcccgaacgcgaaaagagtgccgcaattgacggcgagtaccgcctgcgcggggaggcgcgcaagaccttcgtggagctgatgcgccggggcgacctcccggtgtggctgagctacaaggtggcatccgaaggctttcagtactccgacaggcgctggtgcttcgacggggagcgcaataatcaggtcctggaggagaacatggacgtggagatctggaccaaggaaggcgagcggaagaagctccgcccgcggtggttggacgcgcgcacgtacagcgacccgctggcgctccgtgagttcaaggagttcgcagcggggcgccggtccgtgagcggagacctcatcctggagatcggaaaacttccccagcacctgacccagagagcccagaacgccttggacaacctcgtcatgctacacaactccgagcaaggtgggaaggcataccggcacgccatggaggagctgccggacactatcgagaccatcatgctcctggcgctgatcgccgtgctaaccgggggagtgacgcttttctttctgagcgggcgcggattaggcaagacctccatcgggttactgtgcgtcacctcgtccagcgtgctcttatggatggcctccgtggagccccactggatagccgcgagcataatcctggagtttttcctcatggtcctgctgatacccgagcctgatcggcagcggacaccccaggacaaccagctcgcctacgtggtaatcggtctgctgttcatgatactcacagtagccgccaacgagatggggctgctggagaccaccaagaaggacctcggcatcggacacgccgcggccgagaatcatcaccacgccgccatgctggacgtggacctgcaccccgcctcagcgtggacgctttacgcagtggccaccacgatcatcaccccaatgatgcggcacaccattgagaacacgacagccaacatcagcctgaccgctattgcgaaccaggccgccatactgatggggctcgacaagggctggccgatctctaagatggatatcggggtgcctctgttagccctcggctgctacagccaggtgaatcccctgacactgacggcggcggtgctcatgctggtcgcgcactacgctatcatcggtcccgggttgcaggcaaaggcgacccgcgaggcacagaagcggaccgctgccgggatcatgaaaaacccgaccgtagacggcattgtggcaatcgacctcgaccccgtcgtctatgacgcaaaattcgaaaagcagctgggccagatcatgctgctcatcctttgtacgtcccagatcctgctaatgcgtaccacatgggccctgtgcgagagcatcacactggccacggggccgctcaccactctatgggagggctctcccggaaagttctggaacaccacaatcgccgtcagcatggcgaacatatttcggggcagctatctggcgggcgccgggctagccttctccctgatgaagtccctgggcgggggccgccgcgggaccggtgcccagggcgagaccctcggtgagaagtggaagcggcagttaaaccagctctcaaaaagcgagttcaacacctacaagcgctccggcatcatcgaggtcgaccggtccgaggccaaggaggggcttaagcgcggcgagacgacaaagcacgcggtgtcacggggaaccgccaagctgcgctggttcgtggagcgaaatctggtcaagccggagggtaaggtcatcgacctgggctgcgggcgcggcgggtggagctactactgtgccggcctcaagaaggtgaccgaggtcaaggggtacacgaaagggggccctgggcacgaggagccgatccccatggccacctacggctggaatctcgtaaagctgcacagcgggaaggacgttttcttcataccgcccgagaagtgcgacacgctcctgtgcgacatcggggagagctcaccaaaccccacaattgaggagggacggaccctgcgcgtcctcaaaatggtggagccgtggctgcgagggaaccagttctgcatcaaaatcctgaacccctacatgcccagcgtggtcgagacgctcgagcagatgcagcgcaagcacggcgggatgctggtgcggaaccccctgtcccgcaacagcacccacgagatgtactgggtatcctgcggcaccggaaatatcgtgagcgccgtgaacatgacgtcgcggatgctcctgaatcgctttacgatggcccaccggaagccgacctacgagcgcgacgttgacttgggggccggcacccggcacgtcgccgtggagcccgaagtggccaacttagacataatcgggcagcgcatcgagaacatcaagaacgaacacaagagcacctggcactacgacgaagacaacccctacaagacgtgggcgtatcacgggtcctacgaggtaaagcctagcgggagcgcctccagcatggtgaacggcgtcgtgcgcctgctcacgaagccgtgggatgttattcccatggttacccagatcgcaatgaccgatacgacacctttcgggcagcaacgggtgtttaaggagaaggtcgacacccgcacccccaaggcgaaacggggcacggcccagatcatggaggtcaccgcgaagtggctctggggctttctgtcccgcaacaagaagcctcggatctgcacccgcgaggagttcacccggaaggttcgctcaaacgccgccattggtgccgtgttcgtcgacgagaaccagtggaactccgccaaggaggcggtggaggacgagcggttctgggacctggtaagacgggagcgcgaactgcacaagcagggcaagtgtgccacgtgcgtctacaacatgatggggaaacgggagaagaagctgggcgagttcgggaaggccaagggcagccgtgcgatctggtatatgtggctgggcgctcggttcctagagtttgaggccctggggtttatgaatgaggaccactggttttcccgcgagaatagcctgtccggagtggagggggaaggtctccataagctgggttacatcctgagagacatatcaaagatcccaggcggcaacatgtatgccgacgacacggccgggtgggacacccgcatcaccgaggacgacctccagaacgaagccaagatcacggacatcatggagcccgaacacgctctgttggccaccagcatattcaagttgacttatcagaacaaagtcgttcgggtgcaacgccccgccaagaatggcaccgtgatggacgtcatcagccggcgcgaccaacgcgggagtggacaggtgggcacgtatgggctgaataccttcaccaacatggaggcccagctgatcaggcaaatggagtccgagggtatcttctccccctccgagctagagacccccaacctggccgggcgcgtcctggactggttagaaaagcacggcacagaacggctgagacggatggcgatttccggggacgactgtgtcgtgaaacccatcgacgaccgcttcgcaaccgctctgaccgccttaaacgacatgggcaaggtgagaaaagacattcctcagtgggagcccagcaagggctggaacgactggcagcaggtacccttctgcagccaccacttccatcagctgatcatgaaggacggtcgtgagatcgtggtcccctgccggaatcaggacgagctggtcggccgcgcccgggtatcccaaggcgcgggctggagcctccgcgagacggcatgcctggggaagtcctacgcacagatgtggcaattgatgtacttccaccgacgcgaccttcggctggcagccaacgctatatgtagcgctgtccccgtcgactgggtgcccacgtcccgcaccacgtggtcaatacatgcgcaccaccagtggatgaccaccgaggacatgctgtccgtttggaaccgggtctggatcgaggagaacccgtggatggaggacaagacgcacgtgagctcctgggaggacgtgccctatctcgggaagcgcgaggaccagtggtgcggcagcctgatcggacttaccgcccgggcgacctgggcgacaaacatccaggtcgccatcaatcaggtgcgccgcctaatcggcaacgagaactaccttgactacatgacgtccatgaaacggttcaagaacgaatcagacccggagggggcgctgtggtga

SEQ ID NO: 24710 - RNA, 9879 nt, synthetic construct
  misc_feature 1..9879: note = derived and/or modified CDS sequence (opt11) from DENV-1__JQ915079__SS-prME
  source 1..9879: mol_type = other RNA
agcgtgaccatgctgttgatgctgctgcccaccgtgctcaccttccacctgaccacccggggcggggagccccacatgatcgtgagcaagcaggagcggggcaaaagtctcctgttcaaaaccagtgccggagtgaacatgtgcaccctgatcgctatggatctgggcgagctctgcgacgataccatgacatacaagtgcccacgcatcaccgagacagagccggatgacgtggattgctggtgcaacgcgaccgagacctgggtgacctatgggacttgcagccagacgggcgagcaccggagggataagcggtccgtggccctggcgccccacgtcggcctggggctcgagacccgcacagagacgtggatgtcatccgagggcgcatggcggcagatacagaaggtggagacctgggccctgcggcaccccggatttaccgtgatagcgctgttcctcgcccacgccatcggcacctctatcacgcagaaggggattatcttcattctgcttatgctcgttaccccatccatggccatgagatgtgtgggcattggcaaccgcgacttcgtggaggggcttagtggggcgacgtgggtcgacgtggtgctggagcacggatcctgtgttactacgatggcgaaggataagcccaccctcgacatagagctgttaaagaccgaggtcaccaaccccgccgtgcttcggaagttgtgcatagaggcaaagatcagcaatacgactacagactcccgctgcccgacccagggcgaagcaacgctagtcgaggagcaggacaccaacttcgtgtgtcggcgcactttcgtagaccgtggatgggggaacggttgcggcctcttcggcaagggcagccttatcacgtgcgctaagttcaagtgcgtcacgaagctggaaggcaagattgtgcagtacgagaatctcaagtactcagtgatcgtcaccgtgcacaccggcgatcagcaccaggtcggaaatgagaccacggagcacggcacgatcgccaccataacgccccaggcccccaccagcgagatccagctgaccgattatggggcgctgaccctcgactgcagccccagaacgggactggacttcaacgagatggtgctgttaaccatgaaggagaagtcgtggctggtgcacaagcagtggttcctggacctccctttgccctggactacgggtgcctctaccagccaggaaacctggaatcggcaggacctgctcgtcacgttcaaaacagctcacgcaaagaaacaggaggttgtagtcctgggaagccaggagggagccatgcacaccgccctgaccggggctacggagatccaaaccagtggaaccaccacgatattcgcggggcacctcaagtgcaggctgaagatggacaagctgaccctaaagggcatcagctacgtgatgtgcaccgggtccttcaagcttgagaaggaagtggctgagactcagcacggcacggttttagtccaggtgaaatacgaggggactgacgccccctgcaagatcccgttcagctcccaggacgagaagggggtcacccagaacggtcggctggttaccgcgaacccgatcgtgacggacaaggagaggcccgtcaacatcgaggccgagccgccctttggggagagctatatcgtggtgggcgcgggagagaaggcgcttaaactgtcttggtttaagaagggaagctccataggtaaaatgttcgaggcgaccgcccgcggggcccgccgcatggccatcctgggcgacaccgcctgggacttcggcagcatcggtggcgtcttcacctccgtggggaagctcgtgcaccagatcttcggcacggcatacggggtcttattcagcggcgtgtcctggacaatgaagatcggtatcggcattctgctcacctggcttggacttaacagccggtcaaccagcctctccatgacgtgcatcgccgtgggaatggtcaccctgtacctcggagtgatggtgcaagcagacagcgggtgcgtaatcaactggaagggccgcgagctcaagtgcggttccggcatcttcgtaaccaacgaggtgcatacttggaccgagcagtacaagttccaggcggacagcccgaagcggctgtcagctgccatcgggaaggcctgggaggaaggggtttgcggaatccgctccgcgacgaggctggagaacatcatgtggaagcagatcagcaacgagctcaaccacatacttctggagaacgatatgaagttcaccgtggtggtcggggacgtgtctggcatcctcgcccagggcaagaagaccatccgcccccagcccatggagcacaagtactcatggaagtcctggggcaaggcgaagataatcggcgccgacgtgcaaaacaccacgttcataatcgatgggcccaacaccccggagtgtcccgacgaccagcgggcttggaacatctgggaggtcgaggactacggcttcgggatattcaccacgaatatctggctgaagctacgcgacagctacacccaggtttgcgaccaccggctcatgtccgcggccatcaaggacagcaaggccgttcatgccgacatgggctactggatcgagtccgaaaagaacgagacctggaagctggcgcgcgccagcttcatcgaggtgaagacttgcgtgtggcccaagtcccacacgctgtggagtaacggcgtgctcgagtccgagatggtcattccaaagatctacggggggccgatctcacagcataattacagacccgggtacttcacgcagactgccggcccctggcacctcgggaagctggagctcgacttcgacctgtgcgagggcaccaccgtagtggtcgacgagcattgtggcaaccgcgggccctccctgcggacaaccaccgtgaccggtaagattatccacgagtggtgctgccgctcatgcacgctgccgcccctgcggttcaagggggaggacgggtgctggtacgggatggagattcgccccgtgaaagagaaggaggagaacctggtcaagtccatggtaagcgccggcagcggcgaggtggactctttctccctaggacttctgtgcatctccatcatgatcgaggaggtcatgcgaagccgctggtcgcgtaagatgctcatgaccggcaccctggtggtcttccttctcctgacactggggcagctcacgtggaatgatctgatccgcctctgcataatggtgggcgccaacgcgtctgacaacatggggatgggcactacctacctcgcgcttatggcaacatttcggatgcggccgatgttcgccgtcgggctcctctttcgccggctgacttcccgcgaagtcctgctcttaaccgtggggctgagcctcgttgccagtgtcgagctgcccaacagcctggatgagctcggtgacgggctggctatgggcatcatgatcctgaagctcctcaccgatttccaatcccaccagctgtgggccaccctgctgagcctgacgtttgtaaagaccacgctctcccttcactacgcctggaagaccatggcaatgatcctgagcatcgtgtccctccttcccctctgcctgtccacgacctcccagaagactacctggcttcccgtcttgctcggcagcctggggtgcaaaccgctgaccatgttcctcataacggaaaacaagatatggggacggaagtcctggcccctgaacgaggggatcatggccgtggggatcgtgagcatcctgctcagctccttattgaagaacgacgtgcccctcgcggggccgctgatcgccggcggcatgctcatcgcctgctatgtgatcagcgggtcctcagctgatctctccctggagaaggcagccaaggtgtcatgggaggaggaggccgagcacagtggggcctcacacaacattctggtcgagatccaggacgacggcacgatgaagatcaaggatgaggagcgggacgacacaatcaccatactgcttaaggctactttgcttgcgatttccggcgtgtacccgatgtctatacccgccaccctattcgtatggcatttctggcagaagaagaagcagcggtccggggtcctgtgggacaccccgagcccgcccgaagttgagaaggccgtgctggacgatggcatataccgcatattgcaacgggggctgctggggcgttcccaggtcggcgtgggggtcttccaggagggggtcttccataccatgtggcacgttacgcgcggtgccgtgctgatgtaccagggcaagcgcctggagccgagctgggcctccgtcaagaaggatcttatctcgtacggcgggggctggcggttccagggctcctggaacatgggcgaagaggtacaagtgatcgcggtcgagcccgggaagaaccccaagaacgtccagaccgcccccggcaccttcaagaccagcgagggcgaggtgggtgccatcgccctcgacttcaagcccggcacgtccggaagccccatagtcaaccgcgaaggcaagatcgtaggcctgtacgggaacggggtggtcaccacctctgggacctacgtgagcgctatcgcgcaggccaaggcctcccaggagggccccctcccggagatcgaagacgaggtgttccggaaacgcaatctcacgattatggacctgcaccccggatcaggcaagacccggcgctaccttccggccatcgtccgcgaagccatcaagcgcaagctccgaacgctggtgctggcgccgacccgcgtggtcgccagtgagatggccgaggccctcaagggcatgccaatccgctaccagacgaccgcggtcaagtccgagcacaccgggaaggaaatagtggacctgatgtgccacgccaccttcacgatgagactgctcagccccgtacgtgtccccaattacaacatgataatcatggacgaggcccactttaccgatccggcctccattgcagcccggggctatatcagcacccgcgttggcatgggcgaagccgccgccatcttcatgaccgccacaccgcccgggtccgtggaggcgttcccccagagcaacgcagtcatccaggacgaggagaaagacatcccggaacggtcctggaactctggctacgactggataaccgacttccctggcaagactgtgtggttcgtccccagcatcaagagcgggaacgacatcgccaactgcctgcgcaagaacgggaaacgcgtgatccaactatcccgcaagacattcgatactgagtaccagaagaccaagaacaacgactgggactatgtcgtgaccaccgacatcagcgaaatgggggccaacttccgggccgaccgagtgattgacccccggcgctgcctcaaaccggtcatactgaaggacgggcccgagcgggtgatccttgcggggcccatgcccgtgacggtggcctccgccgcccagcgccggggccgcatcggtcggaatcagaacaaagaaggggaccaatacatctacatgggccagccactcaacaacgacgaggaccacgcgcactggaccgaggccaagatgctgctggacaacatcaacacccccgaggggataatacccgccctctttgagcccgagcgcgagaagtccgccgcaatcgacggcgagtaccggctgcgcggcgaggcgcgcaagaccttcgtcgagctgatgcggcgaggcgacttaccggtgtggctgtcctacaaggtagccagcgagggattccagtacagcgatcgaagatggtgcttcgacggggagcggaacaaccaggtgctggaggagaatatggacgtggagatctggacgaaggagggcgaacgcaaaaagttacggcctcgatggctggatgcccgaacgtactccgaccccctcgccctccgtgagttcaaggaattcgctgcggggcggcgcagcgtctccggcgacctgatcctggagatcggaaagctccctcagcacctgacccaacgggcccagaacgccttagataatctcgtgatgctgcataactcggagcagggcgggaaggcctaccgtcacgccatggaggagctgccggacaccatcgagaccatcatgctgctggcgctgatcgccgtgctcaccggcggggttacccttttcttcttgtccgggcgggggctcggcaaaacaagcatcggacttctgtgcgtgacctcgagctccgccctcctgtggatggccagcgtggaaccccactggattgcggcctccatcatcctggagttcttcctgatggtcctgctgattccggagcccgacagacagcgtacgccgcaggataaccagctagcctacgtggtaatcggcctattattcatgatcctcaccgtcgcggccaacgagatggggctgctggagaccaccaagaaagacctcggaatcgggcacacggcggccgagaaccaccaccacgcagccatgctggacgtggacctgcaccccgccagcgcttggaccctctacgccgtcgccacgacaatcataacgcccatgatgcgtcacaccatcgagaacacgaccgccaacatctccctgacggccatcgctaaccaagccgcgatactcatgggcctcgacaagggctggcctatcagcaagatggatattggagtcccccttctggccctcggctgttactcgcaggtcaatcctctgaccctgactgccgcagtgctcatgctggttgcccactacgccatcatcgggccgggcctgcaggccaaggcgacccgggaggcccaaaagcgcacggccgccgggattatgaagaacccgacggttgacggcatcgtggctattgacctggatccagtcgtgtacgatgcgaagttcgagaagcagcttggccagataatgcttctcatcctgtgcaccagccaaatcctgctgatgcgcacaacgtgggcgctgtgcgagtccatcaccctcgcgacagggcccctcaccacgctgtgggagggcagccccgggaagttctggaacaccaccatcgccgtgtccatggccaacatcttccgaggaagctaccttgctggtgccgggctcgccttcagcctgatgaagtccctgggggggggcaggcgggggaccggcgcccaaggcgagacgctcggggagaagtggaagcgccagttgaaccagctgtcgaagtcgcagttcaacacatacaagcggtcaggcattatcgaggtagaccgctccgaggcgaaggaagggctcaagcggggcgagaccaccaagcacgcggtgagccgcggtacggccaagctgcgctggttcgtggagcgcaaccttgtcaagccggagggcaaagtaatagatttaggctgcgggcggggcgggtggtcatactactgcgccggcctcaaaaaggtgaccgaagtcaaggggtacacgaagggcggcccaggacacgaggaacccatcccaatggccacgtatggctggaacctcgtgaagctgcactcggggaaggacgtgttcttcatcccgcccgagaagtgcgacaccctcctttgcgacatcggcgagagcagtcccaatcccacgatagaagaggggcggacccttcgggtcctgaagatggttgagccgtggctgcgcggcaaccaattctgcatcaagatcctgaatccctacatgccctccgttgtcgagaccctagagcagatgcagcggaaacacggcggcatgttggtgcgcaaccccctgagccggaactccacccacgagatgtactgggtgagctgcggtacggggaacattgtctccgcagtgaacatgaccagccgcatgctcctgaaccgcttcaccatggcccaccgcaaaccgacctacgaacgggacgtagacctgggcgccggtacgcgtcacgtcgccgtggagcccgaggtcgccaacctcgacatcatcgggcaacgcatcgagaacatcaagaacgagcataaatccacctggcactacgatgaagacaacccctacaaaacctgggcgtaccatggcagctatgaggtgaagccctccgggagcgcctcttccatggtgaacggcgtcgttcggctgctgaccaagccttgggacgtgatccccatggtaacccagatcgccatgaccgacaccaccccttttgggcagcagcgcgtgttcaaggagaaggtggacactcggacccccaaggccaagcgcggcaccgcccagattatggaggtcaccgcgaagtggctttggggcttcctgagccggaacaagaagccccgcatctgcactcgggaagaattcaccaggaaggtgcggtccaacgccgccatcggggccgtattcgtggacgagaaccagtggaacagcgctaaggaggcggtggaggacgagcgcttctgggacctggtgcggcgcgagcgcgagttgcacaagcagggcaagtgcgcgacatgtgtctacaacatgatgggcaagcgcgagaagaagctgggtgagttcgggaaggccaagggatcccgggccatctggtacatgtggctgggcgcgcgcttcctcgagttcgaggccctggggttcatgaacgaggaccactggttcagccgagagaattccctgagcggcgtagagggggaaggcctccacaagctggggtacatcctgcgagacatctcaaagattcccggcggtaatatgtacgccgacgacaccgccgggtgggacacgcggatcaccgaggaggatctacagaacgaggcgaagatcaccgacatcatggagcctgagcacgcgcttttagccaccagcatcttcaagctcacctaccaaaacaaggtggtccgcgtgcagcggccggccaagaacggcaccgtgatggacgtcatctcccgccgcgaccagagggggtcaggccaagtgggaacctacgggctgaataccttcacgaacatggaagcccagctgatcaggcagatggagtcagaggggatcttcagccccagcgaattagagacccccaatttagccgggcgggtgctcgactggctcgagaagcacggaatcgagcgcctacggagaatggcgatcagcggggacgactgcgttgtgaagcccatagacgaccggtttgccaccgcactcacggctttaaacgacatgggcaaggtgcgcaaagacatcccgcaatgggagccctcaaagggatggaatgactggcagcaggtccccttctgcagccaccacttccaccagctgatcatgaaggacgggcgggagatcgtggtgccctgccgcaaccaggacgagttagttggccgggcccgcgttagccagggagccggctggagtttacgggagacggcttgcctgggcaagagctatgcccagatgtggcagctgatgtacttccatcgccgggacctgaggctggcagccaacgcgatctgctccgcagtgcccgtcgactgggttcccacctcccggacgacctggtccatccacgcccaccaccagtggatgaccacggaggacatgctgagcgtgtggaaccgtgtctggatcgaggagaacccatggatggaggataagacccacgtgtccagctgggaagacgtgccttacctcggcaagagagaggaccaatggtgcggctccctcatcgggctgaccgcaagggccacctgggcaacgaacattcaggttgccatcaaccaagtgcgccgcctcatcggcaatgagaactacttagactacatgactagcatgaagcgcttcaaaaacgagtccgatcctgagggagcactgtggtga

SEQ ID NO: 24711 - RNA, 9879 nt, synthetic construct
  misc_feature 1..9879: note = derived and/or modified CDS sequence (opt11) from DENV-1__JQ915080__SS-prME
  source 1..9879: mol_type = other RNA
agcgtgaccatgctgctcatgctgctgcccactgtacttaccttccacctaaccacacggggcggcgagccccacatgatcgtgagcaaacaggagcggggcaagagcctcctgttcaagacctccgccggagttaacatgtgcacgctgatcgcaatggacctaggcgagttgtgcgacgacaccatgacctacaaatgccccagaatcaccgagaccgagcccgacgacgttgactgctggtgcaacgcgaccgagacctgggtgacctacgggacctgcagccagacgggggaacaccggcgcgacaagcgatccgtggccctggcgccccacgtgggcctggggctcgagacccgcaccgagacgtggatgagctccgagggcgcctggcggcagatccagaaggtggagacctgggccctgcgccaccccgggttcaccgtgatagcgctgttcctcgcccacgccatcggcaccagcatcacgcagaaggggatcatcttcatcctgctgatgcttgtcacgccttccatggccatgaggtgcgtggggattggcaaccgcgatttcgtggaggggctgagtggcgcgacctgggtcgacgtggtgctggagcacgggagctgcgtgaccacgatggctaaggacaagcccaccctcgacattgagctgttgaagaccgaggtgactaaccctgcagtgctcagaaagctgtgcattgaggccaagatcagcaatactaccaccgactcccgctgcccgacccagggcgaggccacgctggtcgaggagcaggacacaaacttcgtgtgccggcgcaccttcgtggaccgcggttgggggaacggctgcggcctcttcgggaaggggagcctgataacgtgcgcgaagttcaagtgcgtcactaagctggaaggcaaaatcgtgcagtacgaaaacctcaaatactccgtgatcgtcaccgtgcacacaggtgaccagcaccaagtcgggaacgagaccaccgagcacggcacgatagccaccatcacgccccaggcccccaccagcgagatccagctgactgactacggggccctgaccctcgactgcagcccccggaccggcctggactttaacgagatggtgctgctcaccatgaaggagaagtcgtggttggtgcataagcagtggttcctggatctcccgctgccatggactaccggtgcctccaccagccaagaaacctggaaccggcaggacttactcgttacgtttaagaccgcgcacgccaagaaacaggaagtggtggtcctgggctcgcaggagggggccatgcacaccgccctgaccggggccactgagatccagacctccggcacgaccacgatcttcgcggggcacttaaagtgtcgcctgaagatggacaagttaaccctcaaaggcatcagctacgtgatgtgtaccgggtccttcaagctagagaaagaggtggccgagactcagcacggcacggtcctggtacaggtcaagtacgagggcaccgacgccccttgtaagatccccttcagctcccaggacgagaagggggtcacccaaaacggtcggctggtgaccgccaatccgatcgtcacggacaaggagcgccccgtcaacatcgaggccgaaccgcccttcggggagagctacatcgtggtgggcgcgggcgagaaagccctcaaactgtcctggttcaagaaggggtcgtccatcggcaagatgttcgaggccaccgcccgcggggcgcgacgtatggccatccttggcgacactgcctgggactttgggagcatcggcggcgtcttcacctccgtagggaagctcgttcatcagatcttcgggacggcctacggcgtcctgttcagcggcgtgtcctggaccatgaaaatcgggataggcatcctgctcacctggctcggtctgaacagccggtccaccagcttgtccatgacgtgcatcgcagtgggaatggtcacgctgtacctaggcgtgatggtgcaggctgacagcgggtgcgtaatcaactggaagggccgcgagctcaagtgcgggtcgggcatcttcgtgactaacgaggtgcacacctggaccgagcagtacaagttccaagccgacagccccaagcggctgagcgcggccatcggcaaggcctgggaggaaggggtctgcggcatccgctcagcgacgcggctggagaacatcatgtggaagcagatctccaacgaactcaaccacatcctgctggagaacgacatgaagttcaccgtggtggtcggggacgtgtccgggatcctcgcccagggtaagaagaccatccgtccccagccaatggagcacaagtacagctggaagtcctggggtaaggccaaaattatcggcgcagacgtgcagaacaccacgtttatcatcgacgggcccaacaccccggagtgccccgacgaccagcgggcctggaacatctgggaggtcgaggactacggcttcgggattttcaccaccaacatctggctgaagctgcgcgacagctacactcaggtatgcgaccaccggctcatgtccgcggctatcaaggatagcaaagccgtgcacgccgacatgggctattggatcgaatccgagaagaacgaaacctggaaactggcgcgcgccagctttatcgaggtcaagacttgcgtgtggccaaagtcccacaccctgtggagcaacggggtgctcgagtccgagatggtcattccgaaaatatacggaggcccgatcagtcaacacaactaccggcccgggtactttacgcaaaccgccggcccttggcacctggggaaactggaactagacttcgatttgtgcgagggcaccacagtggtggtcgatgagcactgtggcaacagagggccgtccctgcggacgacaactgtaaccggaaagataatccacgagtggtgctgccgcagctgtacgctgccgcccctgcggtttaagggggaggatggctgctggtacgggatggagattcgccccgtcaaggagaaggaggagaatctggtaaagtccatggtgagcgccggcagcggcgaagtggactccttcagcctcgggctgctgtgcatctccatcatgattgaggaggtgatgcggagcaggtggagtcggaagatgcttatgactggcaccctggtggtcttcctgctcctgaccctggggcagctaacgtggaacgacctgatccgactgtgcatcatggtaggcgccaacgcctctgacaacatggggatgggcacgacctatttagcgctgatggccacattccgcatgcggccgatgttcgccgtcgggctcctcttccgccggctgacttcccgcgaggtcctactcctgacagtggggctgagcctcgtagcgtccgtcgagctgcccaacagcttggacgagttaggggacgggctggccatgggcatcatgattttgaagctactgacggacttccagtcccaccagctgtgggccaccctcttaagcctgacgttcgtgaagaccaccctctccctgcactacgcctggaagaccatggccatgattctgagtatcgtgtccctcctgcccctgtgcctcagcacgacctcccagaagaccacctggttgcccgtactgctcggcagcctggggtgcaagccactgaccatgttcctgatcacagagaacaagatctggggccggaagtcctggcccctgaacgaagggatcatggccgttggcatcgttagcatcttactcagctccctgctgaagaacgacgtccccctcgcgggtcccctgatcgccggcggcatgctgatcgcctgctacgtcatcagcgggtccagcgccgatctctccctggagaaggcggccaaggtcagctgggaggaggaggccgagcactccggcgccagtcacaacatcctggtcgaaatccaggacgacgggaccatgaagatcaaggacgaagagcgggacgacaccatcaccatcctcctgaaggcgacgctactcgcgatctccggcgtatacccgatgtctatccccgccaccctgtttgtatggcacttctggcagaagaagaagcagcggtccggagtcctgtgggacacccccagcccgcccgaggtggagaaggccgtgctggacgatggaatctaccgcatcctccaacggggcctgctggggagaagccaagtcggcgtcggggtgttccaggagggcgtcttccacaccatgtggcacgttacccggggggccgtgttaatgtaccagggcaagcggctggagcccagctgggcctccgtcaagaaggacctgatcagctacggtgggggctggcggttccagggctcctggaacatgggcgaggaggtccaggtaatcgcagtcgaacccgggaagaaccccaagaacgtgcagactgcccccggcacgttcaagaccagtgagggcgaagtgggggccattgccctcgacttcaagccaggcacgtccgggagcccaatcgtcaaccgcgaaggcaagatcgtgggcctatacggtaacggcgtggtcaccaccagcgggacctacgtgtccgccatcgcacaggccaaggccagccaggagggcccgctgccggaaatcgaggacgaggtgttccgtaagcgcaacctcacgatcatggacctgcaccccgggtccggcaagacccggcgctacctgcccgccatcgtccgggaggccatcaagcgcaagctccggactctagtcctggcgccgacccgggtggtcgcctccgagatggccgaagccctcaagggcatgcccatccgctaccagaccaccgcggtgaaatcagagcacaccgggaaggaaatcgtggacctgatgtgccacgccaccttcacgatgagactgctcagccccgtccgtgtgccaaactacaacatgatcatcatggacgaggcccacttcactgacccggcctccatcgccgcgcgggggtacatcagcacccgcgtgggcatgggcgaggccgccgccatcttcatgaccgccactccgcccgggtccgtcgaggcgttcccccagagcaacgccgtgatccaggatgaggagaaggacatcccggaacggtcctggaactctggctacgactggatcaccgattttcccggcaagaccgtgtggttcgtcccctccatcaaaagtgggaacgacatcgccaactgcctacgtaagaacggcaagcgcgtgatccaactgtcccgcaagacattcgacacggagtaccagaagaccaagaacaatgactgggattacgtcgtgaccaccgacatcagcgagatgggggccaacttccgggcagaccgcgtgatcgacccccggcgctgcctcaagccggtcatcctgaaggatggccccgagcgcgtgatcctggcggggcccatgcccgtgacggtagcctccgccgcccagcgccggggtcgcatcggccgcaaccagaacaaggaaggggaccaatacatctacatgggccagccgctcaataacgacgaggaccacgcgcattggaccgaggccaagatgctgctggacaacatcaacacccctgaggggatcatccccgccctcttcgagcccgagcgcgagaagtccgccgcaatcgacggcgagtaccgcctgcgcggggaggcgcgcaagactttcgtggaactaatgcgtcgcggcgacctcccggtatggttatcctataaggtcgccagcgagggcttccagtatagcgaccggcgctggtgcttcgacggggaacggaataatcaagtgctggaggaaaacatggacgtggagatctggacgaaggagggcgagagaaagaaactccggccacgctggctggatgcccggacctactccgaccccctggccctccgcgaattcaaggagttcgccgcggggcggcgcagcgtctccggcgacctaatcctggagatcgggaagctcccccagcacctgacccagcgggcccaaaacgcactggacaatctcgtgatgctgcataatagcgagcagggcggaaaggcctaccgccacgccatggaggaacttccggacacgatcgagaccatcatgctcctagctctgatcgccgtgctcaccggaggggtcacactgttcttcctgtcagggcgagggctgggcaagaccagcatcgggctgctctgcgtgacctccagctccgccctcctgtggatggccagcgtggagccgcactggatcgcggcctccatcatcctagagttcttcctcatggtgctgctgatccccgagcccgacagacagcgtactccgcaggacaaccagctcgcctacgtggtgatcgggctgctgttcatcatcctcaccgtagcagccaatgagatggggctgctggaaaccacgaagaaagatctgggcatcggtcacacggcggccgagaaccaccaccacgccgccatgctggacgtggacctgcaccccgcgagcgcgtggaccctctacgccgtggccaccaccatcatcacgcctatgatgagacacaccattgagaacaccaccgccaacatctccttgacggccatagcgaaccaggccgcaatcttaatgggattagacaaaggctggccgatctctaagatggacatcggggtccccctgctcgccctcggctgctactcacaggtgaaccccctgaccctgaccgccgcggtgctcatgctggtcgcccactacgccatcatcgggccaggcctgcaggccaaggcgacccgcgaggcccagaagcgcacggcagccgggatcatgaagaacccgactgtggacggcatcgttgccatcgatttggaccccgtcgtgtacgacgcgaagttcgagaagcagctggggcagatcatgctgctcatcttgtgcaccagccagatcctgctcatgcggaccacgtgggccctgtgcgagtctatcaccctggccacggggcccctcaccaccctgtgggagggcagccccgggaagttctggaatacgaccatcgccgtgtccatggccaacatcttccgcggcagctacctggcaggcgccgggctcgccttcagcctgatgaagtccctgggcgggggccgccgggggaccggcgcccagggtgagacactcggggagaagtggaagcgccaactgaaccagctgagcaagtcccagttcaacacctacaagcggagcggcatcatagaggtcgaccgctccgaggccaaggaagggctcaagaggggcgagaccaccaaacacgcagtgagccgcgggacggccaagcttcggtggtttgtggagcgcaacctggtcaagccggaaggcaaggttatagacctgggctgcgggcggggcgggtggagctactactgcgccggcctcaagaaggtgaccgaggtgaaggggtacaccaagggcggtcccgggcacgaggagccaatccccatggccacctacggctggaacctggttaagttacacagcgggaaggacgtgttcttcatcccgcccgagaaatgcgacaccttgctgtgcgacatcggcgagtcctctcccaaccctacaatcgaggaggggagaaccttgcgggtactcaagatggtagaaccatggctgcgcggcaaccaattctgcatcaaaattttaaacccgtatatgccctccgtggtcgagaccctagagcagatgcagagaaaacacggcggaatgctggtccgcaaccccctgagccggaactccacccacgagatgtactgggtatcctgcggcacgggcaacatcgtctccgccgtgaacatgaccagcaggatgctcctgaaccggttcaccatggcacaccgcaagcccacctacgagcgggacgtggacctgggcgccggcacgcgccacgtcgctgtggagccggaggtcgccaacctcgacatcatcgggcaacgcatcgaaaacatcaagaacgagcacaagtccacctggcactacgacgaggacaatccctacaaaacctgggcgtaccacggcagctacgaggtgaagccctccggtagcgccagctccatggtgaacggcgtcgtgcgcctgttaaccaagccgtgggatgttatcccaatggtcacgcagatcgccatgactgacaccacccccttcgggcagcagcgcgtgtttaaggaaaaggtggacacgcggacccccaaggcgaagcgcggcaccgcacagatcatggaagtcaccgcgaagtggttgtggggcttcctgagccggaacaagaagcctcgcatttgtacccgggaagagttcacccgcaaggtgcggtccaacgccgcgattggggcagtgtttgtagacgagaaccagtggaacagcgccaaggaggcggtggaggacgagcgcttctgggacctagtgcgccgcgagcgggagctccacaagcagggcaagtgcgcaacctgcgtctacaacatgatgggtaagagggagaagaagctgggggagttcgggaaagccaagggctcccgggccatatggtatatgtggctgggcgcgcgcttcctagagttcgaggcccttgggttcatgaacgaggaccactggttctcgcgggagaactccctgagcggtgtggagggggagggcctccacaagctcgggtacatcctgcgcgacatatccaagatccccggcggcaacatgtacgcggacgataccgccgggtgggacacgcgcatcaccgaggaggacctccaaaatgaagccaagatcaccgacatcatggagcccgagcacgccctgctggccaccagcatttttaagctcacgtaccagaacaaggttgtccgagttcaacggccggccaaaaatggcaccgtgatggacgtcatctcgcgccgcgaccagcgggggtcgggccaagtgggcacctatggattgaacacctttacgaacatggaggcccagctgattcgccagatggagtccgagggcatcttttctccatccgaactcgagacccccaacttggccgggcgtgtgctggactggctggagaaacacggcatcgagcgcttacggcgcatggcgattagcggggacgactgcgtcgtcaagcccatcgacgaccgcttcgcgactgccctgaccgctctcaacgacatgggcaaagtgcgcaaggatatcccgcaatgggagccctccaagggctggaatgactggcagcaggtccccttttgcagccaccatttccaccagctgatcatgaaggacgggagagagatcgtggtgccctgccgcaatcaggacgaactagtcggccgggcccgcgttagccagggggcgggctggtccctccgggagacggcctgcctgggcaagagctacgcccagatgtggcagctgatgtacttccaccgccgggacctccgcctggccgccaacgcgatctgctccgcagtgcctgtcgactgggtgcccacaagccggaccacctggtccatccatgcccaccaccagtggatgaccacagaagacatgctgagcgtgtggaaccgagtctggatcgaggagaacccgtggatggaggacaagacccacgtgagctcctgggaggacgtgccctacctcggcaagcgggaggaccaatggtgcggctccctgatagggctgactgcccgcgcgacctgggccacgaacatccaggtcgccataaaccaggtgcgccggctcatcggcaacgagaactacctagactacatgacctcaatgaagcgcttcaagaacgagtccgacccggagggggcactttggtag

SEQ ID NO: 24712 - RNA, 9879 nt, synthetic construct
  misc_feature 1..9879: note = derived and/or modified CDS sequence (opt11) from DENV-1__KJ755855__SS-prME
  source 1..9879: mol_type = other RNA
agcgtgaccatgttgctcatgctgatgcccaccgccctggctttccacctcactactcggggcggggaaccccacatgatcgtgtccaagcaggagcggggcaagagcttgctgttcaagaccagcgccggggtgaatatgtgcaccctcatagccatggacctgggggaactgtgcgaggataccatgacctataagtgcccccggatcaccgaagccgagcccgacgacgtggactgctggtgcaacgccactgacacgtgggtgacctacgggacctgcagccagacaggcgagcaccggcgcgataagcgcagcgtggccctcgcccctcacgtgggcctggggctcgagacgcgcgccgaaacctggatgagctcagaaggggcctggaagcagatccagcgtgtggagacctgggcccttcgccaccccgggttcaccgtgattgcgctgttcctggcccatgccatcggcacttctatcacgcagaaaggtatcatattcatactcctgatgttagtgaccccctccatggcaatgcgttgcgtcggcatcggcagccgggacttcgtggagggtctctccggcgccacttgggtggatgtcgagcttgagcacgggagctgtgtgacgaccatggcgaaggataagcccactctggacatcgaattactgaagaccgaggtgacgaaccctgccgtcctgcggaaattatgcatcgaagccaagatctccaacaccaccaccgacagccgctgcccaacgcagggcgaagccaccctggtggaggaacaggacgccaattttgtgtgcaggcgcaccttcgttgatcggggctgggggaacggttgcgagctgttcgggaagggaagcctcctgacctgcgcgaagttcaagtgtgtcacaaagctggagggcaaaatcgtgcagtacgagaacctcaagtacagcgtcatcgtgacagtccatatcgccgcccagcaccaggtcggcaacgagtcaacagagcacggaaccacggccatcatcacgccccaggccccaaccaccgagattcagttgacggattacggagcgctgacgttggactgctcaccccggaccggcctggacttcaacgaaatggtgctccttaccatgaaggaaaaatcctggctggtccacaagcagtggtttctggatctgcccctgccctggaccagcggggccagcacgtcccaggaaacctggaaccggctgttcctcctggtgacctttaagacagcccacgctaaaaagcaagaggtggtcgtgctggggagccaggagggggccatgcatacggcgctcactggcgcaaccgccctccaaaccttcggcacgactaccatcttcgccgggcaccttaatattcgcctcaagatggacaaactgacactgaagggcatgtcctacgtgatgtgcacggggtcatttaaactggagaaggaggtggcagagactcagcatggcaccattctagtgcagatcaaatacgaggggacggatgccccctgcaagatccccttctccacgcaagatgagaagggtgtgacccagaacggccggctgattaccgccaacccaatcgtaaccgacaaagagaaacctgtgaacatcgaggccgagccgcctttcggggaaagctacatcgtgatcggcgccggggaaaaagcgctgaaactcagctggttcaaaaagggcagctccatcgggaaaatgttcgaggccacggctcgcggggcccggcgcatggccatcctgggcgacaccgcgtgggacttcgggagtatcggaggggtatttacctccgtgggaaagctggtgcaccagatcttcggcaccgcctacggggtcctcttcagcggcgtgtcctggacgatgaaaattggcatcggtgtgctgctgacctggcttggcctgaactccaggtccaccagcctgtcgatgacgtgcatcgccgtcggcctcgtgacactgtacttaggcgtgatggtccaggccgacagcgggtgcgtgataaattggaagggcagggagctcaagtgcgggtccggaattttcgtgaccaacgaagtgcacacctggaccgagcagtacaagttccaggccgactctcccaaacgccttagcgcggccatagggaaggcttgggaagaaggcgtatgcggcatccggagtgctactcgcctggaaaacatcatgtggaagcagatctctaacgagttaaaccatatacttctggagaacgacttaaagtttaccgtagtcgtgggagacgtggcgggcatactagcccaggggaaaaagatgatccggccccaacccatggaacacaagtactcctggaaaaactgggggaaagccaagatcatcggggccgacgtccagaacagcaccttcatcatcgacggacctaacaccccggagtgctccgacgatcagcgcgcatggaacatctgggaggtggaagactacggcttcgggatcttcaccacgaacatatggctgaagctccgggatagttacactcaagtgtgtgaccaccgcctgatgagcgccgcaatcaaggacagcaaggccgtccacgccgacatggggtattggatcgaatccgagaagaacgaaacctggaaacttgcccgggctagcttcattgaggtcaagacctgtacgtggcccaagtcccacaccctctggagcaacggggtgcttgagtctgagatgatcatccccaaaatctacggcggtcccatttcacagcacaactactcgccggggtacttcacacagaccgccggaccctggcacctggggaagctcgagctggacttcgacctctgcgagggcacgaccgtagtggtggatgaacactgcgggaaccgcggccccagccttcggactaccacggtcacgggtaagatcatccatgagtggtgctgcagatcctgcacgctgccgcccttacggttccgcggggaagacggatgctggtacgggatggagattcggccggtgaaggaaaaggaggagaatcttgtaaagagcatggtcagcgctggctcgggggaggtggtgagcctgtccctgggcctcctgtgcatcagcatcatgatcgaagaagtcatgcgctcccggtggtcgcgcaagatgctgatgaccggcacgctcgccgtcttcttccggaagatcagggggcagttaacctggaatgatctgattcgcctctgtatcatggtgggcgccaacgcgtccgaccggatgggaacccgcaccacataccttgccctgatggccacctttaagatgcggcctatgttcagcgtcggtctcctgttccgccgtttaacgtccagagaggtcctcctgttaacaatcgggttgagcctagtggcctccgtcgaactgccgaacagcctcgaggagttgggcgtgctgctagctatggggatcatgatactcacgttactcaccgatttccagtcccaccagctgtgggctaccctgcttagcatgacgttcatcaaaacgaccttctccctgcattacacatggaaaacgatggccatggtcctgagcatcgtgtcgttattccccctgtgcctatcaacgacctcacagaagaccacctggctccccgtgctgctggggtccctgggctgcaagcctctcactatgttcctgatcgcagagaacaaaatttgggggaggaagagttggcccttgaacgaaggcatcatggccgtcggcatagtgtccatcttgctgagctccctcctgaagaacgacgtgccgctggcggggcccctcatagcaggagggatgctgatcgcctgctacgtcattagcgggtcgtcagccgacctgtccctcgagaaggccgccgaggtgagttgggaagaagaggcagagcactccggggcctcgcacaacatactggtagaggtccaggatgatggaacaatgaagattaaggacgaggaacgcgacgacaccctgaccattctcctgaaggccacccttctcgccgtgtccggcgtgtaccctttaagcatcccggcgaccctgttcgtctggtacttctggcagaagaagaagcagagatcaggggtactgtgggacacaccctccccgcccaaggttgaaaaggcggtcctcgacgacggcatttaccgcatcatgcaacgggggctgctcggccgctcccaggtaggggtgggtgttttccaagagaacgtcttccacaccatgtggcacgtgaccagaggcgccgtcctcatgtaccagggtaagcgcctagagccatcatggggccgggttaagaaggacctgatctcctacgggggcggctggggtctcaagggctcttggaacacgggggaagaagtacaggtcatagccgtggagcccggaaagaacccgaagaacgtgcagactgcccccgggaccttcaagaccccggagggcgaggtcggggcgatcgcactggacttcaagcccggaacgtccggcagccccattgtgaaccgcgaagggaagatagtcggtctgtacgggaacggagtagtgaccaccagcggcacctatgtatccgccatcgcccatgcgaaggccagccaggaggggcccctcccggagacggaggtcgaggcgttccggaagcgcaacttgacaatcatggatttacatcccggatcgggtaagacgcggcgctacctccccgcgatagtgcgagaggccatcaaacgcaagatgcgcacccttatcctggcaccgacgcgggtggtcgccagcgagatggcagaggcactcaagggcatgcccataaggtaccagaccactgctgttaagagtgagcacaccgggaaagagatcgtggacctgatgtgccacgcgacattcaccatgcgtctgctcagccctgtcagggtgcccaattataacatgattatcatggacgaggcccacttcaccgacccttcttcactggcggcccggggatacatctcaacccgcgtgggcatgggggaggccgcggccattttcatgacggccaccccgcccgggtcagtcgaagccttcccccagtccaacgcggtcatccaggacgaggagcgggacatcccggagcgctcgtggaactccgggtacgagtggattaccgacttccccggcaagacggtttggttcgtccctagcatcaaggccgggaacgatatcgccaattgcctacgaaagaacggcaagcgagtgatccagctctcccggaagactttcgacaccgagtaccagaagactaagaacaacgactgggactatgtggttaccactgacatcagcgagatgggagccaattttcccgccgaccgcgtgatcgacccgcggcggtgccttaatcccgtgatcctgaaggacggccctgaacgagtcatcctcgcgggccccatgccggtaaccgtggcctccgcaaaccagcgccgggggcgcatcgggcggaatcataataaggagggtgatcagtacatttacatgggccaaccactgaacaacgacgaggatcacgcacactggaccgaggcaaagatgttgcttgacaacataaacacccccgagggcattatccccgcgctgttcgagccggagcgcgagaagtctgccgccatcgacggggagtatcgactgaggggagaagcccgcaagacgtttgtagaacttatgcggcgcggagacctgcctgtgtggctatcctacaaggtcgccagcgaagggttccagtacagcgaccggcgctggtgctttgatggcgagaggaacaaccaagttctcgaggagaacatggacgtcgagatctggacaaaggagggggagagaaagaagctgcgaccccgctggctagatgctcggacctactccgaccccctcgcgctgcgtgagaaaaaggagttcgcggccggccggcgcagcgtctccggggacctgatactcgagatcggcaagctcccgcagcacctgacccagcgggcgcaaaatgccctcgacaacctggttatgctgcacaacagcgagcagggcggtcgcgcctaccggcacgccatggaggaactcccagacacgatcgagaccctcatgctgctggccctgattgcggtgttgaccggaggggtcaccctctttttcctgtcaggcaaagggctgggcaaggccgggaatggcctcctatgcgtcatggcctcctctgccctgctctggatggcaaacgtggagcctcactggattgcggccagcatcatcctagagttcttcttgatggtcctcctgatccccgagccggatcgccagcggacgccccaggataaccagctggcctacgtggtgatccgcctcctgttcatgatcctgacagtcgccgccaatgagatgggtctcctcgagaccacgaagaaggatctggggatcggacacgcggccgtggagaaccaccaccacgccgccatgctggacatcgacttgcaccccgcctccgcctggactctctacgccgtggcgacgaccatcattacgcctatgatgcggcacaccatagagaataccaccgcgaatataagcctcaccgcgattgccaatcaggccgccatcctaatggggctggataagggctggcccatctccaagatggacatcggggttccgctcctcgctttgggcttcctctctcaggttaaccccctgacccttacggcggcggtactcatgctggtggctcactacgccatcattggcccggggctgcaagccaaggccacccgcgaggcccagaagcgtaccgccgccgggatcatgaagaaccccaccatcgacgggatcgttgccatcgacctcgaccccgtggtctatgacgcgaagttcgagaaacagctcggccagatcatgttgctcattctgtgcacctcccagatactgttaatgcggacgacctgggccctttgtgagagtatcaccttagccacggggcccctctccccattatgggagggcagccccgggaagtcctggaacactactatcgccgtgtcaatggcgaacatcttccgggggtcctacctggcaggagccgggctcgcctttagcttgatgaagtccctgggcggcgggcggcgcggcaccggggcccagggcgagacgctaggggagaagtggaagcggcaactaaaccagctttccaagacagagttcaacacctacaagcggagcggcatcatggaggtggatcggagtgaggccaaagagggtctcaagcgtggagaaacgactaagcacgccgtcagccggggaacagccaagctcagatggttcgtggagcggaatctggtgaagcccgaggggaaggtcatcgacctgggctgtgggcgcgggggctggtcctactactgcgccgggctcaaaaaggtgagcgaggttcgggggtacacaaagggcgggcccgggcacgaggagccgatccccatggccacatacgggtgggacctgctgaagcgatgttccggcaaggagtttttcttcataccccctgagaagtgcgacagcttccttggcgacatcggtgagtccagcccgaaccccacgatcgaggagggacggaccgtgcgcgtcctgaagatggtggaaccctggctccggggcaaccagttttgcatcaaaatcttaaacccctacatgccgtctgtcgtagagaccctggagcagatgcaaaggaaacacgggggaatgttagtgcgaaaccccttaagccgcaattccacccacgagatgtactgggtcagctgcgggacgggaaacatcgtgtccgcagtgaacatgacctcacgaatgctgctgaacagatttaccatggcccaccgcaagcccacctacgagcgggacgtcgatctcggcgccgggacacgacacgtggccgtggagccagaggtggccaacctggacatcatcggccagcggatcgagaacataaagcacgaacacaaatccacgtggcattacgatgaggacaacccttacaagacatgggcgtaccacggcagctacgaggtgaagccctcaggtagcgcctcttcgatggttaacggcgtcgtgaagctgctcaccaaaccctgggacgtgatccccatggtcacccagatcgctatgacagacaccaccccattcgggcagcagcgcgtgttcaaggaaaaggtcgatacccggacacccaaggccaagagaggcaccgctcagatcatggaagtgactgcccgatggctgtggagcttcctctcccgcaacaagaagccccggatatgtacccgggaggagtttacgcgtaaagttcgcagtaacgccgccatcggggccgtcttcgtggacgagaatcagtggaactccgcaaaggaggccgttgaggacgaccggttctgggacctcgtccaccgcgagagagaactgcacaaacaaggcaagtgtgcaacctgcgtatacaacatgatgggcaagcgcgagaagaagctgggagagtttggcaaagccaaggggagccgcgccatctggtacatgtggctcggagcgcgattcctggagttcgaagccctcgggtttatgaacgaggaccactggttctcccgggagaatagcctctcaggcgttgagggggaggggctgcacaaacttggctacatactccgcgacatttcgaagataccaggagggaacatgtacgccgatgacactgccgggtgggacacccgcataaccgaggacgacctgcagaacgaggcaaaaatcaccgacatcatggagcccgagcacgcgctgttggccaagtccatattcaaacttacgtaccagaataaagtcgtgcgggtgcagaggcccgccaagaacgggaccgtcatggatgtgatcagccggcgtgaccagaggggctctgggcaagtgggcacgtacgggttaaacaccttcaccaacatggaggcccagctcatccgccagatggagagcgaggagatcttctcccctaacgagctggagaccccgaatcttgcggaacgggtccttgactggctcgagaagtatggcgttgagcgtctgaagcggatggcgataagcggcgatgactgcgtagtcaagcccatcgatgaccgcttcgccacggccctcaccgccctgaacgacatggggaaggtccggaaggacataccacagtgggaacccagcaaaggctggaacgattggcagcaagttccgttttgtagccaccacttccatcagctggtcatgaaggacgggcgggagatagtggtgccctgtagaaaccaggacgagctcgtcggccgagcgcgtgttagtcagggggcgggctggtccctccgcgagaccgcctgcctgggcaagagctatgcccagatgtggcagcttatgtactttcatcggcgcgatctgaggctggccgcgaacgctatctgctccgccgtccccgtcgactgggttccaactagccgcacgacctggtcaatccacgcacaccaccagtggatgaccaccgaggacatgctcagcgtgtggaaccgcgtctggatcgaagagaacccgtggatggaggacaagacgagagtgagtagctgggaggacgttccatacttgggaaagcgcgaagaccagtggtgcggctccctgatcgggctaaccgccagggcgacctgggccaccaacatccaggttgccattaaccaggtgcgccgtctgatcggtaacgagaactacagcgactacatgacgtccatgaagcgcttcaagaacgagagcgagccagaaggggccctgtggtga

SEQ ID NO: 24713 - RNA, 9879 nt, synthetic construct
  misc_feature 1..9879: note = derived and/or modified CDS sequence (opt11) from DENV-1__KF289073__SS-prME
  source 1..9879: mol_type = other RNA
agcgtcaccatgctgttcatgctcttacccactgccctcgcattccacctcaccacacggggtggggagccccacatgatcgtgagcaagcaggaaaggggaaagagcttattattcaagacctcagccggcgtgaatatgtgtaccctaattgcgatggacctgggagagctgtgcgaggacactatgacctacaagtgtcccagaatcaccgaggccgaacccgacgacgtagactgctggtgtaacgccactgacacctgggttacttacgggacctgctcccagaccggcgaacaccgcagggacaagcggtccgtggctctcgcaccccacgtgggcctggggctagagacgagaaccgaaacgtggatgagctccgagggcgcctggaagcaaatacaaaaagttgagacctgggccctccgacaccctggatttacagtgatagcgttattcctggcgcacgccatcggcacatctatcacgcaaaagggcatcatctttatcctcctaatgctggtgactccctccatggctatgcgctgcgtcggcatcggcaaccgtgattttgtggaagggctcagcggcgccacgtgggtggacgtcgtgctggagcatgggtcttgcgtgacgaccatggcgaagaacaagccaaccctggacatagagctactgaagacggaggtaaccaaccctgcggttctgcgcaagttgtgcatcgaggccaagatcagcaagactaccactgactcccgatgccccacccagggcgaggcgactctggtagaggagcaggacgccaacttcgtatgccgccggaccttcgttgaccgaggctggggtaacggctgcgggctgtttggcaagggtagcctgctgacgtgcgccaagtttaaatgcgtaacgaagttagagggcaagatagtccagtacgagaacctgaagtactccgtcatcgtgactgtccacacgggagaccaacatcaggtagggaacgagacgactgagcacggcaccatagcgaccatcacgccccaggcccccacgagcgagattcaactgaccgactacggggccctcaccctcgactgctccccccggaccggcctggacttcaacgaaatggtattgctcacgatgaaggagaaatcctggctggtccacaagcagtggttcttggacctcccgctgccctggacctccggggcgtctaccagccaagaaacctggaatcgacaggatttattagttacgttcaaaaccgcccacgcgaagaagcaggaggtggtcgttctgggatcacaggagggtgccatgcacaccgcattgaccggggccaccgagatacagacctctggcaccaccactatctttgccggccacttaaaatgccggttgaagatggacaagctgaccctcaagggcatgtcgtacgtcatgtgcaccgggtctttcaagctggaaaaagaggtggcggagacccagcacggcacggtgctggttcaggtgaagtacgagggaacagacgcgccttgcaaaatacccatctccactcaagacgagaaaggagtgactcagaacgggcgtctgatcacggccaatccgatcgtcaccgataaagagaagcccgtgaatatcgagaccgagccccccttcggggaaagctatatcgtgattggcgccggcgaaaaagcgctcaagctctcatggttcaagaaagggagctcgatcggcaagatgttcgaggcaacagcccgcggcgcccgccggatggccatacttggcgacacagcgtgggatttcgggtctataggaggtgtctttacctccgtgggtaagctcgtgcaccaggtgttcggaactgcgtacggggtgctgttcagcggcgtctcatggaccatgaagatcgggataggggtcttattgacgtggctgggcctgaacagccgcagtactagcctctcaatgacttgcatcgccgtaggaatggtcacactgtacctgggggtcatggtgcaggcagacagcggatgcgtgatcaactggaagggcagggagctcaagtgcggttccggcatattcgttacgaacgaggttcacacctggacagagcaatacaagttccaggccgacagcccgaaacggttgagtgcagctattggcaaggcttgggaggaaggggtgtgcggcattcgctccgccacccgtctggagaacatcatgtggaagcagatcagcaacgagttgaaccatatcctgttagagaacgatatgaagtttacagtagtggtcggagatgccaacggtatattggctcaggggaagaagatgatccgcccccagcccatggagcacaaatactcctggaagagttggggtaaggccaagatcatcggcgccgatatccagaacacgaccttcattatcgacgggccagataccccagagtgccccgatgatcaccgggcctggaatatttgggaggttgaggactacggattcgggatcttcaccaccaatatctggctgaagctgcgggactcctatacgcagatgtgcgaccaccgcctaatgagcgccgccatcaaggactcgaaggccgtgcacgccgacatgggatactggatcgagagcgagaagaacgagacttggaagttggcaagggcgtctttcatcgaagtcaaaacctgtatctggcccaagtctcacaccctgtggagtaacggcgtcctcgagagcgaaatgattatcccgaagatttacgggggccctatctcacaacataactaccgtccggggtattttacgcagaccgcggggccctggcacctagggaagctggagctcgatttcgacctttgcgagggcactacggttgtcgtagacgagcactgtggcaaccgcgggccgagcctacggacgacgacggtgacggggaagataatccacgaatggtgctgccggtcctgcaccctgccgcccctccgattcaagggagaggatggctgttggtacgggatggagatccgcccagtcaaggaaaaggaggagaatctggttcggagcatggtgtccgccggctcgggggaagtggactcattctccctcgggctactgtgcgtgagtattatgatcgaggaggtgatgcgctcacgatggagccgcaagatgttgatgactggtaccttagcagtgtttctgctcctgataatgggtcaactgacgtggaatgacctcatccggttgtgtatcatggtaggagccaacgccagtgaccgcatggggatggggacgacataccttgccctcatggctactttcaagatgcgtcccatgttcgccgtgggcctgctattcagacgcttgacgagtcgggaggtgttactgctcacaattgggcttagtctggtcgcctcagtcgagttacccaactctttagaagagctgggcgacggcctcgcgatgggcattatgatgcttaaactgctcacggacttccagagccaccagctgtggaccacgctgttatcattaacctttatcaagaccacactatctctcgactacgcctggaagaccatggccatggtcctgtccatcgtgagccttttccccctctgtctgtcgacgacctcccagaaaaccacatggctgccagtgttgctgggctcgttcggctgtaagccgctgactatgtttctcatcacggagaacaagatatggggccgaaagagctggcccctgaacgagggcattatggctgtcggcatcgtgagcattcttctgtcaagcctcctgaagaacgatgtgcccctcgcgggccccctgatcgccggcggaatgttgatcgcttgctacgtcatcagtggctcctccgccgacctcagcctggagaaggccgccgaggtcagttgggaggaggaggcggagcacagcggcgcttcccacaatatcctggtggaggtgcaggacgacggaaccatgaagatcaaagacgaggaacgggacgataccctcaccatactgctgaaagccacactcctggccgtgagcggtgtgtacccgatgtccatccctgcgactctgtttgtctggtacttctggcaaaagaaaaagcaacgcagcggggtgctctgggacacccccagcccgcctgaagtggaacgggcagttctggatgacggcatctaccgcatcctgcagcgaggactgcttggtcgtagccaggttggcgtgggggtctttcaggacggcgtctttcacacgatgtggcacgttacccgcggggctgtactgatgtaccagggcaagcgcctggagccatcctgggcaagcgtcaaaaaggacctcatcagttacggcgggggctggcggttccaggggtcttggaacatgggggaggaggttcaagtaatcgccgtggaacctggcaagaatcccaagaacgtgcaaaccacccccggtacgtttaaaacccctgaaggcgaggttggggcgatagccctggactttaaacccggcacctccgggtcacccatagtgaaccgcgagggaaagatcgtgggcctgtatgggaacggggtcgtcaccacgtccgggacctacgtgtctgccattgcccaggccaaagcgtctcaggagggcccgctccccgagatcgaggacgaggtcttccggaagcgtaacttaaccatcatggacctgcaccccgggtccggcaaaacccggcggtacctcccggccatcgtgcgtgaggccatcaagcgcaagctgcggacgttaattctcgcacccacccgcgtcgtcgcaagtgagatggccgaagctctgaagggcatgccgatccgctaccagacaacggccgtgaaatcagagcatacggggcgggaaatagtggacctgatgtgccacgcaaccttcacgatgcgactcctgtcacccgtccgggtgccgaactacaatatgatcatcatggacgaggctcactttacggaccccgcgtctatcgctgccaggggctacatctctacgagggtggggatgggcgaggccgcggccattttcatgaccgccacgccgcccgggtccgtcgaggcctttccacagtccaacgccgtgattcaagacgaggaaagggacatacccgagaggtcttggaatagcggctacgactggataaccgattttcccggcaagacggtgtggttcgttccctctataaaaagtgggaacgacatcgcaaactgcctgcggaagaacggcaagcgggtaattcagctgtcccgcaagacgttcgacacagagtatcagaagacgaagaacaatgactgggactacgttgtcacgaccgatatcagcgagatgggagctaacttccgggcggacagggttatcgacccgcggcggtgcctcaagcccgttatcctcaaagacgggcccgagcgggtcatactcgccgggcccatgccagtgaccgtagcgtccgccgctcagcgccggggccgcatcggccggaaccagaacaaggagggagaccagtacgtgtacatgggccaacctctaaacaacgatgaggaccacgcccactggaccgaggccaagatgctgctcgacaacatcaacacccccgagggtatcatcccggcactgtttgagccggagcgcaagaagtcggctgccatcgacggcgagtaccgcctgcgcggcgaagcccgaaaaacctttgtggaattgatgcggcggggcgatcttcccgtctggctgtcctacaaggtggccagcgagggtttccagtactccgaccggcgctggtgtttcgacggggaacgcaacaaccaggtgctcgaggagaacatggacgtcgaaatctggaccaaggagggcgagcgcaagaagctgcggccccgctggctggacgcgaggacctattcggatccactggcgctcagggaatttaaggagtttgccgctgggcggcgatcggtgtcaggggacttaatactcgagatcggcaaacttccacaacaccttactttacgtgcccaaaaagcactagataacctcgtgatgctacacaacagcgaacaaggcgggaaagcctatcgccatgccatggaggaactgcccgacaccatcgagacactaatgctcttggccctgatcgccgtcctgaccggaggtgtaaccctgttcttcttatccggtaagggcctcggcaaaacctccatagggctgctatgcgtgatggcatccagcgccttactttggatggcgagcgtggagcctcactggatcgcggcgagcatcatccttgagttctttctcatggtgctgctgatccctgagccggaccggcagcgcactccccaggacaatcaactcgcctacgtggttatcggattgctgtttatgatcctcaccgtggctgccaatgagatgggtctactggagaccaccaagaaggacttgggcatcggccacgtggccgccgagaaccaccaccacgccaccatgctagacgtcgatctgcggcccgcctccgcttggaccctgtacgccgtagcgaccacgatcatcactccgatgatgcgccacacgatcgagaacacaacggccaacatcagcctgaccgccatcgccaaccaagccgcaatactgatgggcctagacaagggttggcccataagtaaaatggacatcggggtgcccctgctggctctcggctgctactcacaagtcaatcccctaaccctgacggctgcagtgctcatgttagtggcgcattacgccatcatagggccggggctccaggccaaggccacccgggaggcacagaagcgaaccgcggccgggatcatgaaaaatcccacggtggacgggatcgtggccatagatttagaccctgtggtgtacgacgccaaattcgagaaacagctggggcagattatgctgttaatcctgtgcacctcccagatcctactcatgcgcacgacctgggccctttgtgagagcataactctggcgacagggcccctaacgacactgtgggagggcagcccggggaagttctggaacaccacaatcgcagtcagcatggctaacatcttccggggttcctacctggcgggggccgggttggctttcagtctgatgaagtctctgggcgggggccgccgggggaccggcgcacagggcgagaccctcggggagaagtggaaacgccagctgaaccaactaagtaagagcgagttcaacacgtacaagaggtccgggatcatggaggtggaccgcagcgaggcgaaggaggggttgaaaaggggcgaaaccacgaaacacgcggtctcgcgcgggaccgcgaagctgcggtggttcgtagaacggaacttagtgaaaccggaagggaaagtaatcgaccttgggtgtggccgcggcggatggtcctactattgcgccggtctcaagaaggtaaccgaggtgaaggggtacaccaagggcggcccagggcacgaggagcccatcccgatggccacgtatggctggaacctggtaaagctccactccgggaaagacgtattctttacgccgcctgagaaatgcgataccctcctctgcgacatcggtgagagctcccctaacccgaccatcgaggagggcagaacactccgggttcttaaaatggtcgaaccttggctgcgcggcaatcagttctgcatcaagatcctaaacccctacatgcccagcgtggtggaaacgctcgagcagatgcagcggaaacatggcgggatgcttgtccgcaatccgttgtcacgaaattcgacccacgagatgtattgggtgtcatgcggcactggtaacatcgtgagcgccgtcaacatgacatcccgaatgctcctgaaccggttcactatgacccaccgcaagcccacctacgaacgcgacgttgatctgggtgcgggcacacggcacgtggcggttgagcccgaagttgccaacctcgacatcatcggacagcgcatcgagaacataaaaaacgagcacaaatctacgtggcattacgacgaggacaatccctacaagacatgggcctaccacggatcctacgaggtgaagccgagtggcagcgcctcatccatggtgaacggcgtggtccgactgttgaccaaaccctgggacgtgatcccgatggtgacccagatcgctatgaccgatacaactcccttcgggcagcagcgggtctttaaggagaaggtggataccagaacgcccagagctaagcggggtaccgcccaaatcatggaggtgaccgccaagtggctctggggcttcctaagccgcaacaagaagccccggatctgcacccgcgaggagttcacacggaaggtccgcagcaacgccgccatcggggctgtcttcgtggacgaaaatcagtggaactccgccaaggaggccgtcgaggacgagcggttttgggacttggtgcatcgcgagcgggagttgcacaagcagggcaaatgtgcaacctgcgtatataatatgatgggcaagcgggagaagaagctgggtgagtttggcaaggcgaagggcagccgggccatctggtatatgtggctaggagcccgcttcctcgagtttgaagccctgggattcatgaacgaggaccactggttttccagggagaacagcctgtccggcgtggagggggagggcctccacaagctggggtacatcctgcgcgatattagcaagatccccggcggcaacatgtacgccgacgacaccacgggctgggacacaaggattactgaggacgacctacagaacgaggcgaaaattaccgacatcatggagccagagcacgcgttgctggccactagcatcttcaagctcacatatcagaacaaagtggtgcgcgtccaacggcccgccaaatccggcaccgtaatggacgttatatcccgccgcgatcaacggggtagcggccaggtagggacatacgggctcaacacatttacgaatatggaggtgcagctgataagacagatggagtcagagggcatctttctcccgtctgagttagaaacccccaacctggccgagcgggtcttagattggctggagaagcacggggtcgagaggcttaagcgaatggcaatctccggcgatgactgtgtggtgaagcctacagacgaccgattcgccaccgccctcacggccctgaacgacatgggaaaggtccgaaaggacattccacaatgggaacctagcaagggatggaacgactggcaacaggtgcccttctgctcccaccacttccatcagcttatcatgaaagacggccgcgagatagtggtcccgtgccggaaccaggacgaactgatgggaagagcgcgggttagccagggcgcggggtggtccctacgcgagaccgcctgtcttgggaagtcctacgcccagatgtggcagctcatgtacttccaccggcgcgacctgcggctggccgccaacgctatctgtagcgctgtacctgtcgactgggtgccgacctcgcgcaccacctggagcatccatgcccaccatcaatggatgacgaccgaggatatgctctccgtatggaacagagtctggatcgaggagaacccctggatggaagacaagacacacgtgagttcctgggaggacgtaccgtacttgggcaagcgcgaggaccagtggtgcggcagcctgatcggcctcaccgccagggccacctgggccaccaacattcaagtcgcaattaaccaggtgcggcgtctgatcgggaacgaaaactacctagactacatgacctccatgaagcggttcaaaaacgagagcgaccctgaaggtgccttatggtga

SEQ ID NO: 24714 - RNA, 9879 nt, synthetic construct
  misc_feature 1..9879: note = derived and/or modified CDS sequence (opt11) from DENV-1__JQ915072__SS-prME
  source 1..9879: mol_type = other RNA
agcgtgaccatgctgctgatgctgctgcccacggtcctcaccttccacttaaccacccgcggcggggagccgcacatgatcgtgagcaagcaggagcggggcaagagcctcctgttcaagacctccgccggggtgaacatgtgcaccttgatagccatggacctgggtgagctctgcgacgacacgatgacctacaagtgtccccgcatcactgagacggagcccgatgacgttgattgctggtgcaacgcaacggagacctgggtgacttatgggacgtgcagccagactggcgagcatcggagggacaagcgttccgtcgccctggcgccccacgttggcctcgggctcgagacccgcacggaaacgtggatgagcagcgagggcgcctggcggcaaattcagaaggtggagacgtgggcgctgcgccacccagggttcacggtgattgccctgttcctcgcccacgccatcggcaccagcatcacgcagaaggggataatatttatcttgctgatgctcgtcactccgtccatggccatgcggtgtgtggggataggcaacagggacttcgtggagggacttagcggcgccacctgggtcgacgtggtgttagagcacgggtcctgcgtcaccacgatggccaaagacaagcccaccctcgacatcgagctgctgaagaccgaggtgacaaaccccgccgttctccggaagctgtgcattgaggccaagattagcaacacgacgaccgattcccgctgcccgacccagggcgaggccacgctggtcgaggaacaggacaccaacttcgtgtgccgccgcacattcgtggaccggggctgggggaacgggtgcggcttattcggaaagggaagcctcatcacgtgtgcgaaatttaagtgcgtcacgaaacttgagggcaagatcgttcagtacgagaacctcaagtactccgtgatagtcaccgtgcataccggcgaccagcaccaagtcggaaacgagaccactgagcatggtacgattgcgaccatcacaccccaggctccgacaagcgagattcagctgacggactacggggcactgaccctcgactgtagcccccggaccggcctggattttaacgaaatggtgctgctcaccatgaaagagaaatcctggctggtgcacaagcagtggttcctggacctcccgctgccctggacgaccggggcatccacttcacaggagacctggaaccggcaggatctgctcgtcacgttcaagactgcacacgccaagaagcaggaagtcgtggtccttggcagccaggagggcgccatgcacaccgcgctgacaggggccacggaaatccagacctccggaaccaccacgattttcgcggggcacctcaagtgccgcctgaaaatggacaagctgaccttgaagggcatctcgtacgtgatgtgcaccggttccttcaagctggaaaaagaggtggcagagacccaacacggtacggtcctggtccaggtaaagtacgagggtaccgacgccccctgcaagattcccttcagctcccaggacgagaagggggtcacccagaacggccggctggtcaccgccaatccgatcgtgacggacaaggagaagcccgtcaacatagaggccgagccgcccttcggggagagctacatcgtggtgggtgcgggcgagaaggcactgaaactttcctggtttaagaaggggagctccatcggcaagatgtttgaggccaccgcccgcggggcacggagaatggccatcctgggcgacaccgcctgggacttcgggagtatcggcggcgtcttcacctccgtggggaagctcgtgcaccagatcttcggcacggcctacggggtcctgttctcgggcgtgtcctggaccatgaagatcgggattggcatactgttaacctggctgggcctgaacagccgcagcaccagcctcagtatgacgtgcatcgccgtagggatggtcaccctgtacttaggcgtgatggtgcaggcggactctgggtgcgtcatcaattggaagggccgggaactcaagtgcggctccggcatcttcgtgaccaacgaggtgcatacgtggaccgagcagtacaagttccaggctgacagcccgaagcgccttagcgcggccatcggtaaggcctgggaagaaggggtctgtggcatccgatccgcgacgcgcctggaaaacatcatgtggaagcagatcagcaacgagctcaaccacatcctgttggagaacgacatgaagttcaccgtggttgtcggggatgtgtccggtatcctcgcccaggggaagaagactatccgtccccaacccatggagcacaagtactcttggaaatcctggggcaaggcgaagatcatcggagccgacgtgcaaaacactacgttcatcatcgacgggcccaacaccccagaatgccccgacgaccagcgcgcttggaatatctgggaggtcgaagactatggctttgggatcttcaccaccaacatatggcttaagctgcgagacagctacacacaggtgtgcgaccaccgcctcatgtccgctgccattaaggacagcaaagccgtgcacgcggatatgggctactggatcgagagcgagaagaacgagacgtggaagctggcgcgggcctcatttatcgaggtcaagacgtgtgtgtggcctaagtcccacaccctttggagcaacggcgtactcgaatcagagatgatcatccctaagatctacggcggcccgatcagccagcacaactaccgtcccgggtacttcacgcagaccgccgggccctggcatctggggaagctggagctcgacttcgacctgtgtgagggcaccaccgtcgtggtggacgagcactgcggccaccggggcccctccctgcgcacaacaaccgtcactggcaaaatcatccacgagtggtgctgcaggagctgcacgctgccgcccctaagattcaagggggaggacgggtgttggtatgggatggagataagacccgtgaaggagaaggaggagaacctggtgaagtccatggttagcgccggcagcggcgaggtggattccttctccctcggtctgctgtgcatttccattatgatcgaggaggtgatgcgcagccggtggtccagaaagatgcttatgacaggcactttggtcgtgttcttactactgacccttgggcagctcacctggaatgacttgatcagactgtgtataatggtcggcgccaatgcgagcgacaacatggggatgggcaccacttacctggccctgatggcgaccttccgcatgcgtccaatgttcgctgtgggcctcctcttccggcgccttacctctcgggaggtacttctgctgaccgtcgggctcagcctcgtggcctccgtggagctgccaaactcactggacgagttaggcgacggtttagcgatgggcatcatgatcctgaaattactgaccgacttccagtcccaccagttatgggcaacgctcttgagcttgacgtttgtcaagaccaccctcagcctgcactatgcgtggaaaacgatggccatgatcttaagcatcgtatccctcttgcccctgtgcctttccacgacctcacagaagaccacctggctccccgtgctgctcggtagtctggggtgcaagccgctcacgatgtttttgatcaccgagaacaagatttggggcagaaaatcctggcccctgaatgaggggatcatggccgtcgggatcgtgagcatcctgctcagctcactgctgaaaaacgatgtgcccctcgcggggcccttgatcgcaggcggcatgctcatagcctgctacgtaattagcgggtcgagcgcggacctctccctggagaaggcggccaaggtgagctgggaggaggaagccgagcattccggcgcgagccacaacatcctggtggagatccaggacgacgggaccatgaagataaaggacgaggagcgggacgacactattaccattctcctgaaggccacactgctcgcgatctctggcgtttacccgatgagtatacccgccaccctgttcgtgtggcacttctggcaaaagaagaagcagcgctccggagtcctgtgggatacccccagcccgcccgaggtggagaaggccgtgctggacgacggcatctaccgtattctccagcgcggcctgctggggcggtcccaggtgggggtcggggtgttccaggagggtgtgttccacaccatgtggcacgtcacgcgcggggccgtgctcatgtaccagggcaagagactggaaccctcttgggccagtgtgaaaaaggacctgatcagctacggcgggggctggcgcttccaggggtcttggaacatgggtgaggaagtccaggtgatagccgtggagcccgggaagaaccccaagaacgtccagaccgcccccggcaccttcaagaccagcgagggcgaggtcggggcaattgccttggacttcaaacctggcacgtccgggagccctatcgtgaaccgggaaggcaagatcgtcggcctgtacgggaacggcgtggtgaccaccagcgggacctacgtctcagccatcgcgcaggccaaggcatcgcaggagggccccttaccggagatcgaggacgaggtgttcaggaagcggaaccttacgatcatggacctgcacccgggatccgggaagacccgccggtatttgcccgccatcgtgcgcgaagccattaaacggaagctccgcaccctggtcctggcgccgacccgcgtggttgccagcgagatggccgaagccctcaaagggatgcccatccgctaccagacgaccgcggtgaagagtgagcacaccggtaaagagatcgtggaccttatgtgccacgccaccttcacgatgcgtctgctcagccccgtgcgggtccccaactacaacatgatcatcatggacgaggcccacttcaccgatcccgcctccatcgccgctcgcggctacatcagcaccagagttgggatgggcgaggccgccgccatcttcatgaccgccacaccgcccgggtcggtggaagcgttcccccagagcaacgccgtcatccaggacgaggagaaggatatccctgagcgctcctggaactcgggctacgactggatcacagacttccccggcaagaccgtgtggttcgttccatccatcaaaagcgggaacgacatagccaactgcctgcggaagaacggcaagcgcgtcatccagctgtcacggaaaacctttgataccgagtatcagaaaacgaagaacaacgactgggactacgtcgtcacaacggacatcagcgagatgggggccaatttccgcgccgaccgggtgatcgacccgagacggtgcctcaaacctgtaatcctgaaggatggccctgagcgcgtcatcctggcggggcccatgcccgtcaccgtggcttcagccgcccaacggcgcggccgaatcggacgcaatcagaacaaggagggggaccagtacatctacatggggcagccgctcaacaatgatgaggaccacgcgcactggaccgaggcgaagatgctgctggacaatatcaacactcccgaggggatcatcccagcactcttcgagcccgagcgggagaagtccgccgccatcgatggcgagtaccgcctgcgcggggaggcgcgcaagaccttcgtcgaactgatgcgccgcggcgatctgccggtgtggctgtcatacaaggtggcctcagagggcttccagtacagcgaccgccggtggtgctttgacggggagcgcaacaatcaggtactggaggagaacatggacgtggagatatggaccaaggaaggcgaacggaaaaagctccggcctcggtggttagatgcccgcacctactcggacccccttgccctccgggagttcaaggagttcgctgcggggcgccggagtgtatccggcgatctgatccttgaaataggcaaattaccccagcacctgacccagcgtgcccagaacgccctcgacaacctagtcatgctgcacaacagcgagcagggcgggaaggcctaccggcacgccatggaggagctgccggacaccatcgagaccatcatgcttctggcgctgatcgccgtgctcactggaggggtgaccctatttttcctgtcagggcgcgggttgggcaagacatcaattgggctgctgtgtgtcacctccagctccgccctgctgtggatggccagcgtggagccccactggatcgcggcctctataatcctggagttctttctcatggtgttactgatccccgagccagaccggcaacgcacgccgcaagacaaccagctcgcctacgtcgtgatcggcctgttgttcatgatcctcaccgtggccgccaacgaaatggggctgctggaaaccaccaaaaaggacctcggcatcggccacacggcggccgagaaccatcatcatgccgccatgctggacgtcgacctgcatcccgccagcgcgtggacactctacgccgtggccaccacgatcataacacccatgatgcggcacaccatcgagaacaccaccgccaatatctccctcacggcgatcgcgaaccaggcagcgatcctgatgggcttggacaagggatggccgatctcgaagatggatatcggggtgcccctgctggctctcggctgctactcccaggttaaccccctgacactaacagccgccgtgctcatgttagtggcccattacgcaatcatcgggcccggcctgcaagccaaggcgacccgcgaggcacagaagcggacggccgccgggatcatgaagaaccctaccgtcgacggtatcgtggccattgacctcgaccccgtggtttacgacgcgaagttcgagaagcagctgggccagatcatgctgctcatcctgtgcaccagccagatactgctcatgcgcaccacgtgggcactgtgcgagtccatcaccttagccaccggccccctcaccacgctgtgggaggggagccccggtaagttctggaatactaccattgccgtgtccatggctaacatcttccggggctcgtacctggcaggcgccgggctcgccttcagcctgatgaagtcactgggtgggagcaggagaggcaccggggcccagggcgagacgctcggcgagaagtggaagcgccagctgaaccagctctccaagagcgagttcaatatctacaagcgcagtgggatcatcgaggtggaccggagcgaggcgaaggagggcctcaagcgcggtgagaccaccaagcacgcggttagtcggggcactgccaagctgcgctggttcgttgaacgaaatcttgtgaagcccgaggggaaggtcatcgacctgggctgcgggcgcgggggctggagctactattgtgccgggctcaaaaaggtaaccgaggtgaagggctatacgaagggcgggcccggccacgaggagcccatccccatggccacctacgggtggaacctggtcaagctccattccggcaaggatgtgtttttcattccgcctgagaaatgtgacaccttgttgtgcgacatcggcgagagctcccccaaccctaccatcgaggagggccggacgctacgcgttctcaagatggtcgaaccgtggttgagagggaaccagttctgcatcaaaatcctgaacccctacatgccctcggtggtcgagaccctagaacaaatgcagcgcaaacacggcggaatgctcgttcggaaccccctgtcccgtaacagcacgcacgagatgtactgggtgtcctgcgggaccggcaacatcgttagtgcggtcaacatgacttcccggatgctcctgaatcgctttacaatggcacaccggaagccgacctacgagcgcgacgtagacctgggggccggaacccggcacgttgccgtcgagcctgaggtggccaacctggacatcatcgggcagcgcatcgagaatataaagaacgagcacaaaagcacgtggcactatgacgaggacaacccctacaagacctgggcataccacggaagttacgaggtcaagcccagcggcagcgcctcaagcatggtgaatggagttgtccgcctgctgaccaaaccgtgggacgtgatccccatggtgactcagatcgccatgacggacacaacccccttcggccagcagagagtcttcaaggagaaagtggacacccgaacgcccaaggccaagcgggggacggcccagatcatggaggtgaccgcgaagtggctctggggctttctgtcccgcaacaagaagccgcggatctgtacccgcgaggagttcacacggaaggtccgcagcaatgccgctatcggcgccgtattcgtggacgagaaccagtggaactccgcaaaagaggcggttgaggatgagcggttctgggacctggtgcgccgggaacgcgaactccacaagcaggggaaatgcgccacttgcgtctacaacatgatgggcaagagggagaagaagctgggagagttcggcaaggctaaggggagccgcgccatctggtacatgtggctgggcgcgcggttcctcgagttcgaagccctgggcttcatgaacgaggaccactggttttcccgagagaactcactgtccggggtcgagggcgaggggctccacaaacttggctacatactgcgtgacatcagcaaaatccccgggggcaacatgtacgccgacgacaccgctggctgggacaccagaataacagaggaggacctccagaacgaggccaaaatcaccgacatcatggagcccgagcacgcgttattagcaacctccatctttaagctcacctatcaaaacaaggtggtgcgggtccagaggccggccaagaacgggacggtcatggacgtaatctctcggcgcgaccagcgaggctccgggcaggtcggtacctacgggctgaacaccttcaccaatatggaggctcagcttatccggcagatggagagcgaggggatattttccccctcggagctcgaaacgcccaacctggccggaagggtgttggactggttagaaaaacacgggattgagcgactgcgccggatggcgatatccggcgacgactgtgtcgtcaaaccaatagacgaccgcttcgccaccgccctgacagccctcaacgacatggggaaggtgcgaaaggacatcccgcagtgggagccaagcaagggatggaacgactggcaacaggtgccgttctgctctcaccattttcaccagctcatcatgaaagacggtcgcgagatcgtcgtgccatgccggaaccaggatgagttggtgggccgcgcgcgggtatcccagggcgcgggatggtcgttacgcgagaccgcgtgcctgggtaagtcctacgcccagatgtggcagctgatgtacttccaccgtcgcgacctcaggctggccgccaacgcgatctgcagcgccgtcccggtggactgggtccccacgtcccgcacaacctggagcattcacgcccaccaccagtggatgaccaccgaggatatgctgtccgtgtggaaccgcgtgtggatcgaggaaaacccgtggatggaggacaagacccatgtgtcgtcttgggaggatgtgccctacctaggcaagcgcgaggaccagtggtgcgggagcttgatcggactcacggcccgtgcgacctgggcaaccaacatccaggtggcgatcaaacaggtccgcagactcatcgggaatgagaactacctcgactacatgacgtccatgaagcggttcaagaatgagagcgacccggagggagccctgtggtga

SEQ ID NO: 24715 - RNA, 9879 nt, synthetic construct
  misc_feature 1..9879: note = derived and/or modified CDS sequence (opt11) from DENV-1__JQ915071__SS-prME
  source 1..9879: mol_type = other RNA
agcgtgacaatgctgctcatgctgctgcccaccgtgctaactttccatcttaccacacgtgggggcgaacctcacatgatcgttagcaagcaggaacgggggaagagcctcttgttcaagacctccgccggcgtgaacatgtgcaccctgatcgccatggacctcggcgagctctgtgacgacacaatgacgtataagtgcccccgcataactgagaccgagcccgacgacgtcgactgctggtgcaacgctaccgagacctgggtgacctacgggacgtgcagtcagaccggcgagcacagacgcgacaagcggtccgtagccctggcgccccatgtcggcctggggctcgagacgcgtaccgagacttggatgagcagtgagggggcctggcggcagatccagaaggtggagacctgggccctccgccacccgggcttcacagtgattgcacttttcctcgcacacgccatcggcactagtattacgcagaagggcatcatctttatcctgctaatgctcgtcaccccctccatggccatgcggtgcgtgggaatcggcaaccgcgacttcgtggaggggttatcaggcgcgacctgggttgatgtggtgctggagcacgggagttgcgtcaccactatggccaaagacaaacccaccttagacatcgaattactcaagacagaggttaccaatcccgccgtgctccgaaagctgtgcatcgaggccaagatcagcaacacgaccaccgacagccgctgcccgacgcagggggaggcgacgctggtcgaggagcaggacaccaatttcgtgtgtagacgcaccttcgtagatcggggctggggtaatggctgcggcctgttcgggaaggggagcctgatcacgtgcgcgaagtttaagtgcgccacgaagctggagggcaagatcgtccagtatgaaaacctcaagtactccgtgatcgtgacggtccacaccggagaccagcaccaggttgggaacgaaactacggagcatggaacgatcgccaccatcactccgcaggccccaacaagcgagatccaactgacggattatggggcgctgacacttgactgtagcccccggaccggcctagacttcaacgagatggtcctgcttacaatgaaagaaaaatcctggttggtgcacaagcaatggttcctggacctcccgctgccctggaccacaggggcgtccaccagccaggagacctggaaccggcaggacctgctagtaacgtttaagaccgcacacgcaaagaagcaagaagtcgtagtactgggaagtcaagaaggcgccatgcacactgcactgacgggggcgacggagatccagacctccggcacaacgactatcttcgccgggcacctcaagtgcaggctaaagatggacaaactaaccttgaagggcatctcttatgtcatgtgcaccgggtccttcaagctcgagaaggaggttgctgagacccagcacggcacggtgttggtccaggtgaagtatgaagggaccgacgccccctgcaagatcccattcagctcccaggacgagaagggggtaactcagaacggccggcttgtcaccgccaacccgatcgtgacggacaaggagcgccccgtgaacatcgaagctgagccgcccttcggcgagagctacatcgtcgtgggcgccggtgagaaagccctcaagctgtcctggttcaagaaggggagtagtatcggcaagatgttcgaggcgaccgcgcgcggggcacgccgcatggccatcctgggagacacggcctgggacttcgggagcatcggcggtgtcttcacctccgtcgggaagttagtgcaccaaatcttcggaacggcctacggtgtgctgttctctggcgtctcctggacaatgaagatcgggatcggaatcctgttaacctggcttggcctgaacagccggtccaccagcctctctatgacgtgcatagcggtggggatggtgaccttatacctgggcgtcatggtgcaagccgacagcggttgcgttataaattggaagggccgcgagttaaagtgcgggtccgggatcttcgtgaccaacgaggtgcacacctggaccgagcagtacaagtttcaggccgacagcccgaagcggctaagcgccgccatcggcaaggcgtgggaggaaggggtgtgtggcatccgctccgccacacggttggagaacataatgtggaagcaaatcagcaacgaattgaaccatatcctcctggagaacgacatgaagtttaccgtagtcgtgggggacgtctccggcatcttggcccaagggaagaaaaccattcgcccccagcctatggagcacaagtacagctggaagtcctggggcaaggccaagatcataggcgccgacgtgcagaacaccactttcatcatcgacgggcccaatacccctgagtgtcccgacgaccagcgggcgtggaatatttgggaggtcgaggactacggattcgggatcttcaccaccaacatctggttgaagctgcgtgacagttacacacaggtctgcgaccaccgtcttatgagtgccgccatcaaggatagcaaggccgtacatgcggacatgggctactggatcgagagtgagaagaacgagacgtggaagctggctcgcgccagcttcatcgaggtgaagacctgcgtctggcccaagtcccacaccctgtggagcaacggggtgctagagtccgagatgatcatacccaagatctacggtggccctatctctcagcacaactatcggccggggtacttcacgcaaacagccggcccgtggcacttagggaagctggagctcgatttcgacctgtgcgagggcaccactgtggtcgtggacgaacactgcggcaatcgggggccgtccctaaggacaaccaccgttaccggtaagataattcatgaatggtgctgccgcagctgcacgttgccaccgctgcggtttaagggggaagacggatgctggtacggcatggaaatacgccccgtcaaggagaaggaggagaatctggttaaatccatggtgagcgccggcagcggcgaggtcgactcctttagcctcggtctactgtgcatctccatcatgatcgaggaggtgatgcggtctcgctggtcccggaagatgctgatgaccggcactctggtggtcttcctgctcctgaccttgggtcagcttacatggaacgacctgattcgcctgtgcattatggtgggtgcaaacgctagcgacaatatggggatgggcaccacatatctcgccctgatggccaccttccgcatgcggccgatgttcgccgtggggctcttgttccgccggctgacgtcccgcgaggtgttgctcctgaccgtgggactcagcttagtcgccagtgtggaactgcccaacagcttggacgaactcggcgacgggctggcaatgggcatcatgatactgaagcttctgaccgacttccaatcccaccaactgtgggcgaccctgctgagcctgacgtttgtgaagactaccctcagcctgcattacgcctggaagaccatggcgatgattctgtcgatcgtaagcctcttgcccttgtgcttaagcacgacctcccagaagaccacctggttgccagtgctgctcggaagcttaggttgtaagccgttgaccatgttcctcatcacggagaacaagatctggggccggaagtcctggcccctgaacgaagggatcatggcggtgggcatcgttagcatcctgctcagctccctgctaaagaacgacgtccccttagcaggtcccctgattgccggcggtatgctgatcgcctgctacgtcattagcgggtctagcgcggacctttccttagagaaggccgctaaggtcagctgggaggaagaggccgagcactccggcgccagccacaacatcctagtggagatccaggacgacgggaccatgaaaatcaaggacgaagagcgcgacgacaccatcactatcctcctgaaggcaaccttactcgccatatccggagtgtaccctatgagcatccccgccacactgttcgtctggcacttctggcagaagaagaaacaacgctccggggtactgtgggacacccccagcccgccggaggttgagaaggccgtcctggacgacggcatttatcgcatcctccaacggggcctactgggtaggtcccaagtgggtgtgggtgtctttcaggaaggcgtcttccacaccatgtggcacgttactcgaggggccgtcctcatgtaccagggcaagcgcctagagccctcttgggcatccgttaagaaggacctgatcagctacgggggaggctggagattccaaggatcatggaatacgggagaggaggtccaggtcatcgctgtggagcccgggaagaatcccaagaacgtccagaccgcccctggcaccttcaagaccagcgagggcgaggtcggggccattgccctcgacttcaagcctggcacgtccggtagccctatcgtgaaccgcgagggcaagatcgtggggctgtacgggaatggagtcgtgacgacaagcgggacgtacgttagtgcgatcgcccaggccaaggcctcgcaggagggcccgctgcctgagatagaggacgaggtcttccggaagcgcaacctcaccatcatggacctgcaccccggctccggaaagacccggcgctacctgccagcgatcgtgcgggaagctatcaagcggaagctcaggaccctggttctggccccgacacgcgtcgtggccagcgagatggccgaagcgctgaagggcatgcccatacgctaccaaaccaccgccgtgaagtccgagcacaccgggaaggagatagtcgacctcatgtgccacgccaccttcaccatgcggctgctaagccccgttagggtccccaactacaacatgatcatcatggacgaggcccacttcacggacccagccagtatcgcggccaggggctacatcagcactcgtgtcgggatgggcgaggctgcggcgatcttcatgacggcgacgccgcccgggtccgtggaggcctttccccaaagcaacgctgtgatccaggacgaagagaaggacatcccggagcggtcctggaacagcggttacgactggatcactgacttccctggcaaaacggtctggttcgtgccctccatcaagagcgggaacgacatcgcaaactgcctgcgtaagaacggcaaacgggtgatacaactgtccaggaagacgtttgacaccgaataccagaagacaaagaacaacgactgggactacgtcgtgaccacagacataagcgagatgggggccaacttccgggcagaccgcgtcattgatccccgtcgctgccttaagccggttatccttaaggacggccccgagagagtgatcctggcagggcccatgcccgtcaccgtcgcctccgcggcgcagcggcgcggacgcatcggcagaaatcagaacaaggagggggaccaatacatctacatgggccagcctctgaacaacgacgaagaccacgcacactggaccgaggcgaagatgctactcgacaacatcaacacccctgaagggatcatccccgctctcttcgagcccgagcgcgagaagtccgccgccatagacggcgagtaccggctgcgcggtgaggcccgtaagacgttcgtggaactgatgcggcgcggtgatctcccggtctggctctcctacaaggtggccagcgagggcttccagtacagcgaccggcgctggtgcttcgacggggagagaaacaaccaggttttagaggagaatatggacgtcgaaatttggaccaaggagggcgagcgcaagaaactccgaccccgctggctggacgctagaacctactctgaccccctggcgctccgtgagttcaaggagttcgcggccgggcggcgttcagtgtccagcgacctgatcctggagatcgggaaactgccccagcacttaactcagagggcccagaacgccctggataatctcgtgatgctccacaattcagaacagggcggcaaggcctaccgccacgcgatggaggagctgccggacacgatcgagacgatcatgctacttgccctgatcgcggtcctcacgggcggcgtgaccctgttcttcctaagcggccgggggttggggaagaccagtatcggcttactgtgcgtcacgagctccagcgccctcctgtggatggcgaacgtcgagccccattggatagcggcctccatcatcctggagttcttcctcatggtgctgctgattcctgagccagacaggcagcggacccctcaggacaatcaattagcctatgttgtcatcgggctgctgttcatgatcctcaccgtggcagcgaacgagatggggctgttagagaccacgaaaaaagacttagggattggacacaccgccgcagagaatcatcaccatgccgctatgcttgacgtggacttacatccagcatcagcgtggaccctctacgccgttgccaccacgatcatcactccaatgatgcgccacaccatagagaacacgacggccaacatctctcttaccgcgatcgccaaccaggccgccattctgatgggcctcgacaagggctggccgatcagcaaaatggatatcggcgtgccccttctggccctcgggtgctactcccaggtgaacccgctgaccctgaccgcggccgtgttgatgctggtggcccactacgccatcatcggaccggggctgcaggcgaaggctacgcgggaggcccaaaaacgcaccgccgccggcatcatgaagaatccaactgtggacgggatcgtagcgatcgatctcgaccccgtggtgtacgatgcgaagttcgagaaacagctggggcagatcatgctgctcattctgtgcaccagccagatcttactcatgcggacgacctgggccctgtgcgaatcgatcaccctggctacaggtcccctcacgacactgtgggaggggtcgcccgggaaattctggaatacgaccatcgccgtatcaatggccaacatcttccgcggaagctacctggcaggtgcgggcttggcgttttcgctgatgaagtccctcggaggcgggcgccggggcacgggtgcccaaggcgagaccctcggcgaaaagtggaagcgccagctgaaccaactgagcaagtcagagtttaacacctacaagcggagcgggatcatcgaggtagaccgctccgaggcacgtgagggtctcaagagaggtgagaccaccaagcacgccgtaagccggggcaccgctaagctgcgctggttcgtcgagcggaacctagtgaagccggaaggaaaggtgatcgatttgggctgtggccgcggagggtggtcctactactgcgctggactcaagaaggtcacagaggtgaagggctacaccaagggcgggcctggccacgaggagcccatccccatggcgacctacgggtggaatttagtgaagctgcacagcggcaaggacgtcttcttcataccgcccgagaagtgtgacacgctcctgtgcgacatcggggagtccagcccgaatcccacgatcgaggagggccgaaccctgcgcgtgttaaaaatggtcgagccgtggctacgggggaaccagttctgcatcaagatcctgaacccgtacatgcccagtgtcgtggagaccctcgagcagatgcagcgcaagcacggcggaatgctggtgcggaacccgctaagccgcaactccacgcatgagatgtactgggtcagctgcgggactggcaatatcgtgtcggccgtgaacatgactagccggatgctcctaaatcgctttaccatggcccatcggaagccgacgtacgagcgtgatgttgacctgggggccggcacccggcacgttgccgtagagccggaggtcgcgaacctcgacatcatcggccagcggatcgagaacatcaagaacgagcataagtccacctggcattacgacgaagataatccctacaagacctgggcctaccatgggtcgtacgaggtgaagccatccggcagcgcctcgtcgatggtcaacggggtggttcgcctgctgacgaaaccgtgggatgtcatcccaatggtgacccagatcgccatgactgacaccacgcccttcggccagcaacgggtcttcaaggagaaggttgatacgcgcacccccaaggcaaagcgggggaccgcgcagatcatggaggttacggccaagtggctctggggctttctgagccgcaacaagaagcccaggatctgtacccgcgaggagttcacccgaaaggtccgctcgaacgcggccatcggagccgttttcgtagacgaaaaccagtggaacagtgcgaaggaggccgtggaggacgagaggttctgggacttagtccgtcgtgaacgtgagctccacaagcaagggaaatgcgcgacgtgcgtctacaacatgatgggcaagcgggagaagaagctgggggagtttggcaaggccaaggggtcccgagcgatctggtacatgtggctgggcgccagattcctcgaattcgaggctctgggcttcatgaacgaagaccactggttcagcagagagaactccctgagcggggtggagggtgaagggctacataaattgggctacattctgcgggatatctccaagatcccagggggcaacatgtacgccgacgacacggccggctgggatacccgcatcaccgaagaggacctccagaacgaggcgaagatcaccgacatcatggagcccgagcacgccctgcttgccacgagcatctttaagctcacctaccagaacaaggtcgtgcgggtgcagcgcccggccaagaatgggaccgtcatggacgtgatcagccgccgggaccagcgcggctccggccaagtaggcacctatggcctgaacacattcacaaacatggaggcccagcttatacgccagatggaaagcgaggggattttcagcccctccgagctcgagacccccaacctggcgggccgcgtcctggactggttagagaagcacggaatcgagcggctgcgccggatggccatcagcggtgacgattgcgtcgtaaagcccatcgacgaccgctttgccaccgccttaacggctctgaacgacatggggaaggttcggaaggacattccgcagtgggagccatccaaaggctggaacgactggcagcaggtccccttctgttcacaccacttccaccaactaatcatgaaggacggccgcgaaatcgtcgtcccatgccggaaccaggacgagctggtgggaagagcacgggtttcacagggcgccgggtggtccttgcgggagactgcctgcctgggcaagtcatacgcacaaatgtggcagctcatgtacttccatcggcgtgacctccggctggctgcgaacgccatctgctccgccgtcccggtggactgggttcccaccagccgcaccacttggagcatccacgcccaccaccaatggatgacgacagaggatatgttaagcgtctggaaccgggtgtggatcgaggagaacccctggatggaggacaagacccacgtgtctagttgggaggacgtcccctacctcggcaagcgcgaggaccagtggtgcggctccctgatcggcttgacagcgcgtgccacgtgggccaccaatatccaggtagccatcaaccaggtgcggagactaattgggaacgagaactacctggattacatgaccagcatgaaacggttcaagaacgaatccgaccctgagggcgcgctgtggtga

SEQ ID NO: 24716 - RNA, 9879 nt, synthetic construct
  misc_feature 1..9879: note = derived and/or modified CDS sequence (opt11) from DENV-1__JQ915073__SS-prME
  source 1..9879: mol_type = other RNA
tccgtaaccatgctgcttatgctgctgccaacggtacttaccttccacctaaccacccggggtggcgagccacacatgatcgtgagcaagcaggagcggggtaagtcgctgctgttcaagacctcggccggggtcaacatgtgcaccctcattgccatggacctgggtgagttgtgcgacgataccatgacgtacaagtgcccccgtattaccgagacagagcccgatgacgtggactgttggtgcaacgcaactgaaacatgggtgacgtacggaacctgcttccagacgggtgagcaccggcgcgataagcggagcgttgcactggcgccgcacgtcggcctcgggctcgagacccgaactgaaacgtggatgtcctcagaaggagcttggcggcagatccagaaagtggagacctgggccttgagacatcccgggtttaccgtgattgcactgttcttagctcacgccatcggaacgtctatcacgcagaaggggatcatcttcatcctgctcatgttggtaacgccctcgatggccatgcggtgcgttggcatcggcaaccgagatttcgtggaagggctttccggcgcgacctgggtcgacgtggtcctggaacacggtagctgcgtcaccactatggccaaggacaagccaaccctcgacatcgagctgctgaagaccgaagttaccaaccccgccgtacttcggaagttatgcatagaggccaagatctcaaacacgacgaccgactcgcgctgtccgacccaaggcgaggctaccctcgtcgaggagcaagacacgaacttcgtctgccggaggaccttcgtggacagaggctggggaaacggatgcggcttgttcggaaagggttcactgatcacgtgtgcgaagttcaagtgcgttacgaagctggaggggaaaatcgtacagtatgagaaccttaaatacagcgtgatcgtcaccgtgcacactggcgaccagcaccaggtaggaaatgaaactactgagcacggcaccatcgccaccatcacaccccaagcccccacctctgaaattcagctgacggactatggggcactgacactcgactgttccccgcgcaccggcctcgactttaacgaaatggtgctcctcactatgaaggagaagtcctggctagtgcataaacagtggttcctggacctgccgcttccatggacgactggggctagcacgagccaggaaacctggaaccggcaggacctgctagtcactttcaagaccgcgcacgccaaaaagcaagaggtggtcgtgttaggatcacaggagggcgctatgcacaccgccctgaccggggctaccgagatacagacttcgggcaccaccacgatcttcgcggggcatctcaaatgtcgcctgaagatggataaacttaccctcaagggtatctcgtatgtgatgtgcacagggagcttcaaactggaaaaggaggtggccgagactcaacacggaacggtgctagtgcaggtaaagtatgagggtaccgatgccccctgcaagatccctttctccagccaggacgagaagggagtcacccagaacggacggctggtgacggccaacccgatcgtgacggacaaggaaaagcccgtgaacatcgaggccgagccgccctttggggagtcgtatatagtcgtgggggccggcgagaaagccctcaagctgagctggttcaaaaagggatccagcattggcaagatgttcgaggcgacagcccgcggggcccggcgcatggcaattctaggagacaccgcctgggactttgggtccatcggcggcgtctttacctccgtgggaaaactagtgcatcagatctttggcacggcctatggcgtcctcttctccggggtgtcatggaccatgaagattggcatcgggatcctcctcacctggctgggtctgaactccagatcaacctccctcagtatgacgtgcatcgccgtagggatggtcaccctttacctgggcgtgatggttcaggcggacagcggctgtgtaatcaactggaaggggcgggagctcaaatgcgggtctggcatcttcgttaccaatgaggtgcacacctggacggagcagtataagttccaagctgacagtccgaagcgcctgtctgccgccattggcaaggcctgggaggagggcgtatgcggcatccgtagcgctacacgcctggagaatataatgtggaagcagatttctaatgagcttaaccatatactgctggagaacgacatgaagttcaccgtggttgtcggggacgtgagcggcatcctcgcccaagggaaaaagaccatcaggccccagcccatggagcacaagtactcctggaagtcatggggaaaggccaagatcatcggcgccgacgtgcaaaacaccacgtttatcatagacggccccaacaccccggagtgtcctgacgaccagcgtgcctggaacatttgggaggtcgaggactacgggttcgggattttcactaccaatatttggctgaagttacgtgattcctacacgcaggtgtgcgaccaccgtctcatgagcgcggcaatcaaggattcaaaggccgttcacgccgacatgggctactggatcgagagcgaaaagaacgagacctggaaattggcgagggcttcctttatcgaggtcaagacctgcgtgtggcctaagagccacacactctggagcaatggcgttctcgagagcgaaatgatcattccaaaaatctacgggggcccgatatcccagcataattacagaccgggttacttcacgcagaccgcgggaccctggcatctggggaaactggagctggattttgacctgtgtgagggcactaccgtcgtggtggacgagcactgcggccaccgggggccgtcactgcgcacgaccaccgttacgggcaagatcatccatgagtggtgctgccggtcatgcaccttgccgccactgcgcttcaagggggaggacggctgctggtacgggatggagatccgaccagtgaaagagaaggaggagaacctggtcaagagcatggtctccgccggcagcggcgaggtggactccttctccctcggcctgctgtgcatctctataatgatagaagaggtaatgaggagtcggtggagccgcaagatgctaatgacgggcaccctggtggtattcctgctcctgacactcgggcagctcacctggaacgacttgatccggctgtgcatcatggtaggtgcgaatgcgagcgataatatggggatggggacaacctacctcgccctgatggccaccttccgcatgaggccgatgttcgcagtagggctcctctttagaagactgacgagccgggaggtgctgctcctgaccgttgggctgtcgctcgttgcgagcgtggagctgcccaacagtttggacgagctgggcgatgggctggcaatgggcatcatgattttaaagctcttaaccgactttcagtcccaccagttatgggcaaccctcctatccctgacgtttgtcaaaacaacattgagcctgcactacgcctggaagaccatggccatgatcctgtccatcgtgagcctcctgccgctgtgcctctctacaaccagccagaagacgacctggctccccgtgctcctcggcagtctggggtgtaaaccactgacaatgttcctcataacggagaacaaaatatggggtcgtaagtcgtggccgctcaacgagggaatcatggccgtaggaatcgtaagtatactgctcagctctctgctgaaaaatgacgtacccttggcggggccactgatcgcaggtgggatgctgattgcctgctacgtcatctcggggtcgagcgcggacctcagcctcgagaaggcggccaaggtgtcctgggaggaagaggccgagcactcaggcgcatcccacaatatcttggtggagatccaggacgacggaaccatgaagatcaaagacgaagagcgggacgacaccatcactatcctcctgaaagccacgctactcgcaatctcgggggtctacccgatgtccataccagccaccttatttgtgtggcatttctggcagaagaagaagcaaaggagcggcgtgctttgggacacgccctcaccccccgaggttgagaaggccgtgctagacgacggaatctatcggatcctccaacgaggcctgctgggccggagccaagtgggcgtcggggtgttccaggagggcgtgttccacaccatgtggcacgtcacgcgcggagccgtcttgatgtaccaaggcaaaaggctggagccttcttgggccagcgtcaagaaggacttaatctcctacggcgggggctggcggttccaggggagctggaacaccggagaggaggtccaggtgatcgcggtggagcccgggaagaacccaaaaaacgtccaaaccacgcctggcacattcaagacctcagagggcgaggtaggagccatcgccctggacttcaaacccggcacctccgggagccccattgtgaaccgggagggcaaaatcgtaggcctgtatggaaacggcgtcgtgaccacgtctgggacctacgtaagcgccatcgcccaggccaaggcctcccaagagggccctctgccggaaatagaggacgaagtgttcagaaaacggaacctaaccattatggacctgcatcctgggtcaggcaaaaccagacggtacctaccagccatcgtgcgggaggccatcaagcggaaactccggacgctggtcctggccccgacccgggtggtggcgagtgagatggccgaggcacttaagggcatgcctattcgctaccagaccaccgccgtgaagtcggaacatacggggaaggagatagttgatctgatgtgccacgctaccttcacaatgcgcctgctctcccctgtgcgggtccctaactacaacatgatcatcatggacgaggcccactttaccgatccggccagcattgccgcccgcggctatatcagtacgagggttgggatgggtgaggcggccgccatcttcatgacggccaccccgcccgggagcgcagaggcgttcccccagtcgaacgccgtgattcaggacgaggagaaggacatcccagaacgttcttggaactccggatacgactggatcaccgacttccccggcaagacagtctggttcgtgcccagcatcaagtccgggaacgacatcgccaactgcctgcggaagaacggcaagcgagtaatccaactgtcacgtaagactttcgacacggagtaccagaaaaccaagaacaatgactgggactacgtcgtcacgaccgacatctccgaaatgggtgctaacttccgcgccgaccgggtcatcgatccgaggcgttgcctaaagcccgtgatcctcaaggacgggcctgagcgcgtgatcctggcaggtcccatgccggtgactgtggccagcgccgcccagcggagaggacgcatcggccgaaatcagaacaaggaaggagatcagtacatatacatgggtcagccgctcaacaacgatgaggaccacgcgcattggaccgaggccaagatgctgctcgacaacataaacacgcccgaagggatcataccggcgctattcgagcccgaacgggagaagtccgccgccattgacggcgaataccgcctgcgcggggaggcacgcaagacattcgtggagctgatgagacgaggcgatctaccggtctggctgtcatacaaggtggcctccgagggcttccagtactcagaccgccggtggtgtttcgatggggagcgcaacaaccaggtgcttgaggaaaatatggacgtcgagatctggacaaaggaaggcgaacggaagaagctccggccgcggtggctagacgcacgcacgtacagcgaccccctggccctccgtgagtttaaagagttcgctgcggggcgccggtccgtgtcgggggaccttattctggagatcggcaagctcccccagcacctgactcagcgagcccagaatgccctggacaaccttgtgatgctgcacaactccgagcagggcgggaaggcctataggcacgcgatggaggagctgccggacacgattgaaacgatcatgcttctcgcgctaatcgccgtactcaccgggggtgtcacgcttttcttcctatcgggtcgcgggctggggaagacgtccatagggctgctgtgcgtgaccagctctagcgccctcctgtggatggcatccgtcgaaccccactggatagcagcctcaattatcttagaattctttcttatggtccttcttataccagaacccgaccggcagagaaccccacaagataaccagctcgcctacgtggtaattggcttactgttcatgatccttaccgttgccgccaatgagatggggttgctggagacgaccaaaaaagacctcggtatagggcatacagcggcagagaaccaccaccatgcggcgatgttagatgtggacttacacccggcttccgcatggacactgtacgccgtcgccacgaccatcatcaccccgatgatgaggcacaccatcgagaacacgacggccaatatcagcctgacggcgatcgcaaaccaagccgccatcctgatgggcctcgacaaagggtggccgatctccaagatggacatcggtgttccactgctggccctcggctgctatagccaggtaaaccctctgaccctgacggccgcagtgctcatgctggtggcccactacgccatcataggtccgggcttgcaggccaaggctacacgtgaggcacagaagcggaccgccgccggcattatgaagaacccgacagtggacgggatcgtggcaatcgacctcgatcccgtcgtttacgacgcaaagttcgagaagcaactgggccagatcatgctgctaatcctgtgcacgagccagatcctattaatgcggaccacctgggccctgtgcgaatctatcacgctggctacggggccactaaccaccctgtgggagggctctccgggcaaattttggaataccactattgccgtcagcatggcgaacatattccggggctcctatctggcgggcgccgggcttgcgttctcactgatgaagtcgttgggcggtgggcgtcgcggtactggggcccagggggaaaccctcggcgagaagtggaagagacaactgaaccagcttagtaagagcgagtttaatacgtacaagcgctccggcattatcgaggtggaccgaagcgaagccaaggaaggcctcaagaggggggagacaacaaaacatgccgtatcacgcggaaccgccaagctgcgctggttcgtggagcgcaacctcgtgaaaccggagggaaaagtgatcgaccttggctgtgggcgcggcggttggagctactactgcgcaggcctcaagaaagtgaccgaagtgaagggttacacgaagggtggccccggacacgaggagccgatcccgatggccacatatggctggaacttggtcaagctgcactccggcaaggacgtcttcttcatcccgccggagaagtgcgacaccttattatgcgatatcggcgaaagctccccgaatcccaccatcgaggagggcagaaccctgcgcgtgctcaagatggttgagccgtggctgcggggcaaccagttctgcatcaagatactgaacccttacatgcccagcgtagtggagactttagagcagatgcagcgcaagcatggagggatgctggtcaggaaccctttatccagaaatagcacccatgagatgtattgggtgtcctgcggcaccgggaacattgtgtccgcggtcaacatgacctcgcggatgctgctaaacaggttcacgatggcccaccggaagcctacctatgagcgtgatgtcgacttaggcgccggtacccgccacgtggccgtcgagccagaggtcgccaacctcgatataatcgggcagcgcatcgagaacatcaagaacgagcacaagagcacctggcactatgacgaggataacccttacaagacgtgggcgtaccatggctcctacgaagtaaaaccaagcgggtcagccagctcgatggttaatggcgttgtccgcttgcttactaagccgtgggacgtcatccccatggtgacccaaatcgccatgaccgacactacccccttcgggcagcagcgggtcttcaaggaaaaagtcgataccagaaccccgaaggccaagcggggcacggcgcagatcatggaggtgaccgcgaagtggctctggggtttcctgtcccgtaataagaaaccgcggatctgtaccagagaggaattcaccaggaaggtacgcagcaacgccgcaatcggtgctgtatttgtggacgaaaaccagtggaacagtgctaaggaggctgtggaagacgagaggttctgggaccttgttcgccgtgaaagagagctccacaagcagggcaagtgcgctacgtgcgtgtacaacatgatggggaaacgcgagaagaagctcggcgaattcgggaaggctaagggcagccgagccatttggtatatgtggctgggtgcgcggtttctcgagttcgaggctctgggcttcatgaacgaggaccactggttttcgcgcgagaatagcctgagcggcgtggaaggggagggcctccacaagctgggatacatcctgcgggacataagcaagatccccggcgggaacatgtacgccgacgataccgcgggatgggacacccgaattaccgaagaggacctccaaaacgaggccaagatcacggatatcatggaacctgagcacgcgctgctggccacctccatcttcaagctgacataccaaaataaagtcgtgcgagttcagcgtcctgccaaaaacggcacagtaatggacgtcatctcacggagagaccagcgaggctccggccaggttggcacgtacgggttaaacacattcactaacatggaagcccagctgatacgccagatggaaagcgagggtattttctccccctctgaactcgagacacccaatctggcggggcgcgtactagactggctcgaaaagcacggcatcgaacggctgcgccgtatggcgatctccggggacgactgcgtggtgaagcccatcgatgaccgcttcgccacggccctgaccgccctcaacgatatgggcaaggtccggaaagatattccgcagtgggagccgtcgaagggctggaacgattggcaacaggtacccttttgttcacatcacttccaccagctgatcatgaaggacggccgcgaaatcgtcgtgccctgccggaatcaagacgaactggtgggccgagcccgggttagccagggcgcgggctggagcctccgcgagacggcgtgcttggggaagagctacgcccagatgtggcagctgatgtacttccacaggcgcgacctccggctggccgccaacgcgatttgcagcgctgtcccggtggactgggtgcctacgtccaggactacgtggagcatccacgcccaccaccaatggatgaccaccgaggacatgctatccgtctggaacagggtttggatagaggaaaacccatggatggaagacaagacccacgtgagctcatgggaggacgtgccctacctcggaaagcgcgaggaccagtggtgcggcagcctgatcggtctgacggcacgggcgacctgggccaccaacatccaggtggccatcaatcaggtgcgtcggttgatcggcaacgagaactacttagactacatgacttcgatgaagcgcttcaagaacgagtctgacccggagggggccctgtggtaa

SEQ ID NO: 24717 - RNA, 9879 nt, synthetic construct
  misc_feature 1..9879: note = derived and/or modified CDS sequence (opt11) from DENV-1__JQ915075__SS-prME
  source 1..9879: mol_type = other RNA
agcgtgacaatgctactcatgctgctgcccaccgtgctcacattccatctgacaactcggggcggggagccccacatgatcgtgagcaagcaagagcggggcaaaagcctcctcttcaagacctccgccggggtgaacatgtgtaccctgatcgccatggacctgggcgagttgtgcgacgacaccatgacttataagtgcccccgcatcactgaaacagagcccgatgacgttgactgctggtgcaacgcaaccgagacctgggtcacctatgggacgtgcagccagaccggcgagcacagacgcgacaagcggtccgtagccctggcgccccacgtaggcctggggctagagacccgcaccgagacgtggatgagctccgagggcgcctggcggcagatccagaaggttgagacctgggccttacggcaccccgggttcacagtgattgctcttttcctcgcccacgccatcggcacctctatcacacagaagggaattattttcatcttactgatgctcgtcacaccatccatggcgatgcggtgcgtgggcattggcaaccgcgacttcgtggaggggctttccggcgcgacgtgggtcgacgtggtgctggagcacggatcttgcgtcaccactatggcgaaggacaagccaacactagacatcgagcttttgaagacagaggttacaaatcccgccgtcctccggaagctgtgtattgaagccaagatcagcaatacgaccaccgattcccgctgccccacccagggcgaagccacgctggtcgaagagcaggatacaaatttcgtgtgccggaggactttcgtggaccgggggtgggggaacggctgcggcctgtttggtaaagggtcactcattacgtgcgcgaagttcaagtgcgccacgaagctggagggcaagatcgttcagtacgagaacctcaagtacagcgtgatcgtgaccgtccatacaggcgaccagcaccaagtgggaaatgagactacagagcatggcacgatcgcaaccatcacaccccaggcccccactagcgagatccaacttacagattacggggccctgactttggactgtagcccccggaccggcctggacttcaacgaaatggtcctgcttaccatgaaagagaagtcctggctggtgcacaagcagtggttccttgacctcccactgccctggacgacaggggcgtccacaagccaagagacctggaaccggcaggacctgttagtgacgtttaagaccgcccacgccaagaaacaggaggtcgtggtgcttggcagccaggagggcgcgatgcacaccgcactgaccggagccaccgagatccagacctccggcaccaccacgatctttgccggacacttaaaatgccgcttaaagatggataagttgaccttaaagggaattagctacgtcatgtgcaccgggagcttcaaactggagaaggaggtggccgagacccagcacgggacagttctggtccaggtgaagtatgagggcaccgacgcaccctgcaagatcccgttcagctcccaggatgaaaagggggtgacccaaaacggccggctggtaaccgccaacccgatcgtgactgataaagaacgccccgtgaacatcgaggcggagccgcccttcggcgagagctacatcgtcgtgggcgccggcgagaaggccctcaagctgagctggttcaagaaagggagctccatcggcaagatgttcgaagccacagcacgcggggcaaggcgcatggccattctgggcgacaccgcatgggacttcgggagcatcggcggcgtgttcacctccgtcggaaaactcgtgcaccagatctttggcactgcctacggggtactgttcagcggcgtctcctggacgatgaagatcgggatcggaatcctactcacctggctgggcctgaacagccggagtacaagcctctcgatgacgtgcatcgctgtgggaatggttactctgtacctgggcgtcatggtgcaggctgacagcgggtgtgtgatcaactggaaaggtcgagagctgaagtgcggctccggtatctttgtcaccaacgaggtgcacacctggactgagcagtacaagttccaggccgatagcccaaaacggctcagcgcagccatcggcaaggcgtgggaggagggggtgtgcggcatccgctcggccacacggctggagaacatcatgtggaagcagataagcaacgagttaaaccacattttactggagaacgacatgaagttcacggtcgtggtgggggacgtctcgggcatcttagcccaggggaagaagacgatcaggccgcaacccatggagcacaagtatagctggaagtcctggggcaaggccaagatcatcggggccgacgtacagaacaccacgttcataatcgacggcccgaatactccggagtgccccgacgaccagcgggcgtggaacatctgggaggtggaagactacggctttgggatctttaccacgaacatatggctcaagctgcgcgattcctacactcaggtctgcgaccaccgtctcatgtccgccgccatcaaggactcaaaggctgtgcacgcggacatgggctactggatcgagtccgagaagaacgagacctggaagctggcccgggcaagctttatcgaggtgaagacttgcgtctggcccaagtcccataccctgtggagcaacggcgtgcttgagtccgaaatgatcatcccaaagatctacgggggcccaataagccagcacaactaccgacccgggtactttactcagaccgcgggcccgtggcacttggggaagctggagctcgacttcgacctgtgtgagggcaccacggtggtcgtggacgagcactgcggcaatcgggggccaagtttgcgaacaaccaccgtgacaggcaagatcatccacgagtggtgctgccgcagttgcacattaccgccccttcggttcaagggggaggacgggtgttggtacgggatggagattcgccccgtcaaagagaaagaggagaatctggtgaaatccatggtgagcgccgggagcggcgaggtcgactcattcagcctcgggcttctgtgcatcagcatcatgatcgaggaggtaatgcggagccgctggtcccggaagatgcttatgaccggcaccctggtggtgttcctgctcctgaccctggggcagctcacgtggaacgacctgatccgtttgtgtatcatggtgggcgcgaacgctagtgacaacatggggatgggcacaacctacttggccctgatggccaccttcaggatgcggcccatgttcgcagtcgggctcctatttcggcgtctgacgtccagggaggtgttgctcctgaccgtagggctgagcctcgttgcctccgtggagctgcccaacagcttagacgagcttggcgacgggctggccatggggatcatgatcctgaagctcctgaccgactttcagtcccatcagctctgggccaccctcctgagcctgacgtttgtgaaaaccaccctctccctgcactacgcctggaagaccatggcgatgatcctgagcatcgtaagcctctttcccctatgccttagcacgacctcccagaagacgacatggctacccgtgctgttgggctcgctcggttgcaagccactgaccatgttcctgatcacggaaaacaagatttgggggagaaagtcctggcctctcaacgaggggattatggcagtcggcatcgtcagcatcctgctgagtagcctcctgaaaaacgacgtgcccctggccgggccgctcatcgccggtggcatgttgatcgcctgttacgtcatcagcgggtcgtcggccgacctgagtttagagaaggccgccaaagtgagctgggaagaggaagccgagcactcaggagcgagccacaatatcctggtggagatccaggacgacggcacaatgaagatcaaggacgaggagagagacgacactataacaatcctactcaaggcaactctgctagccatatccggcgtgtaccccatgagcatacccgcgaccctcttcgtctggcacttttggcagaagaagaagcaacggtccggggtgctctgggacacccccagcccgccggaggtggagaaggcggtcctggacgacggcatctaccgcatcctgcagcggggcctcctggggcgctcccaggtgggagtgggggtcttccaggagggagtattccataccatgtggcacgtgacgcgcggggccgtcctgatgtaccagggaaagcgcctcgagccgagctgggcgtccgttaagaaagacctgatcagctacggcggcggctggagattccaggggtcctggaacaccggcgaggaggtgcaggtcatagccgtggagcccgggaagaatccgaagaatgtgcaaaccgcacccgggatcttcaagacctctgagggggaagtcggggccatcgccctggactttaagcccggcacgtccgggagtccgatcgtgaatcgagagggcaagatcgtgggcctgtacgggaacggcgtcgtgaccaccagcgggacatatgtgtccgctatcgcccaggctaaggcatcccaagagggcccgctgccggagatcgaggacgaggtcttccggaagaggaacctgaccataatggacctccatcctgggtccggcaagactcgccgctacctgcccgcgatcgtgcgggaggctataaagcgcaagctccggaccctcgtgctggccccaacccgtgtcgtagctagcgagatggcggaggcgctgaagggtatgcccatccggtaccagacgaccgccgtgaagtccgagcacaccgggaaagagattgtcgacctcatgtgccacgccaccttcacgatgcgtctgctcagccccgtgcgcgtgcccaactataacatgatcatcatggatgaggcccacttcaccgaccctgcctcaattgcggcccggggttacatcagcacacgtgtggggatgggtgaagccgcggccatatttatgacagcgacgccgcccgggtccgtggaggccttccctcagagcaatgcagtgatccaagacgaggaaaaggacatccctgagcgctcctggaatagcggctacgactggatcaccgacttccccggtaaaaccgtctggttcgtgccgtcgatcaagagcggaaacgacatcgcgaattgtctccgcaagaacggaaagcgggtgatccagctgtcccgcaagaccttcgacacggagtaccagaagaccaagaacaacgactgggactacgtcgtgaccaccgacatcagcgagatgggggccaacttccgggcggaccgcgtcattgacccccggcgctgcctgaagccggtgatccttaaggacggtccagagagagtgatcttagccgggcccatgcctgtcacggttgcctccgcggcgcagcgccggggccgaatcgggcggaatcagaacaaggagggcgaccagtacatctacatggggcaaccgctgaacaacgacgaagaccacgcccactggaccgaggccaagatgctgctagacaatatcaacacccccgaggggattataccagcgctgtttgagccggaacgcgagaaatccgccgcaatcgacggcgagtaccggctccgcggggaggcccggaagacttttgtggagctgatgcggcggggcgacctgccggtctggctctcctacaaggtagcgagcgaaggcttccagtactcggaccggcgctggtgcttcgatggagagcggaacaaccaggtgctggaggagaacatggacgtagaaatatggacgaaggagggcgagcgcaagaagctgcggccccgctggcttgacgcccggacgtactccgacccactggcccttagagaatttaaggagtttgcggctgggcggcgctcggtgtccagcgatttaatcctggagatcggcaagctgccgcaacacctcacccagcgggcccagaatgccctggataacctggttatgctccataatagtgagcaaggggggaaggcctaccgccatgcgatggaggagctgccggacacgattgagaccatcatgctgctcgccctaattgccgtcctaactgggggggtgaccctatttttcctaagtggccgggggctaggtaagacctccatcggcttactgtgcgtgaccagttcaagcgctctgctctggatggcgaatgtcgagcctcactggatcgcagcctccattatcttagagttcttcctcatggtgctccttatccccgagcccgaccggcagaggacgccgcaggacaaccagttggcctacgtggtcataggtctcctgttcatgatcctcaccgtggccgctaacgaaatgggcctcctggaaaccaccaagaaggatctggggatcggacatacggccgccgagaaccaccaccacgccgcgatgctcgacgtggacctgcaccccgctagcgcctggaccttgtacgccgtcgccaccacaatcatcacgcccatgatgcgccacacaatcgagaataccaccgctaacatttccttaactgcaatggccaaccaggcggctatcctgatggggcttgataagggctggcccatctctaagatggacatcggggtgcccctcctggccctgggctgttacagccaggtaaaccccctcaccctgacagcggccgtccttatgctcgtggcacattatgccatcatcggtcctggtttgcaggcgaaagccacccgggaggcccaaaagcgcacggccgccggcattatgaaaaatccgaccgtggacggcatcgtcgcgatcgacttagaccccgttgtatacgacgccaaatttgaaaagcagctcggccagatcatgttactgatcctctgcaccagccaaatcctactgatgcggactacgtgggccctctgcgagtccataaccctggccacaggccccctgactacgctctgggaggggagcccgggcaagttctggaacaccaccatcgccgtatccatggcgaacatattccgcggaagctacctggccggcgcgggcctggcattcagcctcatgaaatccctggggggcggccgccggggtaccggggcacagggcgagaccctgggcgaaaagtggaagcgccagctcaaccagttgagcaagtctgagttcaacacctacaaacggagcgggatcatcgaggttgaccgctccgaggcgcgggaaggcctaaaacgcggggagacaaccaaacacgcagtgagccggggtactgccaagctccgttggttcgtcgagcggaacctggtgaagccggaggggaaagtgatagacctgggctgtggccgcgggggatggagctattactgtgccgggctgaagaaagtcacagaggtgaagggctacaccaagggcgggccaggccacgaggaacccatcccgatggccacctacggttggaacctcgtgaagctgcacagcggtaaggacgtcttcttcatcccgccggagaaatgcgacactctgctctgcgatatcggcgagtccagccctaaccccactatcgaggagggccggaccctgcgcgtgctgaagatggtggagccctggctccgggggaatcagttctgcataaaaatcttaaacccatacatgccctccgtcgtggaaaccctggagcaaatgcaaaggaagcacgggggcatgctcgtgcgtaaccccctgagccgcaacagcacgcacgagatgtactgggtaagctgcgggacgggcaatatcgtgagcgccgtgaatatgaccagccggatgttactcaataggtttaccatggcccatcggaagccgacgtacgagcgcgatgtcgacctgggggccggaacgcgccacgtggcggtggaacccgaggtcgctaacctggacatcatcggccagcggatcgaaaatatcaagaatgaacacaagagcacatggcactacgacgaggataacccgtacaagacgtgggcataccacgggagttacgaagtgaagcctagcggcagcgccagcagtatggtcaatggtgtggtgcgccttctgaccaagccgtgggacgtaatcccgatggtcacacagatcgccatgacagacaccacccccttcggccagcagcgggtgttcaaggaaaaggtcgacacgcgcacccccaaagctaagcgggggacagcgcaaatcatggaggtgacagcaaagtggctgtggggcttcctcagtcgcaacaagaaaccaagaatttgcacacgggaggaattcacccgtaaggtgcgatccaacgccgcgatcggtgccgtcttcgttgacgagaaccagtggaactctgccaaggaggccgtggaggacgagcggttctgggatctggttcgccgggaacgcgaactgcacaagcaggggaaatgcgcgacgtgcgtctacaacatgatgggcaagcgggagaagaagctcggggagttcggcaaggccaaggggtcccgcgcgatctggtacatgtggctgggcgcccggttcttagagttcgaagccctcggcttcatgaatgaggaccactggttcagccgcgagaactccctgagcggagtggagggcgaggggctgcacaagcttggctacatcctgcgagatatctccaagatccccgggggcaacatgtacgcggacgacactgccggctgggacacacgtatcaccgaggaggacttgcagaacgaggcgaagatcaccgatattatggagcccgagcacgccctcctggccacaagcatcttcaaactgacgtaccagaacaaggtagtgcgggtgcagcgccctgccaagaacggaacagtcatggatgttatctcccgccgggaccagcggggcagcggccaagtgggaacttacggcctcaacaccttcacgaacatggaagcccagctgataaggcagatggagtcggaaggtattttcagcccctccgaactggagacccccaaccttgcgggtcgtgtcctggactggctggaaaagcacgggatcgaacggctccgcaggatggccataagcggcgacgattgtgtggttaagcccatcgacgaccgattcgctacggcccttaccgcgctgaacgacatggggaaggtccgaaaggatatcccgcaatgggaaccctccaagggctggaatgattggcaacaggtcccattctgcagccaccacttccaccaactcatcatgaaggacggccgcgagatagttgttccctgccggaatcaagacgagttggttgggcgcgcgcgagtatctcaaggcgccgggtggtccctgcgcgagacagcctgccttggaaagtcctatgcccaaatgtggcaacttatgtactttcacagacgcgacctacggctcgccgcgaacgcaatctgctccgcggtccctgtcgactgggtgcccacctcgcgcaccacctggtccatccacgcccaccatcaatggatgactacggaggatatgctgagcgtctggaaccgcgtttggatcgaggagaacccatggatggaggacaagacccatgtgtcgagctgggaggacgtcccctacttggggaaacgagaagatcagtggtgcggcagtctcattggtctgaccgcgcgagccacctgggccacgaacattcaagttgcaatcaaccaagtccgcaggctcatcgggaacgagaactacttggactacatgaccagcatgaagcggtttaagaacgagtccgacccggagggagccctgtggtga

SEQ ID NO: 24718 - RNA, 9879 nt, synthetic construct
  misc_feature 1..9879: note = derived and/or modified CDS sequence (opt11) from DENV-1__JQ915076__SS-prME
  source 1..9879: mol_type = other RNA
agcgtgaccatgttgctgatgctactgcccaccgttctgacctttcatctgactacccgcggcggagagccccacatgatcgtgagtaagcaggagcggggcaaaagtctactgttcaagacttccgcaggggtgaatatgtgcaccctgatcgcaatggacttaggcgagctctgcgacgacactatgacctacaaatgcccccgcatcacagagaccgaacccgacgatgtcgactgttggtgcaacgcgacggagacctgggtgacctacggtacgtgtagccagaccggggagcaccgacgcgacaagcggtccgtggcgctagcaccccatgtcggcctgggactcgagaccaggaccgagacgtggatgagctcagagggcgcttggcggcagatccagaaggtcgagacctgggccctgcgccaccccgggttcaccgtgatcgccctgtttctcgcccacgccattggtacctcaatcacgcagaaggggatcatcttcatcctgctgatgctcgtcaccccctccatggctatgcgctgcgtgggcatcggcaaccgcgatttcgtggaggggctgagcggcgcgacctgggttgacgtggttctggaacacgggtcctgcgtcaccacgatggccaaagacaagccgaccctcgacatcgagctgctgaagaccgaggttaccaaccccgccgtgctccggaagctctgcatcgaggcaaagatcagtaatacgacgacagattcgcgctgcccgacccagggggaggccaccttagttgaggagcaggacaccaacttcgtgtgtcggcgcacgtttgtggaccggggctggggaaacgggtgcggcctcttcggcaaggggagcctgatcacgtgcgcgaaatttaagtgcgtcacgaagctggagggcaagattgtacagtacgagaacctcaagtactccgtcatcgttactgtgcacacgggcgaccaacaccaggtcggcaacgagaccaccgagcatggcacgatcgccaccatcacgccccaggcgcccaccagcgagatccagctgacggactatggggccttgaccctcgattgcagcccccggaccggactggacttcaacgagatggtgctgctcactatgaaggagaagtcttggctggttcacaagcaatggttcctggacttgccactgccctggaccaccggtgcctcgacaagccaggagacctggaaccggcaggacctgctcgtcacgttcaagaccgcgcacgccaagaagcaggaggtggtggtcctgggcagccaggagggcgccatgcacaccgcactgaccggagccacggagatccagacctccggcaccacgacgatcttcgcggggcacctcaaatgccgcctgaagatggacaagctgaccctcaaaggcatgagctacgtgatgtgcacgggctcctttaaactggagaaggaagtggccgagactcagcacgggacggtcctggtacaggtgaagtacgagggcacagacgcgccctgtaagatccccttctcttcccaggacgagaagggggtgacccagaacggtcggctggtgaccgctaatccaatcgtgaccgacaaagagaagccggtcaacatcgaggccgaaccgcccttcggggagtcatacatcgtggtgggcgcgggggagaaggccctcaagctgtcctggtttaagaaggggtcctccatcggaaagatgttcgaggccaccgcgcgcggtgcgcggcgcatggccatcctgggcgacactgcctgggatttcggatccatcggaggcgtctttacctccgtggggaagctggtccaccaaattttcggcacggcctacggggtccttttcagcggcgtatcgtggaccatgaagatcgggatcggcatcttattgacctggctgggcctgaacagccgctctaccagcctgtccatgacatgcatcgccgttgggatggtcaccctgtacctaggtgtgatggtccaggcagactcggggtgcgtcatcaactggaagggccgggaactcaagtgcggatccggcatcttcgtgaccaacgaggtgcacacctggaccgagcagtacaagtttcaggccgacagcccaaagcgcctgagcgccgccatcggcaaggcctgggaagaaggggtatgcggcattcgctccgcgacgcgcctcgagaacatcatgtggaagcaaatcagcaacgaactaaaccacatactgctggagaatgacatgaagttcaccgttgtggtcggggacgtcagcgggatcctcgcccaggggaagaagaccatccggccccaacccatggagcacaagtacagctggaagtcttggggcaaggccaagatcatcggcgccgacgtgcagaacaccacgtttataattgacgggcccaacacccctgagtgccccgacgaccagcgcgcgtggaacatctgggaggtggaggactatggcttcgggatcttcaccaccaacatctggcttaagctgcgggacagctacacccaggtgtgcgaccaccgcctcatgtccgcggccattaaggacagcaaggccgtgcacgccgacatgggctattggattgagtccgagaagaacgagacctggaagctggcgcgggccagcttcatcgaggtcaagacctgcgtctggcccaagtcccacaccctgtggagcaacggcgtgctcgagtccgagatgatcatcccgaagatctacgggggcccgatcagccaacacaactaccgccccgggtacttcacgcagaccgccggcccctggcatttagggaagctagagctcgacttcgacctgtgcgagggaaccaccgtcgtggtggacgagcactgcggccaccgggggccgtccctgcgtacaactacggtgaccggaaagatcatccatgagtggtgctgccggagctgcactctgccgcccctgcgcttcaagggggaggacgggtgctggtacgggatggagatccggcccgtgaaggaaaaggaggagaatttagttaagagtatggtcagcgccggcagcggcgaggtggacagtttctccctaggtctactatgcatctcaatcatgatcgaagaggtgatgcgcagcaggtggtcccggaagatgctcatgactggcacattggtcgtgttcctgctcctgactctggggcagctcacctggaacgacctgattcggctgtgcataatggtcggcgccaacgcgagcgacaacatgggaatgggcacgacgtacctcgcgctgatggccaccttccgcatgcggccgatgttcgccgtcggcctccttttcaggcgcctgacatcccgggaggtgctgctcctcacggtcgggctgagcctcgtcgccagtgttgagctacccaacagccttgacgagctcggcgacgggctggcgatgggcataatgatccttaagctcctgaccgacttccaatcccaccagctgtgggccacattgctgtcactgacattcgtcaagactaccctctccctgcactacgcctggaagaccatggcaatgattctgtccatcgtgtctctcctaccgctgtgcctctctacgacctcccagaagaccacctggctgcccgtgctgctcggcagcctgggttgcaagccgctgaccatgtttctaatcacggagaacaagatctggggtcgcaaatcctggccccttaacgaggggatcatggcggtcggcatcgttagcatactgctaagctccctgctgaagaacgacgtgcctctcgccgggcccctgatcgccggcggcatgctgatcgcctgctatgtaatcagcgggtccagcgccgacctctctctggagaaggccgctaaggtatcatgggaggaggaggccgagcactccggcgcgagccacaatatcctggtggagatacaggacgacgggactatgaagatcaaggacgaggagcgggacgacaccatcaccatcttgctgaaggcaacattactcgcgatctccggcgtctacccgatgagcatccctgccaccctgttcgtgtggcacttctggcagaagaagaagcaacgatccggggtactgtgggacacccccagcccgccagaggtagagaaggcggtactggacgacggcatctaccggatcctccagcgtggcctgctggggcggtcccaggtgggtgtcggggtcttccaggagggcgtcttccacaccatgtggcacgtcacgcgcggcgccgttttaatgtaccagggcaagcggctggagcccagctgggcctccgtaaagaaagacctaatctcttacggcgggggctggcgcttccaagggtcctggaatacgggcgaggaggtccaggttattgccgtggagccggggaagaacccaaagaacgtccaaaccgcccccggcacattcaagacgtctgagggagaggtgggggccatcgcccttgatttcaagcccgggacctccgggagccccatcgtaaaccgcgaggggaagatcgtcggcctgtatgggaacggggtggtgaccaccagcgggacctatgtctccgccatcgctcaggctaagaccagtcaggagggtcccctgccggagatcgaggatgaggtattccgtaaacggaacctcacaataatggacctgcaccccgggtctggcaaaacacgtcggtacctgccagccatcgtgcgagaggccatcaagcggaaactacgcacgttagtcctggcaccgacccgggtggtggctagcgagatggccgaagccctcaagggtatgcccatccgctaccagaccaccgccgtcaagtccgagcatacggggaaggagatcgtagaccttatgtgtcacgcgaccttcaccatgcgcctgctcagccctgtgcgtgtccccaactacaacatgattatcatggacgaggcccacttcaccgacccggcctccatagccgcccgcggctacatcagcacgcgcgtggggatgggcgaggcggccgctatcttcatgaccgccacgccgcccgggtccgtcgaggccttcccccagagcaacgcggtcatccaggacgaggagaaggacattccggagcgctcctggaacagcggctacgactggatcaccgacttcccaggcaagacggtgtggttcgtgccctccatcaaaagcggcaacgacatcgccaactgtctgcggaagaacggtaagcgcgtcatccagctgtcacggaagaccttcgacaccgagtaccagaaaaccaagaacaacgactgggactacgtggtcaccacagatatctcggagatgggggccaacttccgcgccgaccgggtgatagacccccgccggtgcctcaagccggtgatactgaaggacggccctgagcgcgtcatactggccgggccgatgccagtgaccgtggcgagcgccgcccagcggcgcgggcggatcggccgcaaccagaacaaagagggggaccagtacgtctacatgggccagccgctaaataacgacgaggaccacgcccattggaccgaggcgaagatgctgctggacaacatcaacacgcctgaagggatcatcccagccctcttcgaacccgagcgggagaagtccgccgcaatagatggcgagtaccgcctgcgcggggaggcccgcaaaacatttgtcgagctgatgcgccgcggagacctcccggtatggctgtcttacaaggtggcgtcggagggattccagtactcggaccggcgatggtgcttcgacggagagcgcaacaatcaggtcctagaggagaatatggacgtggagatttggacgaaggagggcgagcggaagaagctcagaccccggtggctggacgcccgcacctactccgaccccctggcgctccgggagttcaaggagttcgccgccgggcgccgtagcgtgtccggggacctgatcctggagatcggcaagctcccccagcacctgacccagcgcgcgcagaacgccctggacaacctcgtgatgctgcacaatagcgagcagggtggaaaggcctatcggcacgccatggaggagttgccggatacgatcgagaccatcatgctcctggcgctgatcgctgtactcaccgggggcgtcaccctcttttttctgtccgggcgcggcctcggaaagacgtcaatagggctgctgtgcgttacctccagctccgccttactgtggatggccagcgtcgagcctcactggatcgccgcgtctataatcctcgagttcttcctcatggtactgttaatccccgagccggaccggcagcggactccgcaggacaaccaactcgcgtacgtggtgatcggactgctcttcatgatccttaccgtcgctgccaacgaaatgggtttactggaaaccaccaagaaggacctgggaatcgggcacaccgccgcagagaaccaccatcacgctgccatgctggacgtggatcttcaccccgccagcgcttggaccctctacgcagtcgccacgacaatcataactcccatgatgcgtcacacgatcgagaatacgaccgccaacatatccctgacagctatcgccaaccaggcagccatcttaatgggactcgataagggctggccaatcagcaagatggacattggggtccccctgctggccctcggctgctactcccaagttaaccccttaaccctgaccgccgccgtgctcatgctggtggcgcactacgccatcatagggcccggactgcaggcaaaggccacccgcgaggcgcagaagcggaccgccgcagggatcatgaagaaccccacagtggacggcatcgtggccatcgacttagaccccgtcgtctacgacgccaagttcgagaagcagctcggacagatcatgctgctcatcctgtgcacgagccaaatactgcttatgcgcaccacctgggcgctgtgtgagtccatcaccctggccactgggcccctcaccaccctctgggagggcagccccggcaagttctggaacaccacgatcgccgtttccatggccaacatattccggggcagctatctggccggcgcagggctcgccttcagcctgatgaagtccctgggaggggggcgcagggggacaggagcccagggggaaaccttaggggagaagtggaaacggcagctaaatcagctgagcaagtcagagttcaacatttataagcgcagcggcatcatcgaggtagaccggtccgaggccaaggaggggctcaagcgcggagagaccaccaagcacgcggtgtcacgggggacggcgaagctgcgctggttcgtcgagcggaacctggtcaagccggagggcaaggtgatcgacctgggctgcgggcgcggagggtggtcctattactgcgctggcctgaagaaggtgaccgaagtcaaggggtacaccaagggcgggcctgggcacgaggagcctatccccatggccacctacggatggaacctggtgaagctgcacagcgggaaggacgtgttcttcatcccgcccgaaaaatgcgacacgctcctgtgcgacatcggcgagtccagccccaaccccaccatcgaggagggacggactctgcgcgtcttaaagatggtcgaaccatggttgcggggtaatcagttctgtatcaagatcctgaacccctatatgcccagtgttgtcgagaccctcgagcagatgcagcgaaagcatggaggtatgttagtgcggaaccccctgagtcgcaactccacccacgaaatgtactgggtaagctgcgggaccgggaacatagtcagtgccgttaacatgaccagccggatgctcctgaaccgcttcaccatggcgcaccggaagccgacatacgagcgcgacgtggacctgggcgccggcacacggcacgtggccgtggagccagaggtcgccaacctcgatatcatcggccagcgcatcgagaacatcaagaacgaacacaagtctacctggcactacgacgaggacaacccctacaagacctgggcctaccacggctcctacgaggtgaagccgtccggtagcgcgagctccatggtcaatggcgtcgtgcgcctactgacaaaaccgtgggacgtcatcccgatggtcacccagatcgccatgaccgacacaacgcccttcgggcaacagagggtgttcaaggagaaagtggacacccgcacccccaaggccaagaggggcaccgcccagatcatggaggtaacggctaagtggctatggggtttcctgagccgaaacaagaaaccgcggatctgtacccgcgaggaattcacgagaaaggtgcgctccaacgcggccatcggggcggtgttcgtcgatgagaaccagtggaacagcgccaaagaggccgtagaggatgagcggttttgggatctggtgcgacgggagagagagcttcacaagcagggcaagtgcgcgacctgcgtgtacaatatgatgggtaaacgggagaagaagctgggtgagttcgggaaggctaaaggctcccgcgcgatctggtacatgtggctgggtgcccgcttcttggagttcgaagcgttgggattcatgaacgaggaccactggttcagccgcgagaacagccttagcggcgtggagggggaagggctccacaagctggggtacatactgcgggacatcagtaagatccccggcggcaacatgtacgccgatgacacggcagggtgggacacccgcatcaccgaagaggatctccagaacgaggccaagatcaccgacatcatggagcccgagcacgccctgctggcgacgagcatattcaagctgacctaccagaataaggtggtccgggtgcagcgcccggccaagaatggcacagtgatggacgtaatctctcggcgcgaccagcgcgggagcggccaggtaggcacctatggcctgaacacattcaccaacatggaagcccagctgatcagacagatggagtccgagggcatcttcagcccctccgagctcgagacccctaacctcgccgggagagtcctggattggctagagaagcatggcatcgagagacttcgtcgaatggccatcagcggggacgactgcgtggtgaaacccatcgatgaccgcttcgccaccgcgcttacggcactcaacgacatgggcaaggtgagaaaggacatcccacagtgggagccttccaagggttggaacgactggcagcaggtccccttctgcagccaccacttccatcagctgatcatgaaggacggacgcgagatagtggttccctgccggaaccaggacgagctggtcggccgcgcccgggtgagccagggcgccggctggtcccttcgcgagactgcgtgtctgggcaagtcttacgcccagatgtggcagctgatgtacttccaccggcgcgacctgcggctggccgcaaacgcgatctgctccgcggtgccggtcgactgggtgcctacctctcgaaccacctggagcattcacgcccatcaccagtggatgacaactgaggacatgttaagcgtgtggaaccgagtctggatcgaggagaacccctggatggaggacaagacccacgtgtccagctgggaggatgtgccctacctcggcaagcgcgaggaccagtggtgtggctccctgatcgggctaacggcacgggccacatgggccactaacatccaggtcgcgatcaaccaggttcgccgcctgatcggcaatgagaactatctagactacatgaccagcatgaagcggttcaagaacgagagtgatccagagggggccctgtggtga

SEQ ID NO: 24719 - RNA, 9879 nt, synthetic construct
  misc_feature 1..9879: note = derived and/or modified CDS sequence (opt11) from DENV-1__KF289072__SS-prME
  source 1..9879: mol_type = other RNA
agtgtgaccatgctgctcatgctgcttcctaccgccctggctttccacctgaccacgcgcggcggcgagcctcacatgatagtgagcaagcaagagcgaggcaagagcctcctgttcaaaacatctgcgggggtaaacatgtgcaccctaatagccatggacctgggcgagctctgcgaggacacgatgacctataagtgcccccgcatcactgaggccgagcccgatgacgtggactgctggtgcaacgccaccgacacctgggtgacctacgggacctgtagccaaaccggcgagcaccgtagagataagcgttccgtggccctggcaccccatgtgggcctgggattggaaacacgcaccgagacctggatgagctccgagggggcatggaggcagatccagaaggtggaaacctgggccttgcgccaccccgggttcaccgtgatcgcactattcctagcgcacgccatcggcaccagcattacgcaaaaggggataattttcatcctgctgatgctcgtgacgcctagcatggcaatgcggtgtgtcggcattggcaaccgcgacttcgttgaaggcctcagcggcgctacgtgggtggacgtcgtgctggaacacggctcctgcgtaaccaccatggctaagaataagcccaccctcgacattgaactgcttaagacagaggtcaccaaccccgcggtgctgcggaagctttgcatcgaggcaaaaatcagcaacactaccacggactctcgctgccctacccagggtgaggcaactctggtcgaggaacaggacgccaacttcgtctgccggcgcactttcgtcgatcggggatggggaaatggctgcggcctcttcggtaaagggagcttactgacgtgcgccaaattcaagtgcgtgaccaagctcgagggcaagatcgtccaatacgagaacctgaagtactccgtgattgtgacagttcacacgggcgatcagcatcaggtgggcaatgaaacaactgagcacggcaccatcgctaccatcacgccacaagcgcctacgagcgagatccagctaaccgactacggggccctcaccctcgactgtagcccgcgcaccggcctggatttcaacgagatggtgctcctgacgatgaaagagaagagctggttggtccataagcagtggttcctagacctgccgctgccctggacttccggggccagcaccagccaggagacttggaaccggcaggacctcctggttacgttcaagaccgcccacgcgaagaaacaggaagtcgtggtgctgggctcccaggagggcgcaatgcacaccgccttgaccggggccacggagatccaaacgagtggcaccaccaccatcttcgcagggcacctgaagtgccgtctgaagatggataagctcaccctgaagggcgtttcgtacgtaatgtgcaccggaagcttcaagctggagaaagaggtggcggaaacccagcacggcacggtcctggtccaggtgaagtacgaaggcactgacgcaccctgcaagatcccaatcagcacccaggacgagaaaggggtcacccagaacggccgtctcatcacggctaacccaatcgtgaccgacaaggagaaacctgtgaacatagagactgagccgccctttggcgagtcctacatcgtaataggcgctggcgagaaggcactgaagttatcctggttcaagaaggggtctagtataggcaaaatgttcgaggcgaccgctcgcggcgccagacgcatggccatcctcggcgacacggcgtgggacttcgggtcgatcggcggagtgttcacctccgtcggcaaactggtgcaccaggtgttcggcaccgcctatggggttctgtttagcggcgtcagctggaccatgaagatcgggattggaatcttactgacgtggctgggcctcaacagccggtccaccagcctgtcaatgacctgtatcgctgtggggatggtaaccctgtatctcggcgtgatggtacaggccgacagcggttgcgttatcaactggaagggtagggagctgaaatgcgggtccggaatcttcgtcacaaacgaggtgcacacctggaccgaacagtacaaatttcaggcagactctccgaagcgattgtcagcggccatcggcaaggcatgggaggagggggtgtgcggcatccggtccgccacccgcttggagaacatcatgtggaagcagatcagcaacgagctgaaccacatcctgctcgagaacgacatgaagttcaccgtcgtggttggtgacgcgaacggcatcctgactcaggggaagaagatgatccgaccacagcccatggagcacaagtactcctggaagtcctggggcaaggcaaagataatcggggccgatacccagaacacgacctttatcatcgacgggccagacacgcctgagtgccccgacgaccaacgggcatggaacatctgggaagtcgaggactacggttttggggtgttcacgaccaacatctggctgaagctcagagactcctatacacaaatgtgtgaccaccgcctgatgagcgccgcgatcaaggactcaaaggcggtgcacgccgacatgggctattggattgagagcgagaagaacgaaacgtggaagttagcacgggcctcgttcattgaagtcaagacctgcatctggcccagaagccacacgttatggtccaacggcgtgcttgagagcgagatgatcatccccaagatctacgggggcccgatctcccagcataactaccggccgggttactttacccagaccgcgggaccctggcatctagggaagctcgagctggacttcaacctgtgtgaggggaccaccgtggtcgtggatgagcactgcgggaacaggggtcccagcctcagaaccacgaccgtgaccggcaagatcatccacgagtggtgttgccgctcatgcactttgccgccactacggttcaagggggaggacggatgctggtacgggatggagatccgccccgtgaaggagaaggaggaaaacctcgtgcggagcatggtgtctgccggcagcggcgaggttgactcgttctccctggggctgctctgtgtaagcattatgatagaggaggtgatgcggtctcggtggtcgcgcaagatgctgatgacggggaccctggccgttttcttcttgttaattatggggcaactgacttggaacgacctaatccgactgtgcataatggtgggggccaacgtgtccgataggatgggaatgggaacgacatacctggcccttatggcgacattcaagatgcgccccatgttcgccgtcggactgctctttcggcgcctaacctcccgggaggtgctgctgcttacaatcgggctgtcactggtcgccagcgtggagctccctaactccctggaggagcttggcgacggactcgcgatgggtatcatgatgctgaagctgctcactgacttccaatcacatcagctgtggaccaccctgttatccctgaccttcataaagacgacgctgagcctcgactacgcctggaagaccatggctatggtgctatccatcgtcagcctgttccccttatgcctatccaccacgtcgcagaagacaacctggttacctgtactcctgggctcctttgggtgcaagccgttgaccatgttcttaataaccgagaataagatctggggccgaaagagctggcccctgaacgaagggataatggcggttggcatagtcagcatcctgctctcatctctgctgaaaaacgacgtgcccctcgccgggcccctgatagccggcggtatgcttatcgcgtgctacgttatctccgggtcgtcagccgacctcagcctggaacgggccgcggaggtctcgtgggaggaggaagcggagcactcgggcgcctcccataacatcctggtggaggtgcaggatgacggaacaatgaagattaaggacgaagagcgcgacgacaccctcaccattctgctgaaggccactctcctggcagtaagcggggtgtacccgatgtcgatccccgccacgctgttcgtgtggtacttctggcagaagaagaagcagcggtcgggggtcctctgggacacccccagcccgcccgaggtcgagagagcggtgttggacgacggcatttaccggatcctgcagagaggtctgttggggcgtagccaagtaggcgtgggggtattccaggacggagtctttcacacaatgtggcacgtgacacgcggggcggtgctgatgtatcaaggcaaacgtctggaaccctcctgggcctcagtgaagaaggacctcataagttacggcgggggctggcgcttccaggggtcgtggaacacgggcgaagaagtccaggttatcgctgttgagcccggtaagaaccccaagaacgttcagaccacccccggtaccttcaaaacaccggagggggccgtgggcgcgatcgcgttagacttcaaacccggaacctccggaagccccatcgtcaatcgggagggcaagatagttggcctctacgggaacggcgttgtcaccacctccggaacgtacgtaagtgcgatcgctcaggcaaaggccagccaagagggtccactccccgagatcgaagacgaagttttcaagaagagaaacctgaccatcatggacctacaccccgggtccggcaagacccgtcgctacttaccagcgatagtccgggaggcgatcaagcgcaagttaaggaccctgatactcgcacccacgagggtggtggcgagcgaaatggcggaggcactgaagggcatgcccattcgctatcagaccaccgccgtcaaatccgagcacactggaaaggagatcgtggatttaatgtgtcacgctacgtttaccatgcggcttctgtctcccgtgcgcgtcccgaactacaacatgatcataatggacgaggcccacttcactgatccggcatccatagccgcgcggggctatattagcacccgggtgggtatgggtgaagccgccgcgatcttcatgacggctacgccacccgggtccgtggaagctttcccacaatcgaacgcagtgatccaggacgaggaacgggacataccggagcgctcctggaacagtggctacgactggatcaccgacttccccggcaagaccgtgtggtttgtacccagtatcaaatccggtaacgacatcgccaactgcctgcgtaagaatggcaagcgcgtaattcagttatcccggaagacgtttgacaccgagtaccagaagacgaagaacaacgattgggactacgtagtgacgacggatatctcagagatgggtgcgaacttccgcgccgatcgggtcatcgatccccgccggtgcctgaagccggtgatcctgaaggacggccccgaacgcgttatcctcgccggcccaatgccagtcaccgccgcgtccgcggcccaacggcgtggcaggatcggccgcaaccaaaacaaggagggggaccagtacatctacatgggccagccactgaacaatgatgaggaccacgcgcactggaccgaggccaagatgctgctggacaacatcaacacccccgaggggatcatccccgcattgttcgaaccggagcgcgagaagtctgctgccattgatggcgagtaccggttacgaggggaggcccggaagacgtttgtcgagctcatgcgcagaggcgatctgcccgtatggctgtcctacaaggtagcctcggaaggcttccagtattccgaccgccggtggtgcttcgacggggagcgtaacaaccaggtgctcgaagagaacatggacgtagaaatttggaccaaggagggcgaacgcaagaaactgcgcccccggtggctggacgcgcgcacctacagcgacccccttgcactgagggaatttaaggagttcgccgccgggcgccggtctgtgtcgggcgacctgatcctcgaaatcggcaagctaccgcagcacctgaccctccgcgctcagaacgcgttggacaatctggtgatgttacacaatagcgagcagggcggaaaggcctaccggcacgcaatggaagagctgcccgacaccatcgagacgttaatgctcctggcactgatcgcggtcttaaccggaggagtgaccttgttcttcctgtccgggaagggcctcggcaagacgagcatcgggctcctgtgtgtgatggcctcctcagtactcctgtggatggcctctgtggagcctcactggatcgccgccagcatcatcctggagttcttcttaatggtgctgctgatacccgagccggaccgccaacggacgccccaggacaaccaactcgcgtacgtcgttatcggactcctgttcatgatcctaaccgtggcggccaacgagatggggctgctggagaccaccaaaaaggacctcgggattgggcacgtcgtggctgagaaccaccaccacgctacgatgctggacatcgacctacaccccgcgtccgcctggaccctctacgcagtggccaccacaatcataacaccgatgatgcgccacaccattgagaacaccaccgccaacatctcactgacggcgatcgctaaccaagccgccatcctcatgggcttagacaagggctggcccatttccaagatggacatcggggtaccgctgctggccctaggctgctactcacaggtaaaccccctgacgctgaccgcggctgtgctaatgctagttgcccactacgcgatcatcggaccgggcctgcaagcgaaggccacaagggaagcccagaagcgcactgctgctggcatcatgaagaatccgactgtggacggtatagtggcaatcgacctcgaccccgttgtgtacgacgccaagttcgaaaagcagctcggccaaataatgctcctcatcctgtgcacctctcagatcctgttaatgagaactacatgggccttatgcgagagcatcacgctggctaccggacccctgaccactctgtgggagggctcccccgggaggttctggaacactaccatcgcggtcagtatggcgaacatctttcgcggctcctacctggccggggccgggttggcattctcactgatgaagtccctgggagggggacggcgcgggactggcgcccagggagaaacgctgggtgagaagtggaagaggcagttaaaccagctgagcaagagcgagttcaatacatataagcgttcaggtatcatggaggtagatcggagcgaggccaaggaagggctcaagcgcggagagaccaccaagcatgccgtgtcccggggaacggctaagctgaggtggttcgtggagcggaatttggtcaaacccgagggcaaggtgatcgacctgggctgcgggcgcggcgggtggagctactactgcgccggcttaaagaaagtgaccgaggtcaagggatacaccaagggcggccccgggcacgaggagcccatcccaatggcgacttacggctggaatatcgtgaagctgcacagcgggcgggacgtcttcttcacgccgccagagaagtgtgacacgctgctttgtgacatcggcgaatcatccccgaacccgacgatcgaggaagggcgcaccctaagggtcctgaagatggtggaaccctggctccgcgggaaccaattctgtattaaaatcttgaatccctacatgccctcagtggttgagacactggagcagatgcagcggaagcatggggggatgctggtgcggaatccgctgtcccggaactctacgcacgagatgtactgggtgtcatgcggcaccggtaacatagttagcgcggtaaatatgacctcccgcatgctgctcaaccgctttaccatgacgcaccggaagcccacctacgaacgcgacgtagacctgggcgccggtacccgacacgtcgccgttgagcccgagatcgccaacctggacattatcggtcagcgcatcgaaaatatcaagaacgagcacaagagcacctggcactacgacgaggataacccgtacaagacgtgggcttaccacggctcctacgaggtcaagccgtcgggttccgcctcatccatggtgaacggcgtggtacggctcctgacgaagccatgggacgttattcccatggtgacccagatagccatgacagacacgacacctttcgggcagcaaagggtcttcaaagagaaggtggataccaggacgccgcgtcctaagcggggcaccgcccaaatcatggaggtcaccgccaagtggctgtggggattccttagccgcaacaagaagccccggatttgtacccgcgaggaattcacacgaaaggtccgctcaaacgctgccatcggggccgtgtttgtggacgagaaccagtggaacagcgccaaggaggcggtggaagatgagcggttctgggacctggtgcaccgcgagcgggagctgcacaagcagggaaagtgcgcgacgtgcgtgtacaacatgatgggcaagcgcgaaaagaagctcggcgagttcgggaaagcgaagggtagccgggccatctggtacatgtggcttggcgctcgcttcctggagttcgaagcgttggggtttatgaacgaggaccactggttttcccgggagaacagcctgtctggcgtcgaaggtgaggggctgcataagttagggtacatcctgcgggacataagcaaaatcccgggcggcaatatgtacgccgatgacaccgccggctgggacacccgaatcactgaggacgatctgcagaacgaggcgaagatcacggatatcatggaacccgaacacgccctcttagcgacctccatcttcaaactcacctatcagaacaaggtggtgcgcgtccaaaggcccgccaagagcggtacggtgatggacgtgataagtcgtagggaccagcgagggagcggccaggtcggcacgtatgggctgaacaccttcacgaacatggaggtgcagctgattcgccagatggagagcgagggcatcttcagcccatcagagctggagaacagcaacctcgccgaaagagtcttggattggctggagaagcacggtgtcgagcgcctcaagagaatggccatctccggcgacgactgcgtcgtgaaacctaccgatgaccgcttcgccactgccctgacagccctgaacgacatggggaaggtccggaaggacatcccccagtgggagccctcaaagggctggaacgattggcagcaggtcccattctgctctcaccacttccaccagctcatcatgaaggacggtcgcgagatagtggtcccgtgccgaaaccaggacgagctggtggggcgcgctcgggtttcacaaggagcagggtggagcctgagggagacagcctgtctgggtaaatcctacgctcagatgtggcagctgatgtacttccaccggcgcgacctgcgtctcgccgccaacgcgatctgcagcgccgtccccgtggactgggtcccgacctcccgaaccacgtggagcatccacgcgcatcaccaatggatgaccaccgaggatatgctgtctgtctggaatcgtgtgtggatcgaggagaacccttggatggaagacaaaacccacgtatcatcctgggaagatgtcccgtacctagggaagcgggaagatcagtggtgtggcagcctaataggcctgacggctcgcgccacctgggcaaccaatatccaggtggcgatcaaccaggtgcggagattgattgggaacgagaactatttggactacatgaccagcatgaaacggttcaagaatgaaagcgactccgaaggcgccctctggtga

SEQ ID NO: 24720 - RNA, 9879 nt, synthetic construct
  misc_feature 1..9879: note = derived and/or modified CDS sequence (opt11) from DENV-1__JQ692085__SS-prME
  source 1..9879: mol_type = other RNA
agcgttacgatgctgctcatgttactgcccactgcactggccttccacttgactaccagagggggggagccccatatgatcgtaagcaagcaggaacggggcaagagcttattgttcaagacctccgcgggggttaatatgtgcaccctgatcgccatggacctgggcgagctttgtgaggacactatgacctataagtgtccccggatcacagaagccgagccagacgacgtcgattgctggtgcaacgccacagacacctgggtcacatatgggacgtgtagccagaccggagaacaccggcgcgacaagcggtcggtggcgctggcgccccacgtgggccttggactcgagacccgtactgagacttggatgtcatcggaaggagcctggcggcagatccaaaaggtggaaacctgggccctgcgacacccaggattcacggtgattgcactgttcttagcgcatgccatcggcaccagcatcacccaaaaggggataatcttcatcctgctgatgctcgtgaccccttcaatggccatgaggtgcgtcggcatcggcaatcgcgacttcgtggagggcctcagtggcgccacctgggtcgacgtcgtcctggaacatgggtcctgcgtgacaaccatggccaaaaataagccgaccctcgacatcgagctgctgaagacggaagtaacaaaccccgcggtcctccgaaaactgtgcattgaggcgaagatctctaacaccacgacagactcccgctgcccaacccagggcgaggccaccttggtggaggagcaggacgctaacttcgtgtgccgccggaccttcgtggacaggggttggggaaatggctgtgggctcttcgggaagggtagcctgctgacatgtgcgaaattcaaatgcgtgacaaaactagaaggcaagatcgtgcagtatgagaacctaaaatacagtgtgattgtgacagtccatacaggtgaccagcaccaagtaggtaatgaaacgactgagcacggcacgatcgcgaccataacgccccaggccccgacctctgagatccagcttactgactatggggctctcactctggactgttccccccggaccggtttagattttaatgagatggtgctcctgacgatgaaggagaagtcctggctggtgcacaaacagtggtttttggaccttcctctgccgtggacctctggtgccagcaccagccaagagacctggaaccgccaggatctcctggtgacgttcaagactgcccacgcgaagaagcaggaggtcgtggtactgggcagtcaagagggagccatgcacaccgcgttgaccggcgccacggagattcagacgagcggcaccaccactatctttgccgggcacctgaagtgccgcttaaagatggataaactcaccctaaagggcgtatcttacgttatgtgcacgggcagcttcaagctagagaaggaggtagcggagacacagcacgggacggtcctggtccaggtgaagtatgagggcacggacgccccctgcaagatccccatatccacccaggatgaaaaaggggtcacccaaaacggccggttaataactgcgaatccgatcgtgaccgacaaggagaagcccgttaacatagaaaccgagcctccctttggggaatcgtacattgtcataggcgctggcgaaaaggcactaaaactgtcgtggtttaagaaggggagctccatcgggaaaatgttcgaggccaccgcccgcggagcccggaggatggccatccttggagacaccgcgtgggactttgggagcataggaggagttttcacaagtgtaggaaagctggtacatcaagtgttcggtaccgcgtacggggtgctgttctcaggcgtgtcgtggaccatgaagattgggataggcatcctcctgacgtggctgggcctcaactcccgctcaaccagcctgtccatgacctgcatagcggtcgggatggtgactctctacctaggcgtcatggtgcaggccgactctgggtgcgtgatcaattggaaggggagggagctgaagtgtggcagtgggatcttcgtcacaaacgaggtacacacttggaccgaacagtataagttccaggcagacagcccaaagcgcctgagcgcagcaatcggtaaggcatgggaggagggggtgtgcggcatacggtccgccacgaggctcgaaaatatcatgtggaaacagatctcaaacgagttgaaccacatcctgctagaaaacgacatgaagttcacggtggtggtcggggatgccaacggcatcctcactcaaggaaagaagatgatccggccccagcccatggagcacaaatatagctggaagagttggggcaaggcgaaaataatcggcgccgatacgcaaaacacaaccttcattatcgacggccccgacacgccggagtgccccgacgaccaaagagcctggaatatctgggaggtcgaggactacggtttcggtgtatttacaacaaacatctggttgaagctccgggattcctacacccaaatgtgcgatcatcgcctgatgagcgccgccatcaaggactcaaaagccgtgcatgccgacatggggtactggatagagagcgagaagaacgagacttggaagctggctcgggcgtcctttatcgaggtaaagacttgcatctggccccggagccacaccctctggtccaatggtgtgctggagagcgagatgatcattcctaagatatacgggggcccgatctcccagcacaactacaggcccgggtacttcacccagacggcgggcccctggcacctcgggaagctcgaactggacttcaacctgtgcgaaggcacgaccgtagtagtggacgagcactgcggcaatcgtggtcctagcttacggaccacgacggtaacaggcaagatcatccacgaatggtgctgccgctcgtgcaccctgccccccctccggtttaggggggaggacggttgctggtatggtatggagataagaccagtgaaagagaaggaggaaaacctcgtccgttcgatggtgtccgctggctcgggagaggtcgatagcttcagcctggggttgctgtgcgtgagcattatgatcgaggaagtgatgcggagcaggtggagccggaaaatgctgatgacgggcactcttgcggtcttcttcttactaattatggggcagctgacctggaacgacctgatacggctgtgtataatggtgggcgccaacgtctccgatcggatgggtatgggcaccacctatctggcccttatggcgaccttcaagatgcggccgatgtttgccgtggggcttctgttccgacggttaaccagccgtgaagtgttattactaaccatcgggttatccttggttgcatcagtggagctcccaaactcgctcgaagagctgggcgatgggctagccatgggaattatgatgctgaagttgctaacggatttccagagccatcagctgtggaccaccctgctatccttaaccttcatcaagacgacccttagccttgactacgcgtggaaaaccatggcgatggttctgtcgatagttagcctgtttcccttgtgcctgtccaccacaagccagaaaacgacctggctaccagtgctccttggctcctttggctgcaagccgttaacaatgttcctcatcaccgagaacaagatctggggccgaaagtcgtggcccttgaacgaaggaatcatggcggttgggattgtttccatcttactctctagcttactgaagaatgacgtgcccctcgccggtcccctgatcgctggcggcatgctgatcgcatgctacgtgatatccgggagctccgcggacttgagtctggagcgcgccgcagaggtctcctgggaggaagaagcggaacatagcggagcgtcccacaacatcctggtcgaggtgcaggacgacgggacgatgaagattaaagatgaggaacgagatgacaccctcactattctgctgaaggccaccttactggccgtgagcggggtttacccaatgtccattcccgctacgctgttcgtctggtacttttggcagaagaagaagcagcgcagcggcgtcctctgggatacgccaagtcctccggaggttgagcgggccgtgctagatgacggcatctaccgcatcctacagcgcggcctgctcggacgaagccaggtcggggtgggggtttttcaagacggtgttttccataccatgtggcacgttacaaggggcgcggttctgatgtaccagggcaagcgcctcgagccctcgtgggccagcgtcaagaaagacttaatatcctacgggggtggctggcggtttcaaggcagctggaacacgggagaggaggtccaggtcatcgccgtggagcccgggaaaaatcccaaaaatgtgcagaccacccccggaacattcaaaacacctgagggcgctgtgggcgccatcgccttggactttaagcccggcacatcaggaagtcccatcgttaaccgcgagggcaagatagtgggcctatacgggaatggggtcgttacaacctccggcacatacgtaagcgccattgcccaggccaaggcgtcgcaggaaggcccgctacccgagattgaagacgaggtgtttaaaaagcgaaacttgaccatcatggatctgcatccagggtcaggaaaaacccgtcggtacctcccggccatcgtccgcgaggccatcaaacgcaaactgcggacactgatcttggcccccacgcgcgttgttgccagcgagatggcggaagctctgaagggaatgcccatacggtatcagaccaccgcagtcaagtctgaacacaccggtaaagagattgtggacctcatgtgccatgccacgttcaccatgcgcctccttagtcccgtgcgggtgccgaattacaacatgatcatcatggatgaggcacacttcaccgatcccgcgtcgatcgccgcccgtggttacatcagtaccagagtagggatgggggaggccgccgcaatctttatgacagccacgccccccgggtcggtagaggcctttccgcaatcaaacgcggtcattcaagacgaagagcgagacatcccagagagatcctggaactccggttatgactggatcaccgacttccccggcaagacggtgtggttcgttccatccatcaagtctggcaacgacatcgccaactgtctgcgcaagaacggtaaacgtgtgatccagctctcgcgcaagacgtttgacaccgaatatcaaaagaccaagaacaacgattgggactacgtggttacaaccgacatatcagagatgggggcgaatttcagggccgatcgggtgatcgacccgcggcgctgcctcaagcccgtcatcctaaaggacggccccgagcgggtaatactcgccggtcccatgccggtgaccgccgcgagcgccgcccagcgccgggggcgcatcgggcggaatcagaacaaggaaggggatcagtacatttatatggggcaacccctgaacaacgatgaggaccacgcgcattggacagaggcgaagatgctgctcgacaatatcaacacccccgaggggattatcccggcgctcttcgaacctgaacgtgaaaaatcagctgccatcgatggcgaataccgcctccgcggggaggcccgcaagactttcgtcgagctcatgcggcggggagacctgcctgtttggctgtcatataaggtggctagcgaggggttccagtactcagaccggagatggtgctttgacggggaacgaaacaaccaggtgctagaggagaacatggacgttgagatttggacaaaggagggcgagcgcaaaaaactgcggccacgctggctggacgcgcggacctacagcgatcccctcgctctccgcgagttcaaggaattcgccgccggacggcgttctgtatccggtgacctaatcctcgagatcgggaaactgccgcagcacctgacattgcgggcccagaacgcattagacaacctggtgatgcttcacaatagcgagcagggtggcaaggcataccgccatgccatggaggagctgccggacaccatcgagacactgatgttattagccctgatagctgtcctaaccgggggcgtcactctgttcttcctgtccgggaaagggctcggcaagaccagcatagggctcttatgtgtgatggcctccagcgtcttgctgtggatggcaagcgtggagccccattggatagctgccagcataatactggagttcttcctcatggtcctgctaatccccgagccggaccggcagcgcacaccccaggacaatcagctcgcttacgttgtcatcggccttctcttcatgattctcaccgtggccgccaacgagatgggactgctggaaaccacaaagaaagacttgggaatcgggcacgtagtggctgaaaaccaccaccacgccacaatgttagacatcgacctgcacccggcgtccgcctggaccctgtatgccgtggccacaaccattataaccccaatgatgcggcacaccatcgaaaatacgaccgccaatataagtctgacggcgatagccaatcaggcggccatcctgatgggcctcgacaaggggtggcccatctcgaagatggacattggggttccgctgcttgccctcggatgctacagccaagtgaaccctctgaccttgaccgcggctgtgctgatgctcgtcgcacactacgcgattatcggcccgggcctccaggcgaaggccacccgtgaggcccaaaagcgcacggccgctggcatcatgaagaaccccaccgtcgacggcatcgtggctatcgacctcgaccccgtggtgtatgacgccaagtttgagaagcagctgggccagatcatgctgcttatcctatgtacctcccagatcctgttgatgcggaccacgtgggcgttatgcgaatcaatcaccttggctaccgggcccctaacaaccctgtgggagggctcccctggtcgtttttggaataccacaatcgcggtttcgatggctaacatcttccgtggctcctacttggccggcgccgggctcgccttcagcctgatgaagtccctgggcggggggagacgggggaccggcgcccagggagaaacgcttggagaaaagtggaagcgccagctgaaccagctgtctaagagcgagttcaatacctacaagcggtctggcattatggaggtcgatcggagtgaggctaaagagggactcaagcggggcgagaccaccaaacacgcagtgtcccgggggacggctaagctgcggtggttcgtggagcgcaacctggtaaaaccagaggggaaggtgattgacttgggctgtggccggggagggtggagttactactgtgcaggccttaagaaagttacagaggtcaagggttacaccaagggcgggcccggtcatgaggagcccatccctatggcgacatacggctggaacatcgtgaaacttcactccgggcgagacgtgttcttcacgccgcctgagaagtgcgacacgctgctctgcgacattggcgaaagctcaccaaatccgaccatcgaggaagggcggaccctccgcgttctgaagatggtcgagccctggctccgcggcaaccagttttgcatcaaaatcctgaatccatacatgcccagcgttgtcgagaccctagagcagatgcagcggaagcatggcgggatgctggttcggaacccgctgagccgaaactcaacccacgagatgtactgggtttcgtgcggtactgggaacatcgtcagcgccgtgaacatgacgtcccgcatgctgctcaaccgtttcacgatgactcatcggaagcccacctatgagagggatgtcgatctcggcgccgggacacggcatgtcgccgtggaaccggagatcgctaaccttgatataatcgggcaacggatagagaatatcaagaacgaacacaagtccacctggcactacgacgaagacaacccttataagacatgggcataccacggttcctacgaagttaagccgtcaggcagcgcgtcgtccatggtcaatggggtagtcaggctcttaacaaagccctgggatgtcattccgatggttacccagatagccatgaccgacactaccccctttggacagcagcgggtcttcaaggagaaagtggacaccagaaccccgcggccaaaacgtgggactgcgcagatcatggaggtaaccgccaagtggctgtgggggttcctaagccggaacaagaagccccgaatttgtaccagagaggagttcacacgcaaggttcggagcaatgcggccgtgggcgcagtattcgttgacgaaaaccagtggaatagcgcaaaggaggccgtggaggacgagcgcttctgggacttagtacaccgagaaagggagctccataagcagggcaagtgcgcaacgtgtgtctacaacatgatggggaagcgggagaaaaagctcggcgagttcgggaaggccaagggcagcagggccatctggtacatgtggctcggcgcgaggttcctagagttcgaagcactcgggtttatgaacgaagatcattggttctcgcgcgaaaattcactgtccggcgtagagggagaaggcctccataagttaggctacatactgcgcgacattagtaagatccctggcggcaacatgtacgcggacgacaccgcagggtgggacacccgcataaccgaggatgacctgcaaaatgaggccaagatcaccgacattatggagcccgagcacgcactcctggcgaccagtattttcaagctgacctaccaaaacaaggtagtcagggtgcagcggcccgcaaagtcaggcaccgtgatggacgttatttccagacgggaccaacgcgggagcggccaagtaggtacttacggcttaaacacattcacaaacatggaggtgcagctgatacgacaaatggagtcggaaggtatttttagccccaatgaactcgaaaactccaacctcgcagagcgggtgttagactggttagagaagcatggggtggagcgtcttaaaaggatggcgatcagcggtgatgactgcgtcgtcaagccgactgatgaccggttcgcgaccgctttaaccgccctcaacgatatgggaaaggtccgcaaggatatcccccagtgggaaccctccaaaggctggaacgactggcagcaggtccctttctgcagccaccactttcaccagctcatcatgaaagacggccgggaaatagtggtcccctgtcgcaaccaggatgaactggtggggcgagcccgcgtgtcccagggagcggggtggtcgctgagggagacagcatgtctgggtaaaagctacgctcagatgtggcaactgatgtacttccaccgcagagacttacggttagctgctaatgccatctgctcagccgtccccgtggattgggtgccgacgagccgcaccacctggtccatccatgcacaccaccagtggatgacgacggaggacatgctgtctgtttggaatcgggtatggatcgaggaaaacccctggatggaagacaagacccacgtctcgagctgggaagatgtgccgtacctagggaaaagggaggatcaatggtgtggctccctcattggcctgacggcacgggccacctgggcgacaaatattcaggtggcaatcaaccaagtacggcgactcatcgggaacgagaattatttggattacatgacgagcatgaagcgcttcaagaacgagagtgactccgagggagccctgtggtga

SEQ ID NO: 24721 - RNA, 9879 nt, synthetic construct
  misc_feature 1..9879: note = derived and/or modified CDS sequence (opt11) from DENV-1__JQ917404__SS-prME
  source 1..9879: mol_type = other RNA
agcgttaccatgcttctcatgctgctacccactgccctcgccttccaccttaccaccaggggcggggaaccccacatgatcgtgagcaaacaggaacggggcaagagcctcttattcaaaacctccgcgggggtgaacatgtgcaccttaatcgccatggacctgggcgagctctgcgaggacaccatgacctataagtgtccgcggatcaccgaggccgagcccgatgacgtcgactgctggtgtaatgccaccgacacctgggtcacctacgggacctgcagccaaaccggggagcaccgtcgcgacaagcggtccgttgccttggcacctcacgtaggcctagggctcgagactcgcaccgagacctggatgagctccgagggcgcctggcggcagatccagaaggttgagacctgggccctgcgccacccggggtttacggtaatcgccctcttcctcgcccacgctatcggcacgagcatcacccagaaggggatcatcttcatattattaatgctcgtaaccccatccatggccatgcgatgcgtcggcattgggaacagggatttcgtggagggcctttcgggcgccacgtgggtggacgtcgtcctggagcacgggtcctgcgttaccaccatggcgaagaacaagcccaccctcgacattgagctgctcaaaacggaggtcaccaaccccgcggtgctacggaagctatgcatcgaagccaaaataagcaacacgaccacggactcccggtgccccactcaaggtgaggccaccctggtggaggagcaagacgcgaacttcgtgtgccggcggaccttcgtggaccggggctggggaaatgggtgcggtctcttcggcaaggggagcctgctgacatgcgccaagttcaagtgcgtaaccaagctcgaaggcaaaatagtgcagtacgaaaacttaaaatactctgtgatcgttaccgtccacaccggcgaccagcatcaggtggggaatgagacgaccgagcacggtaccatcgcgaccatcacgccgcaagcgcccacgagcgagattcaactgaccgactacggggccctcacgctggactgctcgccccggaccggcctagatttcaacgaaatggtcctcctgacgatgaaggaaaagagctggttagtccacaaacaatggttcttggacctgccgttaccctggaccagcggggcgagcacctcacaggagacttggaaccgtcaggacctcctcgtaacctttaagacagcccatgcgaaaaagcaggaggtagtggtgcttggctcgcaagaaggagcgatgcacactgcgctcaccggggccacagagatccagacttctgggaccactacgatcttcgcggggcacttgaagtgcagactgaagatggataagctcaccctgaaaggcgtctcttacgttatgtgcaccggttccttcaaactggagaaagaggttgcggagactcagcacggcacggtgctagttcaagtgaagtacgagggaaccgacgcaccctgcaagatccccatctccacgcaggacgaaaagggggtcacccagaacggtcggctcatcacagccaacccgatcgttactgacaaggagaagcccgtgaacatcgagaccgagccccctttcggcgaaagctacatcgtcatcggcgccggggagaaggcactgaaactgtcctggttcaagaaggggagctccataggaaagatgtttgaggcaacggcccggggagcccgacgaatggccattctcggcgatacggcgtgggacttcgggtcaatcgggggtgtgttcacatcagtggggaaactggttcaccaggtgttcggcacggcatacggggtgctgtttagcggcgtctcctggaccatgaagattgggataggcatcctcttgacgtggctggggctcaactctcgctctaccagcctgagtatgacctgcatcgccgtagggatggttaccctgtacctcggcgtcatggttcaggccgacagcgggtgcgttatcaattggaagggacgggaactgaagtgcggatccgggatcttcgtcacgaatgaggtgcatacatggaccgaacagtataaatttcaagccgattcaccgaagaggctctcggcggccatcggcaaagcctgggaggagggtgtgtgtggcattcggtccgccactcgccttgagaatataatgtggaagcagatcagcaacgaactgaaccacatcctgctcgagaatgatatgaagttcaccgtcgtggtcggggacgccaacggaatactgacacaggggaagaaaatgattcggccccagcctatggaacacaagtactcctggaagtcgtggggcaaagctaagattattggcgccgatacccagaacaccacatttatcattgatgggcccgatacgccggaatgtcccgatgaccagcgcgcctggaatatctgggaggtcgaggactacggattcggggtgttcaccaccaacatctggctgaagctccgagactcctacacccagatgtgcgaccaccgtctgatgagcgcggccataaaggactccaaggccgtgcatgccgacatgggctattggatcgagagcgaaaagaacgagacttggaaactggcccgggccagcttcatcgaggtcaagacctgtatctggcctcgctcacacaccttgtggtcaaacggcgttctagagagcgagatgattatcccgaagatttacggcggccctatctcccagcacaattatcgtcccgggtacttcacccagacggcgggtccctggcacctggggaagctagagctcgacttcaatctgtgcgagggcacaaccgtggtcgtggatgagcattgtggcaaccgcggcccaagcctccgcacaacgaccgtgaccggtaaaatcatccacgagtggtgttgccgctcctgcaccctgccacccctgcgattccgcggggaagacggctgctggtacgggatggagatccggcctgtcaaggagaaagaggaaaacctcgttcgcagcatggtgtccgccggcagcggcgaggtcgacagctttagtctggggctgctctgtgtgtccatcatgatcgaggaggtgatgcggtcccgctggagccgcaagatgctgatgacgggcacgctggccgtatttttcctactaataatgggccagctaacctggaacgatttaattcggctttgcatcatggtgggcgctaatgtgtccgatcggatggggatgggaacaacgtatctagccctcatggcgaccttcaagatgagacccatgttcgccgtcgggttgctctttcgccggctcaccagccgcgaagtgctgctgctcaccatcgggctgtcgctggtagcgagcgtggagctcccaaactccctggaggaactgggggacgggctcgccatgggcatcatgatgctgaagctgctcacagattttcaatcgcaccagctgtggacgaccctgctctccttaaccttcattaagacgacgctgagcctagactacgcgtggaagacgatggcgatggtgctgtccattgtctccctcttccccttgtgcctgtccaccacgtcccaaaagaccacctggttacccgtgctactgggctccttcggttgcaagcctctgaccatgttcctaatcaccgaaaataagatatggggccgcaaatcttggcccttaaacgaggggattatggccgtgggcatcgtctccattcttctctcatcccttctaaagaacgacgtgcccctcgccgggccactgattgccggcggcatgctgattgcgtgctacgtgatctccgggagctccgctgatctcagcctcgagcgcgcggccgaggtctcttgggaggaggaagccgagcactcgggcgcgagtcacaacatactggtggaggtgcaggatgacggaactatgaagattaaggacgaagaaagggacgacaccctcacaatcctgctgaaggccaccctcctggccgtttcaggcgtgtacccaatgtctatcccagccacactcttcgtgtggtacttctggcaaaagaagaagcagcgcagcggggtcctctgggatacaccctcaccgcccgaggtggagcgggccgtacttgatgatgggatctaccgcattctgcagcgggggctgctcggccggagccaggtcggcgtgggtgtcttccaggacggcgtcttccacaccatgtggcacgttacccgcggggccgtgttgatgtaccagggcaagcggctggagccctcctgggctagcgtcaagaaagacctcatttcctacggagggggctggagattccagggcagctggaacacgggggaggaggtacaagtgatcgcagtagaacctgggaagaatccgaagaacgtgcagaccacccccggcactttcaagacccccgagggcgaggtgggtgcaatcgccctggacttcaaacccggcacctccgggtcacccatcgtcaaccgcgaggggaagatagtgggcctgtatgggaacggggtggtgaccacctccgggacctatgtctccgcgatcgcccaggccaaggccagccaggagggcccactacccgagatcgaagacgaggtgtttaagaagcggaacctgaccatcatggatctgcaccccggtagcggcaagaccaggcgttatttacctgccatcgtccgtgaggcgataaaaagaaagctgcgcaccctgatactcgcccccacgcgcgtggttgctagcgagatggccgaagcactgaagggcatgcccatcaggtaccagaccaccgccgtaaaatcggaacacacaggaaaggagatcgtggacctgatgtgccacgcgactttcacaatgcgcctcctgagtcccgtgagggttccaaactacaacatgatcatcatggatgaagcccatttcaccgaccccgcctccatcgctgcccgtggctacatcagcacccgggttgggatgggcgaggccgccgcgatatttatgacagcgacgccgcccgggtccgtcgaggccttcccgcaaagcaacgccgtgatacaagacgaagaacgggatatccccgagcgctcctggaacagcggctacgactggattactgacttccccggcaagacagtatggttcgtgccctccataaaatcagggaacgatattgccaattgtctgcgcaagaatggcaagcgggtcatacagctttcccgcaaaacgttcgacacagagtaccaaaagaccaagaataacgactgggactacgtggttaccacggatatcagcgagatgggggccaacttccgggcggacagagtcatagatccgcggcgctgcctgaaaccagtaatcctcaaggatggcccggaacgggtaatcctcgccgggccaatgcctgtgaccgccgcctccgcagcgcagcgccggggccgcatcggccgtaaccagaacaaggagggggaccagtacatctacatgggccagcctctgaacaacgacgaggaccacgcccattggacagaggccaaaatgctgcttgacaatattaacacccccgaggggatcattcccgccctgttcgagccggagcgcgaaaagtccgcggcgattgatggcgagtaccgccttcgcggggaagcccgcaagactttcgtagagttaatgcggcgcggcgacttacccgtctggctgtcctacaaagtggccagcgaaggctttcagtactccgaccgacgttggtgcttcgacggggagcggaacaaccaggttctcgaagagaatatggacgtcgagatttggacacgcgagggcgagcggaagaagctgcgcccccgctggttggacgcccgcacctactctgaccctctcgctctgcgggagttcaaggagtttgctgccgggcgccggtctgtttccggagacctgatcctcgagattggtaagctgccacagcacctgaccctcagagcccagaacgcccttgacaacctggtgatgctccacaacagcgaacagggcgggaaggcgtaccggcacgccatggaggaactgcctgacaccatcgagacgctgatgctcctggcgctgatcgccgtcctaaccggaggggtgaccctctttttcctgtccgggaaggggctaggcaagaccagcatcgggctgctttgcgtgatggcctccagcgtcctgctgtggatggcgtccgtggagccgcactggatcgccgccagcatcatactggaatttttcctcatggtactgctgatcccggagcctgaccgccagcggacgccccaggacaatcaacttgcctacgtcgtcatcggcctgctgttcatgatcctcaccgtggcagccaacgagatgggcctcctggagaccaccaagaaggacttaggcatcgggcacgtcgtggccgaaaaccatcaccacgccacgatgctcgacatcgatctgcaccccgcgtccgcgtggaccctctatgccgtggccaccaccattatcacgccaatgatgcgccacaccatcgagaacactaccgccaatatctccctgacggccatcgcgaaccaggccgccatattaatgggcctagacaagggctggcccatcagcaagatggacatcggggtgcccctgctggccctaggctgctatagccaggtcaaccccctgacccttaccgccgcagttctcatgctggtcgctcattacgccataattggaccgggactacaggccaaggcgacacgcgaggcgcagaaacggactgccgcgggaatcatgaaaaaccccactgtcgacggcattgtggccatcgacctagaccccgtcgtgtacgatgcgaagttcgagaagcagctggggcaaatcatgctgcttatattatgtacctcacagatcctactgatgcgcaccacgtgggccctatgtgaaagcattacgctggctaccgggccactcacgacgctgtgggaaggctcccccgggcggttctggaataccaccatcgctgttagcatggccaacatcttccgcggctcctacttagcgggcgcagggctcgccttcagtctgatgaagtccctcggcggagggcgtcgcgggactggagcgcaaggcgagacgttaggtgagaagtggaaacgtcagctgaaccagctgagcaaaagcgagttcaacacatacaagcgctccggcatcatggaagtggacaggagcgaggcgaaagaggggctcaagcgcggagagacgaccaagcacgcggtgtcccgggggacggcgaaactgcgatggttcgtggaacggaacctggtcaagcccgaaggcaaggttatcgacctgggctgcgggcgcggcggatggagctactattgcgcgggccttaagaaggtgacagaagtcaaggggtataccaagggcggccccggccacgaggagcccatcccgatggcgacctacggctggaacatagtgaaacttcacagcgggcgcgatgtgtttttcacgcccccggagaagtgtgacacgttactttgcgacatcggagagtcgtcacccaacccgaccatcgaagaggggcgcacgctacgggtattgaagatggtggagccctggctccgcggcaaccagttctgcatcaaaatcctgaacccatacatgccgagcgtggtcgaaacactggagcagatgcagcggaagcatggtggtatgctcgtacgaaacccgctttcacgaaacagcactcacgaaatgtactgggtgagctgcggcacagggaacatcgtctccgctgtgaacatgacatcccggatgctgctaaaccgcttcaccatggcccacagaaagcccacttatgagcgtgacgtggacttaggggcaggcacacggcacgtcgccgtggaacccgagatcgccaatctggatatcatcgggcaacgcatagagaacatcaaaaacgaacacaagagcacgtggcactacgacgaggacaacccctacaagacctgggcataccacggctcatacgaggtgaaaccgagcgggtcagccagcagtatggtgaatggtgtagtccggctattaacgaagccatgggacgtgattcccatggtgacccaaatcgccatgaccgacaccacgcccttcgggcagcagcgcgtcttcaaagagaaggttgacaccaggactccccgccccaaacggggcactgcccagataatggaagtgacggccaaatggctgtggggcttcctcagccgcaacaagaaacctcggatctgtacccgcgaggagttcacccgtaaggtcaggagcaacgcggctatcggggccgtttttgtggatgagaaccagtggaactccgcgaaggaggcagtcgaagacgagcggttctgggacctggtccaccgcgaacgggagctgcacaagcaggggaaatgtgcgacctgtgtgtacaacatgatgggcaaacgggagaagaaacttggcgagtttgggaaggccaaggggagccgggccatctggtacatgtggctgggagccagattcctggaatttgaggcgctaggtttcatgaacgaggaccattggttctcccgcgagaacagcctgtccggggtagaaggggagggactgcacaagctcggttatatcctgcgggacatcagcaagatcccaggcggcaacatgtacgccgatgacacagccgggtgggacacccgcatcacagaagacgacctgcagaacgaggctaaaatcaccgacattatggagcccgaacacgccctcttggccacgtctattttcaagctgacgtaccagaacaaagttgttagagtgcagcgccccgccaaaagcggcaccgtgatggacgtgatctcccggcgcgaccagcggggaagcggccaggttggcacatacggcctgaacacgtttaccaacatggaggtgcagctgatccgtcagatggagtccgaaggaatcttcagtccctccgaactggaaaactccaacctcgccgaacgtgtgctggattggctggagaagcacggggtggagcgactcaagcggatggccatctccggcgacgactgcgtggtcaagccgaccgatgatcgcttcgccaccgcgctgacggctttgaacgatatggggaaggtccggaaggatataccccagtgggagccaagtaagggctggaacgactggcaacaagtccctttctgctctcatcacttccaccagctcataatgaaagatggccgcgagatcgtcgtaccttgccggaaccaggacgagctggtgggccgcgcacgggtgagccaaggggccgggtggtctctgagagagacagcttgccttggcaaatcatacgcgcagatgtggcagctgatgtacttccatcgtcgcgacctgagactcgcggccaacgccatctgtagcgcagtacccgtgaactgggtgcccacctcacggacaacctggagcatccacgcgcaccaccaatggatgacgaccgaagacatgctttccgtgtggaaccgcgtctggatcgaagagaatccctggatggaagacaagacgcacgtgagtagctgggaggacgtaccttacctggggaagagagaggaccagtggtgtggtagcctcatcggcctgaccgcacgcgccacttgggctaccaatatccaggtcgcgatcaatcaagttcggcgcttaatcgggaatgagaattaccttgactacatgacttccatgaagcggttcaagaacgagtcagaccccgagggggcgctgtggtga

SEQ ID NO: 24722 - RNA, 9879 nt, synthetic construct
  misc_feature 1..9879: note = derived and/or modified CDS sequence (opt11) from DENV-1__GU370048__SS-prME
  source 1..9879: mol_type = other RNA
agcgtgacgatgctgctcatgctgatgccaaccgccctggcctttcacttgaccacccggggcggagaaccacacatgatcgtgagcaagcaggagcggggcaagagcctgctgttcaagaccagcgcgggggtgaacatgtgcaccctcatcgccatggacctaggcgagctgtgtgaggacacgctcacctacaagtgcccccggatcacggaagccgaacccgacgacgtagactgctggtgcaacgccactgacacgtgggtgacctacgggacctgcagccagaccggagagcaccggcgagacaaacggtccgtggccctggctccccacgtgggcttggggctcgagacgcgcaccgagacctggatgagctccgagggcgcctggaagcagatccagcgggtggagacttgggccctgcgccaccctgggttcacggtgatcgcactgttcctcgcgcacgccatcggcacgagcatcacccagaaggggatcatcttcatcctgttaatgctcgtgacgccgtccatggcgatgcgctgcgttggcatcggcagccgggacttcgtggaggggttgtccggggccacgtgggtggacgtcgtgctggaacacgggagctgtgtaaccacaatggcgaaggacaaacccaccctcgacattgaactgctgaagacggaggtcacgaacccagcggtcctccggaaactgtgcatcgaggccaagatctctaacaccaccacggacagcagatgtccgacccagggcgaggccaccctggtggaagaacaggacgccaacttcgtctgccggcgcaccttcgtggaccggggctgggggaacggttgcgggttgttcggaaaggggagcctgatcacgtgcgccaagttcaagtgcgttaccaagcttgaaggcaagatcgtccagtacgagaatctcaagtacagcgtgatcgtaaccgtccacaccggcgaccagcatcaggttgggaacgagagcacggagcacggtaccaccgcgaccataacgccccaggcccccacgaccgagatccagctgaccgactacggagcactgaccctcgattgctcaccccgcactgggctgaatttcaacgagatggtcctgctcaccatgaaggagaagtcttggttagtgcataagcagtggttcctggacttgccgctgccctggacttcaggggcctccaccacgcaagaaacctggaaccgacaggacctgctggtgacgttcaagacggcccacgctaagaagcaggaagtggtggtccttggctctcaggagggagccatgcacaccgccctgactggagctaccgagatccaaaccagcggcaccacaacaatcttcgccggccaccttaagtgccgcctgaaaatggacaaattaacactcaagggcatgtcctacgtcatgtgtacggggagtttcaagctggagaaagaagtggcggagacccagcatggcactgtgctagtccagattaagtacgagggcacggacgccccctgcaagatccccttcagcacgcaggacgagaagggcgttacccagaacggacggttaatcaccgccaatccgatcgtaacggataaagagaaacccgtcaacatagaggcggagccgcccttcggagagagctacatcgtgatcggcgcgggggagaaggccctcaagttatcctggttcaagaagggatcttccatcggcaagatgttcgaggccacggcccgcggggcccggagaatggcgattctgggcgacaccgcgtgggatttcggtagcattggcggtgtgttcaccagcgtagggaagctcgtacaccagatcttcggcacggcgtacggggttctcttctcgggggtctcctggacgatgaagatcgggatcggcgtgctgctaacctggctgggccttaacagccgctccacgtccctcagtatgacctgcatcgccgtgggcctggtcacgctgtatctcggggtgatggtgcaggccgactcggggtgcgtcattaactggaagggccgggagttgaagtgtgggtccggcatcttcgtaaccaacgaggttcacacctggaccgaacagtacaagttccaggcggacagcccgcgccggctttcggccgccatcggcaaggcctgggaggaaggtgtctgcggtatcaggtccgccacccggctcgagaacatcatgtggaagcagatcagcaacgagctgaatcacatcttactcgagaacgatatgaagttcacggtagtggtcggggacgtggccggcatcctggcccagggcaagaagatgatcagaccccagcccatggagcataagtactcgtggaaatcgtggggcaaggccaagatcatcggcgccgatgtgcagaacacgaccttcatcatcgacggtcccaacaccccggagtgccccgatgaccagcgggcgtggaacatctgggaggtcgaagactacggctttgggatctttacgaccaacatctggctgaagctccgtgactcatacacccaggtgtgcgaccatcggttaatgagcgcggccatcaaggactcaaaagccgtgcacgccgacatgggctactggatcgagagcgagaagaatgagacctggaaacttgcgcgcgcctccttcatcgaggtcaaaacctgtatctggcccaagagccacaccttatggtccaacggcgtgctggagagcgagatgataatccccaagatctacgggggcccgatctcccagcataactaccggcccgggtacttcacccagaccgccggcccctggcatctggggaaacttgagctggacttcgatctgtgcgagggcaccaccgtggtagtggatgagcactgcggcaaccgcgggccgagcctccggaccaccacggtgacaggaaagatcatccacgagtggtgttgccgctcctgcacccttccgcccctgcggtttcgcggtgaggacgggtgctggtacgggatggagatccggcccgtcaaggagaaagaggagaacctcgtcaagagcatggtgtccgctggcagcggcgaggtcgacagcttctccctggggctgctctgcatctctatcatgatcgaggaggtgatgcgctcccggtggagccgcaagatgctgatcacagggacgctggccgtcttcttcctcctgatcatggggcaggtcacctggaacgacctaatccgcttgtgcatcatggtgggcgcgaacgcttccgaccgaatgggaatgggcaccacctacctggccctgatggccacgttcaaaatgcgccccatgttcgccgtgggactcctgttccggcgcctgaccagccgggaggtcctcctgctgaccatcggactctccctggtggcttcggtcgagcttcccaactccctcgaggagctgggcgacgggctagcgatgggcatcatgatcctcaagctgctgaccgacttccagccccaccagctctgggctactctgctgagcttgacgttcatcaagaccacgttctcgctgcactacgcctggaagaccatggcgatggtgcttagcatcgtgtccctcttccccctgtgccttagcactacctcccagaagacgacgtggctaccggttctgctgggcagtctcgggtgcaaacccctgaccatgttcctgatcgccgagaacaagatttggggacgcaagagctggcccctcaacgaggggattatggccgtgggcatcgtgagtatcttgctgtcctcgctcctgaaaaacgacgtccccctggccgggccgctcatcgccggaggcatgcttatcgcctgttacgtgatctcggggtcctccgccgacctgtccttagaaaaagccgccgaggtgagctgggaggaggaggccgagcactccggcgcgagccacaacatcctggtcgaggtgcaagacgatgggactatgaagatcaaggacgaagagcgggatgatactctgaccatcctcctgaaggccacgttattagcagtgtccggcgtctaccccctgagcatcccggcgacactgtttgtgtggtacttctggcagaagaagaagcagcgctccggggtgctgtgggacaccccctctcctcccgaggtcgagcgggcggtgctggatgacggcatatacaggatcatgcaacggggcctgctggggcgctcccaggtcggcgtcggggtgttccaggagaatgtcttccacaccatgtggcacgtcacccggggggcggtgcttatgtaccaagggaagcgcctggagcccagttgggcctcggtgaagaaggacctgattagctacgggggcggttggcggctccagggctcctggaacaccggggaggaggtccaggtaatcgccgtggagcccggcaagaaccctaaaaacgtccaaaccgcccccgggacattcaagacgccggagggcgaggtgggcgccatcgcgctggactttaagcccggtaccagcggaagtccaatcgtaaatcgggagggtaagatcgtcggcctgtacggcaacggggtggtgactaccagcggcacatacgtttccgcaatcgcccaggccaaggcgagccaggaggggccgttgcccgaaatcgaggacgaagtattccgtaagcgcaacctgaccatcatggacctgcacccaggcagcgggaagacccggcgctacctccccgccatcgtgcgggaggccatcaaacgcaaactgcgcaccttaattctagcccccacgcgggtagtggctagcgagatggcggaggccctcaagggaatgcctatccgataccagaccaccgcggtcaagagcgagcataccggaaaggagatcgtcgacctgatgtgccacgccacgttcaccatgcgactcctgtccccggtgcgcgtccccaactacaatatgatcatcatggacgaagcccacttcaccgatccaagctccatcgcggcacgtgggtacatcagcactcgcgtcggcatgggggaggccgccgccatcttcatgacggcgactccgcccgggagtgtggaggcttttccccagtctaacgccgtgatacaggacgaagagcgggacatccccgagcgctcctggaacagcgggtatgagtggatcaccgacttccccggcaaaactgtctggtttgtgccgtccatcaagagcggcaacgacatcgccaactgcctacgtaagaacgggaagcgcgtgatccagctcagtagaaagacgttcgacaccgagtaccagaaaaccaaaaacaatgactgggactacgttgtgaccaccgacataagcgagatgggcgccaacttccgcgccgatcgggttatagacccccgccgatgcctgaagcccgtcattctgaaggacggccccgagagagtgatcctcgccggcccaatgcccgtcaccgtggccagcgccgctcagcggcgcgggcgtattggccgcaaccacaacaaggagggcgaccaatacatatacatggggcaaccccttaacaacgacgaggatcatgcccactggactgaggccaagatgctcctggacaacatcaatacccccgagggtatcatcccagccctgtttgagcccgagcgcgagaagtctgccgcgatcgacggggaataccgtctgcgcggcgaggccaggaagacgttcgtggagcttatgaggagaggggatctgcccgtctggttgtcttacaaggtggcctccgagggcttccaatactccgaccgccggtggtgcttcgacggcgaacgcaacaaccaggttctcgaggagaacatggatgtcgaaatctggaccaaggagggggaacggaagaaactgcgcccccggtggctggacgcccgcacctacagcgatccgttagccctgcgggagttcaaggagttcgcggccgggagacggagcgtgtccggggacctgatcctcgaaatcggcaagttaccccagcacctgacccagcgcgctcagaatgccttggacaatctggtgatgctgcacaacagcgagcagggcgggcgggcgtaccgacacgccatggaggagctccccgacacaatcgagaccctgatgctgttagccctgatcgccgtcctgaccggaggagttacactcttcttcctgtctgggcgggggctgggcaagaccagcatcggtctgctctgcgtgatggcctccagcgtcctgctctggatggcgtccgtcgagccccactggattgccgcaagcatcatactggagttctttctgatggtgctcctgattccggaacccgaccgacagcggacaccgcaggacaaccagctggcctatgtcgtgattgggttgctgttcatgatcctgactgtggccgccaatgagatgggcctcctggagaccaccaagaaggatttggggatcggccacgtcgccgtggagaaccatcaccacgccgctatgctcgacgtggacctgcacccggcctccgcctggacgctgtacgcggtcgccacgaccatcatcacccccatgatgcgccacacgatcgagaataccaccgccaacatcagccttacggctatagcgaaccaagccgccatactgatggggctggacaagggttggcctatttccaagatggacataggcgtgcccctcctggccctagggtgttacagccaggtgaacccgctcacgctgaccgccgccgtcctgatgctcgtggcccactatgccatcatcggccccgggctgcaggccaaggcaacccgagaggcgcagaaacggaccgccgccggcatcatgaagaaccccacggtcgacggcatcgtggccatcgatctggaccccgtggtgtatgacgcgaagttcgagaagcagctcggccagatcatgctgctgatcctgtgcaccagtcagatcctgctgatgcgtaccacttgggccctctgcgagagcatcacgctggccaccggcccgttgaccaccctctgggaggggtcgccaggtaagttctggaacacgaccatcgcggtcagcatggcaaacatctttcgggggtcctaccttgcgggagccggtttagcgttcagcctcatgaagtcccttgggggcggtcgccgggggaccggggcccagggcgagaccctgggcgagaagtggaagcgccagttgaaccagctgtctaagagcgaattcaatacctacaagcgtagtggaatcatggaggtggacagaagcgaagcgaaggagggtttgaagcgcggcgagacaactaagcacgccgtgtccaggggcaccgccaaactccggtggttcgtcgagcgcaacctggtgaagccggaggggaaggtgatagacttaggctgcggccgcggggggtggagctactactgcgcagggctgaagaaggttacggaggtgaagggatatactaagggcggccccggccacgaggagccgatccccatggccacttacgggtggaacctcgtgaagctgcactccggtaaggacgtcttcttcatccctcccgagaagtgtgacaccctgctctgcgacatcggggagagctcgccgaacccgacgatcgaggaaggtcggacgctgcgggtactaaagatggtcgagccctggctccgcgggaaccagttttgcataaaaatcctgaacccctacatgccgagcgtggtggagactctggagcagatgcagcggaagcacggcggcatgctagtgcgcaaccccctgtcccggaacagcacccacgaaatgtactgggtctcctgcgggaccgggaatatcgtaagcgcggtaaacatgacgtctcgcatgctgctcaaccgcttcaccatggcccaccggaagccgacgtacgagcgcgacgtcgacctgggggccggcacccgtcacgtggccgtggaacctgaggtcgccaacctagacatcatcggccagcgcatcgagaatatcaagcacgaacacaagagtacgtggcactacgatgaggacaatccgtacaagacctgggcttaccacgggagctatgaagtgaagccctcaggctccgcctcgtccatggtcaatggggtggtgaagctcctgacaaagccctgggacgtaatccccatggtgacccagatagccatgacggacaccaccccgttcggccagcagcgagtgttcaaggagaaagtcgacacccgcacgcccaaggccaagcggggcacggcccagatcatggaggtgaccgcgcgctggctgtggggcttcctctcacggaacaagaagccacgcatctgcacccgggaggagttcactagaaaggtgcgaagcaacgccgccatcggagccgtcttcgtggacgagaaccagtggaactccgcaaaggaggccgtggaggacgagcgcttttgggacctagtccaccgggagagagaactccacaagcagggtaaatgcgcgacctgcgtgtataatatgatgggcaaacgggagaagaagctcggggaattcggcaaggctaaggggagccgagccatctggtatatgtggctgggcgcgcggttcctggagttcgaggcgctcggcttcatgaatgaggaccactggttctcccgcgaaaattcgctgtccggggtggagggagaagggctgcataagctggggtatatcctccgggacatcagcaagatacccgggggcaacatgtacgcggacgacaccgccggctgggacacccgcatcacggaagacgacctgcagaacgaggccaagatcactgacataatggagcccgagcatgcgctcctggcaaaagccatcttcaagctcacatatcagaacaaggtagtgcgcgtccagcgtcccgccaagaatgggaccgtcatggatgtaatctcccgccgggaccagcgcggtagcggccaagtgggcacgtacggcctaaacaccttcacaaacatggaggcccagctgatacggcagatggaatccgaagggatcttcagcccctccgagctggagacgccgaacctcgcggagcgcgtcctgtactggctggagaagtacggtgtggagcggctcaagaggatggccatcagcggggacgattgcgtggtcaagcccatcgacgaccgcttcgccacggcactgaccgcgctgaacgacatgggcaaggtgcgtaaggacatcccccaatgggaaccctccaagggttggaacgactggcagcaggtcccgttctgcagccaccacttccaccagctcatcatgaaggacggcagagagattgtcgtgccctgccgaaatcaggacgagctggtgggcagagcgcgcgtctcccagggggccggctggagcctgcgggagactgcctgcctcgggaagtcctatgcccagatgtggcagctaatgtacttccaccgacgggacctgcgcttagcggcgaacgccatttgcagcgccgtgcccgtagactgggttcccactagtagaacgacatggtccatccacgcccatcaccagtggatgacgaccgaggacatgctgagcgtgtggaaccgcgtgtggattgaggagaacccttggatggaggacaagacgcacatctcctcttgggaggacgtaccgtacctgggcaagcgcgaggaccagtggtgcggctccctcatcggcctgaccgcgcgagccacctgggccaccaacatccaagtggccataaaccaggttcgcaggctgatcggcaatgaaaactacctcgactatatgacctctatgaaacgcttcaagaacgagtccgatccggagggggccctgtggtga

SEQ ID NO: 24723 - RNA, 9879 nt, synthetic construct
  misc_feature 1..9879: note = derived and/or modified CDS sequence (opt11) from DENV-1__KM403627__SS-prME
  source 1..9879: mol_type = other RNA
agtgttacaatgctgttgatgctgctgcccactgcgttggcgtttcatctgaccaccagaggaggggagccccacatgattgtgagcaaacaggaacggggaaagagcctcctgttcaaaaccagcgcaggggtgaacatgtgcaccctaatcgccatggacctgggtgaactctgcgaagacacgatgacatacaaatgtccccggatcactgaggcagagcctgacgacgtggactgctggtgcaacgcgaccgacacctgggtgacctacgggacctgcagccagaccggcgagcatcggagggacaagcggtccgttgcccttgcgccccacgttggattaggactcgagacgcgcaccgagacctggatgtcctccgaaggggcctggcggcagattcagaaggtggagacgtgggctcttcgccatccggggttcacggtgatcgccctgttcctcgcgcacgccatagggactagcattacccaaaaggggatcatatttatcctgctgatgctcgttacccccagtatggcaatgcggtgtgttggcatcggtaaccgcgacttcgtggaggggttgagcggcgctacgtgggtggacgtcgtgctggaacacgggtcctgcgtgaccaccatggccaagaacaaacccaccctcgacatcgaactgctgaagacggaagtcaccaaccccgcggtgttgcggaaactgtgcatcgaggccaagatatcaaacactactacggactcacgctgtcccacccaaggcgaagcaacgctggtagaggagcaggacgccaacttcgtctgccggagaacattcgtcgaccggggctggggtaacggttgcggcctcttcggcaaagggtcactactcacatgtgccaagttcaaatgcgtgaccaagctcgagggcaagatagtccagtatgagaacctgaagtactcggtaatcgtgaccgtacataccggcgaccaacaccaggtgggtaacgagacgaccgagcacggcaccatcgccaccatcacgccccaggcccctactagcgagattcagctgaccgattacggggccctgacgctagactgtagcccccggaccggcctggacttcaacgaaatggtcttgctgacgatgaaggagaaatcctggctggtccacaaacaatggtttctcgacctaccactgccctggacctccggggcctcgacaagccaggagacgtggaaccgccaggatctcttagtaacattcaagaccgcccacgcgaagaagcaggaggtcgttgtcctggggtcccaggagggcgctatgcataccgccttgaccggggcaacagagatccagacttcgggcaccaccacaatctttgctgggcatctgaagtgccgcctaaagatggacaagctcaccctgaagggcgtctcttatgtgatgtgcaccgggagcttcaagctggagaaggaggtggcggagacccagcatggtacggtactggtccaggtgaagtatgaaggcacagacgccccgtgcaagatccccatatccacccaggatgagaagggggtaacacagaacgggagattaatcactgccaacccgatcgtcacagacaaggagaaacccgttaacattgagaccgagccgcccttcggtgaatcgtacatcgtcatcggcgcgggcgagaaagcgctgaaactttcctggttcaagaaggggtcctccatcggtaaaatgtttgaggccaccgcgcgcggggcccggcgtatggccatcctcggagacacggcgtgggacttcgggagcatcgggggcgtgttcacctccgtgggcaagctggtccatcaggtgttcggcaccgcctacggggtgctattcagcggcgtcagttggaccatgaagatcgggatcggtatcctcttaacgtggttgggactcaattctcgttccaccagcttatccatgacctgtatcgccgtgggcatggttacgctgtatctcggcgtcatggtgcaggccgacagcgggtgcgtgataaactggaagggccgtgagctaaagtgcgggtccggaatattcgtcaccaacgaggtgcacacctggaccgagcagtacaagttccaggcagattccccgaagagactcagcgcggccatcggcaaggcctgggaggagggcgtatgcggtatccggtccgctacccgattggagaatataatgtggaaacaaatcagtaacgagttaaaccacatactgttggagaacgacatgaagtttaccgtggtggtgggggacgccaatggcatcctgacacaggggaaaaagatgatccggccgcagcctatggagcataaatactcctggaaatcctggggcaaggcgaagatcatcggggcagatatccagaacaccaccttcatcatcgatgggccagacacgcccgagtgccccgacgaccagagggcctggaacatctgggaggtcgaggactacggctttggggtgtttacgactaacatctggctgaagctacgtgactcctatacccaaatgtgcgaccaccgcctgatgtctgccgcgatcaaagactctaaggccgtgcacgccgacatgggatactggatcgaatcagaaaagaacgagacctggaagctggcccgagcatccttcatcgaggtcaagacgtgcatttggcctaggtcccacaccctctggtccaacggtgtgctggagagcgagatgatcatccccaagatttacgggggcccgattagccagcacaactaccggcctgggtacttcacccagaccgcgggcccttggcatctggggaagctcgagctggacttcaacctgtgtgaaggcacgaccgtggtggttgacgagcattgcggcaaccgcggtccaagcctccggaccaccacagtgacaggtaagatcatccacgagtggtgttgccgctcctgcacgctgccgccgctgcggtttcgcggggaagacgggtgctggtacgggatggaaattcggcccgtcaaagagaaggaagaaaacttggtacgaagcatggtgtccgccggcagcggcgaagtagactcgttctccctcggtttactctgtgtttctatcatgatcgaggaggtgatgcggtcccgctggagccgcaaaatgctgatgactggcacgctggccgtgttcttcctactgatcatgggccagctgacgtggaatgacctcatccggctatgcataatggtgggcgcgaacgtgtccgaccgcatgggcatgggcactacctacctggcgttaatggcgacgttcaagatgcggccgatgttcgccgtcggcctgctattcagacggttaaccagccgcgaggttctgctgcttaccattggtctgtcacttgtcgcaagtgtggaactccccaactcccttgaggaacttggggacgggctcgcaatggggatcatgatgctgaagttgttgaccgacttccagagccaccaattgtggacgaccctgctctccctgaccttcatcaagaccacgctgtctctcgactacgcctggaagaccatggctatggttcttagtatagtcagcctgtttcctctctgcctgtcaaccaccagccaaaagacgacctggctgcccgttctactgggctccttcgggtgtaagccgctgaccatgttcctcatcaccgagaacaagatatggggccgcaagagctggccactgaatgaggggatcatggccgtcggcatcgtctccatcttgttaagctccctgctgaagaacgacgtgcctctggccgggccgctgatcgccggcggaatgttgatcgcgtgctacgtaatctccgggagctccgccgacctcagcctggagcgcgccgccgaagtctcctgggaagaggaggcggaacacagtggcgcgtcccacaatatcctggtcgaagtacaggacgatgggacaatgaagatcaaggacgaagagcgagacgatactctcaccatcttactgaaggcgactctactagcggtcagcggggtgtacccgatgtccatccccgcgacgttgttcgtatggtacttttggcagaagaagaagcagcgcagcggggtgctctgggatacgccgtctccgcccgaagtggagcgggccgttcttgacgacggcatctacagaatccttcagagaggcctgttggggcgatcgcaggtcggcgtaggcgtattccaagacggcgtcttccacaccatgtggcatgtgacccgcggggcagtcctgatgtaccaaggcaagaggctggagcccagttgggccagcgtcaagaaagacctcatctcctacggaggaggctggcggttccaggggtcttggaacaccggagaggaggtgcaggtgattgccgtcgaacccgggaagaaccccaagaacgtgcagaccacccccggcaccttcaagacccccgagggggaagtaggcgccatcgccctggatttcaagcctggtacgtccggaagccccatcgtgaaccgtgagggcaagatcgtggggctttacgggaacggagtagtcaccacctcaggtacctacgtcagcgcaatcgcccaggccaaggcaagccaagaggggccgttaccagagatcgaggacgaggtgtttaagaagcggaacctgacgattatggacctgcatccagggtctggcaaaacccgcagatacctcccggctattgtccgcgaagcgatcaaacgcaaactgcggactctgatcttggcccctaccagggtcgtggctagcgaaatggcagaggcgcttaaaggcatgccgattcggtaccagacgaccgccgtgaagtccgagcacactgggaaggaaatcgtagacttgatgtgccacgcaaccttcacgatgcgtctcctgagccccgtgcgggttccgaattacaacatgattataatggacgaggctcacttcacagatcctgcctccatcgcggccaggggctacataagcacccgtgtggggatgggcgaagcagccgctattttcatgaccgcgacgccgcccggctccgtcgagtcattcccacagtccaacgccgtcatccaggacgaggagcgcgacatccctgagcgtagctggaacagtggctacgactggatcactgatttccccggcaaaacggtgtggttcgtgcccagcatcaagagtggtaacgacatcgccaactgcttgcgtaagaacggcaagcgagtgatacagcttagccgcaagaccttcgacaccgagtaccaaaagactaagaacaacgactgggactacgtggttaccaccgacatctccgaaatgggagccaacttccgggccgaccgagtcatcgacccgagacgatgcctgaagccagtgatcctgaaggacgggcccgagcgggtcatcctcgcaggtcccatgccggtgacggctgccagtgccgcccaacgaagaggccgcatcggccgcaaccagaataaggagggcgaccagtacatctacatgggccaacccctgaacaacgatgaggaccatgcccactggaccgaggccaagatgttgctcgacaacataaacacgcccgagggaattatccccgccctgttcgaaccagagcgggagaagtcggctgcgattgatggggagtacaggctgcgcggcgaggcccgcaagaccttcgtggagctcatgcggcgcggcgatctacccgtctggctcagctacaaggtggcctccgagggcttccagtactcagaccgccgctggtgtttcgacggggagcggaacaaccaggtgctcgaggagaacatggacgtcgagatctggacgaaggagggcgagcgcaaaaagctccggccacgctggctggacgcccggacctactctgaccccctagccctgcgcgaattcaaggagttcgcggccggacgcagaagtgtgtccggagatctaattctcgaaatcggcaagctgccccaacacctgaccctgcgagcccaaaacgccctggacaacctggtgatgctccacaactccgagcagggagggaaggcatatcgccatgccatggaggagctgcccgatactatcgagacgctgatgctcctggctctgatcgccgtactcaccggcggtgtgaccttgttttttctgagcggtaaggggctcggtaagacctccattggactgctgtgcgtgatggccagctcagtgctcctctggatggcgagcgtcgagccccactggattgccgcctctatcatcctggagttttttctcatggtgctgttaatccctgagccggacagacagaggacgccccaggataaccagctcgcttatgtagtgatcggtctgctgttcatgatcctcacagtggccgcgaacgaaatggggctgcttgagaccaccaagaaggacctcggcatcgggcacgtcgtggccgagaaccaccatcacgcaacgatgttagatatcgacctgcaccccgcaagcgcgtggacactctacgcggtagccactaccatcatcactcctatgatgagacacacgattgagaacactaccgccaacatctccctgaccgccatagccaaccaggccgccatcctgatgggcctcgacaagggctggcccatcagcaaaatggatatcggggtccccctgctggctttaggctgctactcccaagtgaatccactgactctgaccgcagctgtgctaatgcttgttgcgcactacgccatcatcgggccgggactacaggcgaaagccacccgggaggcccagaagcgcacggccgccggaatcatgaagaaccctacggtggacggcatcgtagccatcgacttagaccctgtcgtctacgatgccaaattcgagaaacagctgggccaaatcatgttgctaatcttatgtacctcccagatccttctcatgcggaccacctgggcgctttgcgagtcaatcacactggccacggggcccctcacgaccctgtgggaaggaagccctggtaaattctggaatacgaccatcgctgtgagtatggccaatatctttcgcggcagttacctggctggcgcggggctcgccttctccctaatgaagtctctgggaggaggccggcgtgggacgggcgcccagggtgaaaccctcggggagaagtggaagcggcaactgaaccagttgtccaagtccgaattcaacacgtacaagcgctccggcatcatggaagtcgatcggtccgaggctaaagaggggctcaagcgcggtgagacaacgaagcatgccgtgagccgggggaccgcgaagctgcgctggttcgtcgaacggaacctggtcaagccggagggaaaggtgatcgacctgggatgtgggcgcgggggttggtcctattattgcgcaggcctcaagaaggtaactgaggtgaaggggtatactaagggcggccccgggcacgaggagcccatccctatggccacctacggctggaacatcgtcaagctacatagcgggcgggacgtgttcttcacgccgcctgagaaatgcgataccctgctctgcgacataggcgaaagtagccccaaccccacgatcgaggaggggcgcacccttcgagtactgaaaatggtggaaccctggctccgcggcaatcaattttgcataaagatcctgaacccctacatgccctccgtggtcgagaccctggagcagatgcaacggaagcatggcggaatgctcgtgcgcaatccgctaagccggaactctacccatgagatgtactgggtaagctgtggcacggggaacatagtttccgcggtaaatatgacctcacgcatgctgcttaatcgcttcaccatggcgcaccggaagcccacctacgagcgcgacgttgacctgggcgcgggcaccagacacgttgccgtggagcccgagatcgccaacctggacatcatcggacagcgcatcgaaaacataaagaatgagcacaagtccacttggcactacgacgaggataacccctacaagacttgggcctaccacggcagctacgaggtgaagccatccgggagcgcgtcctccatggtcaatggagtagtgcgattgctgacaaaaccatgggacgtaatccccatggtgacgcaaatcgccatgaccgacaccactcccttcggtcagcagcgcgtcttcaaggagaaggtggatacgagaaccccgagacccaagaggggtaccgcacagatcatggaggttaccgctaagtggctgtggggctttctaagcaggaataaaaagccacggatttgcacgcgcgaggagttcacccggaaagtgcgctccaacgctgcgattggggctgtgttcgtggacgagaaccaatggaactctgcgaaagaagccgtcgaagacgagaggttctgggacctggtacaccgcgaacgggagctccataagcagggcaagtgcgcgacgtgcgtttacaacatgatggggaagcgcgaaaagaagctcggggagttcggtaaggcgaagggctcccgcgccatctggtatatgtggctgggcgcgagattcttggaatttgaagcccttggtttcatgaacgaggaccactggtttagccgggagaactccctgagcggcgtcgaaggggagggcctacacaaactcggctacattctgcgcgacatctccaagatcccgggaggcaacatgtacgccgatgatactgccgggtgggacacgcgcatcaccgaagacgaccttcagaacgaggctaagattaccgatatcatggagcccgagcacgctctcctggcaaccagcatcttcaaactgacgtaccagaacaaggttgttcgcgtccagaggcccgctaagtccggcacagtgatggacgtgataagccggcgggaccagcgggggtcgggccaggtaggcacttacggcctcaacaccttcacgaacatggaggtgcagctgatccgccagatggagagtgagggaattttctccccaagcgaactggagaactccaacctcgccgagcgggtgctggactggctcgagaagcatggggtcgagcgcctaaagcgtatggcaatcagcggcgacgattgcgttgtgaaacctaccgacgatcgcttcgccaccgccctgaccgccctgaacgatatgggcaaggtccgtaaagacataccccagtgggagccatcgaaaggctggaacgactggcaacaggtccccttttgcagccaccacttccaccagctcattatgaaggacggcagagagatcgtggtcccatgccggaaccaggatgaactggtgggccgcgcccgggtatctcagggcgcaggctggtccctgagagagacggcctgcctcggcaaatcgtacgcccaaatgtggcagctgatgtatttccatcggcgcgatctgcggctcgcggccaacgcaatctgttccgccgtcccggtgaactgggtgccaacctctcgcacgacctggagtatacacgcgcaccaccagtggatgaccactgaagacatgcttagcgtctggaaccgcgtgtggatcgaggaaaatccctggatggaagacaagactcacgtgtcgtcatgggaggacgttccctatttgggtaaacgggaggaccagtggtgcgggagcttaataggtctgaccgcgcgcgcaacctgggcgacgaacatacaggtggcaatcaaccaggtgcggcgtctgatcggcaacgagaactatctcgactacatgaccagcatgaagcggtttaagaacgagtctgaccccgagggtgcgctgtggtga

SEQ ID NO: 24724 - RNA, 9879 nt, synthetic construct
  misc_feature 1..9879: note = derived and/or modified CDS sequence (opt11) from DENV-1__KM403584__SS-prME
  source 1..9879: mol_type = other RNA
agcgtgaccatgctgctaatgttactgcccaccgcccttgccttccacctgaccacccggggcggagagccccatatgattgtgagcaagcaggaacggggcaagagcctgctgttcaagaccagtgcgggggtgaacatgtgcacgctgatcgccatggacctgggcgagctctgcgaggacacgatgacctacaagtgcccccggatcaccgaggccgagcctgacgacgtggattgctggtgcaacgccaccgacacctgggtcacctacgggacctgcagccagaccggggagcaccggagggacaagcggtcggtggccctggcgccccacgtgggcctggggctcgagacccgcaccgagacctggatgagctccgagggcgcctggcggcaaatacagaaggtagagacctgggccctgcgccacccggggttcacggtgatcgcgctgttcttagcgcacgctatcggcaccagcatcacccagaaggggatcatcttcatcctgctgatgctcgtgacccccagtatggccatgcggtgcgtcggcatcgggaaccgggacttcgtggagggtctgtcgggcgccacgtgggtggacgtcgtcttggagcacgggtcctgcgtgacgacgatggccaagaacaagcccaccctggacatcgagctgctaaagacagaggtcaccaaccccgcggtgcttcggaagttatgcatcgaggccaagatctctaatactaccacggactccaggtgtccaacacagggcgaagccaccctggtggaggagcaggatgccaacttcgtttgccggcgcaccttcgtggatcggggctggggtaacggctgcggcttattcggaaaagggagcctactgacctgcgctaaattcaagtgcgtgactaagttagagggcaagatcgtccagtacgagaatctgaagtactccgtcatagtgaccgtgcacaccggcgaccagcaccaagtaggaaacgagacgaccgagcacggtaccatagcgaccatcacgccccaggcccccacgagcgaggtccagctgaccgactatggggccctcaccctggactgcagcccccggactggcctagacttcaacgagatggtgctcctgacaatgaaagagaagtcttggctggtgcacaagcagtggttcctcgatctgccgctcccttggacctcaggggccagcaccagccaagagacctggaatagacaggacttactggtcacgtttaagaccgcacacgcgaagaagcaggaggtggttgtcctgggttcccaggaaggagccatgcataccgccctcaccggggccacggagatccagacctcaggcaccaccacgatctttgcagggcacctaaagtgccgcctgaagatggataagctcaccctgaaaggcgtgtcctatgtaatgtgcacggggagcttcaagctggaaaaggaggtcgctgagacccagcacggcacggtgctggtgcaagtcaagtacgagggcaccgacgccccctgcaagatccctatctcgacccaggacgagaagggggtgacccagaacggccggctcattaccgccaacccgatagtgacggacaaggagaagcccgttaacatcgagaccgagccgcccttcggggagtcttacatcgtgattggcgccggagagaaggcgttgaaactttcctggttcaagaaggggtctagtatcggcaagatgttcgaggccaccgcccgcggggcgcggcgcatggccatcctgggcgacacggcttgggactttggcagcatcggcggggtgttcacctcagtggggaagctggtacaccaagtgttcggcactgcctacggggtcctgttcagcggcgtgtcctggaccatgaagatcgggatcggcatcctcctgacgtggctgggcctcaactctcgctccacctccctgtccatgacctgcatcgccgtggggatggtcaccctgtacctcggcgtgatggtgcaggccgacagcgggtgcgttataaactggaagggccgggagctgaagtgtgggtccggcattttcgttacgaacgaagtgcacacttggaccgagcaatacaaattccaggccgactcgcccaagcgcctgagcgcggccatcggcaaggcctgggaggagggggtctgcggcatccggtccgccacccgcctagaaaacataatgtggaagcagatcagcaacgagctgaaccacatcctgcttgagaacgacatgaagttcaccgtggtggtcggggacgcctatggcatcctgacgcaggggaagaagatgatacgaccgcagccaatggagcacaagtactcgtggaagtcctggggcaaggcgaagataatcggcgccgacacccagaacaccaccttcataatcgacgggcccgacacgccggagtgccccgacgaccagcgcgcctggaacatctgggaggttgaagactacggcttcggggtgttcaccacaaacatctggctgaagctccgggactcctacacccagatgtgcgaccaccgcctgatgagcgccgcgatcaaggattcgaaagccgttcatgctgacatgggctactggatcgagagcgagaagaacgaaacgtggaagctggcccgggcctccttcatcgaggtgaaaacgtgcatctggccacggtcacacaccctctggtccaacggagtgctggagagcgaaatgatcatccctaagatctacgggggcccgatctcccagcacaactacaggcccggatacttcacccaaacggcgggcccctggcacctgggaaagctggagctggacttcaacctgtgcgagggtaccacggtcgtggtcgacgaacactgcggcaaccgcgggccaagtctccggaccacgacggtcaccggcaagatcatccacgagtggtgctgtcgctcctgtaccctgccaccactgcggttccgcggggaggacggctgctggtatgggatggaaatccggcccgtaaaggaaaaggaggaaaacctcgtgcgtagcatggtcagtgcgggcagcggcgaggtggacagcttctccctggggctgctctgtgttagcattatgatcgaggaggttatgcgctccaggtggagccgcaagatgttaatgacgggcaccctggccgttttcttcctcctgattatggggcaactgacgtggaacgacttaatccggctgtgtattatggttggtgccaacgtttccgaccgcatgggaatgggcaccacgtatctggccctcatggcgaccttcaagatgaggcccatgtttgccgtgggtctgctgttcaggcggctcacaagccgcgaggtcttgctgctcaccatcgggctgtccctggtggccagcgtggagcttcccaattccctggaggaacttggggacggcctcgccatgggtatcatgatgctgaagctcctcacggacttccagtcacaccagctgtggaccacgctgctgtctttaaccttcattaaaacgactctgagcctagactacgcatggaagaccatggcaatggtcctgtccatcgtcagcttgttccccctctgcctgtcaaccacgagccagaagaccacctggctgcccgtcctcctcggctccttcgggtgcaaaccgttaaccatgttccttatcaccgagaacaagatctgggggcgcaagagctggccccttaacgagggtatcatggccgtgggcatcgtgtccatcttacttagcagcctgctgaagaacgacgtgccgctcgccggacctctgatcgcagggggaatgctgatcgcgtgctatgtcatctccggttcctccgccgatctctcactggagcgcgccgccgaggtgtcctgggaggaggaggccgaacacagcggtgcgtcacacaacatcctggtggaggtccaggacgacgggacgatgaagatcaaggacgaggagcgggacgacaccctgaccatcctgctgaaggccaccctcctggccgtgagtggcgtgtaccctatgtcgatccccgccacactctttgtctggtacttctggcagaagaagaagcagagaagcggggtgctctgggacacccccagcccgcccgaagtggagcgggctgtcctggatgatggcatctaccgcatcctgcagcgaggcctgttggggcgatcacaggtgggcgttggcgtcttccaggacggcgtgttccacaccatgtggcacgttacgcgcggggcggtcctcatgtaccagggcaagcgcctggagccctcatgggccagcgtgaagaaggacctcatctcctacggcggaggctggcggttccaggggagctggaacacgggggaggaggtgcaggtcatcgccgtggaacccgggaaaaaccccaagaacgtgcagaccacccccggcaccttcaagacgccggagggcgaggtaggggccatcgccctcgacttcaagcccggcacctcagggagccccatagtcaaccgcgagggaaaaatcgtgggcctgtacgggaacggcgtcgtgactacctccgggacgtacgtgagcgcgattgcccaggccaaggccagccaggagggcccgctccccgagatagaggacgaagttttcaagaagagaaacctgaccatcatggacctacaccccgggtccggcaagaccaggcggtacctcccggccatcgtgcgcgaggctatcaagcgcaagctgcgcaccttgatcctcgcccccacgcgcgtggttgccagcgagatggccgaggcactgaaggggatgcccatccggtaccagaccaccgccgttaagtctgagcacaccgggaaggaaatcgtggacctcatgtgccacgccacgttcaccatgcgcctcctgagccccgtcagagtgccgaattacaacatgattatcatggacgaagcacatttcaccgaccccgcaagtattgcggctaggggctatatcagcacccgagtgggcatgggcgaggccgccgccatcttcatgacggcaactccacccggatccgttgaggccttccctcagtcgaatgccgtaatccaagatgaagagcgcgacatccccgagcgtagctggaacagcggctacgattggatcacagacttccctggcaagaccgtgtggttcgtcccatccatcaagagcgggaacgacatcgccaactgcctgcgcaagaacgggaagcgggtgatccagctctcccgcaagacgttcgacaccgagtaccagaagacaaagaacaacgactgggactatgttgtcaccacggacataagcgagatgggggctaacttccgggcggatcgcgtgatcgacccgcggcgatgcctgaagcccgtgatcctgaaagacggcccagagagagtgatcctcgccgggcccatgccggtgaccgccgcctcggcggcccagcgccggggacgcatcggccgcaaccagaataaggagggtgaccagtatatctatatgggccagcccctcaacaacgacgaggaccacgcccactggacggaggccaagatgctgctcgacaatatcaacaccccagagggtatcatcccagccctgttcgagccggaacgggagaaatctgcagccatcgatggcgaataccgcctgcgcggggaggcccgcaagacgtttgtcgagcttatgagacgcggcgacctgcccgtgtggctatcctacaaggtggccagcgagggctttcagtacagcgaccggcggtggtgcttcgacggggaacggaacaaccaggtcctggaagagaacatggacgtggagatttggaccaaggagggcgagcgcaaaaagctccggccccgctggctggacgcccggacctacagcgatcccctcgcgctgagagagttcaaggagtttgccgccgggagacgcagcgtgtccggcgacctgattctggagatcggcaagctgccgcaacacctgaccctccgggcccagaacgccctcgataacctggtcatgctccacaacagcgagcagggcgggaaggcgtaccgccacgctatggaggagctgccggacaccatcgagacgctgatgctcctggcactgatcgccgtgctcaccgggggcgtgacactgttcttcctgtccggcaagggcttgggcaaaaccagcatcgggctgctgtgcgtaatggcctcctcggtgctgctgtggatggcctccgtggagccccactggatagccgcctctatcatcctggagttcttcctcatggtactgctgatccccgagcctgaccgacagcgcaccccgcaggacaaccaattggcctacgttgtgatcggtctcctgttcatgatcctcaccgttgcggccaacgagatggggctgctggagaccaccaagaaagaccttggcatcgggcatgtggtagccgaaaaccaccatcacgccactatgctggacatagacttacaccccgcctcagcgtggacactctacgcagtcgcgaccaccatcatcacgccgatgatgaggcacaccatcgagaataccaccgctaacatatcgctgacagcgatcgcgaaccaggccgccatcctgatgggcctcgacaagggctggcctatctccaagatggatatcggggttcccttactggccctcggctgctactctcaggtgaaccccctgaccctgaccgccgcagttctcatgctggtggctcactacgcgattatagggccgggcctgcaagccaaggcgacacgcgaagcacaaaagcggacggcggccgggatcatgaaaaaccccaccgtggacggtatcgtcgccatcgacctcgaccccgtggtgtacgatgcgaaattcgagaagcagctcggccagatcatgctgctcatcctgtgtacctcccagatactgctcatgcggaccacgtgggccttatgcgagtccatcactctggccaccgggcccctcaccacgctgtgggagggttccccggggcgcttctggaacaccactatcgccgtctctatggctaacatcttccggggctcctatcttgcgggggccgggcttgccttcagcctgatgaagtctctgggcgggggccgccgggggaccggcgcccagggggagacgctcggtgagaagtggaagcgccagctaaaccagctgagcaagagcgagttcaacacctacaagcggtccgggattatggaggtggaccgcagcgaggcaaaggaggggatgaagcggggcgagaccaccaagcacgctgtgtcccgcggcacggccaaactcaggtggtttgtcgaacgcaacctggtgaaacccgagggcaaggtgatcgacctggggtgcggccgtggcgggtggtcttactattgcgccggcctgaagaaggtcaccgaagtgaaggggtacacaaagggcggccccgggcacgaagagcccatcccgatggccacatatggctggaacatcgtaaagctccactcaggacgcgacgtcttcttcacgccgcccgagaagtgtgatacgcttttgtgcgatatcggggagagctcccccaacccgaccatcgaagaggggagaaccctccgagtgttgaagatggttgagccgtggctgcggggaaaccagttttgcattaagatactcaacccctatatgcccagcgtcgtggagaccctggagcagatgcagcgcaagcacggcgggatgctggtccggaaccctctctcccgtaacagcacgcacgagatgtactgggtctcctgcggcaccgggaacatcgtgagcgcggtgaacatgacatctcgcatgctgcttaaccggttcaccatggcccacaggaagccaacatatgagcgggacgtcgacctcggggccggaacccgccatgtggccgtagagcccgaaatcgccaacctggatatcatcggccagcggatagagaacataaagaacgaacacaagagcacctggcactacgacgaggacaacccttacaaaacctgggcgtaccatggctcctacgaggtcaagccgagcggctccgcctcatccatggtgaacggtgtcgtgagactactcacgaagccctgggacgtcatccccatggtcactcagatagcaatgaccgataccacccctttcgggcagcaacgggtgttcaaggagaaggtggacacccgcacgccacggcccaagcggggcaccgcccagattatggaggtcacggctaagtggctgtggggctttctcagccggaacaagaagcctaggatttgcacccgggaggagttcacgcgaaaagtgcggagcaacgcggccatcggggccgtgttcgtcgacgaaaaccagtggaattctgccaaggaggccgttgaggacgaacgcttctgggacctcgtgcacagggagcgcgagctgcacaagcaaggcaagtgcgccacctgcgtttacaacatgatggggaagagggagaagaagctgggcgaattcgggaaggccaagggctcgcgcgccatctggtatatgtggctcggcgctcggtttctggaattcgaggcgctggggttcatgaacgaggaccactggttctcccgcgagaacagcctgtccggcgtggagggggagggcctgcacaagttgggttacatcctccgcgatatctctaagataccgggcggcaacatgtacgccgatgatacggccggctgggacacccggattaccgaggatgacctgcagaacgaggccaagatcacggacatcatggagccagaacacgccctgctcgcgacgtccatattcaaactgacctaccagaacaaagttgttcgcgtgcagcggcccgccaagagcggtaccgtgatggatgtcatctcccgccgggaccaacgcgggagcggtcaagtgggtacctacgggctgaacacgttcactaacatggaggtccagctcatcaggcagatggagagtgagggaatctttagtcccagcgagctggaaaacagcaacctggccgagagagtcctcgactggctggagaagcacggggtggagagattaaagcgcatggccatcagtggcgacgattgcgtggtcaagccgaccgacgaccggttcgccaccgcactcacggccctaaacgatatgggtaaggtccgcaaggacatcccgcagtgggagccatcgaagggctggaacgactggcagcaggtccccttttgctcccaccacttccaccagctgatcatgaaggacggccgcgagatcgtcgtcccttgccgcaaccaggacgagctcgtgggccgggcccgcgtctcgcagggtgccgggtggagcctgagagaaaccgcctgcctgggcaagtcctacgcgcaaatgtggcagctcatgtacttccaccgccgggacctgcggctggcggccaatgccatctgctcggcagtccccgtgaactgggtcccaacaagccgcacgacctggagcatccacgcacatcaccagtggatgacgaccgaggatatgctctccgtttggaaccgggtgtggattgaggaaaacccgtggatggaggacaagacacacgtcagctcctgggaggatgtgccgtatctagggaagcgcgaggaccaatggtgcggcagcctgatcggcctcaccgcccgggccacatgggccaccaacatccaagtggcgatcaaccaggtccggcggctaatcggcaacgagaactacctggactatatgacctccatgaaaaggttcaagaacgagagcgaccctgagggcgccctgtggtga

SEQ ID NO: 24725 - RNA, 9879 nt, synthetic construct
  misc_feature 1..9879: note = derived and/or modified CDS sequence (opt11) from DENV-1__KM403633__SS-prME
  source 1..9879: mol_type = other RNA
agcgtgacaatgctgctcatgctgctgcctaccgccctcgcgttccatctgaccaccaggggcggggagccccacatgatcgtgagcaagcaggagcgggggaaatcgcttctattcaaaacctccgcgggggtgaatatgtgtaccttgattgccatggacctgggcgagctctgcgaagacacgatgacctacaaatgcccgcgcatcacggaggccgaacccgatgatgttgactgctggtgcaacgccactgacacctgggtgacctacgggacctgctcccagaccggcgagcaccggcgcgataagcggtccgtggcccttgctccccacgtgggccttgggctcgaaacccgcaccgaaacctggatgtcctccgagggcgcgtggcggcagatccagaaagtggaaacctgggctctgcgccaccctgggttcacggtaatcgcgctgtttctcgcgcacgccatcggtaccagtataacccagaaggggatcatattcattttactgatgctcgtgacaccctccatggccatgaggtgcgtaggcataggcaaccgggacttcgtggaggggctatcaggcgcaacatgggtggacgtcgtgctggagcacgggtcctgcgtgacgactatggccaagaacaaacccaccctcgacatcgagttactgaaaacggaagtcaccaacccggcagtgctgcggaagctgtgtatagaggcaaaaattagcaacaccaccactgactcccgctgcccgacccagggtgaagcgaccctggtggaggaacaggacgccaattttgtctgtcgccgcacgtttgtggaccggggttgggggaatggctgcggcctcttcggtaagggtagcctgctgacctgtgccaagttcaagtgcgtaaccaagctcgaaggcaagattgtgcagtacgaaaacctgaagtacagcgttattgttaccgtccacaccggcgaccaacaccaggtcgggaacgaaacgaccgagcacggcaccatcgcgacgatcacgccccaggccccgactagcgagatccagctgaccgactacggggccctcaccctggactgcagcccacgcaccggcctggacttcaacgagatggtcttacttaccatgcgggagaagtcctggctggtacacaaacagtggtttctcgacctgccactgccctggacctccggggccagcacctctcaggagacttggaaccgccaagacctcctggtcacgttcaaaaccgctcacgccaaaaagcaggaggtcgtggtgctgggctcccaggagggagccatgcataccgcgctcaccggggccactgagatccagacctcgggcactaccacaatattcgccgggcatctgaagtgccggctaaagatggacaaactgaccctcaagggggtctcctacgtgatgtgcacagggagcttcaagctggagaaggaggtggctgagactcagcacggcaccgtcctggtacaggtgaagtacgagggtaccgacgcgccctgcaagattcccataagcacccaggacgaaaagggggtgacccaaaacggccgcctcattacggccaaccctatcgtgaccgataaggagaagcccgtgaacatagaaaccgagcctcccttcggggagtcatatatcgtcataggggcaggcgagaaggcgctgaagctgtcctggttcaagaaggggtcttccataggtaagatgtttgaagcaacggccagaggggcacggcgcatggccatcttgggcgacacggcgtgggacttcggaagcataggcggcgtcttcacctctgtggggaagctggtccaccaagtgttcggcactgcctacggggtgctgttctcgggtgtttcttggaccatgaaaatcggtatcgggatcctgctaacgtggctcggactcaacagccggtctacctcactgtcaatgacctgcatcgccgtcgggatggtgaccctgtatctcggcgtcatggtgcaggctgactccggttgcgttatcaattggaagggccgggagctgaagtgtgggtccggtatctttgtcacgaacgaggtgcacacctggaccgaacaatacaaattccaggcggatagcccgaagagactaagcgcagctatcggaaaggcttgggaagagggggtgtgcggcatacgctccgcgacgcggctcgagaacatcatgtggaagcagatcagcaacgagctgaaccacatcctactcgagaatgacatgaagttcacagtagtcgtgggggacgccaacgggatcttaacgcaggggaagaagatgatccgcccccagcctatggagcacaagtactcctggaagtcgtggggcaaagcgaagataatcggggccgacacccagaacaccaccttcatcatcgacgggcccgacacgccggagtgtcccgatgaccagcgggcttggaatatttgggaggtcgaggactacggattcggggtgttcaccaccaacatctggctaaagctccgcgacagctacactcagatgtgtgaccaccggctgatgtcggccgcgatcaaggattcaaaggccgtacacgccgacatgggctactggatcgaaagcgagaagaatgagacgtggaaacttgcgcgcgcctcctttattgaggtcaagacttgcatctggccacggagccacaccttatggtctaacggtgtgctggagagcgagatgatcatccccaagatctacggaggtccgatctcccagcacaattaccgcccggggtactttacacagaccgcgggcccgtggcacctcgggaagttagagctagactttaacctgtgcgagggtaccaccgttgtggtggacgagcactgcggtaatcgcggtccgagcctccgcacgacgaccgtgactggcaagatcatccacgagtggtgctgcagaagttgcacccttcctcccctgcgcttccgtggggaagacggctgctggtacggcatggagatccggcccgtcaaggagaaggaggagaacttagtgcgaagcatggtgtccgccggcagcggcgaggtagacagcttctcactggggctgctctgcgttagcatcatgattgaagaagtgatgcgctcccgctggagccggaaaatgttgatgacgggcaccctggcagtcttcttccttctaattatgggtcagctgacctggaacgacctcatacgcctgtgcataatggtgggcgcgaacgtttccgaccggatggggatgggaacgacgtacctcgccctcatggcgacgttcaagatgcgcccgatgttcgctgtagggctgctgttcagacgcttaacttcccgggaagtgctgctgttgaccatcgggctgtccctggtcgcctccgtagagttgcccaactccttggaggaactgggcgacggactagcaatgggcataatgatgctgaagctgctcacggacttccagagccatcaactgtggaccaccctgttgtccctgaccttcatcaagactaccctgagcctcgattacgcatggaagacgatggcgatggtgctctccatcgtcagcctgttccccctctgcctgtcgactactagccagaagaccacctggctgcccgttttactgggctccttcggctgcaagcctctgactatgttcctgatcacagaaaataagatatggggtcgcaagtcttggcccctgaacgaggggattatggcagtgggcatcgtgtccatcctgctgtctagcctgctaaagaacgatgtgccactcgcagggcccctgatcgccggcggaatgctgatcgcttgctacgtgattagcggaagcagcgccgacctcagccttgagcgggccgccgaggtctcatgggaggaagaggccgagcacagcggggcgagtcataacatcttagtggaggtgcaagacgatggcacgatgaaaatcaaggacgaggaacgcgatgacaccctcaccatcctgttgaaagccaccctcttggcggtcagcggcgtgtacccgatgtccatccccgccactcttttcgtgtggtacttctggcagaagaagaagcagcggtctggggtcctctgggacacccccagcccgcccgaggtggagcgtgccgtgctggatgacggcatctaccgtatactacagcgcggcctgctcgggcgcagtcaggtaggcgttggggtctttcaagacggcgtcttccacaccatgtggcacgtgacccgcggcgcggtgctgatgtaccagggcaaacggctggagccttcctgggcctcggtcaagaaagatcttatctcctacggcgggggctggaggtttcagggtagctggaacacaggcgaggaagtgcaagttattgcagttgagccagggaaaaaccccaaaaacgtgcaaaccacccccggcactttcaaaacgcccgaaggggaggtgggggccatcgccttagacttcaagcctgggaccagcgggagcccgatcgtcaaccgcgagggcaaaatcgtgggcctgtacgggaatggcgtcgtcacgacctccggtacgtacgtgagcgcgatcgcccaggccaaagccagccaagagggcccgctccccgaaatagaagacgaggtgttcaagaaacgcaacctgaccataatggatctgcaccccgggtccggtaagacccgccgctatctcccagccatcgtacgcgaagctatcaagcgtaagctcaggacgctgatcctcgcacccacccgcgttgtagccagcgagatggccgaagcgctaaagggcatgcctattcgctatcagaccactgcggtcaagtcggagcacacaggaaaggagatagtggacctgatgtgtcacgctactttcaccatgcggctgcttagccccgtgcgcgtcccaaactacaacatgatcatcatggatgaggcccacttcaccgaccccgcctccatcgctgcccgaggctatatatcgacccgcgtggggatgggcgaggccgccgccatcttcatgaccgcgaccccgcccggttccgtagaagccttcccgcaatcgaacgccgtcatccaggatgaggaacgggacatccccgagcgcagttggaacagcggatacgactggatcacggatttccccggcaagaccgtgtggttcgtgccctccataaagagcggtaacgacatcgccaactgcttgcggaagaacggcaagcgcgtcatccaactctcccgcaagacattcgataccgagtaccagaagaccaagaacaatgactgggactacgtggtgaccacggacatctcagagatgggcgccaacttccgcgcggaccgggtcatcgatccgcgtcgatgcctgaagcctgtgattctgaaagacggcccggagcgggtcatcctcgctgggcccatgccggtgacggccgcctccgcagctcagcgtcgcggccgcatcggccgtaaccaaaacaaggagggggaccagtacatttatatgggccagcccctgaacaacgacgaggatcacgcacactggaccgaggcgaagatgctgctcgataacatcaacaccccggaggggatcatccctgcactgttcgagcccgagcgcgagaagagtgctgccatagacggtgaataccggctacgcggcgaggcccgtaagacgttcgtggagctcatgcgcaggggcgacttacccgtctggctgtcttacaaggtggccagtgagggtttccagtactccgaccgccggtggtgcttcgacggggagcgcaataatcaggtgctcgaggagaacatggatgtagagatctggaccaaggagggtgagcggaaaaagctgcggccccggtggctggacgcccgcacttacagcgatccactcgcgttgcgggagtttaaggagttcgcggctggacgccggagcgtgtcgggggacctgatcttggaaatcggcaaactgccgcaacaccttaccttgcgagcgcagaacgccttagacaatctcgtgatgctccacaattcggagcaaggagggaaagcgtatcggcacgccatggaggagctgcccgacaccatcgagacgctgatgctcctggcgttaatcgccgttctaaccgggggtgtgaccctgttcttcttatccgggaagggcctaggcaagacaagcatagggctgttgtgcgtgatggcgtcaagcgtgttattatggatggcatccgtggagccccactggatcgccgcctcgatcatcctggagttcttcttaatggtcttgctgattcccgagccggatcgccaacggacccctcaggacaaccagctcgcgtacgtcgtgatcggtttactgtttatgatcctcacagtcgcggccaacgagatggggctgctggaaaccaccaagaaggacctcggcattgggcacgtcgtggccgagaatcaccaccatgccacgatgttagacatcgacttacaccccgccagcgcgtggaccttgtacgctgtggccaccactatcatcacgccgatgatgcgccacaccatagaaaacaccaccgccaacatcagcctgacagccatcgctaaccaggccgccattctgatgggcctagacaagggctggcccatctctaagatggatatcggcgtcccattgctggccctcggctgctatagccaggtgaaccccctgaccctgacagccgcggtgcttatgctggtcgcccactacgccatcattgggccgggtctgcaggccaaggcgacccgagaggcccaaaagagaacggctgccgggatcatgaagaacccaactgtggacggcatcgtggccattgacctagaccccgtcgtgtacgacgcgaagttcgagaagcagctgggccagatcatgctgctcatcctgtgcacctcacaaatcctgctcatgcgcaccacgtgggccctctgcgagagcatcaccctggccaccgggccactcaccacgctgtgggaaggctccccggggaagttctggaataccaccatagccgtctcgatggccaacatttttcggggtagctatctagccggtgccgggctcgccttcagcctgatgaagtcgcttggcgggggccgcagagggacgggtgcgcagggagagacactgggggagaagtggaagcgccagcttaatcagcttagcaaaagcgagttcaacacatataagcgatccggcataatggaggtcgatcggtcggaggccaaggaagggctcaaacggggagaaacaacaaagcacgcggtgtcacgtgggacggcaaagctgcggtggttcgtagagcgcaacctggtcaaacccgaggggaaggtgatcgaccttggctgcgggcggggcgggtggagctattattgcgccggcctcaagaaggtgaccgaagtaaaagggtacacaaagggcggcccggggcatgaggagcccatccctatggctacatacggctggaatatcgtgaagctgcactccgggcgcgatgttttcttcacgcctcccgagaagtgtgatactctactgtgcgacatcggcgaaagctctccaaacccgaccattgaggaagggcgaacgctgcgagttctgaaaatggtggagccctggctccgagggaaccagttctgcatcaaaatcctgaacccctacatgcccagtgttgtcgagacgctggaacagatgcagcgcaagcacggcgggatgctcgtgcggaacccgctgtccagaaacagtactcacgagatgtattgggttagttgtggcacggggaacatcgtcagcgccgtaaacatgacgtcccgcatgctgctaaaccggttcacgatggcccataggaagcccacgtacgagcgggacgtggatctaggggccggcactcgccacgtcgcagtagagccggaaatcgccaatctcgacatcataggacagcgcatcgagaacataaagaacgaacacaaaagcacctggcactatgacgaggacaatccttacaagacctgggcgtaccatggttcctacgaagtgaagccgagcgggtcagctagctccatggtcaatggcgtggtgcgcctattgacgaagccgtgggacgttatccccatggtgacacagatcgccatgaccgacaccacgcctttcgggcagcagcgggtattcaaggagaaggtcgacacccgcaccccgcggcccaaacgcggcacagcccagatcatggaggttaccgccaagtggctgtggggcttcctcagccggaacaagaaaccccgaatctgcacgcgcgaggagttcaccagaaaggtccggagcaacgcggctattggggccgtttttgtggatgagaaccaatggaactccgccaaggaggccgtcgaggatgagcgcttctgggacctggtgcaccgcgagagagagctgcacaagcagggcaagtgcgcgacctgcgtgtacaacatgatggggaagcgggagaagaaacttggcgagttcgggaaggccaaggggtcccgagctatctggtacatgtggctgggggcccggtttctggagttcgaggcgctcggtttcatgaacgaagaccactggttctcccgcgaaaacagcctgagcggcgtcgaaggggaaggcctgcacaagctcggatacatactgcgtgacatcagcaagatcccgggcggcaacatgtacgccgacgacacagcaggctgggacaccaggataaccgaagacgacctgcaaaacgaagccaagatcacggacattatggagccagagcacgccctgttggcaaccagcattttcaagctaacctatcaaaacaaggtggtgcgcgtacagaggccagcgaagtcaggcaccgtgatggacgtaatctctcggagagaccagcggggtagcggccaagtagggacctacggtctaaacacatttaccaacatggaggtacaattaatccggcaaatggagtccgaaggcatcttctctccttccgagctggagaacagcaacctcgccgagcgcgttctggattggttagagaagcatggggtcgagcggttaaaacggatggccatatccggagacgactgcgtggtcaaaccaaccgacgaccgattcgcaaccgccctgaccgccctgaacgacatgggaaaagtgcgaaaggacataccccagtgggagcccagcaagggctggaacgactggcagcaagtacctttctgcagccaccactttcaccaacttatcatgaaggacggcagagagatagtagtcccatgccgcaaccaggacgagctggtggggagggccagggtcagccaaggcgccgggtggagcttacgtgagacggcctgcctcggcaagtcctacgcgcagatgtggcaactgatgtatttccatcgcagggacctgcgcttagcggccaacgccatctgcagcgccgtcccagtgaattgggtgcccaccagtcggaccacctggagcattcacgctcatcaccaatggatgacgacagaggacatgctgtccgtctggaaccgggtctggatcgaggagaacccctggatggaggataagacccacgtatcatcctgggaagacgttccctacctcgggaagcgggaggatcaatggtgtggcagcctcatcggcttaacagcccgcgcaacgtgggccaccaatatccaggtggcgatcaaccaggtgcgcagattgatcgggaacgaaaactacctcgactacatgacctccatgaaacgctttaagaacgagagcgaccccgagggagccttatggtaa

SEQ ID NO: 24726 - RNA, 9879 nt, synthetic construct
  misc_feature 1..9879: note = derived and/or modified CDS sequence (opt11) from DENV-1__KM403592__SS-prME
  source 1..9879: mol_type = other RNA
tccgtgaccatgctgctcatgctgttaccaaccgccctggcattccacttaaccacccggggcggggaaccccacatgatcgtgagcaagcaggagcggggcaagagcctcttgttcaaaaccagtgccggtgtgaacatgtgcaccctgatcgccatggacctgggcgaactctgcgaggacactatgacatacaagtgccctcgtatcaccgaggcggagcccgacgacgtggactgctggtgcaacgccacggacacctgggtgacctatgggacctgttcccagaccggcgagcatcggcgtgacaagcggtccgtggccctggcgccccacgtgggcctggggctcgagacgcgcaccgagacatggatgagttccgaaggcgcctggcggcagatccaaaaggtcgagacctgggcactgcgccatcccgggttcaccgtgatcgccctcttcctcgcgcacgccattggcaccagcataacccagaagggtatcatattcatcctgcttatgctagtaaccccctccatggccatgaggtgcgtaggaatcggcaaccgcgactttgtggaggggctgagcggcgccacgtgggtggacgtggtgctggagcacgggtcctgcgtgaccactatggccaagaacaagccgaccttagacatcgagttactgaagacggaggtcacgaaccccgcggtcctacggaagctgtgcatagaggccaagatcagcaatacgaccacggactcccgctgccccacccagggggaggccaccttagttgaagagcaagacgccaatttcgtctgtaggcgcaccttcgtggacagaggctgggggaacgggtgcggcctcttcggcaaaggaagtcttctgacgtgcgccaaattcaagtgtgtgactaaactcgaaggaaagatcgtccagtatgagaatctgaaatactccgtgatagtgacagtacataccggcgaccaacaccaggtgggaaacgagacgaccgaacacggcaccatcgcgactataacgccccaggctcccacgagcgagatccagctgaccgactacggggccctcaccctggactgtagcccccggaccggcctggacttcaacgagatggtcctcctgacgatgaaggagaagagctggctggtccacaagcaatggttcctcgacctgcctctgccctggacctcaggggccagcacctcgcaagagacctggaaccgccaggatctcctcgttacgttcaagacggcccacgcgaagaagcaggaggtggtagtcttgggatcccaggaaggggccatgcacaccgcgctcaccggggccacggagattcaaaccagcggcactaccacgatcttcgccgggcacctgaagtgccgcctgaagatggacaaactcaccctgaaaggcgtatcctacgtgatgtgcaccgggtcattcaagctggagaaggaggtggcggagacccagcacgggacggtgctggtccaggtgaagtacgaaggcaccgacgccccctgcaagatacccatctccacccaggatgagaagggggtcgcgcagaacggccggctcatcaccgccaacccgatcgtgacggacaaggagaagcccgttaacattgagaccgagccacccttcggggagagctacatcgtcataggcgcgggcgagaaggccctgaagttatcctggttcaaaaaggggagctccattggcaagatgtttgaggccaccgcccgtggggcccggcggatggcgatcctcggtgacaccgcctgggacttcgggagcatcggtggtgtcttcacgtccgtgggcaagcttgtccaccaggtgttcgggaccgcctatggcgtgctgttcagcggcgtctcctggaccatgaagatcgggatcggcatcctcctgacctggctgggcctcaacagccgctcgactagcctgtccatgacctgcattgccgtagggatggtcacgttatacttgggcgtcatggtgcaggccgattcagggtgtgtcataaactggaagggcagggagctgaaatgcgggtccggcatattcgttactaacgaggtgcacacttggaccgagcaatacaagttccaagcagacagtccgaaacgcctgagcgccgccatcggcaaggcgtgggaggagggggtgtgcggcatccggtccgccactcgcctcgaaaacatcatgtggaagcagatcagcaacgagctgaaccatatcttgctagagaacgacatgaagttcaccgtggtagtcggggacgcgaacggcatcctgactcaggggaagaagatgatccgtccccagcccatggagcacaagtacagttggaagtcctggggcaaggccaagatcatcggcgccgacacgcagaacaccacctttatcatcgacgggcctgacactccggagtgccccgacgaccagcgcgcctggaacatctgggaagtcgaggactacggcttcggggtgttcacgacgaacatctggctgaagctccgggattcctatacccaaatgtgcgaccacagattgatgagcgcggccatcaaggactccaaggccgtgcatgccgacatgggctactggatagagagcgagaagaacgagacctggaaactggcccgggcgtctttcatcgaggtcaagacgtgcatctggcccaggagtcataccttgtggtccaacggcgtgctggagagcgagatgatcatcccaaagatctacgggggcccgatctcgcagcacaactatcggcctggttacttcacccagaccgccggaccgtggcacctggggaagttagagctggacttcaatctctgcgagggcacgacggtagtcgtggacgagcactgcggcaatcgtgggccaagcctccggaccaccacggtgaccggcaaaatcatccacgaatggtgctgccgctcctgtaccttaccgcccctgcggttccgcggggaggacggctgctggtatgggatggagatccggcccgtcaaggagaaggaggaaaacctcgtgcgctcaatggtttccgctggcagcggcgaggtagacagcttcagcctcgggttgctctgcgttagcatcatgatcgaggaggtgatgcggtccagatggtctcgcaagatgctgatgaccggcacgctggccgtcttcttcctcctgatcatgggacagctcacctggaacgacctcgtgagactgtgcattatggtgggcgccaacgtctcagaccgcatggggatgggcaccacatatctggcgctgatggccaccttcaagatgcggcccatgttcgccgtggggctgttgttccgccggttaaccagccgcgaggtcctgttgctaaccatcggactgtcgctggtagcctctgtggagctccccaacagcctggaggagttgggcgacgggcttgccatggggatcatgatgctgaagctgctcaccgatttccagagccaccagctgtggactaccctgctctctctgacattcatcaagaccacgctcagcctagactacgcgtggaagacaatggccatggtcctgagtatcgtgagcctatttcctctctgcctgtccaccaccagccagaagacgacctggctgcccgttctcctggggtctttcgggtgcaagccgttaaccatgttcctcatcaccgagaacaagatctggggccgaaaaagctggcccctgaacgaggggatcatggccgtgggcatcgtgtccatcctgctctccagcctgttaaagaacgacgtgcccctcgccgggcctctgatcgcgggcggcatgttaatcgcctgctacgtaatctccgggagctccgccgacctcagcctcgagcgcgccgccgaggtgtcctgggaggaggaggcggagcacagcggagcctcccacaacatcctcgtggaggtccaggacgacggcacaatgaagatcaaggacgaggagcgggatgatacgctgaccatcttgctgaaggccaccctgttggcagtaagtggcgtctacccaatgtccatccccgccaccctgttcgtctggtacttctggcagaagaagaagcagcgaagcggggtactctgggacacgcccagcccgcccgaggtggagcgcgcggtcctggacgacggcatctaccgaatcctgcagcgtggcctgctcgggcgctcccaggtaggcgttggtgtgtttcaggacggcgtgttccataccatgtggcacgtgacccggggggcagtcctgatgtaccagggcaagagattggaaccctcctgggccagcgtcaagaaggacctcatctcctacggtggcggctggcggttccagggaagttggaacaccggggaggaggttcaggtcatagccgtggaacccgggaagaaccctaagaatgtgcagacgatgcccggaaccttcaagacgcccgagggtgaagtcggggccatagcgctggacttcaaacccggcacctccgggtctcccatcgttaaccgcgagggcaagatcgtgggcctgtacgggaacggcgtagttacaacgtcggggacctatgtgagcgcgatagcccaggccaaggccagccaggagggaccgctccccgagatcgaagacgaggtcttcaagaagcggaacctgaccatcatggacctgcaccccggctccggcaagacgcgccggtacctccctgcaatcgttcgcgaggcgatcaagcgcaagctgcggaccctgatcctcgcccctacccgtgttgtcgccagcgagatggcggaggccctaaaaggcatgcccattcgataccaaacgacggctgtgaaatccgaacacaccgggaaggagatcgtggacctgatgtgccacgccacctttaccatgcgcctcctgagccccgtgcgggtaccgaactacaatatgatcatcatggacgaggcccatttcacggaccccgcgtccatcgcagccagagggtacatcagcacccgggtggggatgggtgaggccgccgcgatcttcatgaccgctaccccgcccgggtccgtcgaggcgttcccgcaaagcaacgctgtaatccaggacgaggagcgcgacatccctgagcgctcctggaacagcggctacgattggataacggacttccccggcaaaaccgtgtggttcgtcccctctatcaagagcggtaacgacatcgccaattgcctgcgcaagaatggcaaacgggtgatccagctctcccgcaagaccttcgacaccgagtaccagaagacgaaaaacaacgattgggactacgtggtcaccaccgacatctctgagatgggggcgaacttccgggccgaccgcgtgatcgacccgcggcgctgcctgaagccggtcatcctgaaggacggccccgaacgggtgatcctcgccgggccgatgccggtgaccgcagcctccgccgcccaacgccggggccgcatcggccgaaaccagaacaaggagggcgatcagtacatctacatgggacagcccctgaacaatgacgaggaccacgcccactggacggaggccaaaatgctgctcgacaacatcaacacccccgaagggatcatccccgcgcttttcgagccggagcgtgagaagtccgcagccatcgacggcgagtaccgcctccgcggggaggcccgcaagaccttcgtcgagttgatgcggcgcggcgatctgcccgtgtggttgtcctataaggtggccagcgagggattccagtactccgaccggcgctggtgtttcgacggggagcggaacaaccaggtcctcgaggagaacatggacgtggagatatggaccaaggaaggagagaggaagaagctgcggccacgctggttggacgcgcgtacgtacagcgaccccctcgccctgcgcgagtttaaggagttcgccgccgggcggagaagcgtgtccggcgacctgatcctcgagatcggcaaactgccgcagcatctgaccctccgggcccagaacgcgctggacaacctggtcatgctccacaacagcgagcagggagggaaggcctaccgccacgccatggaggagctacccgacaccattgagaccctgatgctccttgccctgatcgcggtgctcaccggcggcgtgaccctgttcttcctgtccgggaagggactcggcaagaccagcatcggtctgctttgtgtcatggcctcctccgtgctcctgtggatggcctccgtggagccgcattggatcgcggccagcatcatcctggagttcttcctcatggttctactgatccccgaaccggaccgtcagcgcacgccccaggacaatcagctggcttatgtcgtgatcgggctgttgttcatgatcctcaccgtcgccgccaacgagatggggctgctggagacgaccaagaaagacctgggcatcgggcacgtggtggccgagaaccaccaccacgctacgatgctggatatcgatctgcacccggcgtccgcctggaccctctacgcagtagccacgaccatcatcaccccgatgatgcgacacaccatcgagaacactaccgccaacatcagcctgaccgcgatcgccaaccaggccgcgatactgatgggcctcgacaagggctggccgatctccaagatggacataggggttcccctgctggccctcgggtgctacagccaggtgaatcccctgaccctgacggcagccgtgttgatgctggttgcccactacgcaatcatcgggccgggcttgcaggccaaggccacccgtgaggcccagaagcgcacagccgccggtatcatgaaaaaccccaccgtcgatggaatcgtcgcgatcgacctcgaccccgtggtgtacgacgccaagttcgagaagcaactgggccaaatcatgctgctcatcctgtgcacatcccagatcttactaatgcggactacctgggctctgtgcgagagcatcactctggccacgggccccctcaccaccctgtgggagggcagtcccgggaagttctggaataccaccatcgccgtcagcatggcgaatatcttccgcggctcctacctggccggcgccggcctggccttcagtctgatgaagagcctgggcggcggccgccgcgggacaggcgctcaaggcgagaccctgggagagaagtggaagcggcagctgaaccagctgagcaaaagcgagttcaatacctacaagcgctccggcattatggaagtggaccggagcgaggcgaaagaggggttaaagcgcggcgagacgaccaagcatgctgtctcccgggggaccgccaaattgcgctggttcgtagagcggaacctggtgaagcccgagggcaaggtgatcgacctggggtgcgggcgcggagggtggagctattactgcgccgggctcaagaaggtaaccgaggtgaaggggtatacgaagggcggccccgggcacgaggagcccataccgatggccacctatggctggaacatcgtgaagctacattccgggcgggacgtcttcttcaccccgcccgagaagtgcgacacccttctctgcgacataggcgagagctcccccaatccgacaatcgaggaggggcgcacgctgcgggtgctgaagatggtggagccatggctccgcggcaaccagttctgcatcaagattcttaatccctacatgcctagcgtcgttgagaccctggagcagatgcagaggaagcacggggggatgctcgtgcgcaatccgctgtcccggaacagcacccacgagatgtactgggtctcctgcggcaccgggaacattgttagcgcagtgaacatgacttcacgcatgctgctcaatcgcttcaccatggcccaccggaagcccacctatgagcgcgacgtggacttgggcgccggcactcggcacgtggccgtggagcccgagatcgcgaacctggatatcatcgggcagcgcatagagaatatcaaaaacgaacacaagagcacttggcactacgacgaggataatccctacaagacctgggcctaccacggctcctatgaggtcaagccgagcggctctgccagctcgatggtgaacggcgtcgtgcggctcctgaccaagccctgggacgtgatccccatggtcacccagatcgccatgacggacaccacccccttcggtcagcagcgcgtgttcaaggaaaaggtggacacccggactccgcgacccaagcggggcaccgcccagattatggaggtgaccgcgaagtggctgtggggcttcctcagccgcaataaaaagccccgcatctgcacccgcgaggagttcaccaggaaggtgcgcagcaacgctgcgataggagcagtgttcgtcgacgaaaaccaatggaactccgcaaaggaggcggtggaagacgagcggttctgggacctcgtgcacagggagagggagctgcacaaacagggcaaatgcgcaacgtgcgtatacaacatgatggggaagagagagaagaagttaggcgagttcgggaaggccaagggctcccgggccatctggtatatgtggctgggcgcacgcttcttagagttcgaggccctcggattcatgaacgaggaccactggttctcccgggagaactcgctgtcaggtgtcgagggggagggcctgcacaagctcgggtacatactgcgcgacatcagcaagattccgggcgggaacatgtacgccgacgataccgccgggtgggacacgcgcatcacggaggacgatctgcagaacgaggccaaaatcaccgacatcatggagcctgaacacgcgctccttgccacctccatcttcaaactgacctaccagaacaaggtagtacgggtgcagcgccccgctaagagcggcacggtgatggacgtgatctcccggcgcgaccaacgggggtcgggacaggttggcacctacggtctcaatacattcaccaacatggaggtgcagttgatccgccagatggagtccgagggaatcttctcaccctccgagctagagaacagcaacctcgccgagagagtactggactggctcgagaagcatggggtggaacgcctcaagcggatggcgatctccggggacgattgcgtggtcaagccgacggatgaccgcttcgcgaccgccctgaccgctctgaacgacatggggaaggtgcggaaggacatcccccagtgggaacccagtaagggttggaacgattggcagcaggtgcccttctgttcccaccacttccatcaactcatcatgaaggacggtcgcgagatagtcgtgccttgccgtaaccaggatgagctcgtggggcgggcccgtgtaagccagggcgccgggtggagcctgcgcgaaaccgcgtgcctcggtaagtcgtacgcccagatgtggcagctgatgtacttccaccggcgcgatctgcggctcgccgccaacgccatctgctccgcggttcccgtgaactgggtccccacttcccgcaccacctggagcatccatgcacaccaccagtggatgaccaccgaggacatgctgtccgtgtggaaccgcgtgtggatagaagagaacccctggatggaggacaagacgcatgtcagctcctgggaagatgtgccgtacctgggaaagcgggaggaccagtggtgtggcagccttatcggactgaccgcccgggccacctgggcgaccaacatccaggtagcaataaaccaagtccggcgcctgatcgggaacgaaaactaccttgactacatgacctccatgaagcgattcaagaacgagagcgaccctgagggcgcactgtggtaa

SEQ ID NO: 24727 - RNA, 9879 nt, synthetic construct
  misc_feature 1..9879: note = derived and/or modified CDS sequence (opt11) from DENV-1__KM403593__SS-prME
  source 1..9879: mol_type = other RNA
agcgtgaccatgctgctcatgctgctgcccaccgccctcgcgttccacctgacgactcggggcggggagccccacatgattgtgagcaagcaggagcggggcaagagccttctgttcaagacgagcgcaggggtgaacatgtgcaccctgatcgccatggacctcggggaactctgcgaggacaccatgacctacaagtgcccccgtatcaccgaagcggagcctgacgacgtagactgctggtgcaacgccaccgacacctgggtgacttacgggacctgcagccaaaccggcgagcaccggcgcgacaagcggtccgtggccctggcgccccacgtgggcctggggctcgagacgaggaccgagacctggatgtcctccgagggagcttggcggcaaatccagaaggtggagacctgggccctgcgccaccccgggttcacggtgatcgcgctgttcctcgctcacgcaatcggcaccagcatcacccagaaggggataatctttatcctgctgatgttagttaccccttccatggcaatgcggtgcgtcggcataggcaatcgcgacttcgtagaggggctgagcggagccacctgggtggacgtggttctggagcatgggtcctgcgtgaccaccatggccaaaaacaagccaaccctcgacatcgagctgctgaagacggaagtcacaaaccccgcggtgcttcgaaagctgtgcatcgaggccaagatcagcaacaccaccacggactcgcgctgccccacccagggcgaggccacattagtggaggagcaggacgccaacttcgtctgccggagaactttcgtggaccggggctgggggaacggctgcggactcttcggcaaggggagcctgctgacgtgtgccaagttcaagtgcgtcaccaagttagaagggaagatcgtccaatatgagaacctgaaatacagtgtgatcgtgaccgtccataccggtgaccagcaccaggtggggaacgaaaccaccgagcacggtaccatcgcgacgataacgccccaggccccaacgagcgagatccagctgaccgactacggggccctcaccctagactgcagcccccggaccggtctggacttcaacgagatggtcctcctgaccatgaaggagaagtcctggttggtgcacaagcagtggttcctcgacctgcctctgccctggacctccggggccagcacaagccaggagacctggaaccggcaagacctcctggtgacgttcaagaccgcccacgcgaagaagcaggaggtcgtggtgctgggcagccaagagggtgcgatgcacaccgccctcaccggggccacggagatccagaccagcggcaccaccacgatcttcgccgggcacctaaagtgccgcttgaagatggacaagctgaccctgaagggcgtctcctacgtgatgtgtacagggagcttcaaactggaaaaggaggtggctgagacacagcacggcacggtcctggtccaggtaaagtacgagggcacagatgccccctgcaagatccccatctccactcaggacgagaaaggagtagcccagaacggtcggctcataactgccaacccgatcgtgacggacaaggagaagccagtgaacatcgagaccgagccgcccttcggcgagagctacatcgtcataggggctggcgagaaggccctgaagctgagttggttcaagaaggggagctccataggcaaaatgttcgaagccaccgccagaggggcacgacgcatggccatcctcggcgacaccgcttgggatttcggtagcatcggcggcgtgttcacctccgtgggaaagctggtccaccaggtgttcggcaccgcctacggagtgctgttctccggcgtgtcctggaccatgaaaatcgggattggcatactcctgacatggctaggactaaacagccgttccacgagcctgtccatgacttgcatcgcagtggggatggtgactctgtaccttggtgtcatggtgcaagctgacagcggttgcgtgatcaactggaagggccgagagcttaaatgcggctccggcatattcgtcaccaacgaggtgcacacgtggaccgagcaatataaattccaggcggatagccccaagcgcctatccgccgctatcggcaaggcctgggaggagggggtgtgcggcatcaggtccgccacccgtctcgaaaacatcatgtggaagcagatcagcaacgagctgaatcacatcctgttagagaacgacatgaagttcaccgtcgtagtgggggatgcgaacgggatcctgacccaaggaaagaagatgatccgaccccagcctatggagcacaagtactcctggaagtcgtggggcaaggccaagataatcggcgcggacacacagaacactaccttcatcatcgacgggcctgataccccggaatgtccagacgaccagcgcgcctggaacatctgggaggtcgaggactacggcttcggtgtgttcacgaccaacatctggctgaagctccgggacagttacacacagatgtgcgaccaccgcctgatgtctgcggccattaaggactcgaaggccgtgcacgccgatatgggctactggatagagagcgagaagaacgagacatggaagctggcccgggcgtccttcatcgaggtaaagacgtgcatctggccaagaagccacaccctctggtcgaatggcgtgctagagtcagagatgattatccctaagatatacgggggtccgattagccagcataactaccgccccgggtatttcactcagaccgccggcccctggcacttggggaagctcgagctagatttcaacctttgcgagggcacgactgtggtcgtggatgaacactgcggcaaccgcgggccgagtctccgtactaccacggtgaccggcaagatcatacacgagtggtgctgccgcagctgtaccctgccgcccctgcgctttcgcggggaagacggctgctggtacggcatggagatccggcccgtcaaagagaaggaagagaacctcgtgcgcagcatggtgtccgccggcagcggcgaggtcgacagcttcagcctggggctgctctgcgtgagcatcatgatcgaggaggtgatgcggtcccgctggagccgcaagatgctgatgacgggcacgctggccgtcttcttcctattaatcatggggcaactgacctggaacgacctcattagactctgcatcatggtgggtgccaacgtctccgaccgcatggggatgggcaccacctatctggcgctcatggccacgttcaagatgcggccgatgttcgcagtgggcctgctgtttcgccggcttaccagccgcgaggtgctgctgctcaccatcggtttgtccctggtagccagcgtagagttacccaactcgctggaggagttgggcgacggcctcgccatgggcatcatgatgctcaagctgctcaccgacttccagagccaccaactgtggacgaccttgctctcattaaccttcatcaagaccacgctgagcctcgactacgcgtggaagaccatggccatggtgttgtcaattgtctctctgttcccgctctgcctgtccaccacaagccagaagacgacctggttacccgtgctgctgggctccttcgggtgcaagcccctgacaatgttcctcatcaccgagaacaagatctggggccgcaaaagctggcccctgaacgaggggatcatggccgtgggcattgtctccatcctgttgagcagcctgctgaagaacgacgtgccgctcgccgggcctctgatcgcgggcggcatgctgatcgcctgctacgtgatctccgggagctccgctgacctcagcctggagagagccgccgaagtttcctgggaagaagaagcggagcactctggcgcctcccacaacatcctggtggaggtacaggacgacggaaccatgaagatcaaggacgaagaacgggacgatacgctcactatcctgctaaaggccactctcctggccgttagcggagtgtacccgatgtccatccccgccacgctgtttgtgtggtacttctggcagaagaaaaagcagcgcagcggggtcttgtgggatacgccctcgccgcccgaggtggagcgggcggtgctggacgacggcatctacagaatactgcagcggggcctgctcgggcgctcccaagtcggcgtgggagtgttccaggacggcgtttttcataccatgtggcacgtaacccgcggcgccgtccttatgtaccagggcaagcgcctggagccctcgtgggccagtgtcaagaaggacctcatctcctatggcgggggctggcgattccaggggagctggaacaccggcgaggaggtccaggttatcgccgtggagcccgggaagaatcccaagaatgtgcagacaacccccggcaccttcaagacccccgagggcgaggtgggggcaatcgccctggacttcaagcccgggacgtccggtagccccatcgtaaacagggagggcaagatcgtgggcctgtacgggaacggcgtggtaaccacctccgggacctacgtcagcgccatcgcgcaagccaaggcaagccaggagggcccgctccccgagatcgaggacgaagtcttcaagaagcggaacctgacgatcatggacctccaccccgggtccggcaagacccgccggtacttaccggcgatcgtccgcgaggccatcaaacgcaagttacggaccctgatcctcgcccccacacgcgtggtggccagcgagatggcggaggcccttaaggggatgcccattcggtaccagactacggccgtcaagtccgaacacaccgggaaagagatcgtagacctgatgtgccacgccaccttcacgatgcgcctcctgagccctgtgcgggtcccgaactacaacatgatcattatggacgaagcccacttcacggacccggcgtccatcgccgcgcgcggctacatcagcaccagagtggggatgggcgaggccgccgcgatcttcatgaccgccacgccgcccgggtccgtggaggccttcccgcaaagcaacgccgtcatccaggacgaggagcgagacatccccgagcgctcgtggaatagtgggtatgactggatcaccgacttccccggcaagaccgtgtggttcgtgccatccattaaaagcgggaatgacatcgccaactgcctgcgcaagaatggcaagcgggtcatccagctctcccgcaagacgttcgacacggaatatcaaaagaccaagaacaacgactgggattacgtggttaccaccgacatcagcgagatgggggcgaacttccgagccgacagagtcatcgacccgcggcgctgcctgaaacccgtgatcctgaaggacggccccgagcgggtaatcctcgccgggcccatgcctgtgacggccgcgtcggctgcccagaggcggggccgcatcggccgcaaccaaaacaaagagggggaccaatacatctacatgggccagcccctgaacaacgacgaggaccacgcccattggaccgaggcgaagatgctgctcgacaacatcaacactccagaggggatcattcccgctctgttcgagccggagcgtgagaaaagcgctgccatcgacggggaataccggctgcgcggggaagcacgcaagaccttcgtggagctaatgcggcgcggcgaccttcccgtctggctgtcatacaaggtggccagcgagggctttcagtactccgaccggcgctggtgctttgacggggagaggaacaaccaggtgctcgaggagaatatggacgtcgagatctggacgaaggagggcgagcgcaagaagctgagaccccgctggctggacgcgcggacctacagcgaccctctcgctctgcgcgagtttaaggagttcgccgcgggacgtcgaagcgtgtccggcgacctgatcctcgagataggcaagctgccgcaacacctgaccctccgggcacagaacgctctggacaacctggtgatgttgcacaacagcgagcagggcggcaaggcctacaggcacgccatggaggagctgcccgacaccattgagaccctgatgctcctggcactgattgcggtcttgacaggtggggtgaccctgtttttcctgtccgggaaaggactcgggaagaccagcatcggtctgctgtgtgtgatggcttcgagcgtcctcctgtggatggcctccgtagagcctcactggatcgccgccagcataatcctggagttcttcctcatggtgctgcttatccccgagcctgaccgtcaacgcactccccaggataaccagctcgcgtacgtcgtgattggcctactgttcatgatcctcacggtggccgccaacgagatgggcttgctggagaccacgaagaaggacctgggcatcggacacgtcgtagcggagaatcaccatcacgcgacgatgctggatatcgacctgcaccccgcctccgcatggacgctctacgccgtagcgaccaccatcattactccgatgatgcggcacacgatcgagaacactaccgccaacatcagtctgaccgcgatcgcgaaccaggcagcgatcctgatgggcctcgacaagggctggccgatcagcaagatggacataggggtccccctgctggccctcggttgctattcacaggtaaaccccttaacgctgactgctgccgtgctcatgctggtcgcacactacgccatcatcgggccgggcctgcaggcgaaggccacccgcgaggcccaaaagcgcaccgccgccgggatcatgaaaaaccccacggttgatggcattgtagcgatagacctcgacccggttgtgtatgacgccaagttcgagaagcagctgggccagatcatgctgttgatcttatgcacctcccagattttactgatgcgcaccacctgggccctgtgcgagagcatcacactggccaccggccccctcaccaccctgtgggagggctccccggggaagttctggaacacgacgatcgcagtgagcatggcgaacatcttccgcggctcctatctggccggagcggggctcgccttcagcctcatgaagtccctagggggtggccgtcgcgggaccggcgctcagggcgagaccctcggggagaagtggaaacggcagttgaatcagctgagcaagagcgagtttaacacctacaagcggtctggcatcatggaggtcgatcggagcgaggcgaaggaaggtctcaagcggggcgagactaccaaacacgccgtgtctcgggggactgccaagttgcgctggttcgtggagcggaatctggtcaaacctgagggcaaggtaatcgaccttggctgcggtcgcggcgggtggtcttactattgtgcaggcctcaagaaggtgacagaggtcaaggggtacaccaaaggcggtcccgggcatgaggaacccatcccgatggcgacctacggctggaacattgtaaaactgcactccgggcgggacgtcttcttcactccgcccgagaagtgcgacaccctgctctgcgacatcggcgagagctcccccaacccgacgattgaggagggccgaaccttgcgagtcctgaagatggtggaaccctggctcagaggcaaccaattctgcatcaagatcctgaacccctacatgccctcggtggtcgagaccctggagcagatgcagcggaagcacggcgggatgctcgtgcgtaatccgctgagtcggaacagcacccacgagatgtactgggtttcctgcggcactggtaacatcgtcagcgctgtaaacatgacctcccgcatgctgctcaatcgcttcaccatggcccaccggaagcccacctatgagagagacgtggacctcggcgccggaacgcggcacgtcgccgtggagcccgagatcgcgaacctggacatcatcgggcaacgcatcgagaacatcaagaacgagcacaagagcacctggcactacgacgaagacaacccctacaagacatgggcctaccacggctcctacgaggtaaagccatccgggtccgccagctccatggtcaacggcgtggtccggctcctcaccaagccctgggacgtgatccccatggtgacgcagatagccatgaccgacaccacgccctttggccaacagcgcgtattcaaagaaaaagtggacacccggaccccacgccccaagcggggcaccgcacagatcatggaggtcaccgctaagtggctgtggggcttcctcagccggaacaagaagccccggatctgcacacgggaggagttcacacggaaggtccgcagcaatgccgcgattggggccgtgttcgtggacgagaaccaatggaactcagccaaggaggcggtcgaggacgagcggttctgggatctagtgcatagggaaagggagctgcataagcagggcaagtgcgcgacctgcgtgtacaacatgatggggaagcgcgaaaagaagttgggagagttcgggaaggccaagggcagccgggctatctggtacatgtggctgggggcgcgcttcctagagttcgaggccctagggttcatgaacgaggaccattggttttcccgggaaaacagcctgtccggagtggaaggggagggactgcacaagttggggtatatcctgcgcgacatcagcaagatcccgggcggcaacatgtacgccgacgacaccgccgggtgggatacgcgtatcaccgaggacgacctgcagaacgaggccaagatcacagatatcatggagccagagcatgcgttgctggccacgtccattttcaagctgacgtaccaaaacaaggtggtgcgggtccagcgcccggccaagagcggcactgtgatggacgtcatctcccggcgggaccagcgggggagcggccaggtcggcacatatgggctcaacactttcaccaacatggaggtgcagctaattcgtcagatggagtccgagggcatctttagcccctccgagctggagaacagcaatctcgccgagcgggtcctcgactggctcgagaaacatggtgtcgagcgccttaagcggatggcgatctcgggcgacgactgcgttgtgaagccgaccgatgaccgcttcgcgaccgccctgactgccctgaacgatatggggaaggtccgcaaggacattccccagtgggagcccagcaaaggctggaacgattggcaacaggtcccgttctgctcccatcacttccaccagctcatcatgaaagacggacgcgaaatcgtggttccgtgccggaaccaagacgagctggtggggcgcgcccgtgtgagccaaggcgccgggtggtcgctgcgcgagacggcgtgtctcggcaagtcctacgcgcagatgtggcagctgatgtacttccaccgccgcgacctacggctcgccgccaacgccatctgcagcgccgtccccgtgaactgggtccccacctcccgcaccacctggagcatacatgcccaccatcagtggatgaccacggaggatatgctatccgtctggaaccgcgtgtggatcgaggagaacccctggatggaggataagacccacgtgtcatcctgggaggacgtcccgtacctggggaagcgggaggaccaatggtgcggcagcctcatcggcttaaccgcccgcgccacctgggcgacgaacatccaggtagccataaaccaggtgcgcaggctcatcgggaatgagaactacctagactacatgacctccatgaagcggtttaagaacgagtctgaccccgagggcgccctgtggtag

SEQ ID NO: 24728 - RNA, 9879 nt, synthetic construct
  misc_feature 1..9879: note = derived and/or modified CDS sequence (opt11) from DENV-1__KM403603__SS-prME
  source 1..9879: mol_type = other RNA
agtgtgacaatgttactcatgctgctgcccacggccctcgccttccacttaaccacccggggcggggagccccacatgatagtcagcaaacaggaaaggggtaagagcctcctttttaagacctccgcgggggtcaacatgtgcactctcatcgccatggatctgggcgagctctgcgaggatacgatgacctacaagtgccctcgaatcaccgaggccgagcccgacgacgttgactgctggtgcaacgccaccgacacgtgggtaacctacgggacctgctcccagacgggcgagcacagacgagacaagcgatccgtagccctcgctccccacgtgggactggggctggagacgagaaccgagacctggatgtcttccgagggagcttggcgtcagatccaaaaggtggagacctgggccttgcgacatcccgggttcacggtcatcgctctgttcctcgcgcacgccatcggcactagcatcactcaaaagggaatcatcttcatcctgctgatgttggttaccccctcgatggccatgcggtgcgttggcatcggcaatcgcgacttcgtggaggggctctcaggcgccacctgggtggatgtcgtgctggagcacgggtcctgcgtgactaccatggccaagaacaaacccacccttgatatcgagctgctgaagacggaagtgaccaaccccgcggtgctccggaaactctgtatcgaggcgaagatctccaacaccaccacggactcccgctgccccacccagggagaagcgaccctggtggaggagcaagacgccaatttcgtctgccgaaggacgttcgtagacaggggatgggggaacggctgcggactattcggaaaggggagcctgctgacgtgcgccaaattcaagtgcgtgaccaagctcgagggcaaaatcgtgcagtacgagaatctgaagtacagcgtgatcgtgacggtccacaccggcgaccagcatcaagtgggcaacgagacaaccgagcacggtactatagcgaccatcacgccgcaagcaccgacgagcgagatccagctgacagactatggggctctcacgctggactgctctcctagaacagggctagacttcaacgagatggtcctcctgactatgaaggaaaagtcctggttggtgcacaagcagtggtttctcgacttgccactgccctggacctccggagccagcaccagccaggagacctggaatcggcaggacttgttggttaccttcaaaacagcacacgcgaagaagcaggaggtcgtagtgctgggcagccaagagggcgccatgcacacagctctgaccggggccacggagatccagaccagcggcaccaccactatatttgcgggtcacttaaagtgccgcctgaagatggacaagttgaccctgaagggggtctcgtatgtgatgtgcacagggtcttttaagctggagaaggaggtggcggagacccagcacggcacggtcctagtccaggtgaaatacgaaggcaccgatgccccctgcaagattccaatctccactcaggacgaaaaaggggtcacccagaacggccggctcatcacggccaacccaatcgtcaccgataaagagaagcccgtgaacatcgagacagagcctccttttggagaaagctatatcgtcatcggagctggagagaaggctctcaagctgtcctggttcaagaaggggagcagtatcggtaagatgttcgaagccaccgcccgcggggcccggcgcatggcgatccttggagatacggcctgggacttcgggagcatcgggggcgtgttcacctcagtcgggaagctagtccaccaggtcttcggcaccgcgtacggagtgctgttcagtggtgtgtcctggaccatgaagatcggaataggcatcttgctgacgtggctgggtctcaatagccgcagcaccagcctgagtatgacgtgtatcgccgttgggatggtgaccctgtaccttggggtcatggtgcaggccgactcagggtgcgtaatcaattggaagggcagggaactgaaatgtgggtctggcatattcgtcacgaacgaggtacacacatggaccgagcagtataagtttcaggccgattccccgaagcgactcagcgcggcaatcggcaaggcctgggaagagggggtgtgcggcatccggagtgccaccaggctcgagaatatcatgtggaagcagatatccaacgagttaaaccatatcttgctcgagaacgacatgaagttcacagtcgtggtgggggacgccaacggcatcttgactcaggggaagaagatgatccgaccccagcccatggagcacaaatactcgtggaagagctggggcaaggcgaaaattatcggggccgacacacagaacaccaccttcatcatcgacggaccggacacgccggaatgccccgacgaccagcgagcctggaatatctgggaggtggaggactacggcttcggggtgttcacgaccaatatctggttaaagctccgggactcctacacacagatgtgcgaccaccgcttaatgtctgcagcgatcaaggacagtaaggcggtgcacgccgacatgggctattggatagagtcggagaaaaacgagacgtggaaactagctagggccagtttcatcgaggtcaagacctgcatttggccacgcagccacactctctggtccaacggcgtgctggagagcgagatgataatccccaagatctacgggggcccgatctcgcagcacaactatcggcctgggtatttcacccaaacggcaggtccctggcacctggggaagctcgagctggatttcaacctgtgcgagggcaccactgtggtcgtggatgaacactgcgggaaccgcgggccctcactgcggaccacaaccgttaccggcaagatcatacatgagtggtgctgccgctcgtgcacactgccgcccctgcggttcaggggggaagacggatgctggtacgggatggagatccgccctgtcaaggagaaggaggagaacctggttcggtcaatggtgtccgccggcagcggcgaggtggactctttctccctggggctcctctgcgtcagcataatgatcgaggaggttatgcggtcccggtggtctagaaagatgttaatgacggggaccctggccgtgtttttcctcctgatcatgggacagctgacctggaacgacctgatccgactgtgtattatggtgggggccaacgtgtctgaccgcatggggatgggcaccacgtatctggccctcatggcgaccttcaagatgcggccgatgttcgccgtcgggctgttgttcaggagactcactagccgcgaggtactgctcctcaccatcgggctgtccctggtcgctagcgtggagctccctaactcgctggaggaactgggcgatgggctcgccatgggtatcatgatgctcaagctgctcacggattttcagagccaccagctgtggactaccctgttgtctctgaccttcatcaaaaccaccctgagtttggactacgcctggaagaccatggctatggtgctgtccatcgtatcgcttttccccctctgcttgtccacaacgtcacagaagacaacctggctgcccgtcttactgggctcgttcggctgtaaaccgctgaccatgtttctcatcaccgagaacaagatctggggccgcaagagttggcccctgaacgaagggatcatggccgtgggtattgtctcaatattgctcagcagcctgctgaagaacgacgtgcccctcgccgggcccttaatcgctggaggtatgctgatcgcgtgctacgtgatatccgggagctccgccgaccttagcctggagcgcgccgcggaggtcagttgggaggaggaagcggaacacagcggagcctcccacaacatccttgtggaggtgcaggacgacgggacaatgaaaataaaggacgaggagcgggacgacaccctaacgatcctgctgaaggccaccctcctggcggtctctggagtatacccaatgtcaatccccgccacgctgttcgtgtggtacttttggcagaagaaaaaacagcgctcgggggtcttgtgggacactccatcccctcccgaggtggagcgggctgtgctggacgacggcatctaccgcattctgcagcggggattactcggacgcagccaggtcggggtgggggtgttccaggacggtgtgttccacaccatgtggcacgtgacccggggggcggttctgatgtaccaaggtaagcgcctcgaaccatcctgggccagcgtcaagaaggacttaatctcttatggcgggggttggaggttccaagggagctggaatacgggtgaagaggtccaggttatcgccgtggagcccgggaaaaaccccaagaacgtgcagaccacacccggcacattcaaaacacccgagggcgaggtgggcgccatcgccctggacttcaagcctggcaccagcggaagccccattgtgaatcgcgagggcaagatcgtcggcctgtatgggaacggcgtggtcaccacctccggaacgtacgtcagtgcgatcgcccaggccaaggccagccaagagggcccgttacccgagatcgaggacgaggtgttcaagaaacggaacctgaccatcatggacctgcaccccgggagcggcaagacccgtcgctacctccccgccatcgttcgcgaggccatcaagcgcaaactgcggacactgatcctcgcccccacgagagttgtggccagcgagatggccgaggcgctcaagggcatgccgattcggtaccagacaaccgcggtcaaatccgagcataccgggaaagagatcgtggacctgatgtgtcacgctacgttcaccatgcgtctgctgagccccgtgcgggtcccgaactacaacatgattatcatggacgaggcccacttcacagacccagccagtatcgcagcccgcgggtacatcagcaccagagtaggcatgggcgaggccgccgcgattttcatgacggcgacgccgcccggaagtgtggaggccttcccgcagagcaacgccgtcatccaggacgaggagcgcgacatccctgagcgctcttggaacagcggctacgactggattactgacttccctggcaagaccgtgtggttcgtcccctccataaagagcgggaacgacatcgccaattgcttgcgtaagaacgggaagcgggtcatccaactctcgcgcaagacgttcgacaccgagtaccaaaagaccaaaaacaacgactgggactacgtggttaccacggacataagcgagatgggggccaacttcagagcggaccgcgtgatcgacccccggcgctgcctgaagcccgtgatcctgaaggacggcccggagcgggtcattctcgccgggcccatgccggtaaccgccgcctccgcggcgcagcgaaggggccgcatcggccgcaatcaaaacaaggagggcgaccagtacatctacatgggccaacctctgaacaacgatgaagatcacgctcactggaccgaagccaaaatgctgctcgacaatatcaacacccctgaggggataatacctgcactgtttgagccggaacgcgagaagtccgcggccatcgacggcgagtaccgattacgcggggaggcccgcaagaccttcgtagagctaatgcggagaggcgacttacccgtatggctgagttacaaggtggccagcgagggcttccagtattccgaccgtcgctggtgtttcgacggggagcggaataaccaagtgctcgaggaaaacatggacgttgaaatctggactaaggagggagagagaaagaagttgcggccccgctggctggacgcacggacttacagcgacccgctagcgttgagagagttcaaagaattcgccgcgggacggcgcagtgtgtccggggacctgatccttgagataggcaagctgccacagcacctgacgctgcgggcccagaacgccttagacaacttggtgatgctccacaacagcgaacaaggcgggaaggcgtaccgccacgccatggaggagctgcccgacaccatcgagacgctcatgctcctggcgttgatcgccgtcctcactgggggcgttaccctattcttcctgtccgggaaaggcctcggaaagacctcgattggactattatgcgtgatggcgtccagcgtgctcttgtggatggcctccgtcgagccccattggatcgccgcctccatcatactggagttcttcctcatggtgttgctaatacccgagccggatagacagcgcaccccccaagacaaccagctggcctacgtcgtcatcggcctgctgttcatgattctcactgtggcggccaacgagatgggattgctggagaccaccaagaaggacctcggcatagggcacgtcgtggccgagaaccaccatcacgccacgatgctggacatcgatctccaccctgcttccgcgtggaccctgtacgctgtggccaccaccatcattacgccaatgatgaggcacaccatcgagaacactaccgcaaatatcagcctaacggccatagcgaaccaggccgcgatcctaatgggcttggataagggctggcccatctccaaaatggatatcggcgtccccttactagcattaggctgttacagccaagtgaatcccctgaccctgaccgctgcggttctaatgcttgtcgcgcactacgccatcatagggccgggcctgcaggccaaggcgacccgcgaggcccagaagcgcacggcggccgggatcatgaagaacccgaccgttgacggcatcgtggcaatagatctcgaccccgtggtatacgacgcgaaattcgaaaaacagctgggccagatcatgctgctcatcctctgcacctctcaaatcctccttatgcggaccacttgggccctgtgcgaaagcatcaccttagccacaggaccactcactacgctgtgggaggggtcccctgggaagttctggaacacaaccatagccgtgagcatggcgaatattttccgcggctcctacttggctggcgccggtttagcattcagcctgatgaagacactgggcggtggccggagggggactggcgcccagggcgaaactctcggggaaaagtggaagcgccagctgaaccagctgtccaagagcgagttcaacacctataagcgcagcggcatcatggaagtcgaccggtccgaagccaaggaggggctcaaaagaggcgagaccacgaagcacgcggtgagccggggcacagccaagctgcggtggttcgtcgagcggaatctggtcaagcccgaaggaaaggtcatcgacctgggatgtgggcgcggcgggtggtcctactactgcgcgggactcaagaaggtcaccgaggttaaggggtacaccaaggggggccctgggcatgaggagcccatcccgatggccacctatggatggaatatcgtgaaactgcacagcgggcgggatgtgttcttcacgccgccggagaagtgcgacactctgctctgcgacattggggaatcctcccccaaccctacgatcgaagagggtcgcaccctccgggtcctgaaaatggtggagccctggttacgcggcaaccagttctgtataaagatcctgaacccttacatgccctccgtggtggagaccctagagcaaatgcagcgcaagcacggcgggatgcttgtgaggaacccgctgagcagaaattccacccacgaaatgtactgggtgagctgcggcacaggaaacattgtctccgcggtgaacatgacgtcccgaatgctgcttaaccgattcacgatggcgcacagaaagccaacctatgaacgcgatgtggatttaggcgccggcacccggcatgttgccgtggagcccgagatagccaacctggacattatcggtcagcgaatcgagaacatcaagaacgagcataaatcaacctggcactacgacgaggacaatccatacaagacctgggcgtaccacggcagctacgaggtgaaaccgtccgggagcgcctcgagcatggtcaacggggtggtccggctcctgaccaagccctgggacgtgatccccatggtgacacaaatcgccatgacagacacgacgcccttcgggcaacagcgcgtcttcaaggagaaggtggatacccggaccccgcggcctaagcgggggactgcacagataatggaagtgacagccaagtggctgtgggggttcctctcccgcaacaaaaagccccgtatctgcacccgcgaggagttcactagaaaagtccgatcgaacgcggcaatcggggccgtgttcgtggacgagaaccagtggaacagcgctaaggaagccgtcgaggacgaaaggttctgggacctggtccaccgcgaacgggagctgcacaagcaaggaaaatgcgcgacgtgcgtgtataacatgatggggaagcgcgagaaaaaactcggtgagttcgggaaggctaagggatctcgggccatctggtacatgtggctcggggcccgctttctggagtttgaagccttggggttcatgaacgaggatcactggttttcccgggagaactccctgagcggcgtcgagggagaggggctccacaagctcgggtacatcttgcgtgacatttccaaaattccggggggcaacatgtacgccgacgacaccgcggggtgggatacacgcatcaccgaggacgacctgcagaatgaggccaagattacggacattatggagcccgagcatgcactgttggctacatccatattcaagctgacctatcagaacaaggttgtgagagtgcaacgcccggccaagtcaggcaccgtgatggacgtaatcagccggcgggatcagcgtggctccggccaggtcggtacttacgggctcaataccttcaccaacatggaagttcagctgattcggcagatggagagcgagggcatattctcacctagcgaattggagaactccaatctcgcggagagggtgttggactggctggagaagcacggggttgaacgcttgaagaggatggccatctccggggacgattgcgtagtgaagccgaccgatgacaggttcgcaactgcgctgaccgccctgaacgatatgggcaaggtaaggaaagacatacctcagtgggagccctccaaaggctggaatgactggcagcaggtcccgttctgcagccaccactttcatcagttaatcatgaaagacgggcgtgaaatcgtagtcccatgcagaaaccaggacgagctggtggggcgcgcccgggtgagccagggagccgggtggagcctgcgcgaaaccgcctgcctcggcaagagttacgcgcagatgtggcagttgatgtacttccaccgtagggacctgcggctcgccgctaatgccatctgttccgcagtcccagtgaactgggtgcccacctcaagaactacctggagcatccatgcgcaccaccaatggatgacgacggaggacatgctgagcgtctggaaccgcgtgtggatcgaagagaatccctggatggaagacaagacccatgtctccagctgggaggacgtcccatacctgggaaaacgggaagaccagtggtgcggctccctcatcggcctgaccgcccgtgcgacctgggccaccaacattcaagtggcgataaaccaggtccggagactgatcggtaacgagaactacctcgactatatgaccagcatgaaacgcttcaagaacgaatctgaccccgagggcgccctctggtga

SEQ ID NO: 24729 - RNA, 9879 nt, synthetic construct
  misc_feature 1..9879: note = derived and/or modified CDS sequence (opt11) from DENV-1__KM403585__SS-prME
  source 1..9879: mol_type = other RNA
agcgtgaccatgctgttaatgttgctacccaccgccctcgccttccacctgaccacccggggtggagagccccacatgatagtcagcaagcaggaaaggggcaagtccttacttttcaagacctccgcgggggtaaacatgtgcaccctgatcgccatggacctgggcgaattgtgcgaggatacgatgacttacaagtgccccagaatcaccgaggccgagcccgacgacgtagactgttggtgcaatgcgactgacacttgggtgacctacggcacctgtagccagaccggcgagcaccggcgggacaagcgctccgtggcactggcgccccacgtcggcctggggttggagacacgcaccgagacatggatgagctccgaaggtgcctggcggcagatccagaaggtcgagacctgggccctgcgccacccagggtttacggtgatcgccttatttctcgcgcacgccatcggcaccagcataacgcagaagggcattattttcattctgctaatgctcgtaactccctccatggctatgagatgcgtaggcatcggcaaccgcgacttcgttgaggggcttagcggggcaacgtgggtagacgtcgtgttggagcacggatcctgcgttaccaccatggccaagaacaagccaacactggacatcgagttgctgaagacggaagttaccaaccctgctgtactacggaagctttgcatcgaggccaaaatcagtaacacaaccacggactcacgctgccccacccagggcgaggccaccctggtggaggagcaggacgcaaacttcgtctgccggcggacgttcgtggaccggggctgggggaacggctgcgggctcttcggcaaaggatccctgctgacttgtgccaagttcaagtgcgtgaccaagctcgagggcagaatcgtccagtacgagaacctgaagtactccgttattgtcaccgtgcacactggcgatcagcatcaggtggggaacgagacgaccgagcacggcaccatcgccaccatcacgccccaggcccccacaagtgaggtgcagctaaccgactacggggccttaactctggactgctcgccccgaaccggtctggacttcaatgaaatggttcttctgaccatgaaggagaagtcctggttggtgcataagcagtggttcctcgacttgcccttaccttggacctccggggcgtcgaccagccaggaaacctggaaccgccaagacctcttggtaacgttcaagaccgcccacgcgaagaagcaagaggttgtggtcctgggctcccaggagggggccatgcacacagccctcaccggggccacggaaatccagaccagcggaaccactactattttcgccggccacctgaagtgccggctgaagatggacaaactcaccctgaagggtgtgtcgtatgtgatgtgcacagggagctttaagcttgagaaagaggtcgcggagacccagcatggcacggtcctagtgcaggtcaagtacgagggtacggacgctccctgcaagatccccatctccacgcaggacgagaagggggtgacccagaacggtcgcctcatcacggccaaccctatagttaccgataaagagaagcccgtcaacatcgaaaccgagccgcccttcggagagagttacatcgtgatcggcgccggcgagaaggcactgaagctgtcctggttcaagaagggtagctccatcggcaagatgttcgaagccaccgcccgtggggcccgccgaatggccatcttaggcgacacggcgtgggacttcggaagcatcggcggcgtattcaccagtgtcgggaagcttgtgcaccaggtgtttggcaccgcctatggggtcctgtttagcggcgtgagctggaccatgaagatcgggatcggcatcttacttacgtggctgggcctcaacagccgatccacgagcctgtccatgacctgcatcgccgtggggatggtcaccctttacctgggagttatggtgcaggcagacagcgggtgcgtcattaactggaagggtcgagagctgaagtgcgggtccggcatctttgtgacgaacgaggtgcatacctggacggaacagtataagttccaggccgacagtcctaagcgtctgagcgcggcaattggtaaggcctgggaggagggggtctgcggcatccgctccgcgactcggctagagaacatcatgtggaagcagatcagcaacgagctgaatcacatcctgctcgagaacgacatgaagtttactgtggtcgtaggagacgcatacgggattctcacgcagggaaagaaaatgatacgcccccagcccatggagcataagtactcctggaagtcttggggcaaggccaagatcattggcgccgacacgcaaaacaccaccttcataatcgacgggcccgacacgccggagtgccctgatgaccagcgggcctggaacatctgggaggtagaggactatggattcggagtgttcaccaccaacatctggttaaagttacgggactcctatacccagatgtgcgaccaccggctgatgtcagccgcaattaaagattctaaggcggtccatgccgacatgggctattggatcgagagcgagaaaaatgagacgtggaaactggcccgcgccagcttcatcgaggtcaagacatgtatctggccgcggagccataccctctggtccaacggcgtgcttgagtctgagatgatcatccccaagatctacgggggcccgatttcccagcacaactatcgccccggttactttacccaaacggccggcccctggcacctggggaagctcgagctggacttcaacctatgcgagggcactaccgtcgttgtggacgagcactgcggcaaccggggaccgagtctccgcacgactaccgtcacaggcaaaatcatccacgagtggtgctgccgctcatgcaccctaccgcccctgcgcttcagaggggaagacggctgctggtacgggatggagatccgcccagtgaaggagaaagaagaaaacttggtgcggagcatggtatccgccggcagcggcgaggtggacagcttctccctgggtctgctctgcgttagcataatgatcgaggaggtcatgcgctcccgctggtcacggaagatgctgatgacgggcaccctcgctgtgttctttctcctgatcatggggcaactcacctggaacgacctcatccgtctctgtatcatggtgggcgcaaacgtctccgaccggatgggaatgggcaccacgtacctggcactgatggcgaccttcaagatgcgtccgatgttcgccgtggggttgctgttccgccgcctcaccagccgggaggtcctgctgctcaccatcggtctgtcgctggtcgccagcgtggagctccccaacagcctggaggagctgggcgatgggctagccatggggattatgatgctgaagctgctaacggactttcagagccatcagctgtggaccacgctgttatccctcaccttcatcaagacgactctgagcctcgattacgcctggaagaccatggcgatggtcctgagcatcgtcagcctctttccactctgcctgtcgaccactagccagaagacaacgtggctgcccgtgttactgggtagcttcggctgcaagcctctgaccatgttcctgatcaccgagaataagatctggggacgcaagagttggcccctgaacgaagggatcatggccgtcggaatcgtgtccatcctgctctccagcctgctgaagaacgacgttcccctcgctgggcccctgatcgctggcggcatgctgatcgcgtgttacgtcatctccgggagctccgccgacctcagcctggagcgggccgccgaggtgtcatgggaagaagaggccgagcacagcggtgcgagtcacaacatcctggtggaggtccaggacgacgggacgatgaagattaaggacgaggagagagacgatacccttaccatactgctgaaggctaccctcctggccgtttcaggcgtgtacccgatgtccatccccgccacactgttcgtctggtacttctggcagaagaaaaagcagcggagcggtgtgctctgggacaccccgtcgccgcccgaggtggagcgggccgttctggacgacggtatctaccggatcttgcagagaggcctgttagggcggagccaagtgggcgtgggcgtcttccaggatggcgtgttccacaccatgtggcacgtgacccgcggggccgtcctgatgtaccaaggcaagcggctggagcccagctgggcctctgtgaagaaggacctcatttcctacggcgggggctggcgtttccaagggagctggaacacgggcgaggaggtccaggtcatcgcagtggagccggggaagaaccccaagaacgtgcaaaccacccccggcacgttcaagacccccgagggcgaggtcggggccatcgccttagacttcaagcccggcacttcggggagcccgatcgtgaaccgggagggaaagattgtgggcctgtacgggaatggcgttgtcaccacttccgggacgtacgttagcgcaatcgcccaagccaaagctagccaggagggaccactccccgagatcgaggacgaggtcttcaaaaaacgcaatctgaccattatggacctccatcccggtagcggtaagacgcggcgctacctccctgctatcgtgcgggaggccatcaagcggaaactgcgcaccctgattctcgccccaacgcgggtggtcgcttcagaaatggccgaagccctaaagggtatgcccatccgctatcagaccaccgctgtgaaatccgaacataccggtaaagagatcgtcgacctgatgtgtcacgccacgttcaccatgcgactcctctctcctgtgcgcgtgccgaactacaacatgatcataatggacgaggcccacttcaccgaccccgcctccatcgcggcccgtgggtacatcagcacccgagtaggcatgggcgaggccgctgccatattcatgacggcgacgccgcccgggtccgtcgaggccttcccacagagcaacgcggtaatccaggacgaggagcgcgatatccctgagagatcctggaatagcggttatgactggatcaccgacttccccggcaaaaccgtgtggttcgtcccctccatcaaatcggggaacgacatcgctaactgcttacggaagaacggcaagcgtgtgatccagctctccaggaagacgttcgacaccgagtaccagaagaccaagaacaacgactgggactatgtggtgaccacggacatcagcgagatgggcgccaacttccgcgcggaccgggtgatcgacccgcgccggtgcctgaaaccagtcattcttaaggatggtcccgaacgcgtgatcctggcaggacccatgcctgtgaccgccgcatccgcggcccagaggcgcggccgcatcggacggaaccagaataaagagggggaccagtatatctacatggggcagcccctgaataatgatgaggaccacgcgcattggacagaggccaagatgctgctcgacaacattaacactcccgaggggatcatccccgctctgttcgagccggagcgcgagaagtccgcggccattgacggggagtaccggctacgcggggaggcccggaaaacgttcgtcgagctcatgcgccggggcgacctacccgtgtggctgtcctacaaggtcgcctcagagggctttcagtacagtgatcgccggtggtgcttcgacggggagcgcaataaccaggtattggaggagaacatggacgtggagatctggaccaaagagggcgagcggaagaagctgcgcccacgttggctggacgcccgaacttacagcgaccccctggcgctgcgggagttcaaggaattcgccgccgggcgtagaagcgtgtccggcgacctgatccttgaaattgggaagcttccgcaacacctgacgcttcgcgcccagaatgccctggacaacctggtcatgctccataacagcgagcagggcgggaaggcttaccggcacgccatggaggagttacccgacaccatcgaaacgctgatgctcctggccctgatcgctgtgctcaccgggggggtgaccctgttcttcctatccggcaaaggactcggtaagaccagcatcgggctgctgtgcgtcatggcgtccagcgtgctcctgtggatggcaagtgttgaaccccactggatagccgccagcatcatactggagttcttcctcatggtcctgctgatcccggagcctgacagacagcggacaccccaggacaaccagctggcctacgtggtgatcggcctgctgttcatgatcctcactgtcgcggccaatgagatggggctgctggagaccaccaagaaggacctcggcattgggcacgtcgtggccgagaaccatcaccatgccacgatgctggacatcgatctgcaccccgcttccgcgtggacgctatacgccgtcgctacaacgatcatcacgcctatgatgcggcacaccatcgagaacaccaccgccaacatcagcctgacggccatcgcgaaccaggccgccattctgatgggcctcgacaagggctggcccatttcgaagatggacatcggtgtgcccttgctcgccttaggctgctacagccaggtgaaccccctgacactaaccgccgcggttctaatgcttgtggcccactacgccatcattggaccaggcctgcaggccaaggcgacccgcgaggcccagaagcggacggcagccgggattatgaagaacccaaccgtagacggcatcgtcgctatcgacctcgaccccgttgtgtacgacgcgaagtttgagaagcagcttggacagatcatgctactcatcctgtgtacgtcccagatcctgctgatgcggaccacttgggccctgtgtgagagtataaccctggccaccgggcctctcaccacgctgtgggagggttccccggggcggttctggaacaccaccatcgccgttagcatggcgaacatctttcgcggatcctatctggcgggcgcaggtttagcattcagcctgatgaagtccctgggcgggggcaggcgcggtactggcgcccaaggcgagacgctcggcgagaagtggaaacggcagctgaaccagctgagcaagagcgaattcaacacttacaagcgcagcggcatcgtggaggttgaccgtagcgaggctaaggaggggatgaagcgcggcgaaaccaccaaacatgcggtctcccgggggacggctaagctccgttggttcgtggagcggaatcttgtgaagcccgagggcaaagtcatcgacctggggtgcgggcgcggcgggtggagctattactgcgccggccttaagaaggtgaccgaagtgaaggggtacaccaaaggaggccccgggcacgaggagcccataccgatggccacgtatggctggaacattgtcaagctccactccgggcgggacgtgttctttacgccgcccgaaaagtgtgacaccctcctgtgcgacatcggcgagtcgtcacccaacccaaccatcgaagaggggcgcaccctccgcgtgctgaagatggtcgagccctggctgcgcggcaatcagttctgtataaagatcctcaacccctacatgcccagcgtagtggagacgctagagcagatgcagaggaagcacggtgggatgctggttcggaaccctctctcccgcaacagcacgcacgagatgtactgggtgtcttgcggcaccgggaacatcgtgtccgcggtcaatatgacctcccgcatgctactgaaccgcttcacaatggcccaccggaagcccacgtacgagcgcgacgtggacctcggcgccggcacccggcacgtggccgtcgagccggagatcgccaatctggacattatcggacaacgcatcgagaacatcaaaaatgagcacaaatccacctggcactacgatgaggacaacccctacaagacctgggcgtaccacggctcctacgaggttaagccgtcggggtccgccagctccatggtcaacggcgtggtgagactgctcacgaagccctgggacgtcattccgatggtgacccagattgccatgactgacaccacgccgtttgggcagcagagggtgttcaaggagaaagtcgacacgcgcacacctcgaccgaagcggggcacagcccagatcatggaggtgacggccaagtggctctggggcttcctgtcccgcaacaagaagccccgcatctgtacccgcgaggagttcacccggaaagtacgctcaaacgccgccatcggcgccgtcttcgtggatgaaaatcagtggaactccgccaaggaggccgtggaggacgagcggttctgggatctcgtccaccgcgagcgcgagctgcacaagcaaggcaagtgcgcgacgtgtgtgtacaacatgatgggcaaacgcgaaaagaagctgggggagtttgggaaagccaaaggcagccgggccatatggtacatgtggctcggcgcccgcttcctcgagttcgaggcgctggggtttatgaacgaggaccactggttctcccgcgagaactcactctccggagtggagggggagggcctgcataaacttgggtacatcttacgggacatcagcaagatccctggagggaacatgtacgccgatgacacggctgggtgggatacacgcataaccgaggatgacttgcaaaacgaggccaagatcaccgacatcatggaaccggagcacgccctactggctacatccatcttcaagctgacatatcagaataaggtcgtgcgggtacagcggcccgccaagagcggcaccgtcatggacgttatcagccggcgcgatcagcggggaagcggccaggtgggcacttacgggctgaacacgttcaccaacatggaggtccagctcatccgtcaaatggagtccgagggcattttcagccccagcgagctggagaatagcaacttggctgaaagggtgctcgactggctggagaagcatggggtggagcgcctgaagcgcatggccatatccggggacgactgcgtggtcaagcccaccgacgaccgcttcgcaaccgcgctcacagcgctgaacgacatggggaaggtgcggaaagacatcccacagtgggagccctcgaagggctggaacgactggcagcaggtcccattttgctcacaccactttcaccaattaatcatgaaagatggtagagagatcgtggtaccatgcaggaaccaggacgagctcgtcgggcgcgcaagagtgagccaaggcgccggctggtctctgagagaaaccgcctgcctcggaaagtcctacgcgcagatgtggcagttaatgtatttccacagacgcgaccttcgcctggcggccaatgccatctgttcagccgtgcccgtcaactgggtgcccacctctagaaccacctggagcatccacgcgcaccaccaatggatgacgaccgaagatatgctctccgtgtggaacagagtctggatagaagagaacccctggatggaggataagacgcatgtgagctcttgggaggatgtaccgtacctggggaaacgggaggaccagtggtgcggcagcctgatcggcctcacagcacgggctacatgggccactaacatccaggtcgcaatcaaccaagtgaggcgtctgatcggcaacgagaattacctggactacatgacctccatgaagcggttcaagaatgagagcgaccccgagggcgcactctggtga

SEQ ID NO: 24730 - RNA, 9879 nt, synthetic construct
  misc_feature 1..9879: note = derived and/or modified CDS sequence (opt11) from DENV-1__KM403595__SS-prME
  source 1..9879: mol_type = other RNA
tccgtgaccatgctgctcatgctgctacccaccgccctcgccttccatctgaccacccggggaggggagccccacatgatcgtgtcgaaacaggagcggggaaagagcctcctgttcaaaacctccgcgggggtgaatatgtgcactctgatcgctatggacctgggagagttatgtgaggacacgatgacctataaatgcccccggatcactgaggccgagcctgacgacgtggactgctggtgcaacgccaccgacacgtgggtcacctacggaacctgcagccaaaccggcgaacaccggcgcgaccggcgctccgttgccctggctccccacgtgggcctgggcctcgagacgcggaccgagacgtggatgagcagtgagggcgcctggcgtcagattcagcgggtcgaaacctgggccctaagacacccggggttcacggtgatcgctctgttcctcgcacacgcgatcggaaccagcattacccaaaaggggatcatattcatcctgctgatgctcgtgaccccctccatggccatgcggtgcgtcggaatcggaaaccgcgatttcgtggaggggctgagcggggccacgtgggtggatgtcgtgctggagcacgggtcctgcgtgacaactatggccaagaacaagccgaccctcgacatcgagcttctgaagacggaggtgaccaaccccgcggttttacggaagttatgcattgaggccaagatcagcaacaccacgacggactctcgctgccccacccagggcgaggccaccctggtcgaggagcaggatgcaaacttcgtctgccgccgcactttcgtggaccggggctgggggaacggttgtggcttgttcggcaagggcagcttactaacgtgcgccaagttcaagtgcgtgactaaactggaggggaagatcgtccagtacgagaacctcaagtactccgttatagtgaccgtccacaccggtgaccagcatcaggtaggcaacgagacgactgagcacgggaccatcgccaccatcacgccccaggccccgacaagcgaaatccagctgaccgactacggggcccttaccttagattgcagccctcgcacgggcctggacttcaacgagatggtcctgctgacgatgaaagagaaatcctggctggtccacaagcagtggttcttagacctgcccctgccttggaccagtggagcctcgaccagccaggagacctggaaccggcaggacctcctggtgacgtttaagaccgctcacgcgaagaaacaggaggtcgtggtgctgggctcccaggagggcgccatgcacaccgctctaacaggggccacggagatccagacgagcggcaccaccaccatcttcgccgggcatctgaaatgccgcctaaagatggacaagctgaccttaaagggagtctcctacgtgatgtgcaccgggtctttcaagctggagaaggaagtggcggagacgcaacatgggacggtcctcgtacaagttaagtatgagggcacggacgcgccctgcaagatccccatttccacgcaggatgagaagggggtcacacagaacggccggctcatcaccgccaacccgattgtgacagacaaggaaaagcccgtaaacatcgagatcgagccgccgttcggcgagtcttacatcgttatcggcgccggcgagaaggcgctgaaactgtcctggtttaaaaaggggtctagcatcggtaagatgttcgaggccaccgcacgcggggctcgccggatggccatcttaggcgacaccgcttgggatttcggtagcataggcggagtgttcacgtccgtcgggaaactggtacaccaagtgttcggcaccgcttacggggtcttgttcagcggtgtctcctggacgatgaagatcgggatcggcatcctcctgacctggctgggcctcaacagccgctcgacgtcgctgtccatgacgtgcatcgcagtggggatggtaaccctgtacctcggagtcatggtgcaggccgactcggggtgcgttatcaactggaagggccgggagttaaagtgcgggagcggcatcttcgtcaccaatgaggtgcacacttggaccgaacagtacaagttccaagccgatagccccaagcgcctgtctgctgccatcggcaaggcctgggaagagggtgtgtgcggcatccggtccgctactcgcctcgagaacatcatgtggaagcagatcagcaacgagctgaaccacatcttattggaaaacgacatgaaattcaccgtcgtggtgggggacgccaacggtatcctgacccagggcaaaaagatgatccggccccagcccatggaacacaagtactcgtggaagtcctgggggaaggccaagataatcggcgccgacacgcagaacaccacttttatcatcgatgggcccgataccccggagtgtcccgacgatcagagagcatggaacatctgggaagtggaggactatgggttcggggtatttacgaccaacatctggcttaagctccgggactcctacacacagatgtgcgaccacaggttgatgtcggccgcgatcaaggactccaaggccgtgcacgcagacatgggctactggatcgagtccgagaagaacgagacctggaagctcgcccgcgcctccttcatcgaggtgaagacgtgcatctggccccgcagccacactctctggtccaacggcgtgctggagagcgagatgatcatccccaagatctacgggggcccgatctcccagcacaactatcggcccgggtacttcacccagaccgccggcccctggcacctagggaagctcgagctggacttcaacctgtgcgagggcacgaccgtggttgtcgatgagcactgtgggaaccgtgggccgagccttcggaccaccacggtgaccggcaagatcatccatgaatggtgctgcaggtcctgcaccctgccacccttgcgattcagaggggaagacggctgctggtacgggatggagatccggccagtcaaagagaaggaggaaaacctcgtgagaagcatggtgtcagccggcagcggcgaggttgactccttctccctggggctgctctgcgtaagcattatgatagaggaggtgatgcgttcccggtggagccgcaagatgctgatgaccggtactttagccatctttttcctcctgataatggggcagttaacctggaacgacctcatccggctgtgcatcatggtgggcgccaacgtgtcagatcgcatggggatgggcaccacctacctggccttgatggctacgttcaagatgcgtccgatgttcgccgtggggctgcttttccgccggctcaccagtcgcgaggtcctgctactcaccatcgggctgtccctggtggccagcgtcgaactccccaattcccttgaggagttgggagacgggctcgctatgggcatcatgatgctgaagctgctcactgacttccaatcacaccagctgtggacgacactgctgtcccttaccttcatcaagacaacgctaagtctggactacgcctggaagaccatggcgatggttctgtccatcgtgagcctatttccgctctgcctgtcaaccaccagtcagaagactacctggctgcccgtcttgctgggctccttcgggtgcaagccgctgaccatgttcctcatcaccgaaaacaagatatggggccgaaagagctggcccctaaacgagggtattatggccgtggggatcgtgtccatcctgttaagcagcctgctgaagaacgacgtccccctcgccgggccccttatcgctggcggcatgctgattgcgtgctacgtgatttccgggagctccgccgatctcagtctagagagagccgcagaggtgtcctgggaagaggaagccgagcacagcggcgcgtcccacaatatcctggtcgaggttcaggacgacgggacaatgaagatcaaggacgaggagcgggatgacacacttaccatattgctgaaggccaccctcctggcagtgagcggagtctatccaatgtccatcccggccaccctgttcgtgtggtacttctggcagaagaaaaagcagcgtagcggggtgctctgggacacgccgagcccgcctgaggtcgaacgggccgtgctggacgacggcatctaccgcattctccaacggggcctacttgggaggagccaggtcggcgtcggtgtattccaggacggcgtgttccacacaatgtggcacgtcacccgcggggcggtactgatgtaccagggcaagcggctggagccgtcctgggccagcgtgaagaaggacctcatctcctacggcggtggctggcgcttccaggggtcatggaacaccggcgaggaagtccaggtgatagctgtggagcccgggaagaacccgaagaacgtccagacgacccctggaaccttcaagactcccgagggagaagtgggggccatagctctggacttcaaacccggaacgtctgggagcccgatcgttaaccgcgagggcaaaatcgtcggcctgtacgggaacggcgtggtgaccacctccgggacctacgtctccgcgatagcccaggccaaagccagccaggaaggcccgctccccgagatcgaggacgaggtgttcaagaagcggaacctcacaattatggacctgcatcccgggtcaggcaaaacccgacggtacctcccggccatcgtccgggaagcgatcaagaggaagctgcggacgctgatcctcgcccccaccagagttgtggctagcgagatggccgaggcgctaaaggggatgcccattcggtaccagacgacagccgtgaagtccgaacacaccgggaaggaaatcgttgacctgatgtgccacgccaccttcacgatgcgcctcctgagccccgtgagagtgccaaactataacatgatcatcatggatgaggcccactttaccgaccctgccagtatcgccgcccgcggctacattagcaccagagtggggatgggcgaggctgccgccatcttcatgaccgctacgccgcccgggtccgtggaggccttcccgcaaagcaacgccgtgatccaagacgaggagcgcgacatccccgagcgcagttggaatagcggctacgactggatcaccgactttcccggcaagacggtctggttcgtaccctccatcaaatcagggaacgacatcgccaattgtctgcgcaagaatggcaaacgagtcatccagctctcccggaagaccttcgacacagagtaccagaagaccaagaacaacgactgggattatgtggtgaccactgacatcagcgaaatgggtgccaactttagggcggaccgcgtaatcgacccgcggcgctgtctgaagcccgtgatccttaaggacggccctgaacgggtgatcctcgccgggcccatgccggtcaccgcagcgagtgcggcccagcgccgcggtcggatcggccgcaaccagaacaaagagggtgaccaatacatctacatgggccagcccctgaacaatgacgaagatcatgcccactggaccgaggccaaaatgctgcttgacaacatcaatacccccgaagggatcatccccgccctgtttgaaccggagcgggagaagtccgcggcgatagatggcgagtataggctgcgcggagaggcacgcaaaaccttcgtggagctaatgcggcgcggcgacctgccggtgtggctgtcctacaaagttgccagcgagggcttccagtactccgaccggcgctggtgctttgacggagagcggaacaaccaggtgctcgaggagaatatggacgtcgagatctggacgaaggagggcgagcgcaaaaagctgagaccccggtggctggacgcccgtacttattcggacccactcgcgctgcgcgagttcaaggagtttgccgccgggcggagatcagtgtccggcgatctgatcttagagatcggcaagctgccgcagcacctgacactccgggcccaaaacgccctggataacttagtgatgctccacaatagcgaacagggagggaaagcctatcgccacgccatggaggagctgcctgacacgattgagacgctgatgctgctggccctgatcgctgtcctgaccggtggggtcaccctcttcttcctgtccggtaaaggtctcggtaagaccagcatcgggctgctgtgtgttatggcgtccagcgtgctcctgtggatggcctccgtcgagccccactggattgccgccagcatcatcctagagtttttcttgatggtcctgttgatccccgagccagaccgtcagcgcacgccccaagacaaccagctcgcctatgttgtcatcggcctacttttcatgatactcacggtggctgccaacgagatgggtctcctggagaccaccaagaaggacctcggaatcgggcacgtagtcgccgagaatcatcaccatgccaccatgttagacatcgacctgcacccggcctctgcgtggactttgtacgccgttgccaccactatcatcactccgatgatgcgccacactattgagaacaccactgccaatatcagcctgacagccatcgcgaaccaagccgccatcctgatgggcctagataagggctggcccatatccaagatggacatcggcgtgcccctgctggctcttggatgctacagccaagtcaaccccctgaccctgactgcagcagtgctcatgctggtggctcactacgccatcatcgggccgggcttacaggccaaggctacccgggaagcccagaagcgaaccgcagctgggatcatgaagaaccccacggtcgacggcattgtcgccatagacctcgacccagtggtctacgacgcgaaattcgaaaagcaactcggccaaatcatgctactcatcctgtgcacctcgcagatcctgctcatgcggaccacatgggccctgtgcgagagcatcacgttagccaccgggcccctcaccaccctgtgggagggctccccggggaaattctggaatacgacgatcgccgtgagcatggctaacatttttcgcggctcctatctcgctggcgccgggcttgcgttcagcctgatgaagtctctaggcggcggccggcgcgggacgggcgcccagggcgaaactctcggggagaagtggaaacgacaactgaaccaactaagcaagtcagagttcaacacatacaagcgctccggaatcatggaagtggatcggagcgaggctaaggaggggttaaagcggggtgagactaccaaacacgcggtctcgcggggaacggcaaagctccgctggttcgtggagcggaacctggttaagcctgagggcaaagttatcgacctgggctgcgggcgtggcggttggagctactactgcgcaggcctcaagaaggtgacggaggtgaaggggtacacaaagggcgggccggggcacgaggagcccatcccgatggccacctacggctggaacatcgtgaagttgcactcagggcgtgacgtgtttttcactccacccgagaagtgcgacaccctgctctgcgacataggcgagagtagcccgaatcctacgatagaggaggggcgcactctacgcgtgctcaagatggtagagccgtggctccgcggcaaccagttctgcatcaaaatcctgaacccctacatgccgtcagttgtggagaccctggagcaaatgcagcggaagcatggcggcatgctcgtccgcaacccgctgtcccgcaacagcacccacgagatgtactgggtgtcctgcggcacggggaacatcgtgtctgcggtgaacatgacctcccggatgctactcaaccgttttaccatggcccaccggaagccgacgtacgagcgcgatgtggacctcggcgccggcactcggcacgtggccgtagagccggaaacggcaaacctggacataattgggcagcggatcgagaatataaagaacgagcacaagagcacgtggcactacgatgaggacaacccctacaagacctgggcataccatggaagttacgaagtgaagccctcggggtcagccagctccatggtgaacggcgtggtgaggctcttaacgaaaccgtgggacgtcatccccatggtcacccagatcgccatgaccgacacaacgcccttcggtcagcaacgggtgtttaaggagaaggttgatactcggaccccacgccccaaacgtgggaccgctcagataatggaggtgacggccaagtggctgtggggtttcctcagtcgcaacaagaaaccccggatatgcacccgagaagaatttaccagaaaggtgaggagcaacgcggccatcggcgccgtattcgtggacgagaaccagtggaactctgccaaggaggccgtggaggacgaacggttctgggacctggtgcatcgcgagcgggagctgcacaagcagggcaagtgcgctacctgcgtgtacaatatgatggggaagcgtgaaaagaagctcggagagtttgggaaggccaagggcagccgggccatttggtacatgtggctgggagcccgctttttggagttcgaggcgttagggttcatgaatgaggaccactggttctcccgcgagaacagcctgtccggcgtggagggggaaggcctgcacaagctcgggtacatcctgcgggacatctcgaaaatcccgggcggcaacatgtacgccgacgacacggccgggtgggacaccaggatcactgaggacgacctgcagaacgaggctaagatcaccgacatcatggagcccgagcacgccctcttagcaacgtccatcttcaagctgacctaccaaaacaaggtcgtgcgggtgcagcggcctgctaagtccggcaccgtcatggatgtgatatcccgaagagaccagcgggggagcggtcaggtggggacctacgggttgaatacgtttactaacatggaggtccagctcatccgccaaatggagtccgagggaatctttagcccttccgaactggagaacagcaatttggcagagcgggtactggactggctggagaagcacggggtggaaaggctcaagagaatggccatctccggcgacgattgcgtcgttaagccgaccgacgaccgcttcgccaccgccctgacggccctgaacgacatggggaaagtgcgtaaagatataccccagtgggagcccagcaagggctggaacgactggcaacaggttcccttctgttcccaccacttccaccagctcattatgaaggacggcagggaaatagtggttccatgccggaatcaggacgaactggtcgggcgcgcccgggtgtctcaaggcgcggggtggtcgctgcgcgagaccgcctgtctcggcaaatcatacgcgcagatgtggcagctaatgtatttccacagacgcgacctgcgactcgccgcgaacgccatctgctcggcagtgcccgtcaattgggtgccaacctctagaacaacctggagcatccatgcgcaccatcagtggatgacgaccgaggacatgctgtcggtttggaaccgcgtctggatcgaggaaaacccctggatggaggacaagactcacgtcagttcgtgggaggacgtgccgtacctggggaagagggaggaccaatggtgcggttctctcattggcctaaccgcgcgcgccacgtgggcgactaacatacaggtcgcaatcaatcaagttcggcgcttaatcggtaacgagaactatctcgattatatgacctccatgaaacggtttaagaacgaaagcgaccccgagggcgccctatggtga

SEQ ID NO: 24731 - RNA, 9879 nt, synthetic construct
  misc_feature 1..9879: note = derived and/or modified CDS sequence (opt11) from DENV-1__KM403604__SS-prME
  source 1..9879: mol_type = other RNA
agcgtgactatgcttctgatgctgttgcccacagccctggctttccacctgaccacccgcgggggtgagccccacatgatcgtctctaagcaggaacggggtaagagcctgctgttcaagacgtcagcgggggttaatatgtgcacccttatcgctatggacctgggcgagttgtgcgaggacacgatgacctacaagtgccctcggattaccgaggccgagcccgacgacgtggattgctggtgcaatgccaccgacacctgggtgacatatgggacatgcagccaaacaggggagcatcggcgggataagcggtccgtcgccctggcgccccacgtaggcctggggctcgagacccgcaccgaaacctggatgtcatccgagggcgcatggcggcaaatacagaaggtggagacctgggccctgcgccatcccgggttcacggtgatcgcgctgttcctcgcacacgccattggcacaagcatcacccaaaaagggatcatattcatactgttaatgctcgtgacaccgtccatggccatgcggtgcgtcggtatcggcaatcgcgacttcgtggaggggcttagcggcgccacgtgggtggatgtcgtgctggagcatgggtcgtgcgtgacgaccatggccaagaacaagcctacccttgacatcgagctgctgaaaacggaagtaaccaaccccgcggttcttcgtaagctgtgcatcgaggccaaaattagcaatacgaccaccgattcaaggtgtcccacacagggcgaggccactttagtggaggaacaggatgccaactttgtctgcaggcgcaccttcgtggatcggggctggggcaatggctgtggcctgtttggcaaggggtccctgctcacgtgtgcaaaattcaagtgcgtcaccaagttagagggtaagattgtacaatacgagaatctaaagtactccgtgatcgtgaccgtccacaccggcgatcagcaccaggtggggaacgagacgactgagcagggcacgatcgcgaccattacgccccaggcgcccacgagcgaaatccagctgaccgactacggggcactcacccttgattgcagcccccgcaccggtctagacttcaacgagatggtcctcctgacgatgaaagagaaatcctggctggtgcacaagcaatggttcttagatctgccgctaccctggacaagcggggcaagcaccagccaagagacctggaatcggcaagacctcctggtgacgtttaagacagcccacgcgaagaaacaagaggtcgttgtcctaggctcccaggagggcgccatgcataccgcgcttaccggtgcaacagagattcagaccagcggcaccaccactatttttgccgggcacctgaagtgccgcctgaagatggacaagctcaccctaaagggagtctcctacgtgatgtgtaccgggagctttaaactggagaaggaggtcgctgagactcagcacggaacggtcttggttcaagtgaaatatgagggcaccgacgcaccgtgcaagattccaatttccacccaggacgagaagggggtgacccaaaacgggcggcttatcaccgccaacccgatcgtgaccgacaaggagaagccagttaacatcgagactgagccgcccttcggggaaagctacatcgtcatcggcgcgggcgagaaggccctgaagctgtcttggttcaagaagggttccagtataggcaagatgttcgaggccactgcccgcggggcccgtcgaatggccatactcggggacacggcgtgggacttcgggagcatcggcggcgtgttcacctcagtggggaagttagtgcatcaagttttcggcaccgcttacggagtgttattcagcggtgtgtcctggaccatgaagatcgggattggcatattgctgacctggctgggtctcaatagccgctccacctctctaagcatgacatgcatcgcggtcggaatggtgaccttatatctcggcgtaatggtgcaggccgacagcgggtgcgtgatcaactggaagggccgggagctaaagtgtggctccggcatcttcgtcacgaacgaggtgcacacctggaccgagcagtacaaattccaggccgacagccccaagcggctgagtgcggccatcggaaaggcctgggaggagggggtgtgcggcatcagatccgccactcgcctagagaacataatgtggaagcaaataagcaacgagctgaatcacattctgttggagaacgacatgaagtttaccgtagtcgtgggggacgccaacggcatccttacccaggggaagaagatgatacggccccagcctatggagcacaaatactcatggaagtcatggggaaaggcgaagatcataggcgccgacacccagaacaccacgtttatcattgacggtcccgacacgccggagtgcccagacgaccagcgcgcgtggaacatctgggaggtcgaggactatggcttcggggttttcaccaccaatatttggctgaaacttcgggactcctatacccagatgtgcgaccaccgcctgatgtcggccgcaatcaaggactccaaggccgtgcacgccgatatggggtactggatcgagagcgagaagaacgagacgtggaagctagcccgggcatctttcatcgaggtcaaaacctgcatctggccccgctcccacaccctttggtctaacggcgtgctggagtcagagatgatcatcccaaagatctacggcggcccgatctcccaacacaattaccggcccgggtacttcacccagacagctggcccctggcacctgggaaagttggagttagactttaacctgtgcgagggcaccaccgtggtcgtggacgagcattgtggcaatagagggccctctctccggaccacgaccgtaaccggcaaaataatccacgaatggtgttgccgctcgtgcaccctcccgcccctgcggttccgaggggaggacggctgctggtacggaatggagatcagacccgtcaaggagaaggaggaaaacttggtgcggagcatggtttccgccgggagcggcgaagttgacagcttctccctgggactgttatgcgtaagcatcatgatcgaggaagtcatgcggtcccgctggtctcgcaagatgctgatgacgggaacgctggcagtcttcttcctcctgatcatggggcagctgacttggaacgacttgatccggctgtgtatcatggtgggcgcgaacgtgagtgaccgcatgggtatgggcacaacgtacttagccctcatggcgacattcaagatgcggcccatgttcgccgtcgggctgctgtttcgtcggcttactagcagggaggttctgctgttgacgatcgggttgtcactggtagccagcgtggagctccccaactccttggaggaattaggcgacggtctcgccatgggaatcatgatgctgaagctcctcacggatttccagtctcaccaactgtggacgaccctcctctctctgaccttcatcaagacgacactgagcctcgactacgcatggaagaccatggcgatggtactgtcgatcgtcagtttgttcccactctgtctatcgactaccagccaaaagactacctggctgcctgttctcctgggcagtttcggctgcaagccactgactatgttcctaattaccgagaacaagatctggggccgaaagagttggcccctgaacgaagggatcatggccgtgggcatcgtctccatcctactctcaagcctgctgaagaacgacgtgcccctcgccggacccttaatagctggcggcatgctgatagcgtgctacgtgatctcagggagctccgccgacctcagcctggagcgtgctgccgaggtttcctgggaggaggaggctgagcactcgggcgcgtcgcacaacatcctggtagaggtacaagacgacgggacaatgaaaattaaggacgaggaaagagatgacaccctcaccatcctgctgaaggccaccctcctggcagtcagcggcgtgtacccgatgtccatcccagcaacgctgttcgtgtggtacttctggcagaaaaagaagcagcgctcgggtgtcttgtgggataccccgagtccacccgaggtggaacgggcggtgctagatgacggcatctaccgcatcctgcaacggggcctcctcggccgcagccaggtcggcgtgggggtgttccaagacggcgtcttccataccatgtggcacgtgacccgtggggcggtgctgatgtaccaaggcaagcgtctagagcccagctgggcttcagtcaagaaagacctcatatcctacggcggagggtggcgtttccaggggagctggaacaccggcgaagaagtccaggtgatcgcggtggaacccgggaagaaccccaaaaacgtgcagaccacacccggcacctttaaaacgcccgaaggtgaagtcggggcaatcgccctggactttaagcccggcacctctggcagccccatcgtcaaccgcgaggggaagatcgtaggtctgtacgggaacggcgtggtaaccacctccggcacgtacgtgtctgcgatcgcccaggcgaaggcttcacaggagggtccgctcccagagatcgaggacgaggtgtttaagaagaggaacctgaccatcatggacctacaccccggttctggcaaaacccgccggtacctcccggcaatagtacgcgaggctattaagcgcaagctgcggacccttatcttagcccccacgcgcgtggtggccagcgagatggccgaagcgctgaagggtatgcccatccggtaccagaccactgccgtcaaatccgagcataccgggaaagagatcgtggatctgatgtgccacgcaactttcaccatgcgcctcctcagccccgtgagggtcccgaactacaacatgattataatggacgaggcccattttaccgaccccgcctcgatcgcggcccgcggctacatctccaccagagtggggatgggcgaggcggccgccatcttcatgacggcgacacctcccggctccgtggaggcctttccgcagagcaacgccgtaatccaagacgaggagcgggacattcccgagcggtcctggaactccgggtatgactggatcaccgacttccccggcaagaccgtttggttcgtcccgtccatcaagagcgggaacgacatcgccaactgcctgcgcaagaacggcaagcgggtcatccagctctcccgcaagacctttgacaccgagtaccagaagaccaaaaacaacgattgggactatgttgtcaccacggatatcagcgagatgggggcaaacttccgggcggaccgcgtgatcgacccgcggcgctgcctgaaacctgtgatcctaaaggacggccccgagcgggttatcctcgccgggcctatgccggttaccgccgcctcggcggctcagcggcggggccgaatcggccgcaaccaaaataaggagggcgatcaatacatctacatgggccagcctctgaacaacgatgaggatcacgcccactggaccgaggcaaagatgctgctcgacaatataaataccccggaggggatcataccagctctgttcgagccggagcgggagaagtccgctgcgatcgacggcgagtaccgcctgagaggggaagccaggaagacgttcgtggagctcatgaggcgcggcgacctccccgtatggctgtcctacaaagttgcaagcgaagggttccagtactccgatcggcgctggtgcttcgacggggagcgtaacaaccaggtgctcgaggagaatatggatgtcgagatctggaccaaggagggagagaggaagaaactgcgcccccgctggctggacgcgaggacctactcggatccccttgcgctgcgcgagttcaaggagttcgccgccgggcggcgcagcgtctccggcgacttgatacttgaaatcggaaagctgccacagcatctgactctacgggcccagaacgccctagacaacctggtgatgctccacaactccgagcagggcgggaaggcataccgccacgccatggaggagctgccagatactatcgagacgctgatgctactggcccttatcgccgtcctcaccgggggcgtgaccttgttcttcctgagcgggaagggcttaggtaagacgagcatcggtctgctgtgcgtgatggcgagtagcgtcctcctgtggatggccagcgtggagccgcactggatcgccgccagcatcatactggagttcttcctaatggtgctcctgatccccgagccggaccgccagaggacgccccaggacaaccagctcgcctacgtggttatcggcctgctattcatgatcttaacggtagcagccaacgagatggggcttctggagaccaccaagaaggacctaggcatcgggcacgtcgtagcggagaaccaccaccacgccacgatgctggacatcgacctccaccctgcttccgcttggactctctatgctgtggctaccacgatcatcacaccaatgatgcggcacactattgagaacaccaccgccaacatcagtctgacggcgatcgcgaatcaggccgccatcctgatgggcttagacaagggctggccgatctcaaagatggacattggggtgccgctgttagccctaggctgctacagccaggtgaatcctctgaccctgaccgccgcggttttaatgctcgtcgcccattacgccattattgggccgggcctgcaggccaaggcgacacgcgaggcgcagaagcgcacggccgcaggtataatgaagaaccctacagtagacggcattgtagccatcgacttagacccggttgtgtacgacgcgaagttcgaaaagcaattgggccagattatgcttctcatcctgtgcacttcacaaatcctgctaatgcggactacgtgggcactgtgcgagagcattaccctcgccaccgggccacttaccaccctgtgggagggcagtcctgggaagttctggaacaccacaatcgcagtgtccatggccaacatattccgaggatcctacctggcgggcgccgggctcgccttcagtctgatgaagtccctgggcgggggacggagaggaaccggcgcccagggcgagacgttaggggagaagtggaagcgacaattgaaccaactgtcgaagtctgagttcaacacttacaagcgctccggtatcatggaggtcgaccggagcgaggctaaggagggtctcaagcgcggcgagaccacgaagcacgcagtctcccggggaaccgccaagctgcgctggtttgtggaacggaacctagttaagcccgagggtaaagtgatcgacctggggtgcgggcgcggtgggtggtcttactactgtgccggcctcaagaaggtgaccgaagtgaagggctacacgaagggcggccccgggcacgaggagccaatcccgatggccacctacggatggaacatcgttaagctgcattccgggcgggatgtgttcttcacaccgcccgagaagtgtgacacgttgctttgcgacattggtgagtcgagcccgaacccgacaatcgaggaggggcgcaccttaagggtactgaagatggtggagccctggctgcgcggcaatcaattctgtataaaaatcctcaacccctacatgcctagcgtggttgagaccctagaacagatgcagcggaagcatgggggcatgctcgtgcggaacccgctgtccagaaattcgacgcacgaaatgtactgggtgtcatgcggcacagggaacatcgtgtcggcagttaacatgacctcccgcatgttgctcaatcgcttcaccatggctcaccggaagcctacgtatgagcgcgacgtggatctgggtgccggcacccggcatgtcgctgttgagcctgagatcgccaatctggacatcatcggacagcgcatcgagaacattaagaatgagcacaaaagcacctggcactacgatgaggacaatccctataagacttgggcgtaccacggctcctacgaagtgaaacctagcggctccgccagctcaatggtaaacggagtggtccgtctcctgacgaagccctgggacgtaatacccatggtgacccagatagcaatgacagatactactccattcggccagcagcgcgtcttcaaggagaaggtggacacccggacccccaggcctaagcggggcactgcccagatcatggaggtgacggccaaatggctttggggcttcttgtcaaggaataagaagcccaggatatgcactcgcgaggaatttacccggaaggtcagatctaacgcggctataggggctgttttcgtggacgagaaccaatggaactccgccaaagaggccgtcgaggatgagcggttttgggacctggttcatcgcgagcgagagctccacaagcagggcaagtgcgcgacctgcgtgtacaacatgatggggaagcgagagaaaaagctaggcgagtttggcaaggccaaaggcagccgggccatatggtacatgtggctgggcgcccgcttcctggagttcgaggcgctcgggttcatgaacgaagaccactggttctctcgggagaacagtctttccggggtcgagggggagggcctgcacaagctcggatacatcctgcgcgacattagcaagattccagggggcaacatgtacgccgatgacacggccgggtgggacacgcgcataactgaggacgacctgcagaacgaggctaagatcactgacatcatggaaccggagcacgccctcctggcgacatccattttcaaactgacctaccaaaacaaggtggtgcgggtccagcgtccggccaagagcggcactgtgatggacgtgatcagccgacgagaccagcgggggagcggccaggtcgggacgtacgggctcaacacgttcaccaatatggaggtgcagctgatccgccagatggagtccgaaggaatcttctcgccatccgagctggagaactctaacctagccgagcgggtgcttgactggctggagaagcacggggtcgagcgcctcaaacgcatggctatatccggcgacgactgcgtagtaaagccgaccgacgaccgcttcgcgacggcgcttattgccctgaacgacatggggaaggtccggaaggatatcccccagtgggaaccgagtaagggctggaacgactggcagcaggtccccttttgctcccatcatttccaccagctcataatgaaggatggtcgagaaattgtggtcccttgccggaaccaggacgagctggtgggcagagcccgggtgagccaaggcgccgggtggagcctccgcgagacggcttgcctcggcaagtcctacgcgcagatgtggcagttgatgtacttccatcggcgagacttacggctcgccgccaatgccatatgcagcgccgtccccgtgaactgggtgccaacatcccgtacaacctggagcatccatgcacaccaccaatggatgaccacggaagatatgctgtccgtctggaacagggtgtggatagaggaaaacccctggatggaggataagactcacgtttcgtcctgggaggacgtcccgtatctggggaagcgggaggaccaatggtgtggcagtctcatcggcctgaccgcccgcgccacttgggccacgaatatccaggtggcgattaaccaggtgcggagactgatcggtaatgaaaattacctcgactacatgacctcaatgaagagattcaagaatgagtctgatcccgagggtgccttatggtag

SEQ ID NO: 24732 - RNA, 9879 nt, synthetic construct
  misc_feature 1..9879: note = derived and/or modified CDS sequence (opt11) from DENV-1__KM403588__SS-prME
  source 1..9879: mol_type = other RNA
agcgtgacaatgctgctcatgctgctgccaaccgccctcgctttccacctgaccaccagaggaggggaaccccacatgatcgttagcaagcaggagcggggcaaaagcctgctgttcaagaccagcgccggtgtgaacatgtgcaccctgatagcaatggacctcggcgagttgtgcgaggacaccatgacttacaagtgtccccggataaccgaggctgaacccgacgatgtggattgctggtgcaacgccacggacacgtgggtgacctacggtacgtgctctcagaccggcgagcatcggcgagacaagcgatccgtagccctggccccacacgtaggcctggggctcgagacccgcaccgagacctggatgtcctccgagggggcctggcgccagatccagaaggtggagacgtgggccctccgccatcccgggttcacagtgatcgctctgtttctcgcgcacgccatcggcacctcaatcacccagaaggggatcatcttcatcctgctgatgctggtgaccccctccatggctatgcggtgcgtcgggatcggcaaccgcgacttcgtagaggggttaagcggagctacatgggtggatgtcgttctagagcacggctcttgcgtgaccaccatggccaaaaataaacccaccctagatatcgaactgctcaagacggaggtcaccaaccccgcagtcctccggaagctgtgcatagaggccaagattagcaacaccaccacggactcccgctgcccaacccagggcgaggccaccctggtggaagagcaggacgccaacttcgtatgccggcgcaccttcgttgaccgcggctggggcaacggctgcggcctcttcggcaaggggagcctgttaacgtgcgccaagttcaaatgcgtgacgaaactcgagggcaagatcgtccagtacgagaacctgaaatactctgtaatcgtcaccgtgcacactggcgaccaacaccaagtggggaacgagacgaccgaacacggcaccatcgcgacgatcacgccccaagcccccacgagcgagatccaactgaccgactacggcgcgctcaccctggactgcagcccgcggaccgggctggatttcaatgagatggtccttctaacgatgaaagagaagtcctggctggtgcacaagcagtggttcctggacctgccactgccctggacctctggagcctcgaccagccaggagacatggaaccggcaagacctcctggtgacgtttaagaccgcccacgcgaagaagcaggaggtcgtggtgctgggctcccaagaaggcgccatgcataccgccctaaccggggcgacggagatccagacctccggcaccaccacgatattcgccgggcatctgaagtgtcgcctgaaaatgggcaagctcaccctgaagggcgtttcctacgtgatgtgcaccggcagcttcaagctggagaaggaggtggcggaaacccagcacgggacggtcttggtccaggtaaagtacgaagggaccgacgccccctgcaagatccccatctccacccaggacgagaagggcgtcacccagaacgggcgcctcatcacggccaatccgatcgtgactgacaaggagaagcccgtgaacatcgaaaccgagccgcccttcggcgagtcgtacatcgtcatcggcgcaggggaaaaggccttaaagctgtcctggtttaagaagggcagctctatcgggaagatgttcgaggcgaccgcccgcggcgcccggagaatggccatcctcggagacatcgcgtgggacttcggttcgatcggcggggtattcacctccgtgggcaagctcgtccaccaagtgttcgggacagcctacggtgtgctttttagcggggtctcctggaccatgaagatcggtataggtatcttactgacatggctagggctgaacagccgctccacgagcctgtccatgacctgcatcgccgtgggtatggtgaccctgtacctcggggtcatggtgcaggcagacagcggctgcgtgataaactggaaggggagggagctgaagtgtggctccggcatcttcgtcaccaacgaagtgcacacgtggaccgagcagtacaagttccaggcagacagcccgaagcgtctgagcgcggcaatcggaaaggcctgggaggagggcgtctgtggcatacggtccgccacgcgcctcgagaacatcatgtggaagcaaatcagcaacgagctgaaccacatcttactcgagaacgatatgaagttcaccgtcgttgtgggcgacgccaatgggattctgactcagggtaaaaagatgatacggccccagcctatggagcacaagtacagttggaagtcctggggcaaggccaagatcatcggggccgacacgcagaacacaaccttcatcatcgacggccccgacactccagagtgccccgacgaccagcgcgcgtggaatatttgggaggtcgaggactatgggttcggcgtgttcacgaccaatatctggctgaagctccgagattcctatacgcagatgtgcgaccaccgcctgatgagcgccgcgatccgggactcaaaagccgtgcacgccgacatgggctattggatcgagagcgagaagaacgagacctggaaactagccagggcctccttcatcgaggttaagacgtgtatttggccccggagccacactctctggtccaacggggtgctcgagtccgagatgatcatcccgaagatctatggcgggcctatttcccagcacaactaccgcccaggctacttcacccagaccgctgggccctggcacctgggcaagctagagctagacttcaacctgtgcgagggcacgaccgttgtcgtggacgagcactgcggtaaccggggtccgagcttgcgcacaaccacggtgacagggaagattattcacgagtggtgctgccggtcctgcaccctgccgcccctgcgcttccggggggaggacggatgctggtacggtatggagatccggcccgtcaaggaaaaggaggaaaacctcgtgcggtcgatggtgtccgcgggctccggggaggtcgacagcttcagcctgggcctgctctgcgtgagcatcatgatcgaagaggtcatgcgctccagatggtctcgtaagatgctgatgacagggacgttggccgtcttctttctcctgatcatgggccagcttacctggaacgacctcatccgcctatgcatcatggtgggagccaacgtgtcagaccggatgggcatggggaccacctacctggcactcatggcgacgttcaaaatgcgcccgatgttcgccgtcggactgctgttccggcgtttgaccagcagagaggtattgctgttgactataggcctgtccctggtcgccagcgtggaactccccaactccctggaggagttgggggatggcctcgcaatgggaatcatgatgctgaagctgctcaccgatttccagagccaccaactctggacgacgctgctcagtctgaccttcatcaagaccacgctgagcctcgattacgcctggaagaccatggcgatggttctctccatcgtcagcctgtttcccctctgcctgtccaccacttcacagaaaacgacctggttacccgtacttctggggtccttcggctgcaaaccgctgaccatgtttctcattactgagaacaagatctggggtcgcaagagctggccccttaacgagggcatcatggcggttgggatcgtgtccatcctgctcagcagcttgctgaagaacgacgtgcccctagccggccccctaatcgccggcgggatgctgatagcgtgctacgtgatctccggtagctccgccgatctaagcctggagcgagccgcagaggtctcctgggaggaggaggccgagcacagcggggcctcccataacatcctggtagaggtgcaggacgacggcaccatgaagatcaaggacgaggaacgcgacgatacgttaaccatccttctcaaagccaccctcctggcggtcagcggcgtgtaccccatgtccatccccgccaccctgttcgtgtggtacttctggcagaagaagaagcagaggtctggcgtcctctgggacacccctagcccacccgaggtggagcgcgccgtgctggacgacggcatataccggatcctgcagcgggggctcctcggccggagtcaggttggcgtgggcgtgttccaggacggcgtcttccacaccatgtggcacgtgacccgcggcgctgtgctgatgtatcagggcaagagactagagccctcttgggccagcgtcaagaaggacctcatctcctacggtggcggatggcggttccagggcagctggaacacgggggaggaggtccaggtcatcgccgtcgagccaggcaagaatcccaaaaatgttcagacgacaccgggcaccttcaagacccccgagggagaggtgggcgctatagccctggacttcaaacccggtacgtccggtagccccatcgtcaaccgggagggcaagatcgtggggctgtacggcaacggtgtggtcaccacgtccggcacctacgtgagcgcgatcgcccaggccaaggccagtcaggaggggccgctcccggagatcgaggacgaggtgttcaagaagcgcaacctgacgatcatggacctgcaccctggctccggtaagacccgtcgttacctcccggctatcgtccgagaagcgatcaaacggaagctgcgaaccctgattctcgcccccacccgggtggtggccagcgagatggcagaggcactgaaagggatgcccattcgctatcagacgaccgccgtcaagtccgagcacaccggcaaggagatcgtggacctgatgtgccatgccaccttcacgatgcgactcctcagccccgtccgcgtcccgaactacaacatgatcatcatggacgaggcacacttcacagatcccgccagtatagcggcccgggggtacatcagcacccgcgtgggcatgggagaggccgccgccatcttcatgacggcgacgccgcccggatctgtcgaggccttcccgcagagcaacgcggttatccaggatgaggagcgggacatcccagagcgctcctggaactcaggctacgactggatcacggatttccccggcaagaccgtgtggttcgttcccagtatcaaaagcggcaacgacatcgccaattgcctgcgtaagaatggaaagcgcgtcatccagctctcccggaagacctttgacacggaataccagaagaccaagaacaacgactgggactatgtggtgaccaccgatatctctgagatgggcgccaacttccgcgcggaccgggtcatcgacccgcgccggtgtctaaagcccgtgatcctgaaggacgggcccgagagagtcatcctcgccgggcccatgccggtggcagccgcctccgcggcccagcggcgcggccgcatcgggcgtaaccagaacaaggagggcgaccaatacatttacatgggtcaacccctgaacaatgacgaggaccacgcccactggacggaggcaaagatgttattggacaacataaacacccccgagggcatcatcccggccctgttcgagccggagcgcgaaaagagtgccgccatcgacggggaatacaggctgcgcggcgaggcccggaagaccttcgtggagctcatgcgccggggtgacctgcccgtctggctgtcctacaaggtggccagcgaagggttccagtacagtgacagacggtggtgttttgacggcgagcgcaataaccaagtgctcgaggaaaacatggacgtcgagatctggaccaaagagggggagcggaagaaactgcgcccccggtggctggacgcgcgcacgtacagcgaccccttagcccttcgggaattcaaggagttcgcggccggccgccggagcgtctccggcgacttaatcctcgagatcgggaagctgccgcagcacttaaccctccgcgcccagaacgcactggacaacctggtgatgctccacaacagcgagcagggcgggaaggcataccggcatgcaatggaggaactgcccgacacgatcgaaaccctgatgctcctggccctgatagcggtcctcaccggtggggtgacgctgtttttcttatctggaaagggcttagggaagaccagcatcggtctgctgtgcgtaatggcctccagcgtcctcctgtggatggcttccgtggagccccactggatcgccgccagcatcatcctggagttcttcctcatggttctgctcatccccgagcccgaccgccagcggactccccaggacaaccagctggcatacgtcgtgatcgggttactgttcatgatcctgaccgtggccgctaacgagatgggcctgctagagacgaccaagaaggacctcgggataggccacgtggtggccgagaaccaccaccacgccaccatgctggacatcgacttacaccccgcgtccgcctggaccctctatgccgttgcaacgacgatcatcacccctatgatgcgccacaccatagagaacacgaccgccaacatctctctgacggcgatcgccaaccaggccgccatactgatgggcctcgacaaggggtggcccatctccaagatggacataggcgtacccctgctggccctcggatgttacagccaggtgaaccccctgaccctgacggcggccgtcctcatgctggtcgcccactacgccatcatcggcccagggctgcaggccaaggctacaagagaagcccagaaacgaactgccgccggcatcatgaagaaccccaccgtagacggcatcgtggccatcgatcttgatcccgtcgtgtacgacgcgaagttcgaaaagcagctggggcagataatgctgttgatcctgtgcacgtcccagatcctgctcatgcgcaccacctgggctctgtgcgaatctattaccctggccacgggcccactcaccaccctgtgggaggggagtccaggcaagttctggaacaccacgattgccgtgagcatggcgaacatcttccggggctcctacctcgccggggccggcctcgccttcagcttgatgaagtccctcgggggcgggcgccgggggaccggcgcccaaggagagacgctcggcgagaagtggaagcgccaattgaaccagctcagcaagagcgagttcaacacctacaagcggtccgggatcatggaggtggaccgcagcgaagcgaaagagggcctcaagcggggggagacgaccaaacatgccgtatcccgcgggacagccaagctgcggtggtttgtggagcgcaacctggtcaagcccgagggcaaagtgatcgatttggggtgcggccgcgggggctggagctactactgcgccgggctcaagaaggtgaccgaggtgaagggatacacgaagggcgggcccggccacgaggagcccatcccgatggcgacctatgggtggaacatcgtgaagctgcattccggccgcgacgttttcttcacgccgcccgagaagtgcgacaccctgttgtgcgacatcggcgagtcttccccaaacccgacgatagaggagggccggacgttgagggtcctgaaaatggtggagccctggcttaggggcaaccagttctgcatcaagattctgaacccctacatgcccagcgtggtcgaaaccctggagcagatgcagcgcaagcacgggggcatgctggtgagaaacccactgtcccgcaactctacacacgagatgtactgggtgtcatgcggtaccggcaacatcgtcagcgcggtgaacatgacgtcccgcatgctgttaaaccggttcaccatggcacatcgaaagccgacctacgagcgggacgtagacttaggcgctggcacccgccacgtcgcggtggagcccgagatcgcgaacttggacatcattggccagcggatagagaacataaagaatgagcacaagagcacttggcactacgacgaggacaacccctataagacgtgggcctaccacgggtcctatgaggtgaagccgagcggctccgcctcctcaatggtcaacggtgtcgtccgcttgctgaccaagccatgggatgtgatccccatggtgacccaaatcgctatgacggacaccacccccttcggccagcagcgagtcttcaaggagaaggtggacacgcgcaccccgcggcccaagcgcggaaccgcccaaatcatggaggtgaccgcgaagtggctgtgggggtttctcagccggaacaagaagccccggatctgcacccgggaggagttcacgcgcaaagtgcggagcaatgccgcaattggcgccgtgttcgtggacgagaaccagtggaactccgccaaggaggcggtggaggacgagcgcttctgggacctggtgcatcgcgaacgcgagcttcacaaacaggggaagtgcgcgacgtgcgtatacaacatgatgggtaagcgggaaaagaagctcggtgagtttggcaaggctaagggctcccgcgccatttggtacatgtggctgggtgcgcggttcctagagttcgaggccctcggctttatgaacgaggaccactggttctcccgcgaaaacagcctgtccggggtcgagggagaggggctacacaagctcgggtacatcttgcgcgacatcagcaagattccgggcgggaacatgtacgccgatgacactgccggctgggatacccggatcaccgaggacgacctgcagaacgaggccaagatcaccgacatcatggagcccgagcacgcactcctggcgacctccatcttcaagctaacctaccaaaacaaggttgtgcgtgtccagcggcccgctaagagcgggaccgtgatggacgtaatatcgcgccgggaccagcgcggctcgggccaggtagggacctacggccttaacaccttcacaaacatggaggttcagctgatccggcagatggaatccgaggggatcttcagcccctccgagctggaaaatagcaatctcgccgagcgcgtgctggattggctggagaagcatggcgtcgagcggctcaagcgcatggcgatatccggggacgactgtgtggtgaaaccgacggatgatcggttcgcgaccgccctgactgccctgaacgacatggggaaggtccgcaaggacatcccccagtgggaaccgtcgaaaggctggaacgactggcagcaggtccccttctgctcccaccacttccaccagctcatcatgaaggacgggcgcgagatcgtggtcccatgccgcaaccaggacgaactggtgggccgggcacgcgtaagccagggggccggctggagcttacgggagacagcttgcctcgggaagtcctacgcccagatgtggcagcttatgtacttccaccgccgggacctgcgcctcgccgccaacgccatttgctcggcagtccccgtgaactgggtccccacgtccaggaccacctggagcatccacgcccaccaccagtggatgacaactgaggatatgttgtcggtctggaatcgggtgtggatcgaggagaatccctggatggaagacaagacgcacgtgagctcctgggaggacgtcccgtatctcggaaagcgcgaagaccagtggtgcggcagcctaatcggtctgacggcccgggcaacctgggcaacgaacatccaggtcgccatcaaccaagtgcgccggctgatcggcaacgagaactacctcgactacatgacgtccatgaagagattcaagaacgagtccgaccccgagggggcactgtggtga

SEQ ID NO: 24733 - RNA, 9879 nt, synthetic construct
  misc_feature 1..9879: note = derived and/or modified CDS sequence (opt11) from DENV-1__KM403605__SS-prME
  source 1..9879: mol_type = other RNA
agcgtgaccatgcttctcatgctgcttcccacggccctcgctttccacctgacgacccgcggcggggagccccatatgatcgtgagtaaacaggagcgcggcaagagcctcttgttcaagacatctgcgggggtaaacatgtgcacccttattgccatggatttaggagagctctgcgaggacaccatgacttacaagtgcccgcggatcaccgaggcggagccggatgacgtggactgctggtgcaacgccaccgacacgtgggtgacctacgggacctgctcccagaccggcgagcacagacgcgacaagcggtccgtggctctggcgccccacgtgggcctggggctcgagacgcgcaccgagacctggatgtcgtctgagggcgcctggcggcagattcagaaggtcgagacctgggcgctgcgccacccgggcttcacggtgatcgctctctttcttgcgcacgccattggcaccagcattacccaaaaagggatcatcttcatactgctgatgcttgtgactccaagtatggccatgcgttgcgtcggcattgggaaccgcgactttgtggagggactttcgggcgctacgtgggtggacgtcgtgctggagcacgggagctgcgtgaccaccatggctaagaacaagcccaccctcgacatcgagctcttaaagacggaagtcaccaaccccgccgtgctgaggaagctgtgcatcgaggccaaaatatcgaacaccaccacggatagccgctgccccacccagggcgaagccaccttggtcgaggaacaagacgccaacttcgtctgccggcgtaccttcgtggaccggggctggggcaacggctgtggactcttcggaaaggggagcctgctgacgtgcgctaagttcaagtgcgtgaccaagctcgagggcaagatcgttcagtacgagaacctaaagtacagcgtaattgtgaccgtccataccggtgaccagcatcaggtagggaacgagacgaccgagcacggaaccattgcgaccattacgccccaagcacccactagcgaaatccagctgaccgactacggagccctcaccctggactgcagccctcggaccggcctggacttcaatgagatggttttgcttacaatgaaagagaagagctggctggtgcacaagcaatggttcctcgacctgccgttgccctggacctccggggcgagcaccagccaagagacctggaacagacaggacctactagtgacgtttaagaccgcccatgccaaaaagcaggaggtcgtcgtcctgggttcccaggagggcgcaatgcacaccgccctcaccggggcgaccgagatccaaaccagcggtacgaccacgattttcgccgggcacctgaagtgccgtctgaagatggacaaactaaccctgaagggcgttagttacgtgatgtgtaccggaagctttaagctggagaaagaggtggcggagacgcagcacggcactgtcctggtgcaggtgaaatatgagggcaccgacgccccttgcaagatacccattagcatccaagacgagaaaggggtcactcaaaacggaagactcatcaccgccaacccgatcgtaacggacaaagagaaaccagtgaacatcgagactgaaccaccattcggggaatcatatatcgtgataggggctggcgaaaaggcgctgaagctgagttggttcaagaaggggtcctccatcggcaagatgttcgaagcgaccgccagaggggcccgtcgcatggcaatcctaggcgacaccgcgtgggacttcggcagcatcggcggagttttcacgtcagtagggaagctggtccaccaagtattcggaaccgcgtatggggtcctgtttagcggcgtctcatggactatgaagatcgggatcggcatcctcctgacctggctgggcctcaatagccgctccacgagcctgagtatgacctgtatcgccgttgggatggtgaccctgtacctcggcgtcatggtacaggcagacagcgggtgcgtaatcaactggaaaggacgggagctgaagtgcggctccgggatcttcgtcaccaacgaggtgcacacatggaccgagcagtataagttccaagccgacagcccgaagcgcctgagcgcggccatcggcaaggcctgggaggagggggtgtgtggcattcgatccgcaacccgcctcgagaacataatgtggaagcagattagtaacgagcttaaccacatcctacttgagaatgacatgaagttcactgtcgtggtgggggacgccaacgggatcctaacccaggggaagaaaatgatcaggccccagcccatggagcacaagtactcctggaagtcctggggcaaggcgaaaattatcggcgccgacacgcagaacaccaccttcattatcgacgggcccgacactccagagtgccccgatgatcagcgcgcctggaacatctgggaggtcgaggattacgggttcggtgtgttcacgaccaatatctggctaaagctccgggactcctacacccagatgtgcgaccaccggctaatgagcgccgccataaaagactccaaggccgtccacgccgatatgggctactggatcgagagcgagaagaacgagacctggaagctggcacgggcatccttcatcgaggtaaagacgtgcatctggccgcgcagccacactctctggtccaacggcgtgttggagagcgagatgatcatccccaaaatctacggtggccctatctcccaacacaattaccggcccgggtactttacccagaccgcaggcccctggcacctggggaagttagaactggacttcaacctgtgtgagggcaccaccgtggtcgtggatgagcactgtggaaaccgggggccgagtcttcggaccacgaccgtgaccggaaagattatccacgaatggtgctgccgctcctgcaccctgccgcccctgagattccggggagaagatggttgctggtacggaatggagatccggcccgtaaaggagaaggaggaaaacctcgttcgtagcatggtgtccgccggcagcggcgaggtcgacagcttctccctgggactgctatgcgtgagcatcatgatagaagaggtcatgcgctccagatggagccgcaagatgctgatgaccggcactttggctgtctttttcctcctgattatggggcagttgacctggaacgacctcatccggctgtgcattatggtgggcgccaatgtttccgaccgcatggggatgggtaccacatacctggccctcatggcgacgttcaagatgcggcctatgttcgccgtcggcttattgtttcgcaggctcaccagccgtgaggttctgcttctaacaattggcctgtccctggtggcgtcagtggagctcccgaactcgctggaggagctgggcgatgggctcgccatgggtataatgatgcttaagctgctcaccgacttccaatcacaccaactgtggactactctgctctccctgactttcatcaaaactacgctgagcctcgactatgcgtggaagaccatggcgatggtgctgtcaatcgtctccctattccccctctgcctgagcactacaagccaaaagacgacctggttacccgtgctcttaggctccttcggatgcaagccgttgactatgtttctcatcacggagaacaagatctggggccgcaagagctggccactgaacgaggggattatggccgtcggcattgtgtccatcctgctgagctcgctgctgaagaacgacgtgcccttagccgggccgctgatcgcaggcggtatgctgatcgcctgctacgtgatctccgggagttccgccgacctgagcctggagcgcgccgcggaggtctcctgggaggaggaggccgaacattcgggcgccagtcacaacatcctcgtggaggtgcaggacgatgggaccatgaagataaaggacgaggagcgggacgacaccttaactatcctgctgaaggccacgctcctggccgtcagcggcgtgtacccgatgtccattcccgccaccctgttcgtgtggtatttttggcagaagaagaagcagaggtctggtgtcctctgggatacgcccagcccgccagaggtggagcgggccgtgctggacgacggcatttaccggatcctgcaacggggcttactcgggcgcagccaagtgggtgtgggggtgttccaggacggcgtctttcacaccatgtggcacgtgaccaggggggcggtgctaatgtaccaaggcaagcgcctggaaccctcctgggccagcgtcaaaaaggacctcatctcatacggcggaggctggcggtttcaggggtcctggaacacaggcgaggaggtgcaggtgatcgctgtcgagccaggcaagaaccctaagaatgtgcagacgacccccggcaccttcaagacccccgagggggaggtgggggccatcgccctggatttcaagcccggcacgagtgggagccccatcgtgaatcgcgagggcaagatcgtgggattatacgggaatggggtcgttactacaagtggaacctacgtttccgcgatcgcccaggccaaggcaagccaggaaggtccgctccccgaaatcgaggacgaagttttcaagaagcggaacttaacaatcatggaccttcacccggggtcaggcaagaccagacggtacctcccggccatcgtgcgcgaggcgatcaagcgcaaactgcggaccctcatcctagcccccaccagagtggtggccagcgagatggccgaagcgctgaaaggcatgcccatccggtatcagacgaccgcagtcaagtccgagcacaccggaaaggaaatcgtggacctgatgtgccacgccacattcactatgcgcctcctgtcgccggtacgcgtaccgaactataacatgataatcatggacgaggcccacttcacggaccccgccagcatcgctgcgcgcggctacatcagcacccgggtagggatgggagaggctgccgccattttcatgaccgcaacaccgccggggagcgtggaggctttccctcaatcgaacgccgtcatccaggacgaggagcgcgacatcccggagaggtcctggaacagcggctacgactggatcaccgatttccctggcaagactgtttggttcgtgccatccatcaaatctgggaatgacatcgccaactgccttcgcaagaacggcaagcgggtcatccagctcagccgcaagaccttcgacacggagtaccagaagaccaaaaacaatgactgggactacgtcgtgacgaccgacatcagcgagatgggcgccaacttccgggccgaccgcgtcattgacccgcggcgctgcctgaagcccgtgatattaaaggacggccctgagcgtgtcatcctcgccgggcccatgccggtgacagcagcctccgctgcccagcgccggggccgtataggcagaaatcaaaacaaggagggcgaccagtacatttacatgggccagcctctgaataacgatgaagaccacgcccactggaccgaggccaagatgcttttggataacatcaacacccccgaggggataatccccgccctgttcgagccggagcgggagaagtccgcggccatcgacggcgagtatcgcctgcgcggggaagcccgcaaaactttcgtcgagctcatgcggcgcggcgatctgcccgtatggctgtcctacaaggttgccagcgaggggttccagtacagcgaccggcgatggtgcttcgacggggagcgaaacaaccaagtgctcgaggagaacatggacgttgagatatggacgaaggagggtgagcgcaaaaagctgcggccccgctggctggacgcccggacctactcagaccccctcgcacttcgcgagtttaaggaattcgctgccggtcggaggagcgtttccggcgacctgatccttgagataggtaagctgccgcagcacctgaccctccgggctcagaatgctctggacaacctggtgatgctccataacagcgagcagggcgggaaggcgtacaggcacgccatggaggagctgcccgacaccatcgagaccctgatgctcctggccctgatcgccgtactaaccggtggggtgaccctgttcttcctgtctgggaaggggctcggcaagaccagcattgggctgctgtgcgtgatggcgtccagcgttttgctatggatggcatccgtggagccccattggatcgccgccagcatcatactggagttctttctcatggtgctgttaatccctgagccggaccggcagcgcactccccaggacaaccagctcgcctacgtcgtgatcggcctactgttcatgatcctcacggtggcggccaacgagatgggcctgctggagaccaccaagaaagacctcggcatcgggcatgtcgtggccgagaaccaccaccatgccaccatgctggacatcgatttacaccccgcatcagcgtggaccctctacgccgtggccactaccatcatcactccaatgatgcggcacactatcgagaataccaccgctaatattagcctgactgcgatagctaaccaggcagcaatcctcatggggctcgacaagggctggcccatctcgaagatggacataggagtccccctgctggccctcggctgttatagccaagtcaaccccctgacgctgaccgccgcggtgttgatgctggtcgcccactacgcaattatcgggccgggcctgcaggcgaaagcgactcgagaggcccagaagcgcacggccgcgggtatcatgaagaatcctacagtcgatggcattgtggccatcgacctcgatcccgtcgtgtacgacgctaagttcgagaagcaactgggccagatcatgctcctgatcctgtgcacatcccagatcctgctcatgcgcaccacctgggccctgtgcgaaagcatcacactggccaccgggcccctgacgacgttgtgggaggggagtcctgggaaattttggaacacgaccatagctgtttcaatggccaacatcttccgcggctcctacctggcgggggccggactcgccttcagcctgatgaagactctgggcggcggtcggcgcgggaccggcgcgcagggggaaacgctcggggagaagtggaagcggcaactgaaccagctatccaagagcgagttcaacacttacaagcgcagcggcatcatggaggtcgaccggtctgaagccaaagaagggctcaaacgcggcgagaccaccaagcatgcggtgagccgggggacggctaagcttcgctggtttgtggagcggaacctggtcaaacccgaaggcaaggtgatagacctgggctgcgggaggggcgggtggtcatactactgtgccggcctgaagaaggtgaccgaagtcaagggatacactaaaggcggccccgggcacgaggagcccatcccgatggccacgtacggctggaacatagttaagctgcatagcgggagggacgtgttcttcaccccacccgagaagtgcgacacgctgctctgcgacatcggcgaatccagccccaacccgaccattgaggaggggcgcaccctgcgggtcctcaagatggtggaaccctggcttcgcggcaaccagttctgtatcaagatcctgaacccctatatgcccagcgtggtcgagaccttggagcaaatgcaacggaagcacggcgggatgctcgtgcgcaacccgctgagccggaactccacgcacgagatgtactgggtctcatgtgggaccgggaatatcgtctccgccgtgaacatgaccagccgcatgctgctcaatcgttttaccatggcgcataggaagcctacgtatgagcgtgacgtggacctgggcgccggcactcggcacgttgccgtggaacctgaaatcgcaaacttagacatcatcgggcagaggattgagaacataaaaaacgagcataaatccacgtggcactacgatgaagacaacccctacaaaacctgggcgtaccacggtagctacgaggtgaagccgtccgggagcgcctccagcatggtcaacggcgtggtacgcctgctgacgaagccctgggacgtgatccctatggtgactcagatcgccatgacagacaccacgcccttcgggcaacagcgcgtctttaaggagaaggtggacacccggaccccgcgccccaagagggggaccgcccagatcatggaggtgacggctaaatggctgtggggtttcctctcccgtaacaagaagcccagaatctgcacgcgcgaagagttcacccggaaagtccgcagcaatgcagccatcggagccgtgttcgtggatgagaaccagtggaattctgccaaggaggccgtagaggacgagcggttttgggacctagtgcaccgcgagcgcgagctgcacaagcagggcaaatgcgcaacctgtgtgtacaacatgatggggaaacgcgagaagaaactcggcgagttcgggaaggcgaagggctcccgggccatctggtatatgtggctgggcgcccgcttcctggagtttgaggcactcggatttatgaacgaggaccactggttcagccgggaaaactcgctgtctggcgtcgagggggagggcctgcacaaactcgggtatatcctgcgggacatctcaaagatcccgggaggcaacatgtacgctgacgatactgccgggtgggatactcgcataaccgaggacgatttgcaaaatgaggcaaagatcaccgacattatggaacctgagcacgccctcctggctacgagcatcttcaagctaacctaccagaacaaggtagtgcgggtccaacgccccgccaagagtggcacagtgatggacgtgattagccgccgcgaccagcgcgggtccggccaggtcgggacttacgggctcaacacgttcaccaacatggaggtgcagctgatccgccagatggaaagcgagggcatcttttccccgtccgagcttgagaattctaacctcgccgagcgggtgctagactggctggagaagcacggtgtagagcgcctcaagcggatggccataagcggcgacgactgcgaggtgaagccgaccgacgacaggttcgccaccgccctgacggccctgaacgacatggggaaggtacgaaaggatatcccgcagtgggagccctctaagggctggaatgactggcagcaggtccccttctgcagccaccatttccaccaactcataatgaaggacgggcgcgaaatcgtcgtcccgtgccgcaatcaggacgaactagtagggcgggcccgggtttcccagggagccgggtggagccttcgcgagacggcctgcctcggcaagagctacgcgcagatgtggcagttaatgtacttccacagacgggacctgcggctggccgcaaacgccatctgctcagctgttcccgtgaactgggtgcccaccagccgcaccacctggagtatccacgcgcaccaccagtggatgacgaccgaggacatgctgtcggtgtggaaccgcgtctggatcgaggaaaacccctggatggaagacaaaacccacgtgtcctcctgggaggacgtgccgtacctagggaagcgggaggatcagtggtgtggctccctcattggccttaccgcccgggccacgtgggccaccaacatccaggtagcgatcaaccaggtgcgccggctgatcggaaatgagaactatttggactacatgaccagcatgaagcggttcaagaatgagtccgaccccgagggcgccctttggtga

SEQ ID NO: 24734 - RNA, 9879 nt, synthetic construct
  misc_feature 1..9879: note = derived and/or modified CDS sequence (opt11) from DENV-1__KM403606__SS-prME
  source 1..9879: mol_type = other RNA
agcgtgaccatgctcttaatgctgctgcctaccgccctggccttccatctgactacccgtggcggagagccccacatgatcgtatccaagcaggagcggggaaagagcctcctcttcaagacctccgcgggggtaaacatgtgtaccctgatcgcgatggacttgggagagctctgcgaagacaccatgacttataaatgcccccggatcacggaggccgagcccgacgacgtggactgttggtgcaatgccaccgatacgtgggtaacctacgggacctgcagccagaccggcgagcaccggcgcgacaaacggtccgtggcccttgcgcctcatgtaggcttaggcttagagacgcgcaccgagacctggatgagcagcgagggcgcgtggcggcaaatacagaaggtcgagacttgggctctgaggcaccccgggttcacggtgatcgccctgttcctagcacacgccatcggcaccagtatcacgcagaaggggataatcttcatcttgctgatgctcgtgaccccctccatggcaatgcggtgcgtgggcatcggcaatcgtgactttgtggaggggctgtcaggcgccacgtgggtagacgtcgtgttagaacacgggtcctgcgtgaccaccatggccaagaacaagccaaccctcgacatcgagttgctgaagacggaggtcacaaacccagccgtgctccggaagctgtgcatcgaggccaagatcagcaacaccactacagattcccgctgccccacccagggcgaggccaccctggttgaagagcaggatgccaatttcgtgtgccggaggacgttcgtcgaccggggctgggggaacggctgcggtctgttcggcaaagggagtctgctgacctgcgccaagttcaagtgcgtgaccaagctcgagggcaagatcgtgcagtatgaaaacctgaagtacagcgtcatcgtgacagtgcataccggggaccaacaccaagtgggcaacgagacgacagagcacggcaccatagcgaccatcacgccgcaggcccccacgctggagatccagttgacggactatggagccctgaccctggactgcagcccccgcaccggactcgacttcaacgagatggtactgcttacgatgaaggaaaaatcctggctcgttcataagcagtggttcctggatctgccgctcccctggaccagcggggcctccaccagccaagaaacctggaacaggcaggacctgctggtgacctttaagaccgcccatgcgaagaaacaggaggttgtcgttctcggtagccaggagggcgcgatgcacacggcactcaccggggccacagagatccagacgtccggcactacgactatcttcgccggacaccttaagtgccggcttaagatggacaagctgactcttaagggcgtctcgtacgtgatgtgcaccgggagcttcaaactagagaaggaggtggcggagacccaacacggaacagtccttgtccaggtaaagtatgaggggactgacgctccatgcaagatccccatatcgacccaggacgagaagggggtcacgcagaacggccgtctgattacagccaatcctatcgtgacagacaaggagaagccagtaaacatagaaaccgagccgcccttcggggagagctacatcgtcatcggcgccggcgagaaggccctgaagttatcgtggttcaagaaggggtcgtctatcggcaagatgtttgaggccaccgcacgtggtgcccggcgcatggcgatactgggcgacacggcctgggacttcgggtccatcggaggtgtctttaccagcgtggggaagctagtccatcaggtgttcggtacggcgtacggggtacttttctccggtgtcagctggacaatgaaaattggaatcggcatcctgctgacgtggttgggtctgaattcccgcagtacctccctctcaatgacgtgcatcgccgtgggcatggtgaccctgtaccttggcgtcatggtgcaagcggactccgggtgcgtgatcaactggaagggtagggagttaaagtgcgggtccggtatcttcgtgacgaatgaagtgcacacctggactgagcagtacaagttccaagcagactccccgaagcgcctctcagcggccataggtaaggcttgggaagagggggtgtgtggcatccggagcgccacccgcctggagaacatcatgtggaagcagatctcgaacgagctgaaccatatcttgctagagaacgacatgaaattcacggtcgtggtaggagatgccaacggtattctaacgcaaggaaagaagatgatccggccccagcccatggagcacaaatacagctggaagtcctggggcaaggcgaagatcataggcgccgacacccagaacaccacctttatcattgatgggcccgacactccggaatgcccggacgaccaacgcgcctggaacatttgggaggtcgaggactacggcttcggtgtgtttacgaccaacatatggctaaagctgcgggatagctacacccaaatgtgcgaccaccgcctgatgagcgcagctatcaaggacagcaaggccgtccacgccgacatggggtattggatcgagagcgagaagaatgagacctggaagctcgcacgagccagctttatcgaggtaaagacctgcatctggccccgctcccacacactgtggagcaacggcgtattggagagtgagatgattattcccaagatctatgggggccctatcagccagcataactatcggccggggtacttcacccagacagcgggcccgtggcacttaggcaagctcgagctggacttcaacctgtgtgaggggacgacagtggtagtggacgagcactgcggaaaccgcggtccgtccctgcggaccacgactgtgactggaaagatcatccacgaatggtgttgccgaagctgcaccctgccgccccttagattcagaggtgaggatggctgctggtatgggatggagatacggccggtcaaggagaaagaggaaaacctggtgcgctcaatggtgagcgccggctccggcgaggtagactccttctcactggggctcctgtgcgtgtccatcatgattgaggaggtgatgcggagccggtggagccgtaagatgctgatgaccggtaccctcgccgtcttcttcctgctgatcatggggcagttgacttggaacgacctcatacggctctgcataatggtaggcgccaacgtgtcagaccgcatggggatgggcactacgtacctcgccctgatggccaccttcaaaatgcgacctatgttcgccgtcggtctcctcttccgccggttaacctcgagagaggtgctgctcctcaccattgggctgagcctggtcgcctctgtggaactacctaactctctagaggagttgggcgacgggctggcgatggggatcatgatgcttaagctgctaaccgacttccaatcccaccaactgtggaccacccttttgtcgctgacgttcatcaagacaacgctctccctggattacgcctggaaaaccatggcgatggtgttgagcatcgtgtccctcttccccctgtgcctgagcaccacgagtcagaagacgacctggctccccgtgttactcggcagcttcgggtgcaagccactcaccatgttcctgatcaccgagaacaaaatctggggaagaaaatcctggcccctgaacgaggggatcatggccgttggcatcgtcagcatcctcctgtccagcttgctcaagaacgacgtgcccctggctgggcctctgatagccggtggcatgctcatcgcgtgctacgtgatcagcggaagtagcgctgatctgagcctggaacgcgccgcggaagtcagctgggaggaggaggctgagcattccggcgccagccacaatatcctcgttgaggtgcaggacgacgggactatgaagatcaaggacgaggagcgggacgataccctgacgatcttgctgaaggcgaccctgttggccgtctcaggcgtgtacccaatgtcaatcccggccactcttttcgtgtggtacttttggcaaaagaagaagcaacgctccggggtcctgtgggacacacccagcccgcccgaggtagagcgggccgtgctggacgacggcatctaccggattctccaacgggggctcttagggcgatcccaggtcggcgtgggtgtgtttcaagacggcgtttttcacaccatgtggcacgtgacacgcggggctgtgctcatgtaccaaggcaagcgcctcgaaccctcctgggcctccgtgaaaaaggacctaatctcatacggcgggggctggaggttccaggggtcctggaacacgggcgaagaagtccaggtgatcgccgtcgagcccgggaaaaaccccaaaaacgtacaaaccacgcccggcacgttcaagaccccggagggcgaagtgggggccattgccctggatttcaagcccggcaccagcgggtcccccatcgtcaatagagagggcaagatagtggggctctatggaaacggcgtcgtcacaaccagcggtacgtatgtgtctgcgatagcccaggcgaaggcctcccaggagggccccctgcccgagatcgaggacgaggtgttcaaaaagcggaacttgacaataatggacctccaccccggaagcggtaagacacgccggtacctgccggccattgtccgtgaggcgataaagcgaaagctgcggaccctgatactggcccccacacgcgtggtggcaagcgagatggccgaagcgttaaagggcatgcccattcggtatcagactaccgccgtcaagtctgagcacaccgggaaggagatcgtggacctcatgtgccacgccacgttcacgatgcgcctgctttcccccgtgcgggtcccgaactataatatgatcatcatggatgaggcccatttcaccgaccccgccagcatcgctgcccgcggctacatctccacccgggtcggcatgggcgaggcagcagcaatctttatgacggcgacgcctcccgggtcagtggaggcgtttccacagtccaatgccgtcatacaggacgaggagcgcgacattccggagcgaagctggaactccggctacgactggatcactgacttccccggcaagaccgtatggttcgtaccgagcatcaaatccggtaacgacatcgcgaattgtttgagaaagaacggcaagcgggtcatccagctgtcgcgcaagacatttgataccgagtaccaaaagacgaaaaacaacgactgggactatgtagtgaccacggacatctccgagatgggagccaatttccgagctgaccgggtcatcgacccaagacgctgcctgaaacctgtgatcctgaaggacggccctgaacgggtcatcctggccgggcccatgccggttaccgctgctagcgcggcccagcgccggggccgcataggtcgcaaccagaacaaggagggggatcaatacatctacatgggccagccgctcaataacgacgaggaccacgcccactggacggaggccaagatgctcctagataacataaatacacccgagggcatcatccccgccctattcgaaccggagcgggagaaatccgccgcgatcgacggagagtaccggttgcgaggggaggccagaaagacgttcgtggaactgatgcggcgcggagacctgccggtctggctcagctacaaggtggcctcggagggcttccagtatagcgaccggcgttggtgtttcgacggcgagcggaacaaccaggtcttagaggagaacatggacgtcgagatctggaccaaagagggtgagcgcaagaagctgaggccccgctggctcgatgctaggacctactccgaccccttagcgctgcgcgaattcaaagaattcgccgccgggcggcgatcggtgtcgggcgatttaatcctggagataggcaagctgccgcagcacttaacgttgagggcgcagaacgctctggacaacctcgttatgctgcacaactccgagcagggtggaaaggcgtacagacatgccatggaggagctgcccgatacgatcgagacgctcatgcttttagctttgatagccgtcttgaccggaggcgtcaccctattcttcctcagcggcaagggcctaggcaagacctctatcgggctgctctgcgtaatggcgagctccgtcctgttatggatggccagtgtggagccccactggatagccgcaagtatcatcctcgagttcttcctcatggtgttactaatccccgagccggatcggcagcgcacgccccaggacaatcagcttgcttacgtcgtgatcggcctcctctttatgatcctgaccgtcgcggccaatgaaatggggctgctcgagaccaccaaaaaggatcttggtatcggccacgtcgtggccgaaaaccatcaccacgccacgatgctggacatcgaccttcaccccgcaagcgcgtggaccctgtacgccgtggccaccactatcataacgccgatgatgcggcacaccattgagaacaccacagccaacatatccctcacggccatcgcgaatcaggcggcgatcttaatgggcttagacaagggctggcccataagcaaaatggacatcggggtcccactgctcgccctgggctgttacagccaggttaaccccctgacgctcactgctgcggtgttgatgctggtggcccactacgccatcatcgggccgggtctccaggcgaaggcgacccgcgaggcccaaaaacgcacggccgctggtatcatgaagaaccccaccgtggatggcattgtggccatcgatctggaccccgtcgtgtacgatgcgaagtttgaaaaacagctgggccagatcatgttactgatcctgtgtaccagccagattctcttaatgaggaccacctgggccctgtgcgagtcgatcaccctcgcgacagggcctctgacaactctgtgggagggctcgccggggaagttttggaacaccaccattgccgtgtccatggctaacatcttccgcggaagctacctcgcgggcgcaggacttgccttctccctgatgaaaactttaggcggcggccgccgcgggaccggcgcccagggcgaaacactgggtgagaagtggaagcggcagctgaaccagctaagcaagtcagagttcaacacctacaaacgtagcggcatcatggaagtcgacagatctgaggccaaggaggggctgaagcgcggcgagaccactaagcacgctgtgtcccgggggacggccaagctgcgctggttcgtggagcggaaccttgtcaaacccgaagggaaggtaatcgacctcggctgcgggagagggggatggtcctactactgcgcaggcttgaagaaagtgaccgaagtcaaggggtacaccaaaggcgggcccgggcacgaggagcccataccgatggccacgtacgggtggaacattgttaaactgcactccgggcgggacgtgttcttcactcctccggagaagtgcgacaccctcctgtgcgacatcggagagagctcccccaatccgacgatagaggaggggaggaccctgcgtgttcttaagatggtggagccgtggttacgcggcaaccagttctgtatcaaaatcctcaacccctatatgcccagcgtggtcgagacccttgagcaaatgcagcggaagcacggcggtatgcttgttcgcaacccgctgtctcggaacagcacccacgaaatgtactgggtctcctgtggcaccgggaacattgtaagcgcggtgaacatgacgtcacgaatgctcctgaatcggttcacgatggcccaccggaagcccacctacgagagagatgtggacctgggcgccggcaccaggcatgtcgccgtggagccagaaatcgcgaatctcgatatcatcggccagcgcatcgagaacatcaagaatgaacacaaatcgacctggcactatgatgaggacaatccatacaagacgtgggcttatcatggctcctacgaagtgaagccgagcgggtccgcaagctcaatggttaacggtgtggtccggcttctgaccaagccctgggacgtgatcccgatggtgacacagatagccatgaccgacacgacgccgttcgggcaacagagagtctttaaggagaaagttgacacacgaactccgcgccccaagcggggtacggcccaaatcatggaggtgaccgccaaatggctctgggggttcctgagtcggaacaagaagccccggatttgcacccgtgaagaattcaccaggaaggtccgctcaaacgcggccatcggggccgtgtttgttgatgaaaaccagtggaacagcgcaaaggaggcggtcgaagacgagcggttttgggaccttgttcacagagagcgtgagctccacaagcagggcaaatgcgcgacgtgcgtctataacatgatgggaaagcgcgagaagaagctgggcgagttcgggaaggccaagggcagccgggccatttggtacatgtggctaggcgcccgcttcctcgagttcgaggcgctagggtttatgaacgaggaccactggttcagtcgggagaacagcctgagtggagtcgagggtgaaggcctccacaaattagggtacattctgagggacatcagcaagataccgggcggcaacatgtacgccgacgacaccgctgggtgggacacccgcattacagaggatgacctccagaacgaagccaagatcacggacatcatggagcccgagcacgcgttactagcaacatccattttcaaactcacctaccagaacaaggtggtgcgcgtccaaagacccgcaaagagtggaaccgtgatggacgtgatctcccggcgagaccagcgggggtctggccaagtaggcacgtacgggctgaatacatttactaacatggaggttcagctgatccggcaaatggaatccgagggcatattcagcccgtcggaactcgagaacagcaacctggccgagcgagtgctagactggctcgagaagcacggggtcgagaggcttaagcggatggcaatctctggcgatgattgtgttgtgaagccgaccgacgaccgattcgcgaccgccctcaccgcactcaacgacatggggaaggttcggaaggacatcccccaatgggagcccagcaaaggctggaacgattggcagcaggtccccttctgtagtcaccatttccaccagctgattatgaaagacggacgggagatcgtggtgccatgtcggaaccaggacgagctggtggggcgggcgcgagtgtctcagggggcagggtggtccctccgcgagaccgcgtgtcttggcaagagctatgctcagatgtggcagctgatgtatttccacaggcgcgacctgcggctcgccgccaacgccatatgtagcgccgtccccgtgaactgggtgcccacctccagaaccacctggtctatacatgcgcaccaccagtggatgaccaccgaagacatgctttccgtctggaatcgcgtgtggatcgaggaaaacccctggatggaagacaagacacacgtgagttcctgggaggacgtcccgtatctcgggaagagagaagaccagtggtgcggcagcctgattggcttgactgcccgcgccacgtgggctaccaacatccaggtggcgatcaaccaggtgcggcgcttaatcgggaacgagaactatttagactacatgacctccatgaagcggttcaagaacgaatcagacccagagggcgctctgtggtga

SEQ ID NO: 24735 - RNA, 9879 nt, synthetic construct
  misc_feature 1..9879: note = derived and/or modified CDS sequence (opt11) from DENV-1__KM403591__SS-prME
  source 1..9879: mol_type = other RNA
tcggtgaccatgctgttaatgttgttaccgaccgcgctcgcctttcacctgacgacccggggcggggaaccccacatgatcgtaagcaagcaggaacggggcaaaagcctgctgttcaagacctccgcgggggttaacatgtgcaccttgatcgccatggacctaggagagctctgcgaagatacgatgacctacaagtgcccccgcatcaccgaggccgaacccgacgacgtggattgctggtgcaacgccaccgacacgtgggtgacctacgggacctgcagccagaccggcgaacaccggcgcgacaaacggtccgtggccctggcgcctcatgtgggtctggggctcgagacccggacggagacctggatgagctccgagggtgcctggcggcagatccagaaggtggagacctgggccctccgccatccagggtttacggtgatcgccctgttccttgcccacgccatcggaacatctatcacgcagaagggaataattttcattctactgatgcttgtgacgccctccatggccatgcggtgtgtcggaattggcaaccgcgacttcgtggaggggctgagcggtgccacctgggtggacgtcgtgctggagcacgggtcctgcgtgaccacgatggccaagaacaagcccaccctcgacatcgagctgttgaaaacggaggtcaccaacccggcggtgttacgaaagctgtgcattgaggccaagatcagcaacacaaccaccgacagtcgctgtcccacccaaggtgaggcgaccctagtggaggaacaagatgcgaacttcgtctgccggcgtaccttcgtagatcggggctgggggaacggctgcggcctcttcggcaaggggagcctgctgacttgcgccaagtttaagtgtgtgaccaagctcgagggcaagatcgtgcagtacgagaacctgaagtactccgtgatcgtgaccgtccacaccggcgaccaacaccaggtggggaacgagacgacagagcatggcaccatcgcgaccatcacgccccaggcccccacgagcgagatccagctgactgattacggggctctcacgctggactgcagcccccggaccggcctggacttcaacgaaatggtcctcctgaccatgaaggagaagtcctggctggtgcataagcagtggttcctcgacctgccgctgccctggacctccggcgctagcaccagccaggagacctggaaccggcaggacctcttagtgacgtttaagaccgcccacgctaagaagcaggaggtcgtggtcctgggcagtcaagagggcgccatgcacactgctctcacaggggcaacggagatccagacctccggcaccaccacgatcttcgccgggcacctgaagtgccgtctgaagatgggcaagctcaccctgaagggggtctcctacgtgatgtgcaccggaagcttcaagcttgagaaggaggtggcggagacccagcacggtacggtcctggtccaggtcaagtacgagggtaccgacgccccgtgcaagatccccatctccacccaggacgaaaaaggcgtcacccaaaacgggagactcattacggcgaacccgatcgtgaccgacaaggaaaagcccgtgaacatcgaaaccgagccgccgtttggggaaagctatatcgtcattggagccggggagaaggcgctgaagctgtcctggtttaagaagggctccagtatcggaaagatgttcgaggccactgcccgaggcgcacggcgcatggcaatccttggagacaccgcgtgggatttcggctcaataggcggcgtcttcacctccgtgggcaaattggtacaccaggtgtttgggaccgcctatggcgtgctgttctcaggggtatcgtggaccatgaaaatcggcatcggtatacttctgacgtggttaggactcaacagccgctcgaccagcctgagtatgacctgtatcgccgtgggcatggtgacactgtacctcggagtcatggtacaggccgacagcggctgcgtgatcaactggaaggggcgggagctcaagtgtggctccgggattttcgtcacgaacgaggtgcatacctggaccgagcagtacaagttccaggccgatagccccaagcgtctatcggcggccatcggaaaggcttgggaagagggcgtgtgtgggatcaggtccgccacccgcctcgagaacatcatgtggaaacagattagcaatgagttgaaccacatcctgctcgagaacgacatgaagttcaccgtcgtggtgggcgacgccaacggtatactgactcagggcaagaagatgattcggccccagcccatggaacacaagtactcctggaagtcgtggggcaaggcaaagataatcggggccgacactcagaacacaaccttcatcatagacggacccgacacgccagagtgccccgatgatcagcgcgcctggaacatctgggaggtcgaagactacggcttcggagtgttcaccaccaacatctggttaaagctcagggattcctacacccagatgtgtgaccatcgcctgatgtcggccgcgattaaggactctaaagccgtgcacgccgatatgggctactggatagagagcgaaaagaacgagacctggaaactggcgcgggcatccttcatcgaggtgaagacttgcatctggccccgcagccataccctctggtccaacggtgttcttgagagcgagatgatcatccccaagatctacggcgggccgatctcccagcacaactataggccaggctacttcacccagactgctgggccctggcacttaggcaagctcgagcttgacttcaacctctgtgagggtaccaccgtggtggtggacgagcactgtgggaaccgcgggcctagcctcagaaccacgactgtgacaggaaaaatcatccacgaatggtgctgccgctcctgtaccctgccgccacttaggtttcgcggcgaggacgggtgctggtacggaatggagatccggcccgtaaaggagaaggaggagaaccttgtacgctctatggtgtccgccggcagcggggaggtcgacagcttctccttgggcctgctctgtgtgtcgatcatgatagaggaggttatgcggtcccgctggagccgaaagatgctgatgacgggcaccctggccgtcttcttcctcctgatcatggggcagctgacctggaacgacttgatccggctgtgtatcatggtgggggccaacgtctcggaccgcatgggtatgggaacgacttacctggcactcatggcgaccttcaagatgcggccgatgttcgctgtagggctgttgttcaggcggctcaccagccgagaggtgctgcttctcaccatcggcctgtccctggtcgcatccgtcgagttacccaactccctggaagaactgggggacggcctcgccatgggtatcatgatgctgaagctgctcacggactttcagagccaccaactgtggaccaccctcctatccttgaccttcatcaaaacgactctgagcctcgactacgcatggaagactatggccatggtgttatccatagtctccttattccctctctgcctttccaccacgagccagaaaaccacctggctgcccgtcctcctcggatccttcgggtgcaaaccgctgaccatgtttctcatcactgagaacaagatctgggggcggaaaagctggcccctaaacgagggcatcatggcagtcggcatcgtcagcatactgctcagctctttactgaagaacgacgtaccgctggctggccccttaattgccggtgggatgctcattgcttgctacgtgatttccggcagctccgccgacctcagcctcgaacgcgccgccgaggtctcctgggaggaggaagccgagcacagcggggcgtcccacaacatactggtcgaagtgcaggacgacggcacgatgaagatcaaggacgaggagcgggacgacaccttaaccatcctgctgaaggcgaccctcttagcggtcagcggagtgtacccgatgtccatccccgccacgttgtttgtatggtacttctggcagaagaagaagcagaggagcggcgttctctgggacacgccgagcccgcccgaggtggagcgggccgtactggacgacggcatctaccgcatcctgcaacggggtctgctcggccgaagccaggtcggggtgggcgtcttccaagacggggttttccatacgatgtggcatgtgacccggggcgcggtgctgatgtaccagggaaagaggctggagccctcctgggcctcggtcaagaaggatctcatatcctacggcggcggctggcggttccagggctcatggaacacgggggaggaggtacaggtcatcgccgtcgagcccggcaagaaccccaagaacgtgcagaccacccccgggaccttcaagacgccagaaggtgaggtgggcgccatcgccctggacttcaagcctggtacctccgggagccccatcgtcaaccgcgagggcaagatcgtggggttgtacggcaacggggtcgtcaccacctccggcacgtacgtttcagccatcgcacaagcgaaggccagccaggaggggccgctccccgaaattgaggacgaggtgtttaagaagcggaacctaaccattatggatctccaccccggctctggcaaaaccaaacgctacctccctgccatcgttcgggaggcgataaagcgcaaactgcggaccttaatcctggcccctacacgggttgttgccagcgagatggccgaggcattgaaggggatgcccatcaggtaccagaccaccgccgtcaagtccgagcataccggcaaagagatcgttgacctgatgtgccacgctacattcactatgcggttgctgagccccgtgcgcgtcccaaactataacatgattatcatggatgaggcccacttcaccgaccccgcctccatcgcggctcggggatatataagcacacgagtgggcatgggggaggccgccgccatattcatgacagcgaccccacccggctccgtggaggccttcccccagagtaatgccgtgatccaggatgaggagcgggacatccccgagcgctcatggaatagcggctacgactggatcaccgactttccaggtaagaccgtgtggttcgtaccttccattaagtctggcaacgacatcgcgaactgcctcaggaagaatgggaagcgcgtcatccagctgtccagaaagacgttcgacacagagtaccaaaagaccaagaacaatgactgggattacgtggtaaccacggatataagcgagatgggcgccaatttccgggccgaccgggtcatcgacccgcgtcggtgcctgaagcctgttattctgaaggacgggcccgagcgcgttatcctcgccgggcccatgcctgtgactgcagcgtccgcagcccagcggcgcggccgcatcggtagaaaccagaacaaagagggcgaccagtatatctacatgggacagcccctcaacaacgatgaggaccacgcccactggaccgaggccaagatgttactagacaacatcaacacccccgagggtatcatccccgccctgttcgagccggaacgcgagaagtccgcggcgatcgacggcgagtaccgtctgcgtggcgaggcccggaagacgttcgtggagctaatgcgccggggcgacctgcccgtctggctgtcctacaaggtggccagcgaggggttccaatattccgacaggcgctggtgctttgatggtgaaaggaacaaccaggtactcgaggagaacatggacgtcgaaatctggaccaaggagggggagcggaagaagttgcgtccccggtggctggacgcacgcacttacagcgaccccctcgcgctgcgggagttcaaggagttcgccgcaggccgtcgtagcgtgtccggcgacctgatcctcgagatcgggaagctgccgcaacacctgaccttacgtgcccagaacgcccttgacaacctggtgatgttacataacagcgagcagggggggaaggcgtaccggcacgctatggaggagctgcccgacaccatcgagacgctgatgctcctcgccctgatcgctgtccttaccggcggtgtgaccctgttctttctgtctggtaagggcctcggcaagaccagcatcggactgctttgcgtgatggcgtccagcgtcctcctgtggatggcatccgtggagccccattggatcgcagctagcatcatcctcgagttctttttgatggtgctgctgatccccgagccggaccgccagagaacgccccaggacaaccagctcgcctacgtcgtgataggcctgctgtttatgatcctcaccgtcgccgcgaacgagatggggctactggagactaccaagaaagacttagggataggccacgtcgtcgccgagaaccaccaccatgccacgatgctagacattgacctgcaccccgcctccgcgtggacactctatgccgtggccaccaccatcatcacccccatgatgcgccacaccatcgagaacaccaccgccaacatatctctgaccgctatcgccaaccaggccgccatattaatgggcctcgacaaggggtggccgatcagtaagatggatataggcgtccccctgctggctctcgggtgctatagccaggtgaaccccctgacgcttaccgcggcggtgctcatgctggtcgcccattacgccataatcggcccggggctccaagccaaggcgacgcgggaggcccagaagcggacggccgccggaatcatgaagaaccccacggtggatggcatcgtggccatcgacctcgaccctgtcgtgtacgatgcgaaattcgagaagcaactggggcagatcatgctgctcatcctgtgcacctctcagatcttgctcatgaggaccacgtgggcgttatgcgagtctatcaccctggctaccggccccctcaccacgctgtgggaggggtccccaggaaaattctggaacaccactatcgcagttagcatggccaacatcttccggggctcctacctggcgggagccggcctcgctttcagcctcatgaagtccctcgggggcggtcgccgggggaccggtgcgcagggggagaccctaggcgagaagtggaagcggcagttaaaccagctgagcaaaagcgaattcaacacctacaagcgctccgggatcatggaggtcgacagaagcgaggcaaaagagggcttaaagcgcggggagaccactaaacacgcggtgtccaggggcacggcaaaactgagatggttcgtggaacgaaatctggtcaagcccgagggtaaagtgatcgacctggggtgcggcaggggtggctggagctactactgcgccgggctcaagaaggtgaccgaagtgaagggctatacaaagggagggcccggccacgaggagcccattccgatggccacctatgggtggaacattgtgaagctgcactccggccgggatgtgttcttcacgccgcccgagaagtgcgacactctcctctgcgacattggggagagctctcccaatccgaccatcgaggagggacggaccctgcgcgtcctgaagatggtggaaccgtggctccgaggcaaccagttctgcataaagattcttaacccttatatgccctccgtggtcgagacactggagcagatgcagaggaagcacgggggcatgttggtccggaacccactatctcgcaacagcacgcacgagatgtactgggtctcctgcggcaccggcaacatcgtcagcgcggtgaatatgacgtcccggatgctgctcaaccgcttcaccatggcccaccgcaagcccacttacgagagggacgtggacctgggtgccggcacccgccatgtagccgtagaacccgagatcgccaaccttgacatcatcggccagcggatcgaaaacattaagaacgagcataagagcacctggcattacgacgaggacaacccttacaagacctgggcgtaccacgggagctatgaagtgaaaccgagcggctcagcatcatccatggtcaacggggttgtcaggctcctgacgaaaccctgggacgtaatccccatggtgacccagatcgccatgaccgacaccacgccctttggccagcagcgcgtcttcaaagagaaagtcgatactcgcaccccgcggccgaagcgcggtaccgcacaaatcatggaagtgacggccaaatggctgtgggggttcctgtctcggaacaagaagccccgcatctgcacacgggaggagttcacccgaaaggtccggagcaacgcggcaatcggcgccgtgttcgtggacgagaaccagtggaactccgcgaaggaagcggtcgaggatgaacgattctgggacctggtgcaccgggagcgcgagcttcataaacaggggaagtgcgcgacctgcgtgtacaacatgatgggcaagcgggaaaagaagctaggagagttcgggaaggcaaagggctcacgtgctatttggtacatgtggcttggggcccggttcctggaattcgaggcgctgggtttcatgaacgaggaccactggttctcacgcgagaacagcctatccggggtcgagggcgaaggactgcacaagctcggctacatcctgcgggacatcagtaagatcccgggcggaaacatgtacgccgacgatacggccggctgggataccaggattaccgaggatgacctgcagaacgaggccaagatcacggacataatggagcccgagcacgcattattggctacgtccatcttcaaactgacataccagaacaaggtcgtacgcgtccagagacccgccaagagcgggaccgtgatggacgtgatctccaggcgggaccagcgcggcagcggccaggtagggacctacggtctcaacacgttcaccaacatggaggtgcagttgatccggcagatggagtccgagggcatcttcagccccagcgagctggagaacagcaacctcgccgagcgtgtgctggactggctggagaagcacggcgtcgagcggctgaaaaggatggcaatctctggggacgactgcgtggtgaagccgacagacgatagattcgccaccgcgctaacggcattgaacgacatgggcaaggtacgtaaggacatcccccagtgggagcccagcaagggatggaacgactggcagcaggtccccttttgctcccaccatttccatcaattaatcatgaaggacgggcgcgagatcgtggtaccgtgccgcaaccaggacgagctggtaggccgtgcccgcgtgagccagggcgctggctggagcctaagagagaccgcgtgcctcgggaaatcctacgcgcaaatgtggcagctgatgtactttcaccgccgggaccttcgcttagccgccaacgcaatctgtagcgcggtccccgtgaactgggtgcccacctcccggaccacctggagcatccacgcgcatcatcagtggatgaccacagaggacatgctgtcggtctggaaccgcgtgtggatcgaggagaacccttggatggaggacaagacccacgtgagcagttgggaagacgtcccatacctgggtaagcgcgaggaccagtggtgcggcagccttatcgggctaaccgcgcgggcgacgtgggccaccaacatccaggtggcaatcaaccaggtgcgccggctcatcggcaacgagaactacctcgactacatgacgtccatgaagcgattcaaaaatgagagcgaccccgaaggggccctgtggtag

SEQ ID NO: 24736 - RNA, 9879 nt, synthetic construct
  misc_feature 1..9879: note = derived and/or modified CDS sequence (opt11) from DENV-1__KM403607__SS-prME
  source 1..9879: mol_type = other RNA
tcggtgactatgctgctcatgctgcttcctaccgcgctggccttccatctgaccacacgtggcggggagccccacatgatcgttagcaagcaagagcgaggcaagagcctcctgttcaagaccagcgcgggggtgaacatgtgtacccttatcgccatggacttgggcgaactctgcgaagacacgatgacatacaagtgcccccggatcacggaggctgagcctgacgacgtggactgctggtgcaacgccaccgatacctgggttacctacggaacctgcagccagaccggagaacaccggcgggacaagagatccgtggccctggcgccgcacgtgggcctgggtctcgagacgcgcaccgagacatggatgtcttcagagggcgcgtggcggcaaattcagaaggtggaaacctgggccctgcggcaccccgggttcacggtgatcgctctgttcctcgcgcacgccattggcacaagtattacccagaagggaatcatctttattctgctgatgttggtaaccccctccatggccatgcgttgcgtgggcatcggtaatcgcgattttgtggagggtctgagcggcgcaacgtgggtggatgtcgtgctggagcacgggtcctgcgtaaccaccatggccaagaacaagccaaccctcgacatcgagctgctcaaaacggaggtgaccaaccccgcggtactccggaagctgtgtatcgaggccaagatcagcaacaccaccacggactcccgctgcccaacccagggagaagcgaccctggtggaggagcaagacgctaacttcgtatgccggcgaaccttcgtggaccggggctgggggaacggctgcggcttattcggcaaggggtcccttctgacttgcgccaagttcaagtgcgtgactaagctggagggaaagatcgtccagtatgagaacctgaaatactccgtgatcgtaaccgtccataccggcgaccagcaccaagtgggcaacgagacgaccgagcacgggaccatcgcgaccataacgccccaggcccccaccagcgagatccagctcacggactacggggccctcaccctggactgcagcccgagaaccggtctcgacttcaacgagatggtgctgcttacaatgaaggagaagtcttggctggtgcacaagcagtggttccttgacctgccgctcccgtggacctcaggggccagcaccagccaggaaacctggaaccggcaggacctactggtaacgttcaagaccgcccacgcgaagaagcaggaggtcgtggtgctggggtcccaggagggtgccatgcacacggcattgaccggggccacagagatacaaaccagcgggaccaccacgatcttcgccgggcatctaaagtgccgcctgaagatggacaagctaaccctaaagggcgtctcctacgtgatgtgcaccggcagctttaagctggagaaggaggtggcggagacccagcacggcaccgtcctggtccaggtgaagtacgagggcacggacgccccctgcaagatccccatctccatccaggacgagaagggcgtcacccagaacggccgtctaatcacggccaatccgatcgtgacggacaaggaaaaaccagtgaacatcgaaaccgagccgccctttggggagagctacattgtcatcggcgccggcgagaaggcgctgaagctgtcctggttcaaaaaggggagctccatcggcaagatgttcgaggccaccgcccgcggggcccggcgcatggctatcctgggcgacaccgcgtgggacttcggttcgataggcggcgtgttcacgtccgtggggaagcttgtccaccaggtattcggcaccgcttacggggtattgttcagtggcgtctcgtggactatgaaaatcgggattggtatccttctgacctggctgggcctcaacagccgctccacgagcctttccatgacctgcatagccgtggggatggtaaccctgtatctaggcgtcatggtgcaagcagatagcggttgcgtgatcaactggaaaggccgggagctgaagtgcgggtccggcatctttgtgaccaacgaggtgcacacgtggacagaacagtacaaattccaggcagacagcccgaagcgcctgtcagcggccatcggcaaagcctgggaggaaggggtgtgcggcatccggtccgccacacggcttgagaacatcatgtggaagcagatcagcaacgagctgaatcacatcctgctcgagaacgacatgaagttcacggtcgtagtcggggacgccaacggcatcctgacccaggggaaaaaaatgatccgcccacagcccatggagcacaaatactcctggaagtcctggggcaaggcgaagatcatcggcgccgacacgcaaaacaccaccttcatcatagacgggcccgacacccctgagtgccccgatgaccagcgcgcatggaacatttgggaggttgaggactacggcttcggggtgttcacgacaaacatctggctgaagcttagggacagttatacccagatgtgcgaccaccgcctcatgagcgccgcaatcaaggactccaaggccgtacacgccgacatgggctattggatagagagcgagaaaaacgagacttggaaactcgcccgggcctcgttcatcgaggtcaagacgtgcatctggcctcgtagccacaccctctggtccaacggcgtactggagagcgaaatgatcattccaaagatctacgggggcccgatctcgcagcacaactacagacccgggtacttcacccagaccgcaggcccgtggcacctggggaagcttgagctggacttcaacctatgtgaaggcacgactgtggtcgtggacgagcattgcggcaaccgcgggccgagcttgcggactaccacggtgactggtaaaatcatccacgagtggtgctgccgctcttgcaccttacctcccctgcggtttcggggggaggacgggtgctggtacgggatggagatccgtcctgtcaaagagaaagaggagaacttggtgcgcagcatggtgtccgccggaagcggcgaggtcgacagcttctcgttggggctgctctgcgtaagcatcatgatcgaggaggtgatgagaagcagatggagccgcaagatgttaatgaccggcacgctggccgtcttctttcttctgatcatggggcagttgacctggaacgatctaatccggttatgcatcatggtgggcgccaacgtgtccgaccgcatggggatgggcaccacctacctggcgctcatggcgacgttcaagatgcggccgatgtttgctgtcggtctgttattccgccgacttaccagtcgcgaggtgctgttactcaccatcgggttgtccctggttgccagtgtagagctccccaattccctggaggagctgggcgacggtctggctatgggaatcatgatgttaaaactactcaccgacttccagagccaccaactgtggacgaccctgctctccttgaccttcatcaagaccacgctgagcctcgattatgcctggaagacgatggcgatggtactgtccatcgtctcgctttttccgctctgcctgtccaccaccagccagaagacgacatggctaccagtgttactgggctccttcgggtgtaaaccgctgacaatgttcctcatcacggagaacaagatttggggccgcaagtcgtggcccttaaacgagggcataatggccgtgggcatcgtatccatattgctctcgagcctgctgaagaacgacgtacccctcgccgggccactgatcgccggcggtatgctgatagcgtgctacgtgatctcgggctcgtctgccgacctcagcttggagcgcgcggcggaagtctcctgggaggaagaggccgagcacagcggtgcgtcccacaatatcctggtggaggtgcaggacgatgggaccatgaaaattaaagacgaagagcgggacgacacgctcaccatactgttaaaggccacgctcctggccgtcagcggtgtctaccctatgtcgatccccgccaccctgttcgtttggtatttctggcagaagaagaagcagaggagcggggtcctctgggacacgccgagcccgccggaggtggagcgggccgtgctggacgacggcatctaccgcatccttcagagaggactgcttgggcgcagccaggtcggcgttggcgtgttccaggatggcgtctttcacaccatgtggcacgtgactcggggtgcggtgctgatgtaccagggcaagcgcctggagccgtcctgggcgtccgttaagaaggatctcatttcctacggcggtggatggaggtttcaggggagctggaacaccggcgaggaggtccaggtgatcgccgtcgaacccgggaagaaccccaagaacgtgcagactacccccggcaccttcaagactcccgagggtgaagtgggtgcaatagccctggatttcaaaccgggtacgtccgggagccccatcgtcaaccgcgaaggcaaaatcgtgggcctatatggcaacggcgtggtcacaaccagcgggacttatgtgagcgcgatagcccaggccaaggccagccaggagggcccgctccccgagatagaggacgaggtgttcaaaaaacggaacctgacgatcatggacctgcatccaggaagcggcaaaacccgacggtacctcccggccatcgtccgcgaggcgatcaaaaggaagcttaggacactgatcctcgcacccacccgagtggtggccagcgagatggcagaggcgctaaaaggcatgcccatccgataccagacgaccgctgtcaagtccgagcacaccgggaaggagatcgttgacctgatgtgccacgcgactttcacgatgcgcctcctcagccccgtgcgcgtaccgaactacaacatgatcatcatggacgaagcccactttaccgatccagccagcatcgcggccaggggctacatcagcacccgtgtagggatgggcgaggcagccgccatctttatgaccgcgacgccgcctgggtccgtagaagccttcccgcagagcaacgccgtcatccaggacgaggagcgcgatatccccgaacggtcgtggaacagcggctatgactggatcactgacttccccggcaagaccgtatggttcgtgccaagcatcaagagcgggaacgacatcgccaactgcctgcgcaaaaacgggaaacgggtaatccagctctcccgcaagacgttcgacacggaataccagaagaccaagaacaatgactgggactacgtcgtgaccaccgatatctcggagatgggcgccaacttccgcgcggaccgtgtaatcgatccgcggagatgcctgaagcctgtgattctgaaggacggccccgagagggtcatactcgcggggccgatgcctgttacagcagcctccgccgcccagcgccggggccgcatcggccgcaaccagaataaggagggcgatcagtacatctacatgggccagcccctgaacaacgacgaggaccacgctcactggaccgaggccaagatgcttctcgacaatatcaacacccccgaagggatcatacccgcgttattcgagccggagcgggagaagtccgcggccatcgacggcgagtataggctgcgaggggaggcccgcaagaccttcgtagagctcatgcggcgcggggatctgcccgtctggctttcgtacaaggttgccagcgagggattccagtactccgacagacgctggtgcttcgacggggagcggaacaaccaggtgctcgaggagaacatggatgtcgagatctggacgaaggagggggagcgaaagaaactgcggccccgctggctggacgcccggacctacagcgacccccttgcgctgcgcgagttcaaagagttcgccgccgggcggcgcagcgtgtcgggcgatctgatactcgaaatcggcaaactgcctcagcacttgacactgcgtgcccagaatgccctggacaaccttgtgatgcttcacaacagcgaacagggcgggaaggcctaccgccacgccatggaggagctgcccgataccatcgaaaccctgatgctcctggcccttatcgccgtactcaccggcggtgtgaccctattttttctgtctgggaaagggctcgggaaaaccagcatcgggttactctgtgtgatggcgtccagcgtcctcctgtggatggccagtgtggagccccattggatcgccgcgagtatcatcttggagtttttcctcatggttcttttaatccccgagcctgacagacagcgcaccccccaagacaaccagcttgcttacgtcgtgataggccttctgtttatgatcttaacggttgcggccaacgagatggggctgctggaaaccaccaagaaggacctcgggatcggtcacgtcgttgccgagaaccaccaccacgccaccatgctggacatcgacctgcaccccgcatcagcgtggacgctctacgccgtagcgaccacgataatcaccccgatgatgcggcacacgatcgaaaacaccaccgcgaacatcagcctcactgccatcgcgaaccaggccgctatcctgatgggcctcgacaagggctggccaatctccaagatggacatcggcgtcccactgctggccctaggctgctacagccaggtgaatcccctgacgctgaccgccgccgtgctcatgctggtcgcccactacgccatcatcgggccggggttacaggcgaaggcaactcgcgaggcccagaagcgcaccgccgccggcataatgaaaaaccccacggtggacggcatcgtggcgatagaccttgatcctgtggtgtacgacgctaagttcgaaaaacagttgggccagataatgctgctcatcctgtgcacctcccagatcctgttaatgcgtaccacctgggccctgtgcgagtcaatcacgctggccacggggcccctcaccacactgtgggagggttccccggggaagttctggaacaccaccatcgccgtgtctatggccaacatcttccgaggatcctacctggcgggagcagggctcgccttcagcctgatgaagaccttgggcgggggccggagaggtacgggcgcccagggtgaaacgctcggggagaagtggaagcggcagctgaaccagctttcgaagagcgagttcaatacgtacaagcgtagcggcatcatggaggtagaccgaagcgaggccaaggaggggctcaaacgtggtgagaccaccaagcacgctgtgtcacggggcacggctaagcttagatggttcgtggaacggaacctggttaagcctgagggaaaggtcatcgacctgggctgcgggcgcggcgggtggtcctattattgtgccggtctcaagaaggtgaccgaggttaaggggtacactaagggcggccccgggcacgaggaaccgatccctatggccacctacggctggaacattgtgaagctgcacagcggacgggacgtgttctttacgccgccagagaagtgtgatacgctgctttgcgatatcggcgaaagtagtcctaacccgaccatcgaggaggggcgcaccctgcgggtcctcaaaatggttgagccctggttgagagggaatcaattctgcataaagatcctgaacccctacatgccctccgtcgtcgagacgctcgagcagatgcagcggaagcacggcggcatgctcgtgaggaaccctctgagtcggaactccacacatgaaatgtactgggtgtcctgcggcaccgggaacattgtctccgctgtcaacatgaccagccgcatgttactcaaccgctttaccatggcccaccgtaaaccgacatacgagcgcgacgtggacttgggcgccggcacccgccacgtcgccgtggaacccgaaatcgccaacctggacattatcgggcagcgcattgagaacatcaagaacgagcacaagtccacgtggcactacgacgaggacaacccctacaagacctgggcgtatcacggaagctacgaggtgaagccttccgggagcgcctccagtatggtcaacggcgtggtccggctcctgacaaagccatgggacgtgatcccaatggtgacccagatagccatgaccgacacgacgccctttgggcaacagagggttttcaaggagaaggtcgacacccggacgccgcgccccaaacgggggaccgcccagattatggaggtgacggcaaagtggctctggggattcttatcgcgcaacaagaagccccggatctgcacccgagaggagttcacccgtaaagtgaggagcaacgcggccatcggggccgtgttcgtggacgagaaccagtggaacagtgccaaggaggccgtcgaggacgagcgtttctgggacctcgtgcacagggagcgtgagctgcacaagcaaggcaaatgcgctacctgcgtctacaacatgatggggaagcgcgagaaaaagctcggcgagttcgggaaggccaaggggtcgcgcgcgatctggtacatgtggctaggcgcccgcttcttagaattcgaggcgctcgggttcatgaacgaggatcactggttctctagagagaacagtctgtcgggtgtcgagggtgagggcctgcataagctcgggtacatcctgcgcgatatctccaagatcccgggcggcaacatgtatgcagacgacacagccggatgggacacccgcatcaccgaggatgacctgcaaaacgaggccaaaatcaccgatataatggagcctgagcacgcgctcctggctacgtccatcttcaagctgacctaccagaacaaggtggttcgtgtccagcggcccgccaagtccggcaccgtgatggacgtaatctctcggagagaccaaagggggtccggccaggtcggcacctacgggctcaacacgttcaccaacatggaagtacagttgatccggcaaatggaaagcgagggaatcttctcccccagcgagctggaaaactccaacctcgctgagcgggtcctggactggcttgaaaagcatggggtcgaacgcctcaagcggatggcgatcagtggcgacgattgcgttgtgaagccgaccgacgaccggttcgcgaccgcgctgacggccctgaatgacatgggtaaggtacggaaagacatcccccaatgggagccgagcaagggctggaacgactggcagcaggtccctttctgctcgcaccatttccaccaactcatcatgaaggacggccgcgagatcgttgtcccgtgtcggaatcaggacgaactggtggggcgcgccagagtgtcccaaggggccggttggagcctgcgcgagacggcctgcctcggaaaaagctatgcgcagatgtggcagctcatgtacttccaccggcgcgatctgcggctcgcggccaatgccatctgctccgccgtccccgtgaactgggtgccaaccagccgtactacatggtcaatccacgcgcatcaccaatggatgacgaccgaggacatgctgagcgtctggaaccgcgtatggatcgaggagaacccctggatggaagacaaaacgcacgtgtccagctgggaggacgtcccgtacctggggaagcgagaagatcagtggtgtggctccctcatcgggctgacagcccgtgccacgtgggccaccaatatccaggtggctatcaaccaggttaggcgcctgatcgggaacgagaactacctcgactacatgaccagcatgaagcggttcaagaacgagtccgacccagaaggtgccttatggtga

SEQ ID NO: 24737 - RNA, 9879 nt, synthetic construct
  misc_feature 1..9879: note = derived and/or modified CDS sequence (opt11) from DENV-1__KM403581__SS-prME
  source 1..9879: mol_type = other RNA
tcagttacgatgcttctcatgctgctaccaactgcgctcgccttccatctgactacccgtggcggggagcctcacatgattgtgtctaaacaagagagaggcaagagcctactgttcaagaccagtgcaggggtgaacatgtgcaccctgatcgccatggacttgggcgagctctgcgaggacacaatgacttacaaatgtccccgaattaccgaagcggagcccgacgacgtggactgttggtgcaacgcgactgacacctgggtcacctatgggacctgcagccaaacgggtgaacatcggcgagaccggcggtctgtggccttggcaccacacgtcggcctggggctcgagacgagaaccgaaacctggatgagcagcgaaggagcctggcgacagattcagcgggtcgaaacatgggccctgcgccaccctgggttcacggtaattgccctgttcctcgcgcacgctatcggtacgtctataacccagaaggggatcatattcatcctgctgatgctcgttaccccctccatggcgatgcggtgcgtcggcatcggcaatcgggatttcgtggaagggctgtccggcgcgacgtgggtggatgttgtactcgagcacgggagctgcgtaaccaccatggctaagaacaaaccaaccctcgatatcgagcttctgaaaaccgaggtgactaaccccgcagtgctccggaagctttgtattgaggctaaaatctccaacacgaccactgactctcgctgccccacccaaggcgaggcaacccttgttgaggagcaggacgctaactttgtttgccggcggaccttcgtcgatagagggtggggcaacggctgcggactgttcgggaaaggctcccttctgacttgcgcgaaattcaagtgcgttaccaagctcgaaggcaagatcgtccaatatgagaatttgaagtactccgtgattgtgaccgtgcacacgggcgatcagcaccaggtggggaacgagacgaccgagcacggcacgatcgcaaccattactccccaggctcctactagcgagatccaactgacagactatggagccctcacccttgactgcagccctcggaccggcctggatttcaacgagatggtcctcctgacgatgaaggagaaatcgtggctggtacacaagcaatggttcctcgacctgccgctgccatggacttccggggcatcgacctctcaagagacctggaaccgacaagacctcctcgtgacgtttaagaccgctcacgccaagaagcaggaggtagtggtattaggctcccaagagggcgccatgcacacggccctcaccggggccacagagatacaaacgagcggtaccactacaatattcgccgggcatctgaaatgccgcctgaaaatggataagctcacactcaagggcgtctcctacgttatgtgcactggctcattcaagttagaaaaggaggtggcagagacccaacacggcacggtcctagtacaagttaagtacgagggcacagacgctccctgcaagatacccataagtacccaagacgaaaagggggttacccaaaacggtcggctcataacggccaaccctatcgtgaccgacaaggagaagcccgtgaacatcgagactgagcctccattcggtgaaagctacatcgtcatcggagccggtgagaaggcactgaagctgtcctggtttaaaaagggatcatccatcgggaagatgttcgaggccaccgctcgcggcgcgcgccggatggccatcctcggggacactgcgtgggacttcgggtcaataggcggcgtgttcacctcggttgggaagctggtccatcaggtattcggcaccgcctacggagtgcttttcagcggagtctcctggacgatgaagatcgggatcggcatcctcctgacgtggctgggcctgaatagtcgctctacctccttatccatgacttgtatcgccgtggggatggtgaccctgtatctcggcgtaatggtgcaggccgactcggggtgtgtaataaactggaagggccgcgagctgaagtgtgggtcgggcattttcgtcacgaatgaggtgcacacctggacggaacaatacaagttccaggccgattcgccgaagaggctctcagcggccatcggcaaggcctgggaagagggggtatgcgggatccggtccgccacccgactcgagaacattatgtggaaacagatctcaaacgaactaaaccacatactgctcgaaaacgatatgaagttcacagttgtggtgggggatgccaacggtatcctgactcaggggaagaagatgatccggccccagcccatggagcacaagtactcctggaagtcctggggcaaggcgaagataataggcgcggacacacagaacaccaccttcatcatcgatggtccggacacgccggagtgccccgatgaccagcgcgcctggaacatctgggaggtcgaggactacggctttggggtttttaccaccaacatctggttgaagctacgggactcctacacacagctgtgtgatcaccggctgatgagcgcagctattaaggatagtaaggccgttcacgcggacatgggctactggatcgagtcagagaagaacgagacatggaaactcgcccgagcgtccttcatcgaggtcaagacctgtatctggccgcgcagccacaccctatggtccaacggcgtgttggaaagcgagatgatcatccccaagatatacggggggccgatctcccaacataactatcggccgggatactttacccagactgcgggcccctggcacctcgggaagctggagctagacttcaatctctgcgagggcactaccgttgtggtggacgagcactgcggcaaccgcgggccatcactgcggactacgacggtgaccggaaaaatcattcacgagtggtgctgccgctcctgtaccctgcctcccttacggttccgcggggaggacggatgttggtacgggatggagatccggccggttaaggagaaagaggagaacctggtgaggtcaatggtgtccgccggcagcggcgaggttgacagcttctccttggggttactgtgtgtgagcatcatgatcgaggaggtgatgcgttccagatggagtcgcaaaatgctgatgacgggcacattagccatcttcttcctgctgatcatggggcagttaacttggaacgacttaattcgtctgtgcataatggtcggcgcaaacgtgtccgaccgcatggggatgggcaccacctacttagccctgatggcgacattcaagatgcggccaatgttcgccgtggggctcctctttagacggcttacctcacgcgaggttctactcctaaccatcgggctgagtctcgtggccagcgtcgagctgcccaactccttagaggaactcggcgatggattagccatgggaatcatgatgctgaagctcttaacggactttcaaagccaccaactgtggaccaccctcctgtctctgacctttattaaaacgaccctcagcctggactacgcttggaagaccatggccatggtgctgagcatcgttagcctctttcccctatgcttgtccaccactagccagaaaacgacctggcttcccgtattgctaggctctttcgggtgcaaaccgctcaccatgttcctgatcaccgagaataagatttggggccggaagtcgtggcctttgaacgaggggatcatggccgtcgggatcgtatcgatcctcctgagcagcctgctcaaaaatgatgtccccctggcagggccattaatcgcaggcggaatgcttatcgcgtgctatgtgatttccgggtcctcggccgacctgtcgctggagcgcgccgccgaggtatcttgggaagaggaggccgagcatagcggcgccagccacaacatcctggtcgaggtgcaggacgacggaacgatgaagatcaaggacgaggagagggacgacactctcacaatcctgctcaaagccacactgctggccgtgagcggcgtctacccgatgtctatccctgccaccctcttcgtctggtacttctggcagaaaaagaagcagcgcagcggcgtcctgtgggacacaccctccccgcccgaggtcgagcgtgcagtgttggacgacggcatctaccgcatcctgcaacggggcctcctgggtagatcccaagtgggcgttggagtttttcaggacggcgtgttccacaccatgtggcacgtaactaggggtgcggtgctgatgtaccagggcaagcgtttagagccctcctgggcctcagtgaagaaggacctaatctcctacggagggggctggcggttccagggttcatggaatacgggtgaggaggtccaggtgatcgcggtcgagcccggcaagaaccctaagaacgtacaaaccaccccgggcactttcaaaacgccagagggagaggtcggggccatcgcactggatttcaagcccggcacctctgggagtccgatagtgaaccgcgaagggaagatagttggcctatacgggaacggagtggtaacgacctcgggcacgtacgtgagtgcgatcgcccaggccaaggccagccaggagggccccctgcccgagatagaggacgaagtcttcaagaagcggaacctgaccataatggacctccacccgggctccggcaagacccggcgctacctcccggccatagtccgggaagcaatcaagcgcaagctgagaaccctaatcctggccccgacgcgcgtcgtggcctctgagatggcggaggcgctgaagggcatgcctataagataccagacgaccgcggttaagtccgagcataccgggaaggagatcgtcgacctcatgtgtcatgccacgttcaccatgcgcctgctgagccctgtgagagtgcctaactacaacatgattatcatggacgaggcccacttcaccgacccagcctcaatagcggcccgcgggtacatctcgacccgggtcgggatgggcgaagccgccgccatcttcatgacagccaccccgcccgggtccgtggaagcctttccacagtctaacgcagttatccaggatgaggaacgcgacattcctgagcggtcctggaactccggatatgattggatcacggacttccccggcaagacggtctggttcgtgccatccatcaagagcgggaacgatatcgccaattgtcttagaaagaacggaaaacgtgtgatccaactgtcccgcaagactttcgacaccgagtatcaaaagaccaagaacaatgattgggactacgtcgtaaccacggacatcagcgaaatgggtgccaactttcgagcggatagggtaatcgacccccgacgctgtctgaaaccagtcatactgaaagacggtcccgagcgggtgatcctggccgggcctatgcccgtgaccgctgcctccgcggcgcagcgccgcggccggatcggccgcaaccaaaataaagagggggaccagtacatctatatgggccagccactgaacaacgacgaggaccacgcccactggaccgaggccaagatgctcctggataacatcaatacccccgaggggataatacccgccctattcgagcccgagcgagagaagtctgcggccatcgacggcgagtaccgtctccgcggggaggccaggaaaacctttgtggagcttatgagacggggcgacctccccgtatggctgagctataaagtcgcttccgaaggcttccaatactcggaccggcgttggtgcttcgatggtgaacggaacaaccaagtgttagaagagaacatggacgtggaaatctggaccaaggagggagagaggaagaaactgaggcctcgctggctcgacgccagaacctactcggaccccctggctctgcgggaattcaaggagttcgccgccgggcggagaagcgtgtccggcgacctgatactggagatcgggaagctgccgcagcacctaactctacgggcgcagaacgcactggacaacctagtcatgctgcacaattcagaacaaggcgggaaggcgtacaggcacgccatggaggagctgcccgatacgatcgagactctcatgctactggcactcatagccgtgctgaccggtggtgttaccttattcttcctctccgggaagggtctagggaagaccagcatcgggctgctctgcgttatggcgtcctctgtcctgttatggatggcctccgtcgagcctcactggatcgccgccagcattatactcgagttcttcctgatggttctcctgatccccgagccggacagacagcgtacgccccaggataaccagctagcctacgtggtcattggcctactctttatgattctgaccgtcgctgccaacgagatgggtctgttagagaccaccaagaaggacctgggtattggacacgttgtcgccgaaaaccaccaccacgccacaatgctggatatcgacctccatcccgcctccgcgtggaccctgtacgctgtggccaccaccattatcacgcctatgatgaggcatacgattgagaacaccaccgcaaacatcagcctgacggctatcgcgaaccaagccgccatcctcatgggcctggataagggctggccaatctccaagatggacatcggtgtgcccctgctggcactgggttgctattcgcaggtaaacccactgaccctaaccgcagcggtcctgatgctggttgcccactacgccatcatagggccaggcctccaagccaaggcgacccgggaggcacagaaacgaacagccgcagggatcatgaagaatcccaccgttgacggcatcgtggcaatagacctcgaccctgtggtctacgatgcgaaatttgagaagcagttgggtcaaattatgctactgatcttgtgtacctcccagatcctcctgatgcggacgacttgggccctgtgtgagagcataaccctcgcgacagggcctttgaccacgttgtgggaggggtcgcctgggaaattctggaacacgaccatcgccgtgagcatggccaacatcttccgcggctcatacctcgcgggcgccgggctcgccttctcattgatgaagagcctcggcgggggtcggcgcgggaccggcgcccaaggtgagaccttgggtgagaagtggaagagacagctgaatcagctaagcaagagcgagttcaacacctacaagagatccggcatcatggaggttgaccgtagcgaagccaaggaagggctgaaacgtggcgaaacaaccaagcacgcggtcagtcgcggtacggcaaagctgcgctggttcgtggagcgtaacttggtgaaaccagagggcaaggtgatcgatctcggctgcgggcgcggagggtggagctactactgcgccggcctgaagaaggtgactgaggtgaaggggtacacgaagggcgggcccgggcacgaggagcccataccgatggccacctacggctggaacattgtcaagctccactccgggcgggacgtgttctttacgccgcccgagaagtgcgacacgctcctgtgcgacatcggcgagagcagtcccaacccgaccatagaggaggggaggaccctgcgagtactcaagatggtcgaaccctggctgcgcggtaaccagttctgtatcaaaatcctgaatccctatatgcccagcgtggtggagaccctagagcagatgcaacgtaagcacggcgggatgcttgtccgtaatccgctgtcgcgcaactcaacgcacgagatgtactgggtctcctgcggcactgggaacatcgtaagcgcggttaacatgacgtctcggatgctgctgaaccgctttaccatggcccacagaaagcccacatacgagcgcgacgttgacctgggagccgggacaagacacgtggctgtcgagcccgaaatagctaacctcgacatcatcgggcaacgcatcgaaaacatcaagaacgagcataagtcgacctggcattatgacgaagataacccctacaagacatgggcgtatcacggcagttacgaggttaagccgtctggtagtgccagcagtatggtaaacggcgtcgttcggctgctaactaagccttgggacgtcattcccatggtgacgcaaatagcgatgaccgacaccacacccttcgggcagcaacgcgttttcaaagagaaggtcgacaccaggactccccgccccaagcgcggcaccgcccaaatcatggaggtaacggctaaatggctctggggcttcttgagtaggaacaagaagcctcggatctgtacccgcgaggagttcacccggaaggtgcgctcgaatgcagcgatcggggccgtctttgtggacgagaatcagtggaacagtgccaaggaggccgtggaggacgagcggttttgggacctggtccatagggagcgggagctacacaagcagggcaagtgtgcgacttgtgtgtataacatgatggggaaacgtgagaagaagctgggtgagttcgggaaggccaagggctccagagctatctggtacatgtggctgggcgctcgcttcctcgaatttgaggcactcgggttcatgaacgaagaccactggttctcccgtgagaatagcctgtccggcgttgagggggaaggtctacacaaattgggatacatcctgcgagacattagcaaaatcccaggcggaaacatgtacgccgacgacacggccggttgggacacacgcatcacggaggatgatctccagaacgaggccaagatcaccgacatcatggagcccgagcatgcattgctggcgactagcatctttaagctcacctatcaaaacaaggttgttcgcgtgcagcgccccgccaagagcggcaccgtaatggacgtgatatcccggcgcgaccagcggggcagcggccaggtcggcacctacgggttgaacacgttcaccaacatggaggtacagctgatacgccagatggagagtgagggcattttcagcccctccgaactcgagaacagcaacttggccgaacgggtgctcgactggctagaaaagcatggggtggagcgcctgaaacggatggccatctccggcgacgactgcgtcgtgaagcccactgacgaccgctttgccaccgcactaacggccctcaacgacatggggaaggtgcggaaggacattccacagtgggaacccagcaaaggttggaacgattggcagcaggtcccattctgtagccaccacttccaccagctgatcatgaaggacggacgcgaaatcgtggtgccgtgccggaatcaggacgaattggtcgggcgcgcccgggtgagccagggtgccggttggagcctccgcgagactgcatgcctgggaaagtcctacgcgcagatgtggcaactgatgtatttccaccgacgcgacctacgactggcagcaaatgcaatttgcagcgccgtgccagtcaactgggtaccaacatcaaggaccacctggagcatccatgcgcaccatcagtggatgacgaccgaggacatgctctccgtgtggaatcgcgtctggatcgaggaaaacccttggatggaggacaagactcacgtgagctcctgggaagacgtgccgtaccttgggaaaagggaggaccagtggtgtggtagcctgatcggcttaaccgcccgcgccacgtgggccaccaacatccaggtggcgattaaccaggtgcggaggctcatagggaatgagaattacctcgactacatgacctccatgaagcggttcaagaacgagagcgaccccgagggcgccctgtggtga

SEQ ID NO: 24738 - RNA, 9879 nt, synthetic construct
  misc_feature 1..9879: note = derived and/or modified CDS sequence (opt11) from DENV-1__KM403597__SS-prME
  source 1..9879: mol_type = other RNA
agcgtgacaatgctgcttatgctgctgcccacagccctcgccttccatctgaccacccgcggcggcgaaccccacatgatcgtgagcaaacaggagcggggcaagagcctcctattcaagacctccgcgggggtaaacatgtgcaccctcatcgccatggacctgggcgagttgtgcgaggatacaatgacctacaagtgccctcggatcaccgaggctgagcctgatgacgtggactgctggtgcaacgccaccgacacatgggttacctacgggacctgtagccagaccggcgagcaccggagggaccggcgcagcgtggcgctggcgccccacgttggtctggggttagagacgcggaccgaaacctggatgagctccgagggcgcttggcgccagatccagcgggtcgagacatgggcgctgcgccaccctgggtttacggtaatcgccctgttcctcgcgcacgccatcggcacctcgattacccaaaaggggatcatcttcattttactgatgctcgtaaccccctccatggctatgcggtgcgtgggcataggcaaccgcgacttcgtggaggggctgagcggcgccacctgggtggacgtcgtgctggagcacggttcttgcgtgacaacaatggctaaaaacaaaccaaccctcgatatcgagctgctgaagacggaggtcaccaaccccgcggtcctccgaaagctatgcatcgaagccaagataagcaacacaacaaccgactcgcggtgcccaacccagggcgaggccaccttagtagaggaacaggatgccaatttcgtctgccggcgcaccttcgtggaccgcgggtggggcaatgggtgcggtctcttcggcaaggggagcctgcttacgtgcgcaaagttcaaatgtgtgactaagctcgagggcaagatcgtccagtatgagaacctgaagtactctgtgatagtgaccgtgcataccggcgatcagcaccaggtagggaacgaaacgaccgagcatggtaccattgcgaccatcacaccccaagcgcccactagcgagatccagctgaccgactacggggccttgacgctggactgcagcccgcggaccgggctggacttcaacgagatggtcctcttgacgatgaaagagaagtcctggctggtacataagcagtggtttctggacctgccactgccctggacctcaggtgccagcaccagccaagaaacctggaatcggcaagacctccttgtcacgtttaagactgcccacgcgaagaaacaggaggtcgtggtgctggggtcccaggagggtgcaatgcacacagcactgaccggagccacggagatccagaccagcggcacgaccacaatcttcgccgggcacttgaagtgtagactgaaaatggacaaattaaccctaaagggcgtcagctacgtgatgtgcaccgggagcttcaagttagaaaaggaagtggcggagacccagcacgggaccgttctggtacaggttaagtacgagggcacagacgccccctgcaagatccccatctccactcaggacgagaagggtgtcacccagaacggccggctcatcaccgctaacccgatcgtgaccgacaaagagaagccagtaaacatcgaaacagagccacccttcggggaatcgtatatcgtcataggcgccggagagaaggccctgaagctgagctggttcaaaaaggggtcatccatcggcaagatgttcgaagccaccgcccgcggcgctcgacgtatggccatcctgggcgacacggcatgggacttcgggagcatcggcggcgtgttcacttcggttgggaagctggtccaccaggtgttcggcaccgcctacggggtgctgttcagcggcgtctcctggaccatgaagatcgggatcgggatcttgctgacgtggctgggacttaatagccgctccaccagcctgagcatgacctgcatagcggtaggcatggttaccctgtacctcggcgttatggtgcaagccgatagcggctgcgtgatcaactggaagggccgggagttaaagtgcgggtcaggcatattcgttacgaacgaggtccacacttggaccgagcagtacaagttccaagccgatagcccgaagcgcctgtcagcggccatcggcaaggcctgggaggaaggtgtgtgtggcatccggtcggcgacccgcctcgaaaacatcatgtggaagcagatctctaacgagctcaatcacatcctgctggaaaacgacatgaagttcaccgtcgtggtgggggacgcaaatgggatcctgacgcaaggtaagaagatgatccgcccacagcccatggagcacaagtactcttggaaaagctggggcaaggcgaagataataggggccgacacccagaacactacattcatcatcgacggtccggacacgccggagtgcccagacgaccagcgagcctggaatatctgggaggtggaggactacggcttcggcgtgtttaccactaacatctggctgaagctgcgagactcctacacacagatgtgtgaccaccgcctaatgagcgccgcgatcaaggatagtaaggccgtccacgccgacatgggctactggatcgagagtgagaagaatgagacgtggaagttagcccgggcgtccttcatcgaggtcaaaacctgcatctggccccgctctcacaccctctggtccaacggcgttctggagagcgagatgatcatccccaagatctacgggggaccgatctcccagcacaactaccggcccgggtatttcacgcaaacagcgggcccctggcacctcgggaaactcgagctcgatttcaatctgtgcgagggcactaccgtggtggtcgacgagcactgcggaaaccgcggcccgagcttgcggaccacgaccgttaccggcaagatcatccacgagtggtgctgcagatcgtgtacactgccgcccctgcggttccgcggggaggacggctgctggtacgggatggagatccggcccgtcaaggagaaagaggagaacctcgttaggagcatggtgtccgccggctcaggcgaggtcgatagcttctccctcgggctgctctgcgtgtcgattatgattgaggaggtgatgcggtctcgatggagccgcaaaatgctgatgacggggaccctggcgatcttcttccttttaatcatggggcagctgacctggaacgatctcatccggttgtgcataatggtcggcgctaacgtgtccgaccgcatgggaatgggcaccacgtatctggccttgatggcgacattcaaaatgcggccgatgtttgccgtggggctgctgttccgccgactcaccagccgcgaggtgctgctactcacaatagggctttccctggtagccagcgtggaactccccaactccctggaggagctgggcgatgggctagccatgggcattatgatgctgaagctgctcacggacttccagtcccaccagctgtggaccacattactatctctgacctttattaaaacgactcttagcctcgattacgcctggaagactatggctatggtgctgtccatcgtgagtctgttccccctctgcctgagcacgacgagccaaaagaccacctggttgcccgtgctcttaggctccttcgggtgtaagccgttgacaatgtttctgataaccgagaacaaaatatggggcagaaagagctggccattgaacgaggggatcatggccgtgggcattgtatccatcttgctcagtagcctgctgaagaatgacgtgccactagccgggcccctgatcgccggcgggatgctaatagcgtgctatgtcataagcggtagcagtgccgacctgagcttagagcgcgccgcggaggtttcatgggaggaggaggccgagcattcgggcgccagtcacaatatcctggtagaggtccaggatgacggcacgatgaagatcaaggacgaagagagagacgacaccctcaccatcttgctgaaggccaccctcctggccgtgagcggcgtttatccaatgtccatcccagctacgctattcgtatggtatttctggcagaagaagaagcaacgctcaggggttctgtgggacaccccgagtcccccggaggtcgagagagctgtcctggacgatggcatttaccgcatcctgcagcggggactgctggggcgatctcaggtgggtgtcggcgtgttccaggacggtgtgttccacaccatgtggcacgtcacccgaggggctgtgttaatgtaccagggcaagcgcctagagccgagttgggcgagcgtgaagaaggatctcatatcgtacggcggcggctggcggttccagggtagctggaacacgggcgaggaagtccaggtgattgccgtggagcccggtaagaatccgaagaacgtccagaccacccccgggacgttcaagacgcccgaaggcgaggtgggggcaatcgccctggactttaagcccggcacctctggaagcccgatcgtcaaccgcgagggcaagatcgtcggcctttatggtaatggcgttgttaccacctcggggacgtacgtcagtgcgatagcccaggccaaggcatcacaggagggcccgctgcctgagatagaggatgaagtgtttaagaagcgtaaccttaccataatggacctgcatcctggatccggcaagactcgccgctacctcccggccatcgtgcgagaggcgatcaagcgcaagctgcggaccctgatccttgccccgacgcgcgtagttgcctctgagatggcagaggcgctgaaaggcatgcccatccggtaccagaccacagctgtgaagtccgagcacacggggaaggaaatcgtggacctgatctgtcatgcgaccttcaccatgcgcctgctgtccccagtgcgggtaccgaactacaacatgatcatcatggacgaggctcactttaccgatcccgccagtatcgccgcccgcggctacataagtacccgagtcgggatgggcgaggccgccgccatattcatgacagcaacgccgccagggtccgtggaagccttcccgcagtctaacgcggtgattcaagatgaggaacgcgatatccccgagaggagttggaactctggttacgactggatcaccgacttcccgggaaagaccgtctggttcgtcccatccatcaagagcggcaacgacatagcaaactgcctgcggaagaacggcaagcgggtaatccagctctcccgcaagacgttcgacactgagtaccagaagaccaaaaataacgattgggactacgtcgtcacaacggacattagtgagatgggggctaacttccgggcggaccgcgtgatcgacccacgtcgctgcctgaaacccgttatcctgaaagacgggcctgagcgtgttatcctcgccgggcctatgcctgtcacggccgcctccgcggcacagcgtcgcggccggattggccgcaaccagaacaaggaaggtgaccagtacatctacatgggccagcctcttaataacgacgaggaccacgcccactggaccgaggccaaaatgctgctcgacaacatcaacacccctgagggtatcatccccgccctgtttgagccagagagggagaagtccgcggccatcgacggcgaatatagactgagaggggaagccaggaagacgttcgtggagctcatgcgacgcggtgacctgcccgtgtggttatcctacaaagtagccagcgagggcttccagtactcggatcggcgctggtgcttcgacggggaacgtaataaccaggtgctcgaggagaatatggacgtggagatttggaccaaggagggcgagcgcaaaaagttacggccccgctggctggacgccaggacatacagcgaccccttagcgctgcgcgagttcaaggagttcgctgcagggcggcgttcagtctccggggacctaatcctcgaaatcggcaagctgccgcaacacctgaccctccgggcgcaaaacgccctggataaccttgtaatgctccataacagcgagcagggcggaaaggcgtatagacacgccatggaggaactccccgataccatcgagacgctgatgctcctcgccctgattgccgtcctcaccggaggggtaaccctgttcttcctgtccgggaagggcctcggcaagaccagcatcggactcctgtgcgtgatggcgtccagcgtgctcttatggatggcgtccgttgagccccattggattgctgcgagcatcatcttggagttcttcctcatggtgctgctaattccagagccggaccggcagaggactccacaggacaaccagctcgcctacgtagtaatcggtctgctgtttatgatattaaccgtggcggctaatgaaatgggactgctggaaaccaccaaaaaggacctaggcatcgggcacgtggtggctgagaaccatcaccacgccactatgctggatattgacttgcaccccgcctccgcgtggaccctttacgccgtggcgacaaccatcatcacgccgatgatgcgacacactattgagaacaccaccgccaacatttcattgacggccatcgcgaaccaggccgccatactgatggggttagacaagggctggcccataagtaagatggacattggggtgcccctgctggcattgggctgctatagccaggtcaaccccctcactctgaccgcagccgtgttaatgcttgtcgcccactacgccatcattggcccaggcctgcaggccaaagcgacccgggaggcacaaaagcgcacggccgccggcataatgaagaatcccaccgtcgacggcattgtggcgatcgacttggaccccgttgtctacgacgccaagttcgaaaagcaattggggcaaattatgcttctcatcctatgcacctcccaaatactgctcatgaggaccacgtgggctctctgtgagagcataacgctggcgaccgggcctctcacaactctctgggagggttccccggggaagttctggaacaccactatcgccgtgagcatggccaatatctttcgcggctcctacctggcgggggccggcctggccttcagcctgatgaagtccctgggcgggggaaggagggggaccggcgctcagggcgaaactctcggggagaagtggaaacgtcagctgaaccagctgagtaagtcagagttcaacacctacaagcgcagtggcataatggaggtagatcgtagcgaggcaaaagaggggctgaagcgcggcgagacaaccaagcatgcggtctcccgggggactgccaaacttcgctggttcgtggagcggaacctggtgaagcccgagggaaaggtcattgacctgggctgtgggcgtggagggtggagctattactgcgcggggctgaagaaggtgaccgaggtgaagggatacaccaagggcggccccgggcacgaggagcccatcccaatggcgacctacggctggaatattgtcaagctgcattccggacgggatgtctttttcacgccacccgagaagtgtgacacgctactctgcgacataggcgagtcttcccccaatccgacaattgaggaggggcgtaccttgcgggtgctgaaaatggtggaaccctggctccgtggcaatcaattctgcattaagattcttaacccctacatgccgagtgtcgtagaaaccctggaacagatgcagcgaaagcacggcggtatgctcgtccgcaacccgttatcccgcaacagcacacacgagatgtactgggtatcctgcggaaccggtaatatcgtgagcgcggtcaacatgacctccaggatgctgttaaaccgcttcaccatggcccaccggaagcccacgtacgagcgcgacgtcgatctgggcgccgggaccaggcacgtggccgttgagcccgagatcgccaatctggacatcatcgggcaacgcatcgagaacatcaagaacgaacacaaaagtacctggcactacgacgaggacaacccttacaaaacgtgggcgtaccacggcagctacgaggtgaaaccgtcaggatccgccagctcaatggtgaatggcgtagtacggctcctgaccaagccctgggacgtcatacccatggtgacccagatcgccatgaccgacaccacaccgttcgggcagcagcgcgtattcaaagaaaaagtagacacccggaccccgaggcccaagagggggacggcccagatcatggaagtcacggccaaatggctgtggggcttcctctctcgcaacaagaagccgcgtatctgcacccgcgaggagttcaccaggaaggttaggtctaacgcggccatcggcgccgtattcgtagatgagaaccagtggaactccgccaaggaggcagtcgaagacgagcggttctgggatcttgttcatcgcgagcgggagttacacaagcaggggaagtgcgctacgtgtgtgtacaacatgatggggaaacgtgaaaagaaattgggtgagttcggtaaggccaagggatcccgggccatatggtacatgtggctgggcgccaggttcctggagttcgaagccctcggtttcatgaatgaggatcactggttctcccgagagaacagcctgtccggggtggagggggagggactgcataagctcgggtatattctcagagacataagcaagatcccgggaggcaacatgtacgccgatgacacagccggctgggacacccgcatcactgaagacgatcttcagaacgaagccaagatcacagatatcatggaaccggagcacgcgctcttagcgacgtccatcttcaagctgacctaccaaaacaaggttgttcgggttcagcgtccagccaagtcgggcaccgtcatggacgtaatctcccggagggatcagcggggcagcggccaggtgggcacctacgggctcaatactttcaccaacatggaggtccaacttatccgccagatggagagtgagggcatctttagcccctccgagctggaaaacagcaacctcgccgagcgggtgctggactggttagagaagcatggggtggaacgcctcaagcggatggccatatctggtgacgactgcgtcgtgaagccgaccgacgaccgctttgccactgcactgacggccttaaacgatatggggaaggtgcggaaggacatcccccagtgggagccctcgaagggctggaacgactggcagcaggtccccttctgctcccatcacttccaccagttaataatgaaagacggacgcgagattgtagtgccttgccggaaccaggacgagctggtggggcgcgcgcgagtgagccagggcgccgggtggagcttgcgcgagaccgcctgcctcggcaaatcctatgcgcagatgtggcagttgatgtacttccaccggcgcgacctgcgactggccgcaaacgccatctgctccgccgtgcccgtcaactgggtacccacctcccggaccacctggagcattcacgcgcaccaccagtggatgacgacggaggacatgctttccgtgtggaaccgtgtatggattgaggagaatccctggatggaggataagacccacgtgagttcttgggaggatgtgccgtacttaggtaagcgggaggaccagtggtgcggcagcttaatcggcctgaccgcacgtgccacgtgggccaccaacattcaggtcgcgatcaaccaggtgcgccgcctgatagggaacgagaattacctcgactatatgacctccatgaagcggttcaagaacgaatcggaccccgagggcgccctgtggtga

SEQ ID NO: 24739 - RNA, 9879 nt, synthetic construct
  misc_feature 1..9879: note = derived and/or modified CDS sequence (opt11) from DENV-1__KM403610__SS-prME
  source 1..9879: mol_type = other RNA
agcgtgaccatgctgctcatgctgctgcccacggctctagccttccacctgactacccgcggaggggagcctcacatgatcgtgtcaaagcaggagcggggaaagtctctcctgttcaaaacctccgcgggggtgaatatgtgcacccttatagctatggacctgggcgagctctgtgaggacacgatgacctacaagtgcccccgcatcaccgaagccgagcccgacgacgtcgactgctggtgcaacgccaccgacacctgggtaacttatgggacctgctcgcagactggcgagcaccggcgcgataagagatccgtggcgctggcgccccatgtgggcctgggcctcgaaactcgtaccgagacctggatgagctccgagggcgcctggcgtcagattcagaaggtcgagacctgggcgctacgccacccgggattcacggtgatcgccctgttcctcgcgcacgctataggcaccagcatcacccagaagggtatcatttttatcctgctgatgctcgtgaccccctccatggccatgagatgcgtcggaataggtaaccgcgactttgtggaggggttgagcggcgcaacttgggtggacgtggtcttggagcacgggtcctgcgtgaccactatggctaagaataagcccaccctcgatatagagctcctgaaaacggaggtgaccaaccccgcggtactccggaaactgtgcatcgaggccaagatcagcaacaccaccactgactcccgttgccccacccagggcgaggccaccttagtggaggagcaggacgccaacttcgtctgccggcgcaccttcgtggaccgcggctgggggaatggctgcggcctcttcggcaaggggagcctgctgacgtgcgccaaattcaaatgcgtgaccaagctcgagggcaaaatcgtccaatacgagaacctgaagtactccgtgatcgtcaccatccacaccggggaccaacaccaggtcgggaacgaaactaccgagcacggcaccatcgcgaccatcacgccgcaagcccccacaagtgagatccagctgaccgactatggggccctcaccctggactgcagcccccgcaccggtctggactttaacgaaatggtacttctgacgatgaaggaaaagagctggctggtccacaagcagtggttcctcgacctcccgttgccctggacctccggagccagcaccagccaggagacctggaatcggcaggacctcttggtgacttttaagaccgcccacgcgaaaaagcaggaggttgttgtgctgggctcccaggagggcgccatgcacacggccctcaccggagccaccgagatccagaccagcggcaccacgacaatcttcgcagggcacctgaagtgccgcctgaaaatggacaagctcaccctgaagggcgtgtcctatgtgatgtgcacagggagctttaagctggagaaagaagtggcagagacccagcacggaacagtcctggtccaagtgaagtacgagggcaccgacgctccgtgcaagatccccatctccacccaggacgagaagggcgtgactcagaacggacggctcatcacggcgaacccgatcgtaacggacaaggaaaagccggtgaatatcgagaccgagccgccattcggggagagctacatcgtgatcggcgccggcgagaaagcgctgaaactgtcctggttcaaaaaggggagctccatcggcaagatgttcgaggccaccgcccgcggggcccggcgtatggccatcttaggcgatacggcttgggacttcgggagcatcggcggagtcttcacctccgtgggcaagctggtgcaccaggtcttcggcaccgcctacggtgtactgttcagcggcgtctcctggaccatgaagatcgggatcggcattctcctgacgtggctgggcttgaacagccgctccaccagcctgtccatgacctgtatcgccgtcgggatggtgaccctgtatctaggcgtgatggtccaggccgacagcgggtgcgtgatcaactggaagggacgtgaactcaaatgcggttccggaattttcgtaaccaacgaggtccacacctggaccgagcagtacaagttccaggccgacagcccgaagcgcctgagcgcggccatcggcaaggcatgggaggagggggtgtgcggcatccggagtgccacacgcctcgagaacataatgtggaaacagatctcgtccgagctgaatcacatcctgttggagaacgacatgaagttcaccgtggtcgtcggggacgccaacgggatactgacacagggcaaaaagatgatccggccacagcccatggagcacaagtacagctggaagtcctggggaaaggcgaagatcataggcgccgatacccaaaacaccacctttatcatagacggacccgatacgccggagtgccccgacgaccagcgcgcatggaacatctgggaggtggaagactacggcttcggggtttttacaaccaacatctggctgaagctccgggactcttacacccagatgtgcgaccatcgcctgatgtctgctgcgatcaaggacagcaaggccgttcacgccgacatgggctattggattgagtccgagaagaacgagacgtggaagctggccagggcctccttcatagaggtaaagacctgcatttggccacgctcccacaccctctggagcaacggcgttctggagagcgagatgatcatacccaagatctacgggggcccgataagtcagcacaactaccgacccggctacttcacccagacggcgggcccatggcacctgggcaagctcgagctggacttcaacctgtgcgagggcaccacagtggtggtcgacgagcactgcggcaaccgagggccgtcccttcggaccacaaccgtgacaggcaagatcatccacgagtggtgctgccgaagctgcacccttccgccgctgcggttccgcggggaggacggctgctggtacgggatggagatccggcccgtgaaggagaaggaagagaacctcgtccgctccatggtgagtgccggcagcggcgaggtggacagtttctccctggggcttttatgcgtatccatcatgatcgaggaggtcatgagaagccgatggtccaagaagatgctgatgacgggcacccttgccgtgttcttcctcctgatcatggggcagctgacctggaacgacttaatacgtctgtgcatcatggtcggcgctaacgtaagcgatcggatggggatgggcacgacgtacctcgccctcatggccaccttcaagatgaggccgatgttcgccgtggggcttttattccgacgacttacctcccgggaggtcctactgctcaccattggcctcagcctggtggccagtgtcgagctcccgaactcattagaagagttaggcgacggactcgcgatgggcattatgatgttgaagctgctcaccgactttcagtcgcaccagttatggaccaccttgctctccctgaccttcatcaagacgacactgagcctcgactacgcctggaaaacgatggctatggtgctgtctatcgtgagccttttccccctctgccttagcaccacgtcccagaagactacctggctgcccgttttgttagggtccttcgggtgtaagccgctgaccatgttcctcataactgagaacaagatctggggccgcaagtcctggcccctgaacgaggggatcatggccgtgggcatcgtaagcatcctgttgagctccctgttaaagaacgacgtaccattggccgggcccctgatcgctggcggtatgctgatcgcctgttacgtaatcagcgggtcaagcgccgacctctccctggagcgggccgccgaggtcagctgggaggaggaggccgagcactctggagcgagccacaacatcctagtggaagtgcaggacgacggtacgatgaagatcaaagacgaggagcgcgacgataccctcaccatcctgctgaaagctaccttactggccgtgtccggcgtctacccgatgagcatccccgccacactgttcgtgtggtacttttggcagaagaagaagcagcggtccggggtgctctgggacacccccagcccgcccgaagttgagcgcgccgttctggatgacggcatctaccggatcctgcagagagggctgctcggtcgatcccaggtgggcgtcggggtgttccaggacggcgtgttccacaccatgtggcatgtcacccgcggtgcggtgcttatgtaccaggggaagcgactggagcccagctgggcctccgtgaagaaggaccttattagctacggtgggggctggagattccaggggtcctggaacacgggcgaggaagtacaggtgatcgccgtcgaacccgggaagaaccccaagaacgtccagaccacccctggcaccttcaagacgcccgagggggaggtgggggccatcgccctggacttcaagccagggaccagcgggagccccatagttaatcgtgagggcaagattgtcggtctatatgggaatggcgtggtgaccaccagcgggacttacgtcagcgcgatcgcgcaggccaaagcatcccaagagggcccgctccccgaaatcgaagacgaggtgtttaagaagagaaatctgaccatcatggacctgcaccccgggagcggcaagacacgccgctacctcccggccattgtgcgggaagccatcaagcgcaaactgcggaccctgatactcgcccccacgcgtgttgttgcctccgagatggccgaggcgctaaagggcatgcccatacgctaccagaccacggccgtcaagtccgagcacacgggcaaggaaatcgtagacctgatgtgccacgccacattcaccatgcggctcctgtccccggtgcgcgtgccgaactacaacatgattataatggacgaggcgcacttcaccgatccagcttcaatcgcggcccggggctacatctccaccagggtcggcatgggtgaggccgccgccattttcatgacggctacgccgcccgggagcgtggaggccttcccgcagagtaacgccgtgatccaggacgaggaacgagatatcccggagcgcagctggaactccggctatgactggatcaccgatttccctggcaagaccgtctggttcgtgcccagcataaagtcagggaacgacatcgccaactgcctgcggaagaatggtaagcgcgtgatccagctctctcggaagacgttcgacaccgagtaccagaagacgaagaacaacgactgggattacgttgtgaccacggatatcagcgagatgggtgccaactttcgcgctgaccgggtgatcgacccacgccggtgcctaaagcccgtcatcctgaaagacggccccgagcgcgtgatcctcgccgggcctatgccggtcaccgccgcaagcgcggcccagcggcgcgggcggatcggccgcaaccaaaacaaagagggagaccagtacatctacatggggcaacccctgaacaacgacgaggaccatgcgcactggaccgaggccaaaatgctgctggacaacatcaacacccccgagggaatcatacccgccctattcgagccggagcgtgagaagtccgcggccatcgacggtgagtacaggcttcgcggagaagcccggaagacttttgtggaactcatgaggcggggcgacctgcctgtctggctaagctacaaggtcgcctccgagggcttccagtacagcgaccgccggtggtgctttgacggggaacgcaacaaccaggtgctcgaggagaacatggacgtggagatctggaccaaagagggcgagcggaagaagctgcggccacggtggctggacgcccgcacctactcagatccgctcgcgcttcgggagttcaaggagttcgccgcagggcgccggagtgtctctggcgacctgatcctcgagatcggaaagctgccgcaacacctgaccctcagggcccagaacgccctggataacctggtgatgctccacaactccgagcagggaggtaaggcgtatcggcacgccatggaggagctgcctgacaccatcgagacgctcatgctcctggccctgatcgccgttctcaccggaggggtcacgctgtttttcctgagcgggaaggggttgggcaagacatcgattgggctactgtgcgtgatggcgtcttccgtgctcctgtggatggccagcgtcgagcctcattggatcgctgcctccatcatcctggagttcttcctcatggtgctgctgatcccggaaccggaccgccagcgcacgccccaggacaaccagctcgcctatgtggttataggcttactgttcatgattctcaccgtggcggccaacgagatggggctgctggaaaccacaaagaaggacctcggaatcggccacgtagtcgcagagaaccaccaccatgccacgatgctggacatcgacctgcaccccgccagcgcgtggacgctctatgccgttgctaccaccattatcacgccgatgatgcgccacaccatagagaatactactgccaacatctcattgaccgccatcgcgaaccaagccgccatcttaatgggcctcgacaaggggtggcccatctcgaaaatggacataggggtacccctactggccctcggctgctactcacaggtcaatccactgacccttaccgccgcggtgctcatgctggtggcccactacgcgatcatcgggccgggcctgcaagccaaggcgacgcgggaggcccagaagcgcacggccgccggtatcatgaaaaaccccacggtcgatgggatcgtggccatcgatctcgaccccgtagtctacgacgcgaagttcgaaaagcaactgggccagatcatgctgctcatcctgtgcactagccagatcctcctcatgcgcaccacatgggccctgtgtgagtccatcacgcttgccaccgggcccctcaccacactgtgggagggcagcccgggtaagttctggaacacgactatcgccgtgtccatggccaacatcttccggggtagctacttggcgggcgccgggctcgctttctccctgatgaagtccctgggcgggggccgccgaggtacaggcgcccagggcgagacgctcggcgagaagtggaagcgccagctgaaccagctgagcaaatccgagttcaacacgtacaagaggagcggcatcatggaggtggaccggtccgaagccaaggagggcttaaagcggggcgagaccaccaagcacgcggtcagccgcgggacggccaagctgcggtggtttgtggagcggaacctggtgaagcccgaaggcaaggtcatcgacctaggttgcggacggggcggttggtcctactactgcgcgggcctcaagaaggtgaccgaagtgaaggggtataccaagggcggcccagggcacgaggagcccataccgatggcaacctatggctggaacattgtcaagctgcacagcggccgcgacgttttcttcacgccgccggagaagtgcgacacactgctctgtgacattggcgagtccagccccaacccgaccatagaggaggggcgaaccctgcgcgttctcaagatggttgagccctggctccggggcaaccagttctgtatcaagatcctgaacccctacatgccctccgtcgtagagacactggaacagatgcagcgaaagcacggcggcatgttggttcggaacccgctaagccgcaacagtacgcatgagatgtattgggtcagctgcggtacagggaacattgtgtccgccgtcaatatgacctcgcggatgctgctcaaccgcttcaccatggctcaccgcaagcccacgtacgagcgggacgtggacctgggtgccggcaccagacatgtggcggtcgaacccgagatcgccaatctggacatcatcgggcagcggatcgagaacatcaagaatgagcacaagtccacctggcactacgacgaggacaacccctacaaaacctgggcgtatcacggctcttacgaggtgaagccgtccgggtccgcctccagtatggtgaacggcgtcgtgcgcctcctcacgaagccctgggacgtcatccccatggtcacgcaaatcgcgatgacagacaccacgcccttcgggcagcagcgggtgttcaaagagaaggtcgatacccgcaccccacggcccaagcgcggcaccgcccagatcatggaggtgacggctaagtggctgtggggcttcctctcccggaacaagaagccccgcatctgcacccgggaggagtttaccagaaaggtgcggtccaacgcggccataggggcagtcttcgtggacgagaaccagtggaacagcgccaaggaggccgtagaggacgagcgcttctgggacctggtccaccgtgagcgtgagctgcataaacagggcaagtgcgcgacctgcgtgtataacatgatggggaagcgggagaagaagctcggcgagttcgggaaggctaagggctcccgcgccatatggtacatgtggctgggcgcccggttcctggagttcgaggcgctcgggttcatgaacgaggaccactggttcagccgcgagaactccctgagcggtgtggagggggagggcctgcacaagctagggtacatcctaagagacatctccaagatcccgggcggcaacatgtatgccgatgacacggccggttgggacacccgcatcaccgaggatgacctgcagaacgaggccaaaataaccgacatcatggagcccgagcacgccctgctggcgacctccatcttcaagctgacataccagaacaaagtcgtgcgcgtgcagcggcctgccaagtccggcaccgtaatggatgtgatcagcagacgcgaccaacgcgggtccggccaggtgggcacctacgggctcaacacgttcaccaacatggaagtccaactgatacggcagatggaaagcgagggcatcttcctgccatccgagctcgagaactcaaaccttgccgagcgcgtgttggattggctcgagaagcacggggtggagcggcttaagcgcatggccatctccggcgacgactgcgtggtgaagccgaccgatgaccggtttgccaccgcgctcacggccctcaacgacatggggaaggtacggaaggacatcccccagtgggagccctccaagggctggaacgactggcagcaggtcccgttctgcagccaccacttccaccaactgatcatgaaggacggtcgggaaatcgtggtgccgtgccgcaatcaggacgagctagtcgggcgggcccgcgtgagccagggcgccgggtggtctctccgggagaccgcctgcctgggcaagtcttacgcgcaaatgtggcagctgatgtatttccatcgccgggacctcagactggccgccaacgccatctgcagcgccgtgcccgtaaattgggttcctacctcccggaccacctggagcatccacgcgcaccaccagtggatgacgaccgaggacatgctgtccgtatggaatcgcgtctggatcgaggagaacccctggatggaggacaagacccatgtgagctcatgggaagacgtgccgtatctcgggaagcgcgaagaccagtggtgcggcagcttgataggcctgaccgcccgggcaacgtgggccaccaacatccaggtcgcgatcaaccaggtgcgtcgactcatcgggaacgagaactacctagactacatgacttccatgaagcgcttcaagaacgagagcgaccccgagggcgccttatggtga

SEQ ID NO: 24740 - RNA, 9879 nt, synthetic construct
  misc_feature 1..9879: note = derived and/or modified CDS sequence (opt11) from DENV-1__KM403596__SS-prME
  source 1..9879: mol_type = other RNA
agcgtgaccatgttgctcatgctgctaccgaccgccctcgcatttcacctgaccacccgcggcggggagccacacatgatcgtgagcaagcaggagcggggaaagagcctcctgttcaagacaagcgcgggggtgaacatgtgcacgcttatagccatggacctgggcgagctctgcgaggacaccatgacatacaagtgcccccggataaccgaggccgagcccgacgatgtcgactgctggtgcaatgccaccgatacctgggtgacctacgggacctgcagccaaactggcgagcaccggagggatcggagatcggtggccctggctccgcacgtaggtctgggccttgagacgcggaccgagacctggatgagctcagagggcgcgtggagacagatccagcgggtcgagacctgggccctgcgccaccccgggttcaccgtgatcgcattgttcctcgcgcatgcaatcggcacctctatcacccagaagggaatcatcttcatcctactgatgctcgtgaccccttccatggcgatgcggtgcgtcggcatcggcaacagagacttcgttgaaggactgagcggcgcgacgtgggtggacgtcgtgctggagcacggttcctgcgtgaccaccatggccaagaacaaaccaaccctcgacatcgagctgctgaagacggaggtcaccaacccagcggtgctccggaagctttgcatcgaggccaagatcagcaacaccaccactgattcgcgctgccccacgcaaggcgaggccaccctcgtggaagagcaagacgccaacttcgtctgtcggcgcacattcgtagaccggggctgggggaacggttgtggtctcttcggcaagggaagcctactcacgtgcgctaagttcaagtgcgtcaccaagttagagggcaagattgtccagtacgagaacctgaagtatagcgtgatcgttacggtccacaccggcgaccagcatcaggtggggaacgaaacgaccgagcacggtaccatcgccaccatcacgccccaggcccccacgagcgagattcagctgaccgactacggggccctctcccttgattgcagcccccgcaccggccttgacttcaacgagatggtcctcttaaccatgaaagagaagtcctggctggttcacaagcagtggttcctggacttaccgctgccctggacaagcggggccagcacctcccaggagacctggaaccggcaagacttgttagtgaccttcaagacggcccatgcgaagaagcaggaagtcgtggtgttgggctctcaagagggtgccatgcacaccgccctcaccggggccacggaaatacagacttccggcaccaccaccatcttcgccgggcacctgaagtgccgcctcaagatggacaaactcacgcttaagggcgttagctatgtgatgtgcaccggcagcttcaagctggaaaaggaagtagcggagacccagcatggcactgttttggtccaagttaagtacgaaggaacagatgccccctgtaagattccgatcagcacacaagacgaaaagggggtcacccagaatggccggctcatcaccgccaacccgatcgtaactgataaggaaaagcccgtaaacatcgagatcgagccgcccttcggggaatcctatatcgtcatcggggccggcgagaaggccctgaaattaagctggttcaagaaggggtcctccattggtaagatgttcgaagccaccgccaggggggcccgccggatggccatcctcggagacaccgcgtgggacttcggctccatcggcggcgtgttcaccagcgtgggtaagcttgtccaccaggttttcggcaccgcttatggggtgctgttctccggcgtcagctggaccatgaagatcgggatcggaatcctcctgacctggctgggcctcaattcacgcagcacctccctatccatgacgtgtattgctgtggggatggttaccctgtacctcggcgtcatggtgcaggcggactccgggtgcgtgataaactggaaaggccgagagctgaaatgtgggagcggtatcttcgtcaccaacgaggtgcatacctggactgagcagtataagttccaggctgacagcccaaagcgtctgtcagcggccatcggcaaggcctgggaagagggggtatgcggcatccggtcggccacccgcctggagaatataatgtggaagcagatctccaacgagctgaaccacatactgctcgagaatgatatgaagtttaccgtcgttgtgggggacgccaacggcatcctcacccaggggaagaaaatgatccggccccagcccatggagcataagtactcttggaaatcctggggcaaggcgaagattataggcgccgacactcagaacacaaccttcatcatagacgggcccgacacgccggagtgcccggatgaccaaagagcctggaatatttgggaggtcgaggactacggcttcggggtgttcactacgaatatctggctgaagttgcgggactcgtacacccagatgtgcgaccaccgcctgatgtcggccgccatcaaggattcaaaggctgtgcacgccgacatggggtattggatcgaatcggagaaaaatgagacctggaagttagcccgggccagcttcatcgaggtcaagacctgcatctggccacgctcccatacgctctggagtaacggcgtgttggagtccgagatgattatcccgaagatttacgggggcccgatcagccagcataactatcgacccggttatttcacacaaacagcgggcccctggcatctagggaagctggagctggacttcaacctgtgcgagggtacgacggtggtcgtggatgagcactgcggcaaccgcgggccttcgctccggactacgacggtcacgggcaaaattatccacgagtggtgctgccgcagctgcaccctgccgccgctgcggttcagaggggaggacgggtgctggtacgggatggagatccggcctgtcaaggagaaggaggaaaacctcgtgcgcagtatggtaagcgccggcagcggtgaggtcgactccttcagcctggggttgctctgcgtgtccatcatgatcgaggaggtcatgcggagccggtggtcccgcaaaatgctgatgaccggcactctggccatcttcttcctcctgataatgggccagctcacctggaacgacctcatccggctgtgcatcatggtcggcgccaacgtgagcgaccgcatggggatgggcacaacctacctggcactcatggcgacgttcaagatgcggccgatgttcgccgtgggactgctgttccgcaggctcacgtcccgggaagtcttgctcctcaccatagggctgagcctggtggcctctgttgagttacccaacagtctggaggagctcggcgacgggctagccatgggaatcatgatgttgaagctgctcacagacttccagtcccaccagctgtggaccacactgctcagtctgaccttcataaagaccaccctgtccctcgactatgcctggaagacgatggcgatggtattgagcatcgtgtctctgttcccactctgtttgagcaccacgtcacagaagaccacgtggttacctgtcctcctgggcagcttcgggtgtaagcccctaaccatgttcctcataaccgagaacaagatctggggccgaaagagctggccactgaacgaggggatcatggccgtgggcatcgtgagcatcctgctttctagcctgttaaagaacgatgtccccctcgcagggcccctgatcgccggaggcatgctgatcgcgtgctacgtgatctcagggtccagcgccgacctctccttggagcgggccgcagaggtgagctgggaggaggaggctgaacactccggtgcgagccacaacatactggtcgaggtgcaggacgacgggaccatgaagataaaggacgaggagcgggatgataccctcacgatcctactgaaagccaccttgctcgccgtatccggagtctacccgatgagcattccagccacgctgttcgtgtggtacttctggcagaagaaaaagcagcgttccggtgtgctctgggatacgccctctccgccggaggtagagcgggccgtgcttgatgacggtatttaccggatcctacagcgggggctgctcgggcgctcgcaggttggcgtcggagtgttccaggacggcgtgttccataccatgtggcatgtcacccgcggggcggtgttgatgtaccaaggtaagcgcctggagcccagctgggcctccgtgaagaaggacctgatcagttacggagggggttggcggttccagggtagctggaacaccggcgaggaggtgcaggtgatcgccgtggagccagggaagaaccccaaaaacgtacaaaccactccaggcacattcaaaacgcccgagggcgaggtgggggcaatcgccctggacttcaagcccgggaccagcgggtccccgatcgtgaaccgcgagggaaagatcgtcggcctgtacgggaacggcgtggtgacgacgagcgggacctacgtaagcgccatcgcccaggccaaggcctcccaagaaggcccgctccccgagatcgaggatgaggtgtttaagaaacggaatctgacaatcatggacctgcacccgggtagcggcaagacgcgtcgctacctccctgccatcgtgcgggaagccatcaagagaaagctgcggacgctgattttggcccccacccgagtcgtggcctccgaaatggcagaggcgctgaaagggatgcccatccgttaccagacaacggctgtcaagagcgagcacaccgggaaagagatcgtagatctgatgtgccatgccaccttcacgatgcgcctcctgtcgccagtgagagtaccgaattacaatatgattataatggacgaggcccatttcacggatcctgcaagcatcgctgcccggggctacatcagcaccagggtcgggatgggcgaggccgctgccatttttatgaccgctacgccgcccgggagcgtggaggctttcccgcagtccaacgccgtgatccaggacgaagagcgcgacatccccgagcggagctggaactccggctacgattggatcacggacttccccgggaagaccgtctggttcgtgcccagcataaagtcgggaaatgacatcgccaactgcctccgcaagaacggcaagcgggtgatacagctaagccgtaagaccttcgacacagagtaccagaagacgaagaacaatgactgggattacgtcgtgaccaccgacatctccgagatgggggcaaacttccgggcggaccgcgtgatcgacccacggcgctgtctgaagcccgtcatcctgaaagacggccccgagcgggtgatactcgccgggcccatgccggtcactgccgccagcgccgcccagcgccgtggccggattggacggaaccagaacaaagaaggggatcagtacatctacatgggtcagcccctgaacaacgacgaggaccacgctcactggacggaggccaaaatgctgctggacaatatcaacaccccagaggggataattcctgctctgttcgagccggagagagagaagagtgcggccatcgatggagagtaccgcttacgcggggaggcacgcaagaccttcgtggagctcatgcggcgcggcgacctgcccgtctggctcagctataaagtcgcttccgagggcttccaatattcggaccgtcgctggtgcttcgacggggagcggaacaaccaagtcctcgaggagaacatggacgtggagatctggaccaaggagggcgaacgcaaaaagttacgccccagatggctggacgcccggacctacagcgatccactcgcgttgcgcgagttcaaggaattcgccgccgggcggcgctcggttagcggcgacctgatcctagagatcggaaagctgccacagcacttgacccttcgggcgcaaaacgccctggacaacctggtaatgctccacaactccgagcaagggggcaaggcgtatcgtcacgccatggaggagctacccgacacaatagagactttgatgctcctggccctgatcgccgtgctcactgggggcgtcacgctgttttttctatccgggaagggcctcggcaagactagcatcggcctgttgtgcgtgatggcgtcttccgtgctcctgtggatggccagcgtcgaacctcactggatcgccgcctccatcatcctcgaattcttcctcatggtgctactgatccccgagccggaccggcagcgaacacctcaggacaaccagctcgcgtacgtggtcatcggcctattgttcatgatcctaaccgtggccgccaacgaaatggggttgttagaaacgaccaaaaaggacctcggtatcgggcacgtggtcgccgaaaaccaccaccacgccaccatgctggatatagacctgcacccggccagcgcgtggacactctacgccgtggccacgaccatcatcaccccgatgatgcgccacaccatcgagaacacgaccgccaacatctccctgactgccatcgctaaccaagccgcgatcctgatgggtctcgacaagggctggcccatcagcaagatggacatcggtgtccccttgctggctctaggttgctactcccaagtcaaccccctgaccctgacggctgcggtcctcatgctggttgcccactacgccatcatcgggccggggctgcaagccaaggcgacccgagaggcccagaagaggaccgccgccgggataatgaagaatcccacggtcgacggcatcgtggccatcgacctcgacccagtcgtctatgacgcaaagttcgagaagcagttgggccagatcatgctgctcattctatgtactagccagatcctgctcatgcgtaccacctgggccctgtgcgagtccatcactctggccacggggcccctcaccaccctgtgggaaggcagcccggggaagttctggaacaccacgatcgccgtgtccatggccaacatcttccgcggtagctatttagcgggcgcggggctcgccttctccctgatgaagtccctgggcgggggccggcgcgggacgggcgcccaaggcgagactttgggcgaaaagtggaagcggcaactcaaccagctgagcaagtccgaattcaacacctacaagcgatccggcattatggaggtggaccggtccgaagccaaggaggggctcaagaggggcgagacgaccaaacatgcggtctccagagggaccgccaagctgcgctggttcgtagagaggaacctggtgaagcccgagggcaaggtcatagacctggggtgcggccgcggcgggtggagttactactgcgcgggcctcaaaaaggtgaccgaggtcaagggctacacgaaaggcggcccggggcacgaggagcccatcccgatggctacctacggttggaacatcgtcaagttgcacagcgggagggacgttttcttcacgccgccagagaaatgcgacaccttactctgcgatatcggtgagtccagccccaacccgacgatcgaggaagggcggacgctgcgagtgctgaagatggtcgagccctggcttcgcggtaaccaattttgcatcaagatcctgaacccttacatgccctccgtggtggagaccctggagcagatgcagcggaagcacggaggtatgctggtccgtaacccgctgagccgcaattccacccatgagatgtactgggtcagctgcgggacagggaatatcgtgtccgcagtaaacatgacttctcgcatgctgctcaaccgcttcactatggcccatcggaagcccacttacgagcgcgacgttgacctcggcgccggaacccggcacgtcgcagtcgagcccgagactgccaacctcgacatcatcgggcagcgcatcgagaacatcaaaaacgaacacaagtccacctggcactacgatgaggacaacccctacaagacttgggcgtaccacggttcgtacgaggtgaagccgtccgggagtgcctccagcatggtgaacggggttgtgcggctcctgaccaaaccctgggacgtcatcccaatggtgacgcagatcgccatgaccgacacgacccccttcgggcagcagcgcgtattcaaggagaaagtcgacacgcggaccccccgccccaagcggggcacagcccagatcatggaggtaaccgccaagtggctatggggctttctcagccgaaacaagaaaccccggatctgcacacgcgaggagttcacgcggaaggtacgctcaaacgccgccataggtgccgttttcgtagacgaaaaccagtggaacagtgccaaggaagccgtggaagacgagcgattctgggatcttgtccacagagagcgggagctgcacaagcaggggaagtgtgcgacctgcgtgtacaatatgatgggaaagcgcgagaagaagctgggcgagtttgggaaggccaaaggttcccgggccatctggtatatgtggctgggggcccgtttcttggagttcgaggcgctcggattcatgaacgaggaccactggttcagccgcgagaactcgctgagcggtgtggagggtgagggcctgcacaaactcgggtacatactgcgggacatatccaaaatcccagggggcaatatgtatgccgacgacaccgccggttgggacacgcgcatcaccgaggatgacctccaaaacgaggccaaaatcaccgacatcatggagcccgagcacgcactcctggccaccagtatattcaaactgacgtatcagaacaaggtggtgcgggtgcagcgcccagctaagtccggcaccgtcatggacgtgatcagccggcgcgatcagcggggttcaggccaggtgggcacctatgggctcaacaccttcaccaacatggaagtccagctgataaggcaaatggaaagcgaggggatcttttcccccagcgaactggaaaactctaatctcgcggaacgggtgctcgactggctggagaagcacggggtggagcgcctcaaaagaatggccataagcggtgacgactgcgtcgtgaagcctaccgacgaccgcttcgccaccgcgttgacagccctgaacgacatggggaaggtgcggaaagacatcccccagtgggagccttccaagggctggaacgactggcagcaggtccccttttgcagtcatcatttccaccagctcatcatgaaggacggtcgcgagattgtggtgccgtgtcggaaccaggacgagctcgtaggccgcgcccgcgtgagccagggcgcagggtggtccctgcgcgagactgcgtgcctcggaaagagctatgcgcagatgtggcagctgatgtacttccaccgccgtgacttgagactcgccgccaacgccatctgctccgccgtgccagtcaattgggtgcccaccagccggaccacctggtctatccacgcacaccaccagtggatgaccactgaggatatgctcagcgtgtggaaccgcgtttggatcgaggagaacccctggatggaggacaagactcacgtgtcaagctgggaggatgtgccgtacctgggtaagcgtgaggaccagtggtgcggctcgttaatcggcctgaccgcccgcgcgacctgggccacgaatatccaggtcgctatcaaccaagttcgacgtctgatagggaacgagaactatctcgactacatgaccagcatgaagaggtttaagaacgaatctgacccggagggcgccctgtggtaa

SEQ ID NO: 24741 - RNA, 9879 nt, synthetic construct
  misc_feature 1..9879: note = derived and/or modified CDS sequence (opt11) from DENV-1__KM403616__SS-prME
  source 1..9879: mol_type = other RNA
agcgttactatgctactcatgctgctgcccaccgccctcgccttccaccttactacccgaggaggggagccccacatgatcgtgagcaagcaggagcgtggcaagtctctccttttcaagacctctgccggggtgaacatgtgcaccctcatcgccatggacctgggcgagctctgcgaggatacgatgacctacaagtgccctcggatcaccgaggccgagcccgacgacgtagactgttggtgcaatgccaccgacacctgggtgacctacggcacttgctcacagaccggcgagcaccggcgcgacaagcggagtgtcgccctcgctcctcacgtgggcctgggactcgagacccgcactgagacctggatgagctccgaaggggcctggcggcagatccagaaggtcgagacgtgggcacttcgccaccctgggttcacggtgatcgccctgtttctcgcccacgccatcggaaccagcatcacccagaaggggatcattttcatactgctgatgctcgtgaccccctccatggctatgcgctgcgtgggcatcggcaaccgcgacttcgtggaggggctgagcggcgccacgtgggtcgacgtcgtgctagagcacgggtcctgcgtgaccaccatggccaagaacaagcccactctcgacattgagctgctgaagactgaggtaacgaaccccgcggttctccgcaagctgtgcatcgaggctaaaataagcaataccaccacggactcccgctgccccacccagggggaggctaccctggttgaggagcaggacgccaacttcgtctgccggcgaactttcgtggaccggggctgggggaacggctgcggtctctttggtaaagggagcctgctgacgtgcgcgaagttcaagtgcgtgaccaagttagaagggaagatcgtccaatacgagaacttaaagtattccgtggtggtcaccgtgcacaccggtgatcagcaccaagtcgggaatgagacgaccgagcacggcaccatagctaccatcacgccccaggcccccacgtcagagattcaactgaccgattacggggccctcaccctggactgctcgccacggaccggcctggacttcaacgagatggtgctcctgacgatgaaggagaagtcctggctggttcacaagcaatggttcttagacctcccgctgccgtggacctccggagcctcaaccagccaggaaacctggaatcgccaggacctcctggtcacgttcaagaccgcccacgcgaagaagcaagaggtggtggtactcggctcccaggagggcgccatgcataccgcccttaccggggcgacggagatccagacctctggcacaaccactatcttcgccggacacctgaaatgccgcctgaagatggacaaactcactctgaaaggcgtctcctatgtgatgtgcaccggcagctttaaattggagaaggaagtcgcggagacacagcatggcacggtgctggtgcaggtcaaatacgaaggcaccgacgccccctgcaagatcccgatttccacgcaggacgaaaagggcgtgacccagaacggccggctcattacggctaacccgatagtgacagacaaggagaagccggtcaacatcgaaaccgagccaccctttggggagagctacattgtgatcggggctggcgagaaggcgctcaaattatcctggttcaagaaaggttcgtcaatcggaaagatgttcgaagccaccgcccgcggggcacggcgcatggccatcttaggcgacacggcgtgggacttcggcagcatcggcggtgtattcactagcgtcggtaagctggtgcaccaggtttttggcaccgcctatggggtcttgtttagcggcgtgtcctggaccatgaaaatcgggatcgggatcctcctgacctggctcggcctcaacagcaggagtacctcactgtccatgacctgcatcgctgtggggatggtcactttgtacctcggcgtgatggtgcaggcagattcgggttgcgtaattaattggaagggccgggagttaaaatgcggctccggcatctttgtgacaaacgaagtgcacacatggaccgagcagtacaagttccaggccgacagtccgaagcgcctgagcgcggccatcggcaaggcctgggaagaaggggtctgcgggataaggtccgccacccgcctcgagaacatcatgtggaagcagatcagcaatgaactgaatcacatcctgctcgagaacgacatgaagttcaccgtggtggtcggggatgccaacggcatcctgacacaggggaagaaaatgatccggccacagcccatggaacacaagtactcctggaagtcctggggcaaggctaaaatcatcggggccgacacccagaacaccaccttcatcatcgacgggcccgacacgcccgagtgcccggacgaccagcgagcctggaacatatgggaggtggaggactacggctttggggtgttcaccaccaatatttggcttaagctcagggactcctacacacagatgtgcgaccatcgcttgatgagcgccgcgatcaaggactccaaagccgtccacgccgatatgggttactggatcgaaagcgaaaagaacgagacgtggaagctggcccgagcttccttcatcgaggtgaagacctgcatctggccccgcagccacaccctctggtccaacggcgtgctggagtccgagatgatcatccccaagatctatgggggcccaatatcgcaacacaactaccggccagggtatttcacccagacagcgggcccctggcacctggggaagctcgagctggacttcaacctgtgcgagggcaccactgtagtggtggacgagcactgcggcaaccgcggtccgagccttcggaccacgaccgtcactggcaagattatccacgaatggtgctgccgctcctgtaccctgccgccgttgcggtttcgaggggaagacggctgctggtacgggatggagatacggcctgtgaaggagaaggaggagaacctcgtgaggtccatggtctccgcgggcagcggtgaagtggacagcttcagcctggggctactgtgtgtgagcatcatgatcgaagaggtcatgcgctcccgctggagccggaagatgctcatgacgggcacactggccgccttctttctcttaataatggggcagctgacgtggaatgacctcatcaggctgtgcatcatggtgggcgccaacgtgtccgaccgcatgggaatgggtacgacgtacctggcactcatggccaccttcaagatgcggccaatgttcgccgtcggcctactgtttcgccggctcacaagccgcgaggtgctgctgctcaccatcgggctgagcttagtagcgtcggtggagctcccaaactccctggaagaactcggagacgggctcgccatgggcatcatgatgctgaaactgctcactgattttcaaagccatcagctttggacaaccctgttgtccctgaccttcatcaaaacgacgctcagcctggactacgcgtggaagaccatggccatggtgctgtccatcgtcagcctattccccctctgcctttctacgacgagccagaagaccacctggttacccgtgttgctgggctccttcgggtgcaagccgctgaccatgttcctcatcaccgagaacaagatttggggcagaaagagctggcccttgaatgagggaatcatggccgtgggaatcgtctccattctgctgtcgagcctgcttaagaacgacgtgcccctcgccgggcccctcatcgccggcggcatgctgatcgcctgctacgtgatcagcggaagctccgcggacctctcgctggaacgcgccgctgaggtctcatgggaggaggaggccgagcacagcggtgcctcgcacaatatattggtagaggtgcaggacgatggcacgatgaaaattaaggacgaggagcgggacgacaccctcacaatcctgctgaaggccaccctgctcgccgtcagcggcgtgtatccgatgtccatccccgccaccctattcgtgtggtacttctggcagaagaagaagcagcgcagcggggttctctgggacaccccctccccgccagaggtggagcgggcagtgctggacgacggcatataccgcatcctgcagcggggcctgctcgggcgcagccaggtcggggtgggagtgtttcaggacggcgtcttccataccatgtggcacgtgacccgcggggccgtgctgatgtaccagggcaagcggctggagccttcttgggccagcgtcaagaaggatctcatatcctacggcggaggctggcggttccaggggagctggaacacaggcgaagaagtccaggtaatcgcggtggagcccgggaagaaccccaaaaatgtgcagaccacccccggcaccttcaagacgcccgagggcgaggtgggcgccattgcgctggactttaaaccagggaccagcggtagccccatcgtcaaccgcgaggggaagatcgtgggcctgtacgggaacggcgttgtcaccacatccggcacttatgtgagcgccatcgcccaggccaaggccagccaggagggcccgctcccagagatcgaggatgaagtgttcaagaagcggaacctcacgataatggacttacacccggggtccggtaagacccgcaggtacttaccagcgattgttcgcgaggccatcaagcggaagctgaggaccttaatcctcgcgcccacgcgcgtagtggcaagcgagatggcggaggcgctgaagggcatgcccatcaggtaccaaaccaccgcagtaaagtccgagcacaccggcaaggagatcgtggacctgatgtgccacgcaaccttcactatgcgcctactgagccccgtgagagtaccgaattacaacatgataatcatggacgaagcccacttcaccgacccagcgtccatcgccgcccgcggctacatcagtacgagagtgggaatgggtgaggccgccgcgatcttcatgacggccactccgcccgggagcgtggaagccttcccacagtcaaacgctgtcatccaagatgaggagcgcgatatccccgaacggtcctggaacagcggctatgactggatcaccgacttccccggtaagacggtgtggtttgtaccttccatcaagtctggcaatgacatcgccaactgcctgcgcaaaaacggcaagcgggttatccaactcagccgcaaaaccttcgacaccgagtatcagaagaccaagaacaacgactgggattacgtagtgaccacggacattagcgagatgggtgcgaacttccgggccgaccgcgtcatagacccgcggcgctgcctgaaacccgtgattctgaaggatggacccgaacgggtcatccttgccggacccatgccggtcaccgcagcgtccgctgcccagcgccggggccgcatcggtcgcaatcagaacaaggagggtgaccagtacatctacatgggccagcccctgaacaatgatgaggaccatgcccactggaccgaggccaagatgctgctcgacaacatcaacacccccgaagggatcattcccgccctgttcgaaccggagcgggagaagtccgcagcgatcgacggcgagtaccgtctgcgcggggaggcccgcaagacctttgtggagctcatgcggcgcggcgacctgcccgtctggctatcctacaaggtggccagcgagggctttcagtactctgaccggcgctggtgtttcgacggggagcggaacaaccaggtgctcgaagagaacatggacgttgagatctggaccaaagagggcgagcgcaagaaacttaggcctcgctggctagacgcgcggacctacagcgacccgctcgccctgcgcgagttcaaagagtttgccgccgggaggcgcagcgtgtccggcgacctgatcctcgagattggcaagctgccgcagcatctgaccttaagagcgcagaacgcgctggataatcttgtcatgctccacaatagcgagcagggcgggaaggcctatcgtcacgccatggaggagctgccggacaccatcgagacgctgatgctcctggccctgatcgcggtactcaccgggggcgtgacactattcttcctgagtggcaagggcttaggcaagaccagcatcgggctgctgtgcgtcatggcctcgagcgtccttctgtggatggcctcagtagagccccactggatcgcggcgagcatcatcttagagttcttcctcatggtgctgctgatccccgagccggaccggcagcgcacgccccaggacaaccagctggcatacgtagtgatcggtctgctgttcatgattctcaccgtagccgccaacgagatggggctgctagagacgaccaagaaggacctcggcatcggccacgtcgtggccgagaaccaccaccacgctacaatgctagacattgacctccacccggcgtccgcatggactctctacgccgtggccacaactatcatcacgccgatgatgcggcacacaatcgagaacaccaccgccaacataagccttacggcgatcgccaatcaggccgctatcctcatgggcctcgacaagggctggcccatctccaagatggacatcggtgttccccttctggcccttggctgctatagtcaagtaaaccccctgaccctgacagcagccgtgctcatgctggtcgctcattacgccatcatcggtcccggcctgcaggccaaggccacccgcgaggcgcagaaacgaactgccgccgggatcatgaagaaccccaccgtggacggcatcgtggcgatcgatctagatcctgtggtctacgacgccaagtttgagaagcagttaggccagataatgctgctaatcctgtgtacgtcccagatactattgatgcggaccacgtgggcactatgtgaatcgatcacactggcgaccggccccctgaccactctgtgggaggggtccccggggaaattctggaacaccaccatcgccgtgtccatggcgaacatcttccgcggttcctacctggcgggtgcggggctcgccttcagtctaatgaaatcgctgggcgggggccggcgcgggaccggcgcacagggcgagacgctgggcgaaaagtggaagcggcaactgaaccagttgagcaaaagcgagttcaatacctacaagcgctccggcatcatggaggtcgaccggagcgaggcaaaggagggtctcaagcgaggcgaaaccacgaaacacgccgtgtcccgggggactgccaagctgcggtggttcgtggagcggaacctggtcaaacccgagggcaaggtaatcgacctgggctgcgggcgtggcggttggagctactattgcgccggtctgaagaaagttaccgaggtcaaggggtacacaaagggcggccccgggcatgaggagcccattccgatggcaacttacggctggaacatagtcaagctgcattctggtagggacgtgttcttcactccgccggagaagtgcgacacgctgctctgtgacatcggtgaatcatcccccaacccgactatagaggaagggcgcaccctgcgagtcctgaagatggtggagccctggctgcgcggcaaccagttctgcataaagatcctgaacccctatatgcctagcgtggtcgagactctggaacagatgcagcggaagcacggcggcatgctcgtgcgcaacccactgtcccgcaacagcacgcatgaaatgtactgggtgtcttgcggcaccgggaacatcgtcagcgccgtgaacatgactagccgcatgctgcttaaccgcttcaccatggcccaccggaagccgacgtacgagcgggacgttgacctgggcgcaggcacccggcacgtcgccgtggagcccgaaatcgcgaacctggacatcatcgggcagcgcatagagaacatcaagaacgagcacaagagcacatggcactatgacgaggacaacccctacaaaacctgggcgtaccacggctcctacgaggtaaagcccagcgggtccgccagctccatggtcaacggcgtggtccggctcctgaccaagccctgggacgtgatcccgatggttacccaaattgcaatgaccgacacgacgcctttcggacaacagcgcgtgttcaaggagaaggtggacacccggaccccgcgccccaaacggggcaccgcccagatcatggaggtaacagccaagtggctgtggggcttcctctcccgcaacaagaagccccgaatctgcacgcgcgaggagttcacccggaaggtccgcagcaacgccgccatcggagccgtgttcgtggacgagaaccagtggaacagcgccaaggaggctgtcgaggacgagcggttctgggacctggttcaccgtgaacgggagcttcataagcaaggcaagtgtgcaacctgcgtgtacaacatgatgggtaagcgcgagaagaagctcggcgagttcgggaaggcgaagggcagccgggccatctggtatatgtggttaggcgctcgcttccttgagttcgaggccctagggttcatgaacgaggaccactggttctcccgggagaactctctgtcaggtgtcgaaggggagggcctgcataagctcgggtatatactgcgcgacatcagcaagatcccgggcggcaacatgtacgccgacgacaccgccgggtgggatacccgcatcaccgaggacgatctgcagaatgaagccaagatcaccgatatcatggagcccgagcatgcgttgctggccacgtccatcttcaagctgacctaccagaacaaagtggtgcgggtccagcgcccggccaaaagcggcacggtaatggacgtaatctcccggcgagatcagcgggggtcgggccaggtcggcacatacgggctcaacacgttcaccaacatggaggttcagcttattcggcagatggagtccgagggcatcttcagcccttccgaacttgagaatagcaatctcgcagagcgggtgctggactggctggagaagcacggggtcgagcggctcaagaggatggctatttccggagatgactgcgtggtaaaaccaaccgacgatcgcttcgcgaccgccctcacggccctaaacgacatgggtaaggtccggaaggacatcccccaatgggaaccaagcaaaggctggaatgactggcagcaggtccccttctgctcacaccacttccaccagctcatcatgaaggacggccgcgagattgtggtcccctgccggaaccaggacgagctggtagggagagcgcgcgtgagccaaggcgccgggtggtctctccgcgagaccgcctgcctcggcaagtcctacgcccagatgtggcagctgatgtacttccaccggcgcgacttgcggctcgccgccaacgccatctgcagcgcggtacccgtgaattgggttcccacctcccgcaccacctggagcatccatgcccaccaccagtggatgaccacggaggacatgctgtcggtctggaatcgcgtgtggattgaagagaacccctggatggaggacaagacccatgtgagctcgtgggaagacgtcccgtacctggggaagcgggaggaccagtggtgtggcagccttatcggactcaccgcccgcgccacgtgggcgaccaacatacaagtggctatcaatcaggtgcggcgcctgatcgggaacgagaactacttagactacatgacgtccatgaaaagattcaagaacgaatcggaccccgagggcgccctgtggtga

SEQ ID NO: 24742 - RNA, 9879 nt, synthetic construct
  misc_feature 1..9879: note = derived and/or modified CDS sequence (opt11) from DENV-1__KM403617__SS-prME
  source 1..9879: mol_type = other RNA
agcgtgaccatgcttctcatgctgctgccaacggcgctcgcatttcacttaactacccggggcggggagcctcacatgatcgtgagtaagcaggagagaggtaagagcttgctgtttaaaacatccgccggcgtaaacatgtgcaccctgattgccatggacctgggggagctatgcgaggacacgatgacctacaagtgcccgcgcattaccgaggcggagccagatgacgtggactgttggtgcaatgcaaccgatacctgggttacatatggcacttgctcgcagaccggcgagcacagaagagataagaggtccgtggccctggcgccgcatgtgggtctaggccttgagactcgcactgagacgtggatgtcttccgagggagcctggcggcagatacaaaaggtcgagacgtgggctcttagacatcccgggtttacagtgatagcgctgtttctcgcccacgcaatcggcaccagcattacccagaagggcataatcttcatactgctgatgctcgtgaccccctctatggctatgcggtgcgtcggcatcggcaatagggacttcgtcgaggggctgtctggtgccacttgggtcgacgtggtgctggaacatggcagctgtgtaaccaccatggctaagaacaaacccaccctcgatattgagctgctgaagacggaagtcacaaatccagcggtacttcggaagctgtgcatcgaggctaagatcagcaacaccacaacggactcccgctgccccacccaaggtgaggcaaccttggtggaggagcaagacgccaatttcgtatgccggcgaacgtttgttgaccgggggtggggaaacggctgcggcctctttggcaaggggagtttactgacatgcgccaagtttaagtgcgtgaccaagttagaaggaaagatcgtccaatacgagaatctaaagtactctgtggtggtcacggtgcataccggcgaccagcaccaagtcggcaacgagacgacggaacacggcacaatcgcgacaatcacgccccaggcacctacgagcgagatccagctaacagactatggagccctcaccttggactgcagcccgcggaccggactagacttcaacgagatggtgttactgacgatgaaagagaaaagctggttggtacataagcaatggtttctcgacctgccgctgccctggacatccggggccagtactagccaggagacctggaacaggcaggacctcctcgtcacgttcaaaaccgcacacgccaagaaacaggaagtggtggttctgggttcacaggagggcgccatgcacacagcactcaccggggccaccgagattcaaacttcaggcaccaccacgatcttcgccgggcatttgaagtgccgcttaaagatggataagctcacgctgaagggcgtttcttatgtgatgtgcaccgggagcttcaagctggagaaagaggtcgctgagacgcaacacggcacggtgctggtacaagttaagtatgaaggaaccgacgccccctgcaagatcccaatctccacccaggacgagaagggggtgacccagaacggtcggctcatcacagccaacccgattgtgaccgacaaggaaaagcccgtgaacattgaaaccgagccgcccttcggtgagagctatatcgtcatcggcgccggcgaaaaagcgctgaaactgagttggttcaagaaggggtcgtcgatagggaagatgttcgaagcgacggcccggggagcgcgtagaatggctattctaggcgacactgcttgggatttcggatccatcggcggtgtcttcacatccgttgggaaactggtacaccaggtgtttggcaccgcctacggtgtcctgttctccggcgtgtcgtggactatgaagatcgggattggcatactcctgacctggttagggctcaactcccgatccaccagcctgtccatgacatgcatcgccgtaggcatggttactctgtacctgggagtaatggtgcaggccgacagtgggtgcgtcataaattggaagggccgggagctgaaatgcgggtccggcatctttgtgaccaacgaagttcacacttggaccgagcaatataagttccaggccgatagccccaaaaggttaagcgcggccattggaaaggcctgggaggagggcgtttgtggaatccggtctgccacccgcttagagaacatcatgtggaagcagatcagcaacgagctgaaccatatattgctcgaaaatgatatgaagtttacggtggtggtcggagacgccaatgggattctgacccagggtaaaaagatgatccggccccagcccatggagcacaagtactcctggaagtcttggggcaaagcgaaaatcattggcgccgacacccagaacaccacgttcataatcgatggtcctgacacgccggagtgccctgacgaccagcgcgcctggaacatctgggaggtggaagactatggctttggggtgttcaccaccaatatctggctgaaactcagagattcgtacacccagatgtgtgatcacaggctgatgagcgcggcgatcaaggactccaaagccgtccacgccgacatgggctattggatagaaagcgagaagaacgaaacatggaaactggcgcgggctagcttcatcgaggttaagacctgcatatggccccgctcacataccctctggtcgaatggcgtactcgaatccgaaatgatcatacccaagatatatggtggcccaatcagccagcacaactatagaccaggttacttcacccagacggcgggcccctggcacttggggaagctcgagctggactttaatttatgtgagggcacaactgtcgtggtcgacgaacactgcggaaaccgcggtcccagcttgagaaccaccaccgtaaccggtaagatcatacacgagtggtgttgccgctcctgcaccctgccgccgctgcgattcagaggggaagacggttgctggtacgggatggagattcggcctgtgaaggagaaagaagaaaacctcgtaaggagcatggtgtccgccggaagcggggaggtggatagcttctccctggggttactctgtgtcagtataatgatagaagaagtgatgagatctcgctggagccggaagatgctgatgactggaaccctggccgtcttcttcctattaataatgggccagctgacctggaatgaccttataagactctgcatcatggtaggcgctaacgtctccgatcgcatggggatgggcaccacttacctggccttgatggccacctttaaaatgcggcccatgtttgctgtcgggctgctgttccgccgactcacctcgcgcgaggtactactcctcacgatcgggttaagcctggtcgcttcggtggagcttcccaactcgctagaggagctgggcgacggccttgctatggggatcatgatgttaaagctactaacggatttccagagtcatcagttgtggaccacgctactctcattgaccttcatcaagacgaccctgtctctcgactatgcctggaagactatggcaatggtactgtccatcgtgagcctgtttcccctctgcttaagtaccacgagccagaagaccacgtggctcccagtactcctgggctccttcgggtgcaagccgctgactatgtttctgatcactgagaacaaaatctggggccgcaagagttggcccctgaacgaagggatcatggctgtcggaatcgtgtctatcctgctgagtagcctgttgaagaacgacgtccccctcgctggccccctgatcgccggcggcatgctgatcgcgtgctacgtcatttcagggagctccgccgatctaagtttagagcgggccgcagaggtctcttgggaggaagaggccgagcactcaggtgcgtcccacaatatcctcgttgaagtccaggatgacgggacgatgaaaatcaaggacgaggaaagggacgacactctgaccatactgctgaaggcgaccctcctggccgtctcaggcgtgtacccaatgtccatccccgccacgctgttcgtatggtacttctggcagaagaagaagcagcgatcgggcgtactctgggataccccgagccctcccgaggtcgagcgggccgtgttggatgacggcatttaccgcatattacagagaggccttctcgggcgcagccaagtaggcgtgggcgtcttccaggacggtgtgttccataccatgtggcacgttacccgtggcgcagtcctgatgtaccaggggaagcgcctggagccttcctgggccagcgttaaaaaggacctcatctcttacggagggggctggcggttccaagggtcctggaatacaggggaggaggtgcaggtcattgccgtggaacccgggaagaaccccaagaatgtgcagacgaccccagggaccttcaaaacccccgagggagaggtcggggccatcgccttggacttcaagcccggaacctcggggtctcctatcgtgaacagagagggcaagatcgtgggactgtacggaaacggtgtcgttaccacctccgggacatatgtgtctgcgatcgcccaggccaaagcaagccaagaaggcccgctccctgagatcgaggacgaggtctttaagaagcgcaatctgaccatcatggaccttcatcccggctcgggcaagacccgcaggtatttacctgcaatagtgagagaggctattaaacgcaaactgcggaccctgatcctggccccaactcgggtggtcgcctcggagatggcggaggcgttaaaggggatgcccatcaggtatcaaactacggccgtgaagtctgagcatacagggaaggagatcgtggacctgatgtgccacgccacgtttaccatgagacttctgagcccagtccgagtgccgaattacaacatgatcatcatggacgaggcccactttaccgaccccgcctctatcgcggcacgaggttacatatcgaccagggtgggaatgggtgaggccgcggccatcttcatgacggcgaccccgcccggctctgtcgaggctttcccccaaagcaacgccgtgatccaggacgaggagcgggacataccagagcgatcctggaacagcgggtacgactggatcacagactttcccggcaaaaccgtatggttcgtaccgtcgataaagagcgggaacgacattgccaattgcctgcgcaagaacggcaaacgggtgatccagctatcccgcaaaaccttcgacactgagtaccaaaagaccaaaaacaacgactgggactatgtggtcactacagacatcagcgagatgggggcgaactttagagcggaccgagttatagacccgcggcgctgcctaaagcctgtcatcctcaaggacggaccagagcgggtaatattggccgggcccatgcctgtgaccgcggcctccgcggcccagagacggggccggatcggccgcaaccagaataaagagggagatcaatacatatacatggggcagcccctgaacaatgacgaggaccatgcccactggacggaggcgaagatgctactcgataatataaatacacctgagggtatcattcccgccctgttcgaaccggagcgggagaaaagcgcggctatcgacggggagtatcgcttgcgcggggaagcccgcaaaacgtttgtcgaactcatgcggcgtggggacctgcctgtctggctgtcctacaaggtggcttccgagggcttccagtactccgaccggcgctggtgcttcgacggcgaacgaaacaaccaggtccttgaagaaaatatggacgtggaaatttggaccaaggagggcgaacgcaagaagctacgccctcgctggctggacgcacggacatactcggaccccctcgctctgcgagagttcaaagagttcgcggctgggcggcgcagtgtgtccggcgatctgatactcgagatcggcaagctaccgcaacacctcaccctcagggcccagaacgcactggacaaccttgtcatgctccataacagcgaacaaggcgggaaggcctaccgccatgccatggaagaactgcccgatactatcgagacgctgatgcttctagccctgatagccgtgctcaccggaggggtgaccctgttcttcctgtccggtaaaggactcggcaaaacctctatcgggctgctgtgcgtcatggcgtccagcgtgctcctgtggatggcttctgtcgagccacactggattgcggccagcattatcctggagttctttctcatggtcctcctgattccagagccagaccggcagaggacgccgcaagacaaccagttggcctacgtggtaatcgggcttctattcatgattctaacggtagccgccaacgagatggggttgctggagaccaccaagaaagacttgggaattggccacgtggtcgccgagaaccaccaccacgccacgatgctggacatcgacttgcaccccgcttccgcgtggaccttatatgctgtagctaccaccatcatcacgccgatgatgcggcacaccatcgagaacactaccgccaacatctccctgaccgctatagcgaaccaagccgccatattgatgggcctcgacaagggttggcccataagcaagatggacataggagtgcccctgctagccctcggctgctacagtcaggttaacccgttaaccctgaccgccgcggtcttaatgctggttgcacactatgccatcatcgggcccgggctgcaagccaaggcgacccgggaagcccagaagcgcactgccgcggggatcatgaagaatcccactgtggatggtatcgtggccattgatctggacccagtggtctacgatgcaaaatttgaaaaacaactgggccagataatgcttctgattctgtgcaccagccagatcctgttgatgaggactacatgggccctgtgtgagagcatcactttagccaccggcccgctcactacgctgtgggagggctcaccgggaaagttctggaacacaaccatagctgtgtccatggccaacatcttccgcggctcctacctggccggcgctggacttgccttcagcttaatgaaaagtctgggagggggccggagagggacgggggcccagggcgagacgctgggagagaaatggaagaggcagcttaatcagttaagcaagagcgagttcaacacatacaaacggtccggcatcatggaagttgaccggagtgaggccaaggaggggctgaagcgcggcgaaaccactaagcatgctgtcagtcgtgggacggccaagctgcgctggtttgttgagcgaaatctggtcaaacccgaggggaaagtgatagacttgggctgcgggcggggcggttggagctattactgtgccggattaaagaaggtgaccgaggttaagggatacaccaaaggcggccccgggcacgaggagccgataccgatggccacctacgggtggaacatcgtcaagctgcactccgggagggacgttttcttcacgccacccgagaagtgtgacacgctgctctgtgacatcggagagagttcccccaacccgactatcgaggaggggcgcacattgcgggtactgaagatggtggagccctggcttcgcggcaaccaattctgcatcaagatccttaatccatacatgcctagtgtcgtcgagaccctcgagcagatgcaacggaagcacggcgggatgctcgtgagaaacccgctgtcccggaactcaacgcacgagatgtattgggtctcctgtggcaccgggaacatcgtgagcgcggtaaatatgacgagcaggatgctgctgaatcgattcaccatggcccaccgcaagcccacgtacgagagggacgtggacctgggcgccggcaccaggcacgttgccgtagagcccgagatagccaacctcgacatcattggtcagcgcatcgaaaacatcaagaacgagcacaagtcgacctggcactacgacgaggacaacccctataaaacctgggcgtaccatggctcctacgaggtcaagccctcaggatccgccagcagcatggtcaacggtgtggtgcgactcctgaccaagccctgggatgtaatccccatggtaacacagattgcaatgaccgataccacaccgttcgggcagcagcgcgtgttcaaggagaaggtggacacccggacaccacgccccaaacggggtaccgcacaaatcatggaagtcacggcaaaatggttatggggtttcctcagccgcaataagaaaccccggatttgcacccgagaggagtttacccggaaggtacgtagtaatgccgccattggcgccgtgttcgtcgacgagaaccagtggaacagcgccaaggaggcagtcgaggatgagcggttctgggacctagtgcatagggagcgggaactgcacaagcagggaaagtgtgcgacctgcgtctacaatatgatgggcaagcgcgaaaagaagctcggagagttcgggaaggctaagggcagccgcgccatctggtacatgtggctgggcgcgcgctttttggagtttgaggctctcgggttcatgaacgaagaccattggttctcacgggaaaacagcctgtcgggtgttgagggggaaggacttcacaaactcgggtacatcctcagggacatcagcaagattccgggcggcaacatgtatgccgatgatactgccggttgggatacccggatcactgaggacgatctgcagaacgaggccaaaatcaccgacataatggagcccgaacacgccttgctggcgacatccatattcaaactgacataccagaacaaggtggtccgggtgcagcgccccgctaagagcggcaccgtcatggacgtcatctccaggcgcgatcagcggggtagcggccaagtgggcacatacggattaaacacgttcaccaacatggaagtgcaactgataagacagatggagtccgaaggcattttctcgccctccgagctagagaatagcaacctcgccgagcgggtcttggattggctcgagaagcacggcgtggagaggttaaagcggatggccatctccggcgacgactgcgtggtaaagccaacggacgaccgcttcgccaccgcgctaacggccctgaatgacatggggaaagtgagaaaggacatcccccaatgggagcccagcaagggctggaatgactggcagcaggtcccgttttgctcccatcactttcaccagcttatcatgaaagacggcagagagatcgtcgtgccgtgtagaaaccaggacgagctggtgggtagggcccgggtcagtcagggcgctgggtggagcctccgagagaccgcatgcctcggcaaaagctatgctcaaatgtggcagctgatgtacttccatcgccgggacctgcggctcgctgccaacgccatttgcagcgccgtgcccgtaaactgggtgccgacctccagaacaacctggtcaatacacgctcaccatcagtggatgactaccgaggacatgctgtccgtgtggaaccgcgtgtggattgaagagaatccatggatggaggacaagactcatgtaagcagctgggaggacgtgccgtacctagggaagcgggaagaccagtggtgcggtagcctcattggcctgaccgcgagagccacctgggccaccaatatccaggtggctatcaatcaggtgcgacgcctgatcggcaacgagaactatctcgactacatgacctccatgaagcggttcaagaacgagtcggatcccgagggggccctgtggtaa

SEQ ID NO: 24743 - RNA, 9879 nt, synthetic construct
  misc_feature 1..9879: note = derived and/or modified CDS sequence (opt11) from DENV-1__KM403635__SS-prME
  source 1..9879: mol_type = other RNA
tcagtcacaatgctgctcatgctgctacccacggccctcgccttccacctgaccacccgtggcggggagccccacatgatcgtaagcaagcaggagcggggcaagagtttattattcaagacctctgctggggtgaacatgtgcaccctgatcgccatggacctgggcgaactctgcgaggacacgatgacctacaagtgccccaggataaccgaggccgaaccggacgacgtggactgttggtgcaacgctacagacacctgggtgacgtacgggacctgtagccagaccggcgagcaccggcgcgacaagaggtccgtggcgctggcgccccatgtaggcctggggctcgagacccgcaccgagacatggatgagctccgagggcgcatggcggcagatccagaaagtggaaacctgggccctgcggcaccccggctttacggtgatcgccctgttcttagctcacgctatcggaaccagcatcacccagaagggaatcatcttcatccttctaatgctcgtcaccccctccatggccatgcggtgcgtcggaatcggcaaccgggacttcgtggaaggtctgagcggcgccacgtgggtggacgtcgttctggagcacgggtcctgtgtgaccaccatggccaagaacaaacccaccctcgacatcgaactgttgaagaccgaagtcaccaaccccgcggtgttgcgaaagctgtgcattgaggccaagatcagcaacaccaccacggattcgcgctgcccgacccaaggcgaggccaccctggtggaggagcaggatgccaacttcgtttgcaggcgtaccttcgtggaccgcggctgggggaacggctgcggcctctttggcaaggggagcctgctgacgtgtgccaagttcaagtgcgtgaccaagctagagggcaagatcgtccagtacgagaacttgaagtactcagttatcgtcaccgtccacaccggcgaccagcaccaggtagggaacgaaacgaccgagcacggcaccatcgctaccatcacgccccaggcccccacgtccgagatccagctgaccgactacggggccttaaccctggattgcagtccgcggaccggcctggacttcaacgaaatggtcctactgactatgaaggagaagtcctggctggtgcacaaacagtggttcctcgacctgccgttgccctggaccagtggggcctccgcctcgcaggagacctggaaccggcaggacctcctggttaccttcaagacggcgcacgccaagaagcaggaggtcgtggtgctaggctcccaggagggagcgatgcacaccgcgctcaccggcgcgaccgagatccaaacgagcggcacaaccaccatcttcgcgggccaccttaagtgccgcctgaagatggacaagctcacgctgaagggcgtctcctacgtgatgtgcaccgggagcttcaagctggagaaggaggtggccgagacccagcacggtaccgtcctggtccaagtgaagtacgagggcacggacgccccctgcaagattcccatctccacccaggacgagaagggagtcacccagaacggccggctcatcaccgccaacccgatcgtcacggacaaggagaagcccgtgaatatcgagaccgagccgcccttcggggagagctatatcgtcatcggcgcgggcgagaaggccctgaagctgtcctggttcaaaaaggggagctctatcggcaagatgttcgaagccacggcccgcggggcccggcgcatggcgattttaggcgacacagcctgggatttcgggtccatcggaggcgtgtttacttccgtggggaaacttgtccaccaagtgttcggcaccgcctacggggtgctgttctcaggcgtctcctggactatgaagattgggataggtatccttttgacctggctgggcctcaacagccgctccacgagcctttccatgacctgtatcgccgtcgggatggtgactctgtacctcggcgtcatggtgcaagccgacagcgggtgcgtgatcaactggaagggccgcgagctgaaatgtgggtccggcatcttcgtcaccaacgaggtgcatacctggaccgagcagtacaagttccaggcggacagcccgaagcgcctgagcgccgccatcggcaaggcctgggaagagggggtatgcggtatccggtccgccaccagattagagaacatcatgtggaaacagatcagcaacgaactcaaccatatcctgcttgagaacgacatgaagttcaccgtcgtagtgggggacgcgaatggtatcctgacccaagggaagaagatgatccggccccagcccatggagcataagtactcctggaagtcctggggtaaagcgaagatcatcggcgcggacacgcagaacaccaccttcatcatagacgggcccgacactccggagtgccctgacgaccagcgcgcctggaacatttgggaggtcgaagactacggcttcggtgtgttcacgaccaacatctggctgaagctccgggacagctacacccagatgtgcgatcaccgcctgatgagcgcggccatcaaggattctaaagcagtgcacgcagacatgggctactggatcgagagcgagaagaatgagacttggaagcttgctcgggcgtccttcattgaagtcaagacgtgtatttggccacgaagccacaccctttggtccaacggggtgctggagagcgagatgattattcccaagatttacgggggaccgatatcccaacacaactacagaccagggtatttcacgcaaaccgctggcccctggcacctagggaagttggaactggacttcaacctgtgcgagggcacgaccgtagtcgtggacgagcactgcggcaaccgcgggccgtccttacggaccaccactgttaccggcaagatcatccacgaatggtgttgccgctcctgcaccttgccgcccctgcggttccgcggggaggatggctgctggtacggtatggagatccgcccggtcaaggagaaggaggagaacttggtgcgctcaatggtgtctgccggctcgggcgaagtcgactcattttccctggggctgttgtgcgtgtcgatcatgatcgaggaagtgatgcggtctcgctggagtcgcaaaatgctgatgaccggcacgctggcagtcttctttctccttatcatggggcagctgacctggaacgacctcattcgactgtgcatcatggtaggcgccaacgtgtccgataggatggggatgggcacaacttacctggcactcatggccacgttcaagatgcgtccgatgttcgccgtcggtctactgttccggcggctcaccagccgcgaagtgctccttttgaccatcgggctgtccctggtggccagcgttgagctccccaactccctggaggagctgggcgacgggctcgcaatgggcatcatgatgctgaaactgctcaccgacttccagagccaccagctgtggacgaccttattgtccctgaccttcatcaagaccacgctcagcctcgactacgcgtggaagaccatggcgatggtgctgtctatcgtaagcctgttccccttgtgcctgtccaccacaagccaaaagacgacttggttgcccgtgctcctgggctccttcggttgcaagcctctgaccatgttcctcatcaccgagaacaagatctggggccgcaagagctggccactgaacgaggggatcatggccgtgggcatcgtcagcatcctgctcagctctttgctgaagaacgacgtacccctcgccgggcccctgatcgcgggcggcatgctgatcgcctgttacgtgatctccgggtcgtccgcggacctcagcctggagcgcgctgccgaagtctcctgggaggaggaggcggagcacagcggtgcttcacacaatatcctggtggaggtccaggacgatggcaccatgaaaatcaaggacgaggagcgggatgacacactcaccatcctgctgaaggccaccctcctggcggtaagcggagtgtatccaatgtccatccccgccaccctgtttgtgtggtatttctggcagaagaagaagcagcgcagcggtgtcctctgggacacgccctcaccgcccgaagtggagcgggcggtcctggacgacggtatctaccgcatcctgcagcggggcctgctcggaagatcccaggtcggcgtgggcgtatttcaggacggcgtcttccacactatgtggcacgtgacccgcggggccgtgctgatgtaccagggcaagcgactcgagccctcgtgggccagcgtcaagaaggacctgatctcctacggggggggctggcggttccagggtagctggaacaccggcgaagaggtccaggtaatcgccgttgagcccgggaagaaccccaagaacgtacagacgactcccggcaccttcaagacccccgagggcgaggtcggcgccatcgccctggactttaagcccggcacgagcggtagccccatagtcaatcgcgagggcaagatcgtgggcctgtacgggaacggcgtagtcaccacctccgggacctatgtgagcgccatcgcacaggcaaaggctagccaggagggcccactcccagagattgaggacgaagtgttcaaaaagcgtaatctgactatcatggatctgcaccccgggtcaggcaagacccgccggtaccttccggcgatcgtccgggaggccatcaaacgcaagctgaggacactgatcctagcccccacccgcgtggtagccagcgaaatggcagaggccctgaagggcatgcccatccggtatcagacgaccgccgtgaagagtgaacacaccgggaaagagatagtggacctgatgtgccacgccacatttacgatgcgtctcctgagtcccgtgcgggtccccaactacaacatgatcatcatggacgaagcgcacttcaccgatcccgcgtccatcgccgcccgcggctatatcagcacacgggtggggatgggcgaggccgccgcgatctttatgaccgccaccccgcccggttcggtggaggccttccctcaaagcaacgccgtaatccaggacgaagagcgcgacatccccgagcggagttggaacagtggctatgactggatcacggacttccccggaaagaccgtgtggttcgtgcccagcattaagagcgggaacgacatcgccaattgcctgcgcaagaacggcaagcgggtcatccaactttctcgcaagaccttcgacacggagtaccagaagaccaagaacaacgactgggactacgtcgtgaccacggacatcagcgaaatgggcgccaactttcgggcggaccgcgtcatcgacccgcggcgctgtctgaaacctgtgatcctgaaggacggccccgaacgggtcatcctcgccgggcctatgccggtgacagccgcatcagccgcccagcgacgggggagaatcggccgcaaccagaacaaagagggggaccagtacatctacatgggccaacccctcaacaacgacgaggaccacgcccactggaccgaggccaagatgctgctcgataatatcaacacccccgaggggatcatccccgccctgttcgagccggagagagaaaagtccgccgccatcgacggcgagtaccgcttacgcggggaggccaggaagacctttgtggagctcatgagacgtggcgacctgcccgtctggctgtcctacaaggttgccagcgagggcttccagtactcagaccggcgctggtgcttcgacggggagcggaataaccaggtgctagaggagaacatggacgtcgaaatctggacgaaggagggagagcgcaagaaactgcggccccgctggttggatgcacggacctacagcgaccccctcgccttgcgcgagttcaaagagttcgctgcagggcggcgcagcgtgtctggcgatctgatcctcgagatcggcaagctcccgcaacacctgaccctccgggcacagaatgcgctggacaacctggtgatgttacacaacagcgagcagggcggaaaagcctaccgccacgcaatggaggagctgcccgacaccatcgagacccttatgcttctggccctaatcgcggtcctcaccggcggcgtaaccttattctttctctccgggaaggggctcggcaaaacgagcatagggctgctgtgcgtgatggcctccagtgtccttctgtggatggcctctgtggagccccactggatcgctgccagcatcatcttagagttctttctcatggtgctgctgatccctgagccggaccggcagcggacgccccaggacaaccagctcgcgtacgtcgtgatcggcctgctgttcatgatcctcacggtggccgccaacgaaatgggtctgctggaaaccaccaaaaaggacctcggcatagggcatgtcgtggccgagaatcaccaccatgccaccatgctggacatcgacctgcaccccgcctcggcctggacgctctacgccgtggccaccaccatcattaccccgatgatgcggcacacaattgaaaacaccaccgccaacatttcgctgaccgcgatcgccaaccaggccgccatattaatgggattggacaagggctggcctatctccaagatggacataggggtccccttgctggccctcggctgctacagccaggtgaaccccctgacgctgaccgcagctgtgctaatgctggttgcccactacgcgatcatcgggccggggctgcaggccaaggccactagggaagcccagaagcgcaccgcagccggcatcatgaagaaccccacggtcgacgggatcgtcgcaattgatctcgaccccgtcgtgtacgacgccaagttcgaaaagcagctgggccaaatcatgctgctcatcctgtgcaccagccagatcctgctcatgcgaaccacctgggccctgtgcgagagcatcacgctggctaccgggcccctcaccacactgtgggagggctccccggggaagttctggaacacgaccatagcagtgagcatggcgaacatcttcaggggctcctatctcgccggcgccgggctggccttcagcctgatgaagtccctgggcgggggcagacgggggacgggcgcccagggcgagaccctcggggagaagtggaagcggcagctgaaccagctgagcaagagcgagttcaacacgtacaagagatccggaatcatggaggtcgaccgaagcgaggcgaaagagggtctcaagcgcggcgagaccaccaagcacgccgtttcccgggggaccgccaagctgcgctggttcgtggagcgaaacttggtcaagccagagggcaaggtgatagatctgggctgcgggcgcggagggtggagctactactgcgccggattgaagaaggtgacggaagtcaaaggctacaccaagggcggccccgggcatgaggagcctatcccgatggcgacttacggttggaacatagtgaaactgcactccgggagggacgtgttcttcacgccgcctgaaaagtgcgacaccctgctctgtgacatcggcgagagctcccccaaccccacgatcgaggaggggagaaccttacgagtcttgaagatggtcgagccctggttacggggcaaccaattctgcatcaaaatcctgaacccgtacatgcccagcgtcgtcgagaccctcgagcagatgcagcggaagcacggagggatgctggtccgcaacccgctctcccggaacagcacacacgagatgtactgggtgagctgcggcacggggaacattgtcagcgccgtgaacatgacctcccgcatgctgttgaaccgcttcaccatggcccatcggaagcccacctatgaacgcgacgtggacctgggcgccggcacgcggcatgtcgccgtggagcccgagatcgcaaacctggacataatcgggcagcgcattgagaatatcaagaacgaacataagagcacctggcactacgacgaagataacccctataaaacgtgggcctaccacggctcctacgaggttaagccgtcggggtccgccagctccatggtaaacggcgtcgtccgtctcttgaccaagccctgggatgtgattcccatggtgacgcagattgccatgaccgacactacaccctttgggcagcagcgcgtattcaaagaaaaggtagacacgagaaccccgcgccccaagcggggcacggcccagatcatggaggtaaccgcgaagtggttgtggggtttcctgagccgtaacaaaaaaccccggatctgcacgagggaggagttcacccggaaggtccgctctaacgctgccattggggccgtgttcgtagatgagaaccagtggaactcagctaaagaagcggtcgaggacgagcggttctgggacctggtgcatcgcgagcgggagctccacaagcagggcaagtgtgcgacctgcgtgtacaacatgatgggaaagcgtgaaaagaagctcggtgaattcgggaaggccaaaggcagcagagcaatctggtacatgtggctcggtgcccggtttttggaatttgaggccctcggctttatgaacgaggatcactggttttcgcgggagaatagcctgtccggagtcgagggcgagggcctacacaagctcgggtacatcctgcgagacatcagcaaaattcctggaggcaacatgtacgccgacgacacggccgggtgggacacgcgcatcaccgaggacgacctccagaacgaggccaagatcaccgacataatggagcccgaacacgcgctcctggccacctccatcttcaagctgacgtaccagaacaaggtggtgcgggtccagcgacccgccaagagcggcaccgtgatggacgtcatctcccggcgcgaccagcgggggagcggccaagtcggtacctatgggctcaacactttcactaatatggaggtgcagctgatcaggcagatggagtccgagggcatctttagcccctccgaactggaaaacagcaacctcgccgagcgcgtgctggactggctggagaaacacggggtggaacgactcaagagaatggccatctccggcgacgattgcgtggtgaagccgaccgacgaccgcttcgcgaccgccctgaccgccctgaacgacatggggaaggtccggaaggacatcccacagtgggaacccagcaagggctggaacgactggcaacaagtcccgttctgctcccaccatttccaccagctcatcatgaaagacggacgcgaaatagtggtaccgtgccggaaccaggacgagctggtggggcgcgcccgcgttagccagggagcagggtggagcctgagagagactgcgtgtctcggcaagtcctacgcccagatgtggcagctgatgtacttccaccggcgcgaccttcgactcgccgccaacgcaatctgtagcgcggttcccgtgaactgggttccgacgtcccgcaccacctggagtatccacgcccaccaccagtggatgaccacggaggacatgctgtccgtctggaaccgcgtgtggatcgaggagaacccctggatggaggacaagacgcacgtttcctcctgggaagacgtcccctacttggggaagcgggaggaccagtggtgcggcagcctcatcggcctaacagcccgagcaacctgggcgacgaacatccaagtggccatcaatcaggtgcgtcgcctggtcgggaacgagaactacctagactacatgaccagcatgaagagattcaaaaacgagagcgatcctgagggcgcactttggtga

SEQ ID NO: 24744 - RNA, 9879 nt, synthetic construct
  misc_feature 1..9879: note = derived and/or modified CDS sequence (opt11) from DENV-1__KM403621__SS-prME
  source 1..9879: mol_type = other RNA
agcgtaaccatgctgctaatgctgctgcccacagctctcgctttccacctgaccacgcggggtggagagccccacatgatcgtgagcaagcaagagcgaggcaaaagccttctattcaagacatccgcgggggtgaacatgtgcacgctgatcgccatggacctgggagagttatgtgaggatactatgacatacaagtgtccccgtattaccgaggccgaacccgacgatgttgactgctggtgcaacgccaccgatacctgggtgacatacggaacatgcagccagaccggcgagcatagacgcgacaagcggtccgtggccctggcaccccacgtggggctggggctcgagaccaggaccgagacttggatgtcgtccgagggcgcatggcgacagatacagaaggtggagacgtgggctctgcgccacccgggattcacggttatcgccttattcctcgcgcacgccatcggcacctcaatcacccagaagggcataatcttcatcctgctcatgctcgtgaccccctccatggctatgcggtgcgttggcatcggcaacagagacttcgtggaggggctgtcaggcgccacgtgggtcgacgtcgtgctcgagcacgggtcctgcgttaccaccatggccaagaataagcccactctcgacatcgaactactgaagacagaggtaaccaacccagcagtgctgagaaagctgtgtatcgaagccaagatcagcaacaccaccacggattcccgctgccccacccagggcgaggccactctcgtggaggagcaagacgccaacttcgtctgccggcgcaccttcgtggacagaggctgggggaacggctgcggcttattcggaaaagggagcttgctgacgtgtgccaagttcaagtgcgtcaccaagcttgaagggaaaatcgtgcagtacgagaacctgaaatacagcgtgatagtgaccgtccacaccggcgaccagcatcaggttggcaacgagacgacggagcatggtaccatcgccaccatcacaccccaagcacccacttcagaaatccagctgaccgattatggggccctcacactagactgctctcccaggaccgggttggactttaacgagatggtccttttgacaatgaaggagaagtcctggctggtgcacaaacagtggtttttggacctgccgctaccctggacatcgggggcctcaacgtcacaggagacgtggaaccggcaggacttactggtgacgttcaagaccgcccacgcgaagaaacaggaggttgtggtgctggggtcccaggagggggccatgcacaccgccctcaccggggcgacggagatacaaacctcaggaaccacaacgatcttcgccgggcacctgaagtgccggctgaagatggataagctcaccctgaagggcgtatcctatgtcatgtgcactggaagcttcaagttggagaaagaggtggcggaaacgcagcacggcacggttctggtccaggtgaagtacgagggcaccgacgccccctgcaagatcccgatctccactcaggacgagaagggggtaacccaaaacggcagactcatcacggccaacccaatcgtgaccgacaaagagaagcccgtcaacatcgagaccgagccgcccttcggggagtcatacattgtcattggcgccggcgagaaggccctgaaactatcctggttcaagaagggcagctcgatcggcaagatgttcgaggccaccgcccgcggagctcggcgcatggccatactcggcgatacggcatgggacttcggtagcatcggaggcgtgttcacgtccgttgggaagctggtccaccaagtgttcggcaccgcctatggggtgctgttctccggcgtttcgtggaccatgaagatcgggataggaatcctcctgacgtggctgggactcaattcccgctccaccagcttatccatgacctgcatagccgtggggatggtcaccttgtacttaggagtcatggttcaggccgacagcgggtgcgtgatcaactggaagggccgggagctcaaatgcgggtccgggatctttgtcacgaacgaggtgcacacttggacggagcagtacaagttccaggccgacagcccaaagcgacttagcgctgcgatcgggaaggcatgggaggagggggtgtgtggcatcagatccgctaccaggctcgagaacataatgtggaagcagatctccaacgaactcaaccacattctgctggagaacgacatgaagttcaccgttgttgttggggacgccaatggcatcctcacgcaggggaagaaaatgatcagaccgcaacccatggaacacaaatattcctggaagtcctggggcaaggcaaaaataataggggccgacacccagaacaccacattcataatcgacggaccagacacgccagagtgccccgacgaccagcgcgcatggaacatctgggaagtcgaggattatggcttcggggtcttcaccacaaacatctggctgaagctccgggacagttatacccaaatgtgtgaccacagattaatgagcgccgcgatcaaggactccaaggccgtgcacgctgacatggggtactggattgaaagcgaaaagaacgagacgtggaaactagcccgggcctcgttcatcgaggttaagacctgcatatggccccgcagccacaccctctggtcgaacggcgtgctggagtctgagatgatcatacccaaaatctatggggggccgatatcacagcacaactaccggcccgggtacttcacccaaactgcgggcccatggcacctggggaagttagagctcgacttcaacctgtgcgaggggaccaccgtggtcgtggatgagcactgtggtaaccgcgggccgtcgctccgaaccacgaccgttaccggaaagataattcatgagtggtgctgccgctcgtgtaccctgccgccactgcggtttcgcggggaggacggctgctggtatgggatggagattaggcccgtcaaagaaaaggaggaaaacctcgtgcgcagcatggtgtccgccggaagcggcgaggtcgactcattctccctggggctgctatgcgtaagcatcatgatcgaagaggtgatgcggtcccgctggtcccgtaagatgcttatgactggcaccctggccgtcttctttctcctgatcatgggccagctgacatggaacgacctcatccggctgtgcatcatggtcggcgccaatgtatccgaccggatggggatgggcaccacttacctcgccttaatggctaccttcaagatgcgacctatgttcgcagtcgggctgctcttcagacggttaaccagccgcgaggtattactgttaaccatcggtctatccctggtcgcttcagtggagctgcccaacagcttagaagaactaggcgacgggctcgccatgggcataatgatgctgaaactgttgactgacttccagtcccaccagttatggaccaccctgctaagccttacgttcatcaagacgaccttaagcctcgactatgcttggaaaacgatggcaatggtcctgtccatcgtaagcttattcccgctttgcctgtccaccacgagccagaagaccacgtggctgccggtactccttggctccttcggctgtaagcctcttaccatgtttctaatcaccgagaacaagatctggggccgcaagagttggccattgaacgaaggcatcatggccgtgggtatcgtgtctatactcctgagcagcctgctgaaaaacgacgtgcccctcgccgggccccttatcgccggaggcatgttaatcgcgtgctacgttatctccgggagctccgcggatctgtcattagagcgcgccgcggaggtctcatgggaggaggaggctgagcatagcggggcgtcgcacaacattcttgtggaggttcaagacgacggaactatgaagatcaaggatgaagagcgcgatgacacactcaccatcctgctgaaggccaccctccttgccgtatccggtgtgtatccgatgagcatacccgcaacgctgttcgtgtggtacttctggcagaagaagaagcagcgcagcggggtcctctgggacacccctagcccaccggaagtggagcgggcagtcctggacgacgggatctaccgcatcctgcagcggggattgctcgggcgctcgcaagtcggcgttggggtttttcaagacggcgtctttcacaccatgtggcacgtgacccgcggggccgtgctgatgtaccagggcaaacgcctggaaccgtcctgggcctcggtaaagaaggaccttatctcctacggcggaggctggcggttccaggggagctggaacacgggcgaagaggtgcaggtaattgcagtcgagcccgggaagaaccccaagaacgtgcagaccacccctggcacctttaagacgcccgagggcgaggtgggtgctattgccctggacttcaagcccggcacttccggaagcccgatcgtcaaccgcgaagggaagatagtaggcctgtacgggaacggcgtggtcactaccagtgggacgtatgttagcgcaatcgcccaggctaaggccagccaggagggcccgttgcctgagatcgaagatgaggttttcaagaagcggaacctgaccatcatggacctccatcccgggtcggggaaaaccaggcggtatctacccgcgatagtccgcgaagctatcaagcgcaagttacggactctgatcctcgcccccacgcgcgtggtcgcctcggagatggccgaagcgctgaagggtatgccaatacggtaccaaacgaccgccgtcaagtccgaacacactgggaaagagatcgtcgacctgatgtgccatgcgacattcaccatgcgactcctgagccccgtgcgcgttccaaactacaacatgataatcatggacgaggcccacttcaccgaccccgcgtctatcgccgcccgtggttacatcagcaccagggttgggatgggggaggcagccgcgattttcatgacggcgacgccgcctggttccgtcgagagcttcccgcagtctaacgccgtcatacaggacgaggaaagagacatcccagagagaagctggaactccgggtacgattggattacagactttcccggaaagaccgtgtggttcgtgccctccatcaagtccggtaacgacatagccaactgcctgcgcaaaaacggcaaacgggtcatccagttgtcccgcaagacgtttgacaccgagtaccaaaagacgaagaacaacgactgggactacgtggtgaccaccgacatcagtgagatgggggctaacttccgtgccgaccgcgttatcgacccgcggaggtgcctgaagcctgtgatcttaaaggatggacctgagcgtgtcatcctcgcagggccaatgcctgtgaccgccgcctcagccgcgcagcgccggggccgcatcggcagaaaccagaacaaggagggggaccaatacatctacatgggccagcccctcaataacgacgaggaccatgcccattggaccgaggcgaagatgttattggacaacatcaacacccccgaggggatcatccccgccctgttcgagcctgagcgggagaagtccgccgcgatagacggggagtatcgcctgagaggcgaagcccgcaagacgtttgtggagcttatgcggagaggcgacctgccagtatggctgtcttataaggtggcctccgaaggttttcagtactccgacaggcgctggtgcttcgacggggagcggaacaatcaggtcctggaggagaacatggacgtcgagatatggacaaaggagggcgagaggaagaagttacggcccagatggctggacgcccgtacctacagcgaccctctcgcgttgcgcgagttcaaggagttcgcggccgggcggagatctgtgagcggtgacctgatcctagaaattggcaagctgccgcagcatttgactctccgggcccaaaacgcactggacaacttggttatgctccacaactccgagcagggcggaaaggcctaccgtcacgcgatggaagagttacccgatactattgagacgctaatgctcctggccctgatcgctgtcctcaccgggggagtgaccctgttcttcctctccgggaagggcctcggtaagacctcaattggcctgctgtgtgtcatggccagctccgtcctcctgtggatggccagcgtcgagccccactggatagcagcctccattattctggagttcttccttatggtgctgctgatccccgagccggatcggcagcgcaccccccaggacaatcagctcgcatacgttgtcattggcctcctgttcatgatcctcaccgtggctgcgaacgagatggggctattggagaccaccaagaaggacttgggcatcggacacgtcgtagccgaaaaccaccaccatgccacgatgctggacatagacttgcatcccgccagcgcctggactctctacgcagtcgccacgacaatcatcacgccgatgatgcggcacaccatcgaaaataccaccgccaacatctccctaacggcaatcgccaatcaggcggcgatcctgatggggctagataagggctggccgatcagcaaaatggacatcggggtccccctcctggccctcggctgctattcccaggtgaaccccctcaccctgaccgccgccgtgctcatgctcgtcgcgcactatgccatcattggcccggggctgcaggctaaagccacccgcgaagcacagaagaggaccgccgccgggatcatgaagaacccgacagtggatggcatcgtggcgatcgatctcgaccccgtggtttatgacgcgaagttcgagaagcagctgggccagatcatgctgttgatcctatgtacaagccagatcctactcatgcggaccacctgggcactgtgcgagtccatcacgttagccacagggcccttgaccacgctgtgggaagggagcccggggaagttctggaataccactatcgccgtgtccatggcgaacatcttccggggcagctacctggccggcgcggggttggcctttagtctgatgaaatccctaggcggaggccggcgagggaccggcgcccagggcgagactctcggggagaagtggaagcgacagctgaaccaactgagcaagtccgagtttaacacttacaaacgtagcggcatcatggaagtcgacagatccgaggccaaggaagggctcaagcgcggggagaccaccaaacacgcagtgtcccggggtacggccaaactccgatggttcgtggagcggaacctggttaagcccgagggaaaggtaatcgaccttggatgcgggaggggcggttggtcatactactgtgccggactcaagaaagtgaccgaggtcaaggggtacacgaaggggggaccggggcacgaggagcctatccccatggccacctacgggtggaacatcgtgaagctgcacagcgggcgggatgtgttctttacgccgcccgagaagtgtgacacgctgttgtgcgacatcggcgagtctagccccaacccgactatcgaggagggcagaacgctgcgggtgctgaagatggtggagccctggttaaggggcaaccaattctgcatcaaaatcctgaacccctacatgccttccgtggtggagaccctcgagcagatgcagaggaagcacggcgggatgctcgttaggaacccgctttcacgtaactccacgcacgagatgtactgggtaagctgcggcactggcaacattgtcagtgccgtgaacatgaccagccgcatgctgctcaatcgtttcacaatggcgcaccggaagcccacgtacgaaagggacgttgacctgggagccggcaccaggcatgtcgccgtggagcccgagattgccaacctggacatcatcgggcagcgcatcgagaacatcaagaacgagcataagagtacctggcactatgatgaggataacccctacaagacctgggcctaccatggcagctacgaggtgaagccgtccggaagcgcgtcctccatggtcaatggggtggttcgcctgctgacaaagccgtgggacgtgatccccatggttactcaaatcgccatgaccgataccacgccatttgggcaacagcgcgtcttcaaggagaaggtggacacccggacccctaggccaaagagaggcaccgcccagatcatggaggtgacggcaaaatggctgtggggcttcctcagccggaacaagaagccccggatctgcacccgtgaagaattcacccggaaggtccggtccaacgctgcgatcggtgccgtctttgtcgacgagaatcagtggaattctgccaaggaggccgtggaagacgaacggttctgggacctggtgcacagagagcgggagctgcacaaacagggaaagtgcgcgacctgcgtgtacaacatgatggggaaacgcgagaagaagctcggcgagttcggaaaggcgaagggcagccgggcaatctggtacatgtggttgggtgcccgcttcctggagtttgaggccctcggattcatgaacgaagaccactggttcagccgggagaactccttaagtggcgtagagggggagggcctgcacaaactcgggtacatactgcgcgacatcagtaaaatcccgggcggaaacatgtacgcggacgacactgccgggtgggatactcgcatcaccgaggacgacctgcagaatgaggccaaaatcacggacattatggagcccgagcacgccctcttagccaccagcattttcaagctcacctaccagaacaaagtggtacgggtacaacgccccgcgaagtccggtaccgtgatggacgtgatctcgagacgcgaccagcggggatccggtcaggtcggcacctatgggctcaacacattcacgaacatggaggtacagttaatccgccaaatggagagcgagggcattttcagtcccagcgagctggaaaacagcaacctcgccgaacgggtcttagactggctcgagaaacacggggtcgagcgccttaagagaatggccatcagcggcgacgactgcgtggttaaacctaccgacgaccgctttgccaccgcactgacggcgcttaatgacatgggcaaggtcaggaaagacatcccccagtgggagccatccaagggctggaacgactggcagcaggtacccttctgctcacaccacttccaccagctcatcatgaaggacggccgcgagatcgtggtaccgtgccggaatcaagacgagcttgtggggcgcgccagagtgagtcaaggggcggggtggtccctgcgcgagaccgcttgcctcggcaagagttacgcgcagatgtggcagctgatgtacttccaccgccgcgacttgagactagccgccaatgcgatctgctccgctgtcccagtgaactgggtcccgaccagccgcaccacctggtccattcacgcgcaccaccaatggatgacgaccgaagacatgctgagcgtctggaatcgggtatggatcgaagagaacccctggatggaagacaagacccacgtttccagctgggaagacgtcccctaccttggcaagcgggaggaccagtggtgcggttccctaattggactgaccgctcgcgccacgtgggccaccaacatacaggtggccatcaatcaggtacggcgcctgatcgggaacgagaactacctcgactacatgactagcatgaagcggttcaagaacgagagcgaccctgagggcgccctgtggtga

SEQ ID NO: 24745 - RNA, 9879 nt, synthetic construct
  misc_feature 1..9879: note = derived and/or modified CDS sequence (opt11) from DENV-1__KM403623__SS-prME
  source 1..9879: mol_type = other RNA
agcgtgacaatgctactcatgctgctgcccaccgccctcgccttccacctgacaacccggggcggggagccccacatgatagtgagcaagcaggagcgtggcaagagcctcctcttcaagacctccgcgggggtgaatatgtgcaccctgatcgccatggacctgggcgagttgtgtgaggacactatgacctacaagtgcccccggatcaccgaggccgagcccgacgatgtggactgctggtgcaacgccaccgatacctgggtgacctatgggacctgcagccagaccggtgagcaccggcgcgacaagcggtccgtggctctggccccccacgtgggcctgggcctcgagacccgcactgagacctggatgagctccgagggagcctggcggcagatccagaaagtggagacctgggccctgcgccaccccgggttcacggtgatcgcctttttcctggcgcacgccatcggcaccagcattacccagaaggggatcatctttatcttgctgatgctcgtgaccccatccatggccatgaggtgcgtcggcatcggcaaccgcgatttcgtggaggggctcagcggcgccacgtgggtggacgtcgtgctggagcacgggtcctgcgtgaccaccatggccaagaacaagcccaccctggatatcgagctcctgaagacggaagtaaccaaccccgcggtgctgcggaagctctgcatcgaggccaagatatcgaacaccaccactgactccagatgtcccacccagggtgaggccaccctggttgaggagcaagacgcaaacttcgtctgccggcgcaccttcgtggaccggggatgggggaacggatgcgggctgttcggaaaggggagcctcctgacgtgcgctaagttcaagtgcgtgaccaagctggaaggcaagatcgtccagtacgagaacctcaagtacagtgtgatcgtgaccgtccacaccggcgatcagcatcaggtggggaacgagacgaccgagcacggcacgatcgcgaccataacgccccaggccccgacgagcgagatccagttaaccgactacggggccttaaccctagattgcagcccccggaccggcttggactttaatgagatggtactgctcaccatgaaggagaagtcctggctggtgcacaagcagtggttcctggatctcccgctgccctggacctccggggccagcaccagccaggagacctggaaccggcaggacctgctcgtaacgtttaagaccgcccacgccaagaagcaggaggttgtggtgctgggctcccaggagggcgccatgcacacagccctgaccggggccacggagatccagacgagcggcaccacaaccatcttcgccgggcacctcaagtgccgccttaaaatggacaagctgaccctcaagggcgtctcctatgtgatgtgcaccgggagcttcaagctggagaaagaggtggcggagacccagcacggcacggtccttgtccaggtgaagtacgaggggaccgacgccccctgcaagatcccgatctccacccaggacgagaagggggtcacccagaatgggcgcctgattacggcaaacccgatcgtgaccgacaaagagaagcccgtcaacatcgagacggaaccgcccttcggcgagagctatatcgtcataggtgccggcgagaaggcgctcaagctctcctggttcaagaaggggagctccattgggaagatgtttgaggccaccgcccgcggggctcggcgcatggccatcctgggcgacacggcgtgggacttcggcagcataggcggcgtgttcacctccgtggggaagctcgtccaccaggtctttggcacggcctacggggttctgttcagcggcgtgtcctggaccatgaagatcgggatcggcatcctactgacgtggctgggcctgaacagccgctccaccagcctctccatgacctgcatcgccgtggggatggtgaccctgtacctgggtgtcatggtgcaggccgacagcgggtgcgtgatcaactggaagggccgagagctcaaatgcgggtccggaatctttgtcacgaacgaagtccacacttggaccgagcagtacaagttccaggccgacagcccgaagcgcctgagcgcggccatcggcaaagcctgggaggaaggggtgtgtggcatccggagtgccacccgactggagaacataatgtggaagcaaatcagcaacgagctcaaccatatcctgcttgagaacgacatgaagttcaccgttgtggtgggtgacgccaacggcattctcacgcaggggaaaaagatgatccggccccagcctatggagcacaaatactcctggaagtcctggggcaaggcgaagattatcggcgccgacactcagaacaccaccttcatcatcgacgggccggacacgccggagtgccccgacgaccagcgcgcctggaacatctgggaggtcgaggactacggcttcggagtgtttaccaccaatatctggctgaagctgcgggactcctacacccagatgtgcgaccaccgcctcatgagcgctgcaatcaaggactccaaggccgtgcacgccgacatgggctattggatcgagagcgaaaagaacgagacgtggaagctggcccgggcctccttcatcgaggtcaagacctgcatatggccccgaagccacaccttgtggtccaacggcgtgctcgagtccgagatgatcatccccaaaatctacgggggcccgatctcccagcacaactaccggcccgggtacttcacccagacggcgggcccctggcacctagggaagctggagctcgatttcaatctatgcgagggcaccaccgtggttgtggacgagcactgcggcaaccgcgggccgagcctgcggaccacgaccgtgaccggtaagatcatccacgaatggtgctgccgctcttgcaccttgccccccctgcggttccgcggggaggacggctgctggtatgggatggagatccggcccgtcaaggagaaggaggagaacctggtacgcagcatggtgtccgccggcagcggcgaggtcgacagcttctccctagggctgctgtgcgtaagcatcatgatcgaggaggttatgagatcccgctggtcccgcaagatgctcatgaccggcaccctggccgtattcttcctgctcatcatgggccagttgacctggaacgacctgatcagactctgcattatggtgggcgccaatgtgtccgaccgcatggggatgggcaccacgtacctggccctgatggcgaccttcaagatgcggccgatgtttgccgtgggtctcctgttccgacggctaaccagcagggaggtcctcctgctcaccatcgggctctcgctggtcgctagcgtggagctgcctaactccctagaggagctgggcgacggcctggccatgggcattatgatgctcaagctgctgaccgacttccagagccaccagctctggaccaccctgctgagtctcaccttcatcaagacgaccctgagcctggactacgcctggaagaccatggcgatggtcctatctatcgtctctctgttccccctgtgcctctcaaccacgagccagaagacgacctggctgcccgtgctgctcgggtccttcgggtgcaagccgttgaccatgttcctgatcaccgagaacaagatctggggccgcaagagctggcctctcaacgaaggcatcatggccgtgggtatcgtctccattctgctgagcagcttgctgaagaacgatgtgcccctggccgggcctctcatcgctggcggtatgctgatcgcctgttacgtgatatccgggagctccgccgacctgagcctcgaaagagccgccgaggtctcctgggaggaagaggcggaacacagcggcgcgtcgcacaacatcctggtggaggtgcaggacgacgggacgatgaagatcaaggacgaggagcgggacgatacccttaccatcctcctgaaggccactctgcttgccgtgtcaggcgtgtacccgatgtcaatacccgccacgcttttcgtgtggtacttttggcagaaaaagaaacaacgaagcggggtcctgtgggacactccctcgccgcccgaggtggagcgggccgtgctcgacgacggcatctacagaatcctccagcggggcctcctggggcgcagccaggtcggcgtgggcgtgttccaggacggcgtcttccacacgatgtggcacgtgacacgcggcgccgtgcttatgtaccagggcaagcgcctggagccctcctgggccagcgtcaagaaggacctgatctcctacggcgggggctggaggttccagggcagctggaacacgggagaggaagtccaggtgatcgccgtagagcccgggaagaaccccaagaacgtacagaccaccccaggcaccttcaagacgccagagggcgaggtgggggccatcgccctcgacttcaagccgggcacctccgggtcacccatcgtaaatcgcgagggcaagatcgttggcctgtacgggaacggcgtggtaaccacctccgggacgtacgtgagcgcgattgcccaggccaaggccagccaggaaggcccactgcccgaaatcgaggacgaggtgttcaagaaacggaacctcacaatcatggacctgcaccccggttccggtaagacccgccgttacctgccggccatcgtccgcgaagcgatcaagcgcaagctccggaccttaatcctcgcacccacgagggtggtggccagcgagatggccgaggccctcaagggcatgcccattcggtaccagaccaccgcggtcaagagcgagcacaccgggaaagagattgtggacttaatgtgccacgccacgttcaccatgcgcctgttatcgcccgtgcgggtcccgaactacaacatgattatcatggacgaggcccacttcaccgaccccgcctccatcgccgcccgcggctacatcagcacccgggtggggatgggagaggcggccgccatctttatgaccgcgacaccccccgggtccgtggagtccttcccgcagtccaacgcagtcatccaagacgaagagcgcgatatacccgaacgcagctggaactccggctatgactggatcaccgacttccccggcaagaccgtctggttcgtgcccagcattaagtccgggaacgacatcgccaattgtctgcgcaaaaacggcaagcgggtcatacagctgagccgcaaaacgttcgataccgagtaccagaaaaccaagaacaacgactgggactacgtggtaacgacggacatctcagagatgggggccaacttccgggccgaccgcgtcatcgatccacggcgctgcctcaagcctgttatcctgaaggacggtccagagcgggtcatcctggccgggcccatgccggtgaccgccgcgagcgccgcgcagcgccggggccgcatcggccgaaaccagaataaggagggggaccaatacatctatatgggccagcccctcaacaacgacgaggaccacgcccactggaccgaagccaagatgctgctggacaatatcaacacgcccgaagggatcattcccgccctcttcgagccggagcgggagaagtccgccgcgatcgacggcgagtacagactgcgcggggaggcgcgcaagacgttcgtggagctgatgcggcgcggcgacctgcccgtttggctgagctacaaggtggcttccgagggcttccagtactcagaccggagatggtgcttcgacggggagcggaacaaccaggtgctggaggagaacatggacgtcgagatctggaccaaggagggcgagaggaagaagctccggccccgctggctggacgcacggacatactccgaccccctggccctccgcgagttcaaggaattcgccgccgggaggcgcagcgtgagcggcgacctgatcctcgagattggcaagttgccccagcacctgacgctgcgggcccagaacgcccttgacaacctggtgatgctgcacaactccgagcagggcgggaaggcctaccgccacgcgatggaggaactccctgataccatcgagacgctgatgttactcgccctgatcgcagtcctgacggggggcgtcaccctttttttcctgagcgggaaaggcctgggcaaaacatccatagggctcctgtgcgtgatggccagctccgtcctgctctggatggcgagtgtagaaccccactggatcgccgccagcatcatcctagagtttttcctgatggtgctactgatccccgagccggaccggcagcgcactccccaggacaatcagctggcctacgtcgtgatcggcctcctgttcatgatcctgaccgtggccgctaacgagatggggctcctggagaccaccaagaaggacctgggaatcgggcacgtcgtggcggagaaccaccaccacgccacgatgctcgacatcgacctgcatcccgcctctgcctggaccctgtacgcggtggccaccaccatcatcacgccaatgatgagacacaccatcgagaacaccaccgccaacatctccctcacagccattgccaaccaggcagccatcctgatgggactggacaagggctggccaatctctaagatggacatcggtgtccccttgttagccctgggctgctattctcaggtgaatcccctcaccctgaccgccgccgtgctgatgctcgtcgcgcactacgccataatcgggccgggcctgcaggccaaggccacccgcgaggcgcagaagagaacggccgccgggatcatgaagaaccccaccgtggacggaatcgtggccatagacctggaccccgtcgtgtacgacgccaagttcgagaaacagttagggcaaatcatgctgttgatcctctgcacctcacagatcctgttaatgcgtaccacgtgggcgctctgcgaatccatcaccctggccaccgggcctctgaccacgctctgggagggcagcccgggtaagttctggaacactaccatcgccgtgagtatggccaacatctttcgcggcagctacctggccggcgcggggctggcattctcactcatgaagtcactgggcgggggccggcgcggtaccggagctcagggcgagacgctgggggagaagtggaagcggcagctgaaccagctgagcaagtcggagttcaacacctacaagcgatcgggcatcatggaggtcgaccggagtgaggccaaggaggggctgaagcgcggcgagaccaccaagcacgccgtgagccgggggacggcgaagctccgctggttcgtggagcggaacctggttaagccagagggcaaggtgatcgacttgggctgcgggcgcggcgggtggtcctattactgcgccggcctgaaaaaggtgaccgaggtcaaggggtacactaagggcggccccgggcacgaggagcccatcccgatggccacctacggctggaacatcgtgaagctccacagcggacgggacgtattcttcacgccgcccgagaagtgcgatacattactgtgtgatatcggcgagtccagtcccaacccgaccatcgaggagggacgcaccctcagggtccttaagatggtggagccctggctgcgtggcaaccagttctgtatcaaaatcctcaacccgtacatgccctccgtggttgagaccttggagcagatgcagcggaagcacggcgggatgctggttcgcaatccgctcagccggaactcgacgcacgagatgtactgggtgtcgtgcggcaccgggaacatcgtctccgccgtgaacatgacgagccgcatgctgctgaaccgctttaccatggcccaccggaaacccacgtacgagcgcgacgtggacctaggcgccggtacccgacacgtcgcagtggagcccgagatcgccaatctcgacatcatcggacagcgcatcgagaacatcaagaacgagcacaaatccacctggcactacgacgaggacaacccctataagacatgggcataccacggctcctacgaagtgaagccgtccgggagcgcgtccagcatggtcaacggcgtggtccgtctgctcactaagccctgggacgtcatccccatggtgactcaaatcgccatgaccgacaccacgcccttcgggcagcagcgcgtcttcaaggagaaggtggacacccggacgccacgccccaagcggggcaccgcccagatcatggaggtgacggccaaatggctgtggggcttcctgagccgcaacaagaagccccggatctgcacccgcgaggagtttactcggaaggtccgctccaacgccgcgatcggtgccgttttcgtggatgagaaccagtggaacagcgccaaggaagccgtcgaggatgagaggttctgggacctcgtgcaccgcgaacgggagttgcacaagcagggcaagtgcgcgacttgcgtgtacaacatgatggggaagcgcgagaagaagctcggcgagttcgggaaagcgaagggctcccgggccatctggtacatgtggctcggcgcccgctttctggagttcgaggcccttgggttcatgaacgaggaccactggttctcgcgggagaactcgctgtcgggtgtagagggggagggcctgcacaagctcgggtatatactccgcgacatcagcaagattccaggcggcaacatgtacgcggacgatacggccgggtgggacacgcggatcaccgaggacgacctgcagaacgaagccaagatcaccgacatcatggagcccgagcacgcactgctcgctacgagcatcttcaagctgacctaccagaacaaagtagtacgggtccagcgccccgcgaagtccggcacggtgatggacgtgatctctagacgcgaccagcggggctccggccaggtcggcacctacgggctaaacacgttcaccaacatggaggtgcagctcatccgccagatggaaagcgagggcatcttctccccatctgagctggagaacagcaacctggccgagcgcgtgctcgactggctggagaagcacggggtcgagagactgaagcgaatggccatcagcggcgacgactgcgtggtaaagcctacagacgaccgcttcgccaccgccctcacggcgctgaacgacatggggaaggtccggaaggacatcccccagtgggaacccagtaagggatggaacgactggcaacaggtccctttctgcagccaccacttccaccagctgatcatgaaggacggccgcgagatcgtggtcccgtgccggaaccaggacgagctcgtggggcgcgcccgagtgagccagggcgccgggtggtccctgagagagaccgcctgcctgggcaaatcctacgcccagatgtggcagctcatgtacttccaccggcgcgatctgcggttagctgcaaacgccatctgctccgccgtccccgtgaactgggtccccaccagccgcaccacttggtccatccatgcccaccaccagtggatgacgaccgaggatatgctctctgtctggaaccgcgtgtggattgaggagaacccctggatggaggacaagacccacgtgtctagctgggaagacgtcccgtatctggggaaacgggaggaccagtggtgcggctcccttatcggcctcactgcgcgcgccacatgggccaccaacatccaggtggccatcaaccaggtgcgccgcctgatcgggaacgagaactacctggactacatgacctcgatgaagcggtttaagaacgagtctgaccccgagggcgcgctctggtga

SEQ ID NO: 24746 - RNA, 9879 nt, synthetic construct
  misc_feature 1..9879: note = derived and/or modified CDS sequence (opt11) from DENV-1__KM403575__SS-prME
  source 1..9879: mol_type = other RNA
agcgtgaccatgctgttgatgctactgcccaccgccctcgccttccatctgaccaccaggggcggggaaccccacatgatagtgagcaaacaggagaggggtaaatcgctcctctttaagacgtccgcaggggtgaacatgtgcacactgatcgccatggacctgggcgagttatgcgaagatactatgacctacaagtgccccagaatcaccgaggccgagccggacgatgtggactgctggtgcaacgcaaccgacacatgggtgacctatgggacctgcagccaaaccggcgagcaccgacgcgacaagcggtccgtcgccctggcgccccatgtgggcttaggtctcgaaactcgcaccgaaacctggatgagctccgagggcgcttggcggcagatccagaaggtggaaacctgggcgctgcgccaccctgggttcacggttattgcacttttcctcgctcacgctattgggacaagcatcactcagaaggggatcatcttcatcctgctgatgctcgtgaccccctccatggccatgcggtgtgtcggtatcggcaaccgcgacttcgtggaggggctgagcggcgccacgtgggtggacgtcgtgcttgagcacggatcatgcgtgaccaccatggccaagaacaagcccacattggatatcgagctgctgaagacggaagttaccaaccccgcggtcctccggaagctgtgcattgaggcgaagatctctaataccaccacggattcccgttgccccacgcagggcgaggccactctggtggaagaacaagacgccaacttcgtttgcagacgcacgttcgtcgaccggggctggggtaatggctgcggactcttcggtaaggggagcctcctaacctgcgccaagttcaagtgcgtgaccaagctcgaagggaagatcgtccagtacgagaacctcaagtactccgtaatcgtgaccgtccacaccggtgaccagcaccaagtggggaacgagacgaccgagcacggaaccatcgcgaccataacgccccaggccccgacgagcgaaattcagttgaccgactacggcgccctcaccctggactgcagcccccgtaccggtttggatttcaacgagatggtccttttaacaatgaaagaaaagtcctggctcgtgcacaagcaatggttcctagacctaccgctgccctggacttccggggccagcactagccaggagacctggaacagacaggacctcctggtaactttcaaaacggcccacgcaaagaagcaagaagtcgtggtgctgggatcccaggagggcgccatgcacacagccctcaccggtgccacagaaatccagaccagcggcaccaccacgattttcgcaggccacctgaagtgccgcctaaagatggacaagttaacgctgaaaggcgtctcgtacgttatgtgtaccgggagcttcaaactggagaaggaggtggcagaaacccaacacgggaccgtgctggtccaggtcaagtatgaagggacggacgccccctgcaaaatccccatctccacccaggacgaaaagggcgttacccagaacggacggctcatcacggccaatcctatcgtgaccgacaaggaaaagcctgttaacattgagaccgagcctcccttcggggagagctacatcgtcataggagccggcgagaaggccctgaagctgtcctggttcaaaaaggggtcgtccattggcaaaatgttcgaggccaccgccagaggggcccggcgcatggcaatattaggcgacacggcgtgggacttcgggtcaatcggcggcgtgttcacctcagtggggaagctagtccaccaggtattcggcaccgcttatggtgtcctgttcagcggcgtctcctggaccatgaagataggtattggcatattgttgacgtggctgggcctcaatagccgctccacctcactgtccatgacctgtatcgccgtgggaatggtgaccttgtacctcggtgtcatggtccaggcagacagcgggtgtgtgatcaactggaaggggcgagaactaaagtgcgggtccggcatcttcgtcactaacgaggtgcacacctggactgagcaatacaaatttcaagccgatagcccgaaacgcctaagcgcggctatcggcaaggcatgggaggagggcgtgtgtggaatccggtccgccactagactcgagaacataatgtggaaacagattagcaacgaactgaaccacatcttactcgagaatgatatgaagttcaccgtcgtagtgggggatgcaaacggcatcctcacgcagggcaaaaagatgattagaccacagcccatggagcacaagtactcctggaaaagctggggaaaggcgaagattatcggagccgatacccagaacacgacctttatcattgacggcccggacacgccagagtgccccgacgatcagcgcgcgtggaatatttgggaggtggaggactacggcttcggggtgttcaccacaaacatatggctgaagctcagagattcttacacccagatgtgcgaccatcgcctgatgtcagccgcaattaaagactctaaagccgtgcacgccgacatgggctactggatcgaaagtgagaaaaatgagacgtggaagttggccagggcctccttcatagaggtcaagacatgtatctggcccaggagccacaccttgtggtccaacggggttcttgagagcgaaatgatcatccccaagatctacggcggcccgatatcccaacataattacagacccgggtacttcacccagaccgctggcccttggcacctggggaaactcgagctggacttcaatctgtgcgagggcaccaccgtggtcgtggacgagcactgcggcaatcgcggtccgtcactccggaccaccactgtgactgggaagatcattcacgagtggtgctgccgctcttgcaccctgccgccccttcgtttccggggagaggatggctgctggtatggaatggagataagaccggtcaaggaaaaggaagagaacctagtgcgcagtatggtttccgccggcagcggcgaggtcgacagcttctcattaggccttctctgtgtgagcattatgatcgaggaagtgatgcggagcagatggtctagaaagatgctgatgacgggcaccctagcagtcttcttccttctgatcatggggcagctgacctggaacgatctcatcaggctgtgcataatggtgggtgccaacgtgtctgaccgcatgggaatgggcacaacctatctggcactgatggcgaccttcaagatgcggccgatgttcgccgtcggtctgctgttccgtcggctcaccagtcgcgaagttctgctgttgacgatcgggctgagcctggtggccagcgtggaactccccaactccctggaagaactgggcgacgggctagcaatgggtatcatgatgctgaagctcctcacggacttccaaagccaccagctgtggaccactctgctctccctgacctttatcaagacgaccctgtcgctggactacgcctggaagacaatggcgatggtgctgagcatcgtcagtttgttccccctctgcctgtccaccacgtcccagaagaccacctggctgcccgtgttgttgggctccttcgggtgcaagcctttaactatgttcctcataactgaaaataagatctggggacgcaagagctggccccttaacgaggggatcatggccgtgggaatcgtgagtatcttgctcagtagcctgctgaagaatgatgtgcccctcgcgggtcccttgattgccggcggaatgcttatcgcgtgttacgtgatatccggcagctccgctgacctgagcctggagcgagccgccgaagtctcctgggaagaagaggccgagcacagcggcgcgtctcacaacatcctggtggaagtgcaggatgatggaacgatgaagatcaaggacgaggagcgggacgataccctcaccattctgctcaaggccactctattggccgttagtggggtgtatccgatgtccatcccagcgacgcttttcgtctggtacttctggcagaagaaaaagcagcgcagcggagtcctctgggacacccccagcccgcccgaggtcgaaagggccgtgcttgacgacgggatctaccggatcctgcagcggggcctgctcgggagatcgcaggtcggtgtgggtgtcttccaagacggggttttccacacgatgtggcatgttacgcgcggtgcggtgctgatgtaccaaggcaaacgcttagaaccctcctgggccagcgttaaaaaggacttgatttcttatggtgggggctggaggtttcaagggagttggaacacgggcgaggaggtgcaggtaatcgccgtcgaacccgggaagaatccgaaaaacgtacagacaacacctggcacgttcaagacgcccgagggcgaggtgggagccatagccctggactttaagcccggcacctccggatctccaatcgtcaatcgcgagggaaagatcgtaggcctatacgggaacggtgtcgttaccacctctggtacgtacgtgagcgcgatcgcccaagccaaggccagccaagagggcccgctacctgagatcgaagacgaagtattcaagaaaagaaacctcacgatcatggacctacaccccggttccggcaagacccgtcggtacctacccgccatcgtccgagaggcgattaaacgcaaactacgtacgttgatcttggccccgacgcgggtggtggccagcgagatggccgaggcactgaaaggcatgcccatccggtaccagactaccgccgtaaaatccgagcacacggggaaggagattgttgacctgatgtgccacgcgacgttcaccatgagactcctgagccccgtgagagtcccgaactataacatgatcataatggacgaggcccacttcaccgaccctgcctccatcgccgcccgcggatacatcagcacgcgcgtgggaatgggcgaggccgccgcaatcttcatgacggcgaccccgcccgggagtgtggaggcttttccgcagtccaacgccgtcatacaggacgaggagcgagacatacccgagcgaagttggaactcgggttacgactggatcaccgacttccccggcaagaccgtgtggttcgtgccctccatcaagagcgggaatgacatcgccaactgcctgcgaaagaatgggaagcgggtaatccaactcagtaggaagacgttcgacacggagtaccagaagaccaagaacaacgactgggactacgtggttacgacggacatcagcgagatgggagccaacttcagagccgaccgcgtgatagacccgaggcgctgcctgaaacctgtgatactgaaggacggtcccgagcgggtcattttagccgggcccatgcccgtgacggcagcatccgcggcccagcgccggggccggatcggccgcaaccagaacaaggagggtgaccaatacatctatatgggccagcccctcaacaacgacgaagaccatgcccactggacggaggctaagatgttactcgataacataaacacccccgaggggataatccccgccctcttcgaaccggagcgggagaaaagcgccgccattgacggcgagtaccgcctgcgcggagaggcccgcaaaacgttcgtcgagctgatgcgccgcggcgacctgcctgtctggctgtcatacaaggtggccagcgagggcttccagtactcggaccggcgctggtgcttcgatggcgagagaaacaatcaagtgctagaggagaacatggacgtagagatctggaccaaggaaggcgagcgcaagaagctgcgccccaggtggttggacgcgcggacatacagcgacccactcgcactgcgcgagttcaaagagttcgcggccgggagacgttccgtctccggcgacctgattttagaaatcggcaaattgccgcaacacctgaccctcagagcacaaaacgccctcgacaacctggtaatgctgcacaatagcgagcagggcgggaaggcataccgacacgcgatggaggagctgcccgacaccatcgaaacgttgatgctcctggccctgatcgcggtcctcacaggcggtgtgaccctgttcttcttgtcggggaagggcctcggaaagaccagtattgggctgctgtgcgttatggcctccagcgtcctgctgtggatggcctccgtggaaccgcattggatcgccgcctctatcatcttagagttcttcctcatggtgctgttaatcccggagccggatagacaacggacgccccaagacaatcagctcgcctatgtcgtgatcggcctgttgttcatgattctaaccgtggctgccaacgagatggggcttctggaaaccaccaagaaggacctcggcatcgggcacgtcgtggccgagaaccaccaccacgccacgatgctggacattgacctgcaccccgcatccgcatggacattatacgctgtggcaaccaccattatcacccccatgatgcggcacactatcgagaacaccaccgccaacatttcgctgacggcgatcgctaatcaggccgcaatcttaatgggcctcgacaagggctggccaatctccaagatggacattggggtccccctgctggccctcggctgttacagccaggtgaaccctttaaccctaactgccgcggtgctcatgctggtggcccattacgctatcatcgggccgggcctgcaagccaaagcgacccgggaggctcagaaacgcacggccgccgggatcatgaagaaccccacggtggacggcatcgtcgccatcgatcttgacccggtcgtgtacgacgcgaagttcgagaagcagttaggtcagattatgttgttaatcctgtgcacctcccagattctgctcatgagaaccacgtgggcgctgtgcgagagcatcacgctggcgactgggcccctcactacgttgtgggaggggagcccggggaagttctggaacaccactatcgcagtgtccatggcaaacatcttccgcggttcctacctggcaggcgccgggctcgccttcagccttatgaagtcgttaggcgggggccggcgagggaccggcgcccaaggcgagacgctcggggagaaatggaagcgccagctgaaccagttaagcaagagcgagttcaacacatacaagagatcgggtatcatggaggttgacagaagcgaggctaaggaagggctcaaacgtggcgagaccacaaagcacgcagtgtccagagggacggccaagctgcgctggttcgtggaacggaacctggtgaagcccgagggcaaggtgatcgacctggggtgcgggcgcgggggctggagctactactgcgccggcctcaaaaaggtgaccgaggtgaaggggtacacgaaaggcggccccggtcacgaggagccaatcccgatggccacctacggctggaatatcgtcaagctgcattccggccgagacgtgttcttcacgccgcccgaaaagtgcgacactcttctctgcgacatcggcgaaagctcccccaacccaaccatcgaagaagggcgcaccctgcgtgtcttgaagatggtcgagccatggctccgtggcaaccagttttgcatcaagatccttaacccttacatgcccagcgtggtcgagaccttggagcagatgcagcgaaaacacggcgggatgttagtccgcaatccactgtcccggaacagcacacacgagatgtactgggtgtcctgcggtacaggtaacatagtctccgccgtcaacatgacctcccgcatgctgctcaatcgtttcaccatggcccaccggaaacccacgtatgagcgcgacgtggatttgggcgcggggactcggcacgttgccgttgagccagaaatcgccaacctggatatcatcgggcagcgcatcgaaaacatcaaaaatgagcacaaaagcacctggcactacgatgaggataacccctacaaaacttgggcctaccacggctcttacgaagtcaagccttcaggttccgcttcctccatggttaacggagtggtccggttgctgacaaagccctgggatgtaatcccgatggtgacccagatcgccatgacagacaccacgcccttcggccagcagagggtcttcaaggaaaaggtggacacgcggaccccgcgcccgaagaggggcacagcccagattatggaggtgacggccaagtggttgtggggcttcctctctcggaacaagaaaccccggatatgcactagggaggagttcacccggaaggtaaggagcaatgccgccattggagccgtgtttgtggacgagaaccagtggaactctgccaaggaggccgtcgaggacgaacggttctgggacctcgtgcatagagaacgggaactgcacaagcagggaaagtgcgcgacctgcgtttataacatgatggggaagcgggagaagaagctaggtgagtttgggaaggccaagggaagccgggcaatttggtatatgtggctgggggcacgcttcctggagttcgaagcattggggttcatgaacgaggaccattggttttctcgggaaaacagcctgtcgggagtcgagggggagggcctccacaagctcgggtacattctgcgcgacatcagcaaaatccccggcggaaatatgtatgccgatgatacggccggttgggacacccgcataaccgaagatgacttacagaacgaggcgaaaataaccgacatcatggagccggagcatgccttgttagctacgtctattttcaagctgacctaccaaaacaaggttgtccgcgtccagcggcccgccaagagcggcaccgtaatggacgtgatttcccgacgcgaccagcggggaagcggccaggtcggtacgtacgggctgaacaccttcaccaacatggaggttcaactgatccgtcagatggaatccgaagggattttcagcccttctgagctggagaactccaacctggccgagcgcgtactggactggctcgaaaaacacggcgttgaacgcctcaagcgaatggcaatctcaggcgacgactgcgtggtgaagccgaccgacgaccgctttgccaccgctcttactgctctcaacgacatgggaaaggtcaggaaagacatccctcagtgggagccgagcaagggctggaacgactggcaacaggtccccttttgctcccaccactttcaccagctcatcatgaaggacggccgcgagatcgtggtcccgtgccggaaccaggacgaattagtggggcgcgctagagtgtcccagggagccggctggagcctgagggaaaccgcctgcctcgggaagtcctacgcgcagatgtggcagctgatgtacttccaccgccgcgacctgcggctcgccgccaatgccatctgcagcgccgtgccggtgaactgggttcccacatcacgcacgacctggagcatccacgcgcaccaccagtggatgacgactgaagacatgctctccgtctggaaccgcgtttggatagaggaaaacccttggatggaggacaagacgcatgtgagctcctgggaggatgtcccctacctgggcaaacgagaggaccagtggtgcggcagcctcatcggcctcaccgcccgcgctacttgggccaccaatatccaggtagctatcaatcaggtgcggcgcctgattgggaatgaaaactatctcgactacatgacctccatgaagcggttcaagaacgagagcgaccccgagggtgccctgtggtga

SEQ ID NO: 24747 - RNA, 9879 nt, synthetic construct
  misc_feature 1..9879: note = derived and/or modified CDS sequence (opt11) from DENV-1__KM403586__SS-prME
  source 1..9879: mol_type = other RNA
agcgtaaccatgctgctcatgctgctccccacggcattggcattccacctgaccacaagaggcggggagccccacatgatcgtgagcaagcaggagcggggcaaatctctcctcttcaagacctccgcgggggtgaatatgtgtaccctgattgccatggacttaggcgagctgtgcgaggacacgatgacgtacaaatgcccccggattactgaggccgagcccgacgacgtagactgttggtgcaacgccacagatacctgggttacatacgggacctgctcacagaccggcgagcaccggcgcgacaagcgttccgtagccttggcgccgcatgtgggcctaggcctcgagacccgcaccgagacctggatgtcctccgagggcgcctggcggcaaattcagaaagtcgagacctgggctctccgccaccccgggttcacggtgatcgcgttcttcctggcgcacgccatcggcaccagcataacccagaaagggattatcttcatcctcctgatgttggtgaccccttccatggctatgcggtgtgtgggaatcgggaaccgcgacttcgtggaggggctctccggcgccacgtgggttgacgtcgtgctggagcacgggtcctgcgtgaccacaatggccaagaacaagcccaccctggacatcgagctcctgaagacggaggtcaccaaccccgcggtgctgcggaagctgtgcattgaggccaagataagcaacaccaccacggacagtcgctgccccacccagggcgaggcgaccctggtggaggagcaggacgcgaacttcgtctgccggcgcaccttcgtggaccggggctggggcaatggctgtgggctgttcggtaaggggagcctcctgacgtgtgccaagttcaaatgcgttaccaagctggagggcaaaatcgtccagtatgagaacctcaagtatagtgtgatcgttaccgtccacaccggcgaccagcatcaagtgggtaacgagacgacggagcacggcacgatagcgaccataacgccccaggcccccacatctgaggtccagctgaccgattacggggcgctgaccctcgactgcagcccccggaccgggctggacttcaacgagatggttctgctcacgatgaaggagaagtcctggctggtgcacaagcagtggttcctggacctcccgctgccctggacatccggggccagcacctctcaggagacctggaaccggcaggacctcctcgtaacgttcaagaccgcccacgcgaagaagcaggaagtggtggtcctgggctcccaggagggcgccatgcacaccgccctcaccggggctactgagatccagaccagcggcaccacgacgatctttgccgggcacctcaagtgccgcttaaagatggataagctgacgctcaagggcgtgtcctatgtgatgtgcacggggagcttcaagctggagaaggaggtcgcagagacccagcacggcacagtgctggtgcaggtcaagtacgagggtaccgacgccccctgcaagatacccatctcgacccaggacgagaagggggtgacccaaaacggccggctgataacggccaacccgatcgtgaccgacaaggagaaacccgtcaacatcgagaccgagccgcccttcggggaatcatacattgtgatcggcgccggtgagaaagcgctcaaactctcttggttcaagaagggcagctccatcggtaagatgttcgaggccaccgcccgcggggcccggcgcatggccatccttggcgacacggcgtgggacttcggtagcatcggcggtgttttcacgtccgtcggcaagctcgtgcaccaggttttcggcaccgcctacggggtcctgttcagcggagtgagttggaccatgaagatcgggatcggcatcctactcacgtggttaggtctaaacagtcgctccactagcctctccatgacctgcatcgccgtggggatggtcacgctctacctgggcgtgatggtacaggccgacagcgggtgcgttatcaactggaagggccgggagctcaagtgcggttccggcatcttcgtgacgaatgaagtgcacacatggaccgagcagtacaagttccaggccgacagcccaaagagactgagcgcggccatcggtaaggcgtgggaggagggggtctgcggcatccggtccgcaacccggctggagaacattatgtggaagcagataagcaacgagctcaaccacatcctgctcgaaaacgacatgaagttcaccgtggtggttggggatgcctacggtatcctcacacaggggaagaagatgatacgcccccaacccatggagcacaagtactcgtggaagtcatggggcaaggctaagatcatcggcgccgacacccagaacacaacctttatcatcgacggacccgacacgccggagtgcccagacgaccaacgcgcttggaacatctgggaggtagaggactacggcttcggggtatttacaaccaacatatggcttaagttacgggactcctacacccagatgtgcgaccatcgtctcatgagcgccgcaattaaagacagtaaggccgtccacgccgacatgggctactggattgagagcgagaagaacgagacgtggaagctggcccgggcctcctttatcgaagtgaagacatgcatctggccccgcagccacaccctgtggtcaaacggcgtgctcgaaagcgagatgataatccccaagatctacgggggcccgatcagtcagcacaactaccggcccgggtacttcacccaaacggcgggcccctggcacctggggaagttggagctcgacttcaatctgtgcgagggcaccacggtcgtggtggacgaacactgcggcaaccgcgggcctagcctgcggaccaccacagtcaccgggaagatcatccacgagtggtgctgccgatcctgcaccctgccacccctgcggttccgcggggaggatgggtgctggtacggtatggagatacggcccgtgaaggagaaggaggagaacctggtgcgcagcatggtctccgcggggagcggcgaggtcgacagcttctccttaggtttgctttgtgtatcaatcatgatcgaggaggtcatgcggtcccgctggtccagaaagatgctcatgacggggactttagccgttttcttcctgctcattatggggcagctgacctggaacgacctgatccggctctgtattatggttggcgccaatgtctccgaccgcatggggatgggcaccacgtaccttgccctgatggcgacattcaagatgcggccgatgtttgccgtgggcctcctgttcagacggctgacatcgcgcgaagtcctcctgttaaccatcgggctctccctggtggcctcggtggagctgcccaactccctcgaagagctgggcgacgggctcgccatgggcatcatgatgctcaagctgctgacggacttccagagccaccagctctggaccaccctgctgtccctaaccttcattaagacgaccctgagcctggactacgcctggaagaccatggcgatggtcctctccatcgtgagcctgttcccgctgtgtctctccactacttcccagaaaaccacctggcttcccgtgctgcttggttcctttggctgcaagccgctgaccatgttcttgattaccgagaacaagatatggggccgtaaaagctggcccctcaatgaggggattatggccgtaggcatcgtgtctattctgctcagctcactgctgaagaacgacgtacccctggcagggcccctcatcgctggcggcatgctgatcgcgtgctacgtcatcagcgggagctccgccgacctgagcctcgagcgagccgccgaagtgtcctgggaggaggaagccgagcacagcggcgcgagccacaacatcctggtggaggtccaggacgacgggacgatgaagatcaaagacgaggagcgggacgacacactgactatactcctgaaggccaccttgctcgccgtgagcggcgtgtacccgatgtccatccccgccacattattcgtctggtatttctggcaaaagaagaagcagaggagcggcgtcctgtgggacacccccagcccgccagaggtggagagggccgttctcgacgatggcatctaccggatcctgcagcggggcctgctgggccgcagccaggtgggcgtgggggtattccaggacggagtgttccacaccatgtggcacgtgacccgcggggcggttctaatgtaccagggcaagcgcctagagccctcctgggcctcggtgaagaaggacctgatctcttacggcgggggatggcgattccaggggtcgtggaacacgggcgaggaggtgcaagtcatagcagtcgagcccgggaagaaccccaaaaacgtccagacgacccccggcacattcaagacgcccgagggcgaggtcggggccatcgccctagacttcaagcccggcacctccgggagccccatcgtgaaccgcgagggcaaaatcgtgggcctgtacggaaacggtgtcgtgaccacatccgggacgtacgtcagcgcgatcgcccaggccaaggccagccaggaaggaccgctccccgagatcgaggacgaggtctttaaaaagcggaacctcaccatcatggacctgcaccctgggtccggcaaaacccgccggtacctgccggcaatcgtgcgcgaggcgatcaagcgcaagctccgcaccctgattctggctccaacgcgcgtggtcgccagcgagatggccgaggccttaaaaggcatgcccatcagataccagaccacggccgttaagtccgagcacacggggaaggagatcgtggacctgatgtgccacgccacgttcaccatgcgcctgctcagcccagtccgggtgccgaactacaacatgatcatcatggacgaagcccacttcaccgaccccgcctccatcgcggcacggggctacatcagcactcgggtggggatgggagaggccgccgccatcttcatgactgcgacgccgcccgggtccgtcgaggccttcccgcagagcaacgccgtgatccaagatgaggagcgcgacatccccgagcgctcctggaactctgggtacgactggatcacagacttccccggtaagaccgtatggttcgtcccctccatcaagagcgggaacgacatagctaactgcctaagaaagaacggcaagcgtgtaatccaactgtcccgcaagacgtttgacaccgagtaccagaagaccaagaacaacgactgggactacgtggtcacaacggacatcagcgagatgggggccaatttccgggcggaccgcgtgatagacccgagacgctgcctcaagcccgtcatcctaaaggacggcccagagcgggtgatcttggccgggcccatgccggtgaccgccgcctccgcggcacagcgccggggccgcatcggccgcaaccagaacaaggagggagatcagtacatctacatgggccagcccctcaataatgacgaggaccacgcccactggacagaggccaagatgctacttgataacatcaacacccccgaggggataattcccgccctcttcgagccagagcgggagaagtccgcggccatcgacggagagtaccgcttacgtggggaggcccgaaagacgtttgtcgagctgatgcgtcgcggcgacctcccagtgtggctgtcctacaaagttgccagcgagggcttccagtactccgaccggcgctggtgcttcgacggtgagcggaacaaccaagtcttagaggagaacatggacgtggagatctggaccaaagagggggagcgcaagaaactacggccgcgctggttagatgcacggacgtatagcgaccccctggcgctacgcgagttcaaggaattcgcagctggacggcgcagcgtgagtggggacctgatcctggagatcggtaagctaccgcagcacctgaccctgcgggcccagaatgccctcgacaacttggtcatgctgcacaacagcgagcagggcgggaaagcgtaccgccacgccatggaggagttacccgacactatcgagacgctgatgctgctggccctgatagcagtgctgaccgggggcgtcacccttttcttcctttccgggaagggcctgggcaaaaccagcatcgggctcctgtgcgtcatggcgagcagcgtcttactctggatggcttccgtggagccacactggatcgccgccagcatcatcctggagttcttcctgatggtcctcctgatacccgagccggaccggcagcggacgccccaagacaaccagctggcctacgtggtgatcgggctgctgttcatgatcctgactgtcgcagccaacgagatgggcctcctggagacgaccaagaaggacttaggcatcgggcacgtggtggccgagaaccaccaccacgccactatgctcgatatcgacctgcaccccgcctccgcgtggaccttatacgccgtagctaccaccatcattacgcctatgatgcggcacaccatcgagaacaccacagccaatatctcactcacggccatcgctaaccaggccgccatcctgatgggcttggacaagggctggcccatcagtaagatggacatcggggtgcccctcctggccctgggctgctatagccaggtgaaccccctcaccctgaccgccgcggtactgatgctcgttgcccattacgccatcatagggccgggtttgcaggcaaaggcgacgcgcgaggcccagaagcgtactgccgccgggatcatgaagaaccccactgtagacggtatcgtggccatcgacctggaccccgttgtttacgatgcgaagttcgagaagcagctcggccaaatcatgttgctgattctctgcacctcccagatcctgctgatgcggactacctgggccctctgtgagagcatcaccctggccactgggccactgaccacactctgggagggcagtcctgggcgcttttggaacacaaccatcgccgtcagcatggccaacatcttccgtggctcctacctggcgggagcagggttagccttctccctcatgaaatccctgggtggggggcgccgggggaccggcgcccagggcgagacgttaggggagaagtggaaacgccaactcaaccagttaagcaagagcgagtttaacacttacaagcggtccggtatcatggaggtggaccgcagcgaggccaaagaggggatgaaacgaggcgagaccaccaagcatgcggtgtcccgcgggacggccaagctgcggtggtttgtcgagcgcaacctcgtgaagcccgagggcaaagtgatcgacctgggctgcgggcggggcgggtggagctactattgcgcaggcctgaagaaggtcaccgaagtgaaggggtacaccaagggcggccccgggcacgaggagcctatcccgatggcgacctacggctggaacatcgtaaagctacactcagggcgcgatgtctttttcacgccgcccgagaagtgcgacacattactgtgcgacatcggcgagtcatcccctaacccgaccatcgaggagggacgcaccctgcgcgtgctcaaaatggtggaaccctggctgcgaggcaaccaattctgcatcaagatcctgaacccctacatgcccagcgtcgtggagactctcgagcagatgcagcgcaagcacggcgggatgctggtgagaaacccactgtctcgaaacagcactcatgagatgtattgggtctcctgcggtaccgggaatatcgtgtcggcggtgaacatgacttcccgtatgctcttaaaccggtttaccatggcccatcgcaagcccacgtacgaacgggacgtcgacttgggcgccggcactcgccatgtagccgtggagcccgagatcgccaacctcgacatcatagggcagcggatcgagaacatcaagaacgagcacaagagcacctggcactacgacgaggacaacccctacaagacgtgggcgtaccacggctcctacgaggtcaagccgagcggctccgcgagctcgatggtgaacggcgtcgtccgcctgctgacgaagccctgggatgtgatccctatggtcacacagatcgccatgacggacaccacgcccttcggacagcagcgggtgttcaaagagaaggtggacacccgcaccccgcggcccaagcggggcaccgcccagatcatggaagtcacggccaaatggctctggggcttcctgagccggaacaagaagccccgtatctgtacccgggaggagttcacccgcaaggtgcggagcaacgcggccatcggggctgtgttcgtcgacgagaaccaatggaactcggcgaaagaggcagttgaggacgagagattttgggacctggtccaccgcgagcgagagctccacaagcagggcaaatgtgctacctgcgtctacaacatgatggggaaaagggagaagaagctgggcgagttcgggaaggccaagggtagccgcgccatctggtatatgtggctcggcgcccggttcctcgagttcgaggctttggggtttatgaacgaggaccactggttttcccgcgagaacagcttgtccggggtggaaggggagggcctacacaagctggggtacatcctgcgcgacatcagcaagatcccgggcggcaacatgtatgcggacgacacggcgggctgggacacccggattaccgaagatgacctccagaacgaagccaagatcaccgacatcatggagcccgagcacgctctgctcgccacgtctatcttcaagctcacctaccagaacaaggtagtccgtgtgcagcggcccgccaagagcggcaccgtgatggatgtaatctccagaagggaccagcgcgggagcggtcaagtgggcacctacgggctgaataccttcacgaacatggaggtgcagctgatccgtcagatggagtccgagggcattttcagcccctccgagctcgagaacagcaacctggccgagcgcgtccttgactggctcgagaagcacggtgtggagcggctgaagcgcatggccatctccggagacgattgcgtggtcaagccgaccgacgaccgattcgcgaccgcgctaaccgccctaaatgacatggggaaggtgcgcaaggacatcccccagtgggagccctctaaagggtggaacgattggcaacaggtcccattctgctcgcaccacttccatcaactaatcatgaaagacggccgggaaatcgtagttccgtgccgcaatcaggacgaactggtggggcgggccagggtcagccagggcgccgggtggagcctccgggagaccgcctgtctgggcaaatcctacgcccagatgtggcagctgatgtacttccatcgccgggacctccgcctggctgccaacgccatctgctcggccgtccccgtgaattgggtccccacctcccgcacaacatggagcatccacgcccaccatcagtggatgacgaccgaggatatgctgtccgtgtggaacagagtgtggatagaggagaacccctggatggaggacaagactcatgttagttcctgggaggacgtgccgtacctggggaagcgcgaggaccagtggtgcggcagcctcatcggcctgactgcccgcgccacgtgggccaccaacatacaggtggcgatcaaccaggtccgtcggctcatcgggaacgagaactacctggactacatgacctccatgaagcgcttcaagaacgagagcgaccccgaaggcgctctgtggtag

SEQ ID NO: 24748 - RNA, 9879 nt, synthetic construct
  misc_feature 1..9879: note = derived and/or modified CDS sequence (opt11) from DENV-1__KM403602__SS-prME
  source 1..9879: mol_type = other RNA
agtgttaccatgcttttgatgctgctgcccacagcgttggctttccatctcactacacgtggcggtgagccacacatgatcgtgtcgaagcaagagcgcgggaagtcgcttttgttcaagacctccgcgggtgttaacatgtgcaccctgatcgccatggaccttggcgagctatgcgaggacacgatgacctataagtgcccccggatcacggaagctgaacccgatgacgtcgactgttggtgcaacgccaccgacacctgggtaacctatgggacatgcagccagacgggcgagcatcggcgagacaagcgatccgtggccctggcgcctcacgtgggcctggggctcgagactcgtaccgagacctggatgtcatcagagggtgcctggcggcagattcagaaggtggaaacctgggccctgcgccatccggggttcacggttattgccctattcctcgcgcacgccatcggaaccagcataacccaaaaagggatcatttttatcctgctgatgctcgtgacgccatcaatggcaatgcggtgtgtcggaataggcaacagagacttcgtggagggactgagcggcgcgacgtgggtggacgtcgtgctagagcacgggtcgtgcgtcaccacgatggctaagaacaagcccaccctggacattgagctgttgaaaaccgaggtgaccaatcccgcagtgctccggaagctctgcatagaggctaagatctcaaacaccaccacggattcccggtgcccgacccagggcgaggccaccctggtggaagaacaggacgccaatttcgtctgccgcagaacattcgtggatcggggctgggggaacggctgcggcctcttcgggaaagggagcttgctcacgtgtgccaaattcaagtgcgtcacgaagctcgaagggaagattgtccagtacgagaacctgaagtacagtgtgatcgtcaccgttcacacaggcgaccagcaccaggtcggcaatgagacgaccgagcacggaacaatcgcgaccatcacaccacaggcccccacgtccgaaatacagcttacagactacggggcaatcacgctcgactgtagccctcgcaccggcctggacttcaacgaaatggtgttattgaccatgaaggagaaatcctggctagtgcacaagcaatggtttctcgacctcccgcttccctggacctccggggcctcaacaagccaggagacctggaatcggcaggacttgcttgtgacgttcaaaaccgcccacgcgaagaagcaggaggttgtcgtgctgggttcccaggaaggcgctatgcacaccgccctgacgggggccacggagatccagacctcgggcaccactacgattttcgccggccatctcaagtgccgactgaagatggacaaactgacgctcaagggcgtctcctacgtgatgtgtaccggatcgttcaagctcgagaaagaagtggcagaaactcagcacggcactgtcctcgtccaggtgaagtacgaggggaccgacgccccgtgcaaaatcccgatctccactcaggacgagaagggagtaacacagaatgggcggctgatcacggccaacccaattgtaaccgacaaagagaagcccgtcaacatcgaaaccgaaccgcctttcggggagagctacattgtcattggcgccggtgaaaaggctctcaagctgtcctggttcaaaaaggggtcgtctataggcaagatgtttgaggccaccgctcgcggggctagacgcatggcaatactcggggataccgcgtgggactttgggagcatcggcggggtgtttacctccgtggggaaactcgtccaccaggtatttggcacagcttatggggtcctgttctctggcgtcagttggaccatgaagatcgggataggcatcttactcacgtggctgggattgaattcccgcagcaccagtctgtccatgacctgcatagcggttgggatggtgaccctgtacctgggggtcatggtgcaggccgacagcggttgcgttatcaactggaagggcagagagctaaagtgcggttccggtatcttcgtgacaaacgaagtgcacacctggaccgagcagtataaatttcaagccgactctccgaaacgtttgagcgcagctataggaaaggcctgggaggagggggtgtgcggaatacggtctgctaccaggctggagaacatcatgtggaagcaaatctcgagcgagctcaaccatattctgctggagaatgacatgaagttcaccgtggtggttggggacgccaatgggatactcacgcagggcaagaagatgattaggccgcagcccatggaacacaagtatagctggaagtcctggggcaaggccaagataatcggagccgacacccaaaacaccacattcatcatagacgggcccgacacgccggagtgccccgacgaccagcgcgcgtggaatatctgggaagtcgaggactacggtttcggcgtgttcaccaccaacatatggctgaagctgcgggactcgtacacccagatgtgcgaccaccgcctcatgagtgccgcgataaaggacagcaaagccgtgcacgccgacatgggctactggattgagtctgagaagaacgaaacgtggaagctggcccgggcaagtttcatagaggtaaaaacctgcatctggcctcgctcccacacactttggagcaacggcgtactcgagtcagaaatgataatacccaaaatttacgggggtccaatctcccaacataactaccgtcccgggtacttcacccagacggctggtccctggcacctcgggaagctggagctcgacttcaatctgtgcgagggcaccaccgtggtcgtggacgagcactgcggcaatcgcggtccttcccttcggacgactaccgtgaccggcaaaatcatacatgaatggtgctgccgcagctgcaccctgccgccgttgcggttccgcggagaggacggttgttggtatgggatggagattcgacccgtcaaggaaaaggaagagaacttagtgcgttccatggtttccgcgggatctggggaagtcgactccttctcactggggctgttatgcgtgagcataatgatcgaggaggtgatgcggtcgcgctggtccaagaagatgctgatgaccggcaccctcgccgtcttctttctgctcatcatgggccagctaacctggaatgacctcatacgattatgcataatggtgggcgcaaacgtgtcggaccggatggggatgggaaccacgtacctggcactgatggcgacattcaaaatgcgccccatgttcgctgtcgggctcctgtttcggcggcttacgtcccgggaggttctcctcctgaccatcggcctctcgctagtcgcttccgtggagctccccaactcgctagaggaacttggcgacggtctggcgatgggcatcatgatgctaaagctgcttacggattttcagtcccatcagctctggaccacactgctcagcctcaccttcataaaaacgaccctgtctttggactacgcctggaagaccatggccatggtgcttagcattgtatcgctgttccccctgtgcctcagcacgacgtcgcaaaagaccacgtggttgccagtgctcttagggtccttcggctgtaagccgttgaccatgtttcttataaccgagaataagatctggggccgcaagagctggcccctcaacgaggggatcatggccgtaggcatcgtcagcatcctgttgtcttcactgctgaagaatgatgtgcccctggccgggcccttgatcgccggaggcatgctgattgcgtgctacgtgataagcgggtcctctgcagatctgtcactcgagcgggccgctgaagtctcatgggaggaggaagccgaacattccggcgcgagccacaacatcttggtggaagtgcaagatgacgggacgatgaagatcaaggatgaggaaagagacgacacgctgacgatcctcctgaaggccaccctgctcgcagtttccggcgtgtacccgatgtccatccctgctactcttttcgtgtggtacttctggcagaagaagaaacagagatccggggtcctgtgggacacccccagcccgcccgaggtagaacgagccgtcctcgacgacggcatctatcggatcctgcaacgcggcctgctagggcggtctcaagtcggtgtaggcgttttccaggacggcgtcttccacacaatgtggcacgttacccgcggagctgtgctcatgtaccagggcaagcgcctcgagccctcgtgggcctccgtcaagaaagacctgatcagctacggcgggggctggcggttccagggttcctggaacacgggagaggaggtccaagtgatcgccgtcgaaccggggaagaaccccaagaacgtgcagaccactcccggcacctttaagacacctgaaggcgaggtcggggctatcgctctcgacttcaagcccggcacctccgggtcccccatagtcaaccgtgaggggaagatcgtgggactgtatgggaacggagtagtcaccacctcagggacttacgtgagcgcgatcgctcaggccaaggcctcacaggagggccctctgcccgagatcgaggacgaggttttcaagaaacgcaacctgacgattatggacctgcaccccgggtccggcaagacgcggcgctacctcccggccatcgtccgggaagccataaagcgcaaactgcgcacgctgatccttgcgcccacgcgcgtggtggcctccgagatggccgaagcgctcaagggcatgcccatccggtaccagaccaccgcagtcaagtcagagcatacaggcaaagagatagtggatctgatgtgccacgccacgttcaccatgcgactgctctccccagtgcgcgtgccgaattacaatatgattatcatggacgaggcacactttaccgaccccgcctccatcgccgcccgcgggtacatctccacccgcgtggggatgggcgaagccgccgccatctttatgactgcgacgccccccggatcagtggaggccttcccgcagtcaaacgccgttatccaggacgaggagcgggacatcccggagcgctcgtggaattccggctacgactggattaccgacttccccggcaagacagtatggttcgtgcctagcatcaaatccgggaacgatattgccaactgcctgcggaagaacggcaagcgcgtaatacagctgagccgtaagacgtttgacaccgaataccagaagaccaagaataatgactgggactatgtggtgactacggacatttccgagatgggggccaacttccgggccgacagagtcatagacccgagaagatgtctcaagcccgtaatcttgaaagacggccccgagagggtcatactggccggtcccatgcctgttacggcggcatcagctgcccaacgccgcggccgcatcggtcgcaaccagaacaaggagggcgaccagtacatctacatgggccagcccctgaataacgacgaggaccacgctcactggacagaagccaagatgctgctcgataatatcaacacccccgaagggatcatccccgcattattcgagccggaacgcgaaaaatccgcggccatcgacggggaataccggctgcgtggagaggctcgaaaaaccttcgtcgagctgatgcgccggggtgacttgcccgtctggctttcgtacaaggtcgcctcagagggcttccagtatagcgataggcggtggtgcttcgacggggaacgcaataatcaggtgttagaggaaaatatggacgttgagatctggaccaaagaaggggaacggaagaaattacgcccccgctggttggatgcccgcacttatagcgaccccttggccctccgtgaatttaaggagttcgcagccggacgccggagcgtgagcggcgacctgatccttgagatcggcaaactaccgcaacatctgaccctgcgcgcccagaacgctctcgacaacctggtaatgttacacaactccgagcagggaggtaaggcgtataggcacgccatggaggagctgcccgacactatcgagacactaatgctgctcgccttaatcgctgttctgaccggaggcgttacgctcttctttctgtcggggaaaggcctgggtaagacctccatcggtctcctgtgcgtaatggcaagcagtgtcctcttatggatggcgagcgtggagcctcactggattgcggccagtatcatcctggagtttttcctgatggtactcctgatcccagaaccggaccgccagcgtaccccccaggacaaccagcttgcctatgtcgtgattggcctcctgtttatgattctgaccgtcgcggccaacgaaatggggctcctggagaccaccaaaaaggatctcggcatcgggcacgtagtggccgagaaccatcaccacgctaccatgctcgacattgacctgcacccggcctcggcctggaccctgtatgccgtggctacaaccatcataactccgatgatgcgccacaccatcgagaataccaccgccaatatctccctcacggccatcgcgaaccaggcagccattctcatgggcctcgataagggttggcccatcagcaagatggacatcggggtccccctcctggcattaggctgctacagtcaggtgaatcccctcactctcacagcagcggtactgatgttggtcgcccactacgcgataatcggtcccggcctgcaggccaaggcgacccgggaggcccagaagcgcacggccgccggtataatgaagaacccaaccgtggacggcatcgtggccatcgacctagaccctgtcgtttacgacgctaaattcgagaagcagctcgggcagatcatgctgctgatcctctgcacctcccagatcttgctgatgcgcactacgtgggcactctgtgagtcaatcaccctggccaccggcccactgacgaccctctgggagggcagcccggggaagttttggaacaccaccatcgccgtcagcatggccaacatcttccgtggaagttaccttgcaggcgccggactggctttctccctcatgaagtcgctaggcggcggccgccgcgggaccggcgcgcagggcgagaccctgggggagaagtggaagcgccagcttaatcagcttagcaagtccgagttcaacacgtacaagagaagcgggatcatggaggtcgaccgcagcgaagcaaaagagggcttgaagcggggtgagaccaccaaacatgcggtctcccgcggaacggccaagctccggtggttcgtggagagaaatctggtcaagcccgagggtaaggtgatcgatttaggctgcgggcggggcggctggtcctactattgcgccggtctcaaaaaggtgaccgaggtgaaggggtacaccaaggggggccctgggcatgaggagcccatcccgatggcaacctacggctggaacatcgtcaagcttcattcggggagagatgttttcttcaccccgccagaaaaatgcgacacgttactgtgcgacatcggcgaatccagccctaacccgaccatcgaggaggggagaacgctgcgcgtcctgaagatggtggagccatggttacggggcaaccagttctgcatcaaaatactgaacccttacatgccctccgttgtagagacactcgagcaaatgcaacgcaagcatgggggtatgttggttcggaaccccctatcacgcaattccacgcatgagatgtattgggtgtcgtgcggaaccgggaacatcgtctccgctgtcaacatgaccagcagaatgcttctgaatcgcttcaccatggcccaccgcaagcccacctatgagcgagacgtggacctcggggccggaacccgacacgtcgccgtggagcccgagatcgccaacctggatatcattggacagcggatcgagaacatcaagaacgaacataaaagcacctggcactatgacgaggataacccctataagacttgggcatatcacggctcatacgaggtgaagccgtccgggtcggcctccagcatggtcaatggcgtcgttcgcctgctaacgaagccttgggacgtgatccccatggttacgcagatcgccatgactgatacaacgccgttcgggcagcaacgggtcttcaaagagaaggtagacacgcgcacgccgagacccaagcgtggcaccgcccagatcatggaggtgacggccaaatggctgtggggcttcctcagccggaacaagaagccccgcatttgcacccgggaggagtttactcgcaaggttcgctccaatgcggcaatcggtgccgtgttcgtagacgagaaccaatggaactctgccaaagaagccgtcgaagacgagcgattctgggaccttgtgcatcgggagcgggagctgcacaaacagggcaagtgcgccacctgcgtgtacaatatgatgggaaagcgggagaaaaaactaggcgaattcgggaaggcgaaaggctcccgggccatatggtacatgtggctcggagcccggttcctagagttcgaggcgctggggtttatgaacgaggaccactggttttcccgcgaaaattctctcagcggcgtagaaggggagggcctgcacaaactgggctacatcctccgggacatcagcaagataccgggcggcaacatgtacgcagatgacactgccggttgggacacccgcattaccgaggacgacctgcagaatgaggcaaagatcacagacataatggagcccgagcacgcgctgctcgctacgagcatcttcaagctgacctaccagaacaaggtggtgcgcgtccagcggcccgcaaagtccggcaccgtgatggacgtcatcagccgccgggatcagcgcgggtccggtcaggttgggacctacgggctaaacacgtttaccaacatggaggttcagctcatacggcagatggagagcgaggggatcttctcccccagcgagctggagaactctaaccttgccgagcgcgtgctggactggctggagaagcacggggtggagcgactgaagaggatggctatatcaggcgatgactgcgtggttaagccaaccgacgaccggttcgccaccgcgctcacggccctgaacgacatgggaaaggtccgcaaagatatcccacagtgggaaccctccaagggttggaacgactggcaacaggtccccttctgctctcaccacttccatcagctgatcatgaaggacggtcgggagatcgtcgtcccgtgccgcaatcaggacgagttagtggggagggcgcgcgtgagccagggcgctgggtggagcctgcgggagactgcctgcctcgggaaatcgtatgcgcagatgtggcagctcatgtacttccataggcgggatctgcgactggccgcgaatgccatctgctcggccgtacccgttaactgggtgcccaccagccggacgacttggtccatacacgcgcaccatcagtggatgacgaccgaggacatgctcagcgtctggaatcgcgtgtggatcgaagagaacccctggatggaggacaagacccatgtgtccagctgggaggacgtcccgtacttggggaaacgcgaggaccaatggtgcggttccctgatcggcctcaccgcacgggccacttgggcaaccaacatccaggtggcgatcaaccaggtgcgtcggcttatcggaaacgaaaattatttagactatatgaccagcatgaagcgctttaagaacgagtcggaccccgaaggcgccctttggtga

SEQ ID NO: 24749 - RNA, 9879 nt, synthetic construct
  misc_feature 1..9879: note = derived and/or modified CDS sequence (opt11) from DENV-1__KM403582__SS-prME
  source 1..9879: mol_type = other RNA
agcgtgaccatgctgcttatgcttttacccaccgccctggccttccatctgacaacgcggggtggcgagccgcacatgatcgtaagcaagcaagagcgtggcaagagcctcctattcaaaacctccgccggggtgaacatgtgcaccctgatcgccatggacctgggcgagctctgcgaagatactatgacctacaagtgcccccggatcaccgaagccgagcctgacgatgtggactgctggtgcaatgccaccgacacatgggtgacttacgggacatgctcccagaccggcgagcaccggcgagaccgaaggtccgtagccctggcgccccacgtgggcctggggctcgagacccggactgagacgtggatgagctcggagggcgcgtggagacagatccagcgggtggagacctgggccctgcgccaccccgggttcaccgttatcgccctgttcctcgcgcacgccatcggcacatctatcacccagaaggggattatattcatcttgctgatgctggttaccccctccatggctatgcgctgcgttggcatcggcaaccgcgacttcgtggaggggctaagcggcgctacgtgggtggatgtcgttctggagcacgggtcctgcgtgactacgatggccaaaaataagcccaccctcgacatcgaactgctgaagaccgaggtcaccaaccccgcggtgctccggaagctgtgcatcgaggccaagatctcaaatactactacggactcccgctgccccacccagggcgaggccaccttagtggaagagcaagacgccaacttcgtctgccggcgcacctttgtggacagggggtgggggaacggctgtggcctgtttgggaaggggagccttttgacttgcgccaagttcaagtgcgtgaccaagctcgagggcaagatcgtacaatacgagaacctgaagtactccgtgatcgtgaccgtccacacaggcgaccaacaccaagtggggaacgaaaccactgagcatggcactatagctaccatcacgccccaagccccgacatctgagatccagttaactgactacggggccctcaccctggactgcagcccacggacaggcctggacttcaacgagatggtgctcctgacgatgaaggagaagagctggctggtgcacaagcaatggtttctcgacctgccgctgccttggaccagtggggcctcaacctcccaggagacctggaatcggcaggacttgctggtgacattcaagaccgcgcacgcgaagaagcaggaggtggtggtgctgggctcccaagaaggcgctatgcacaccgccctcaccggggccacggagatccagaccagcggaacgaccacgatttttgccgggcacttaaagtgccgcctgaaaatggacaagctcaccctgaagggtgtcagctacgtgatgtgcaccggcagctttaaactagaaaaggaggtggcggagacccagcacggcacggtcctggtccaggttaagtatgagggaacggacgcgccctgcaagatccccatctctacccaggatgagaagggggtcacccagaacggtaggttaatcacggcgaaccccattgttaccgacaaggagaagcctgtgaacatagagaccgagccgcccttcggggagtcctacatcgtcatcggcgccggcgagaaagcgctgaagctgtcctggttcaagaagggcagctcaatcggcaagatgttcgaagccaccgcgcgaggtgcacggcggatggccatcctcggcgacacggcgtgggatttcggaagtatcgggggtgttttcacctccgtcggcaagctagtccatcaagtgttcggcaccgcgtacggggtgctgttcagcggcgtatcctggactatgaagatagggataggtatcttactgacgtggctgggacttaactccaggtccactagcctttccatgacctgcatcgccgtggggatggtgaccctctacctcggcgtcatggtgcaagccgacagcgggtgcgtgataaactggaagggtcgggagctcaagtgcgggtccggaatcttcgtcactaacgaggtgcacacctggacggagcagtacaaattccaggcggactctcctaagcggctgagcgcggcaatcggcaaagcctgggaagaaggggtgtgcggcatccgctccaccacccgcctcgagaacattatgtggaagcagattagtaatgaactgaaccacattctgctcgagaacgacatgaagtttaccgtcgtggtaggtgacgcaaacggcatcctgacacaggggaagaagatgatccggccccagcccatggagcacaagtactcctggaaatcctggggtaaggccaagatcattggcgcggacacccagaacacgacgttcatcatcgacggacccgataccccggagtgtccagacgaccaacgcgcctggaacatctgggaagtcgaagattacggcttcggggtgttcaccaccaacatttggttgaagctccgggactcctacacgcaaatgtgcgaccaccgcctgatgagcgccgccatcaaggactccaaagccgtgcatgccgacatgggctactggatcgagagcgagaagaacgaaacctggaagctggctcgagcctccttcatcgaggtcaagacgtgcatctggcctcgcagccacaccctctggtccaacggcgtactggagagcgagatggtgatacccaaaatctacgggggcccgatctcccagcataactatcggccgggctacttcacgcagaccgcgggcccatggcacttggggaagctcgagttagacttcaacctgtgtgagggcaccaccgtcgtggtggacgaacactgcggcaaccgcgggccgagcctccggacgaccacagtcaccggcaagatcatccacgaatggtgctgccgctcctgcacgcttcccccactgcggttcagaggggaggacggctgctggtacgggatggagatccggcctgtgaaggagaaggaagagaacctcgtacgcagcatggtctccgcgggcagcggtgaagtagatagcttcagtctggggctgctatgcgtgagcatcatgatcgaggaggtaatgcgctcccggtggagccgcaagatgctgatgacgggcaccctagccatcttcttcttacttatcatgggccagttaacctggaacgacctcatccggctgtgtattatggtcggcgcaaacgtgtccgaccgcatggggatgggaactacgtaccttgccttgatggccaccttcaagatgcggccgatgtttgcggtcggactcctgttccgccgtctcaccagccgcgaggtcctgctgctcacgatcgggctgtcactggtcgcctccgtggagctcccgaactcccttgaggagctaggcgacggcctcgccatgggcatcatgatgctgaagctcctcaccgacttccagagccaccagttgtggactacactgctctccctgacgttcatcaagactaccctgtcgctcgactacgcctggaagactatggcaatggtattatcaatcgtcagcctgttccctctgtgcctgtccacgactagccagaaaaccacctggctgccggtgctcctcggatcctttggatgcaaaccgctcaccatgttcctcatcaccgagaacaaaatctggggccgcaagtcttggcccctgaatgaagggataatggctgtgggcatcgtttccatcttgctttctagcctgctgaaaaacgacgtgcctcttgctgggcccctgatcgccggcggcatgctgatcgcctgttacgtgattagtggtagctccgctgacctcagcctggaaagagccgctgaagtgtcctgggaggaggaggccgagcactcgggcgcctcccacaacatactggtcgaggtgcaggatgatgggaccatgaagatcaaggacgaggaacgtgacgataccctcactatcctgctcaaggcgacgctcctcgccgtcagcggcgtgtacccgatgtcgatccccgccaccttgttcgtgtggtatttctggcagaagaagaagcagcgcagcggggtcctctgggatacccccagcccgccagaggtagagcgggccgtgctagacgacggaatctaccgcatcctccagcgaggccttctagggcgcagccaggtaggggtgggggtgttccaggatggcgtcttccacacaatgtggcacgtgacgcgcggggccgtgctgatgtaccagggtaagcgcctcgagccgtcctgggcaagcgtcaaaaaagacctgatctcctatggcgggggctggcgtttccaggggtcttggaacactggcgaggaggtccaagttattgcggtcgagcctgggaagaacccaaaaaacgtgcagaccacccccggcacgttcaaaacgccagagggcgaggtgggggccatagcccttgactttaagcccgggacctccggatcaccaatcgtcaaccgcgagggcaagatcgtgggcctctacggtaacggcgttgtaaccacttccgggacctacgtgtccgccatcgcgcaggccaaggccagccaggagggcccgctccccgagattgaggacgaggtgttcaagaagaggaacctaacgattatggacctgcaccccgggagtggcaagactcgccgctatttaccggccatcgtccgggaggcaattaagcgcaagctgcggacgctgatactcgcgcccacccgcgtggtggccagcgaaatggcagaagctctgaagggcatgcccatccggtaccaaaccacggcggtcaagagtgagcacacgggtaaagagattgttgacctcatgtgccacgccacattcaccatgaggctcctgagccccgtgcgggtaccgaactataacatgattatcatggacgaagcacatttcaccgaccccgccagtatcgccgcgagaggctacatcagcacacgtgtggggatgggcgaggctgcagccatcttcatgacggccacgccgccgggctccgtagaggcgttcccgcagagcaacgctgtcatacaggacgaggagcgcgacatccccgagcggtcctggaacagcggctatgactggatcactgacttccccggcaagacggtgtggttcgtgccgtccataaagtcagggaatgacattgccaactgcctccgcaagaacgggaagcgggtcatccagctctcccgcaaaaccttcgacaccgagtaccagaagactaagaacaacgactgggactacgtggtaacgactgatatcagcgaaatgggggctaatttcagggccgaccgcgtcattgacccgcggagatgcctgaagcccgtgatcctgaaggacggccccgagcgggttatcctcgcgggccccatgcccgtcaccgccgcctcagctgcgcagcgcagaggccggatcggccgaaatcaaaacaaggagggggaccagtacatctacatgggtcagcccctgaacaatgacgaagatcatgcccattggaccgaggcgaagatgctgctcgacaatattaacacaccagaggggataatccccgccctgttcgagccggaacgcgagaagtctgccgcgatcgacggtgagtaccgtctgcgcggtgaggcccgaaagacattcgttgaactcatgagacgcggcgacctgcccgtatggctgtcctacaaggtcgccagcgagggcttccagtactccgaccggcgctggtgcttcgacggggagcggaacaaccaggtgcttgaggagaacatggacgtcgagatttggacgaaggagggcgagagaaagaagctgcggccccgctggctggacgcccggacctactccgaccccctcgccctgagggagtttaaggagttcgcggccgggcggcgcagcgtgtccggggatctgattctcgaaatcggaaaactcccacagcacctgaccctccgggcccagaacgccctggacaacctggtgatgctccacaacagtgagcagggagggaaggcctatcgccacgcgatggaggagcttcccgacacgatcgagactctgatgctgctggccctgattgccgtcctcaccggcggcgtgaccctgttctttttaagtgggaagggtcttggcaagacctcgatcggtctgctgtgcgtgatggcctccagcgtcttattatggatggcgagcgtggaaccccactggattgctgccagcatcatcctagagttctttttgatggtgctgctgatccccgagccggaccgtcagcgtacgcctcaggacaatcagttggcctatgtcgtgatcggcctgcttttcatgatcctcacggtggccgcgaacgagatggggctgctggagaccacgaagaaggacctcgggatcgggcacgtcgtggccgagaaccaccaccacgccaccatgttggacatcgacctgcaccccgcatccgcctggaccctctacgccgtcgctaccaccataatcaccccgatgatgcgccacaccatcgagaacaccaccgctaacatcagcctgaccgccatcgccaaccaggcggcgatcctgatgggtctagacaagggatggcccatctccaagatggacattggggtccccttactggccctcggctgctactcgcaggttaaccccctgaccctgactgccgctgtgctcatgctggtggcgcattacgcaatcatcgggccgggcctccaggccaaggccacgcgggaggcgcagaaacgcaccgccgccggaatcatgaaaaatcccaccgttgacggcatcgtggccatagacctcgaccccgtcgtgtacgacgccaagttcgaaaagcagctgggccagatcatgctgctaatactgtgcacgagtcagattctcctcatgcggaccacctgggcgctatgcgagtccatcacgctggccaccgggcccctaacaacactgtgggagggatccccggggaagttctggaacactaccatcgctgtgagcatggccaatatctttaggggttcctacttggccggcgccgggctcgccttcagcttgatgaagtccctgggcgggggccggcgggggacgggcgcccaaggagagacgctcggggagaaatggaagcgacagctgaaccagttgtcgaagtcggagttcaacacctacaagaggtcaggcatcatggaggtcgaccggtcggaagccaaggagggtctcaagaggggcgagaccaccaagcacgcagtctcccgggggaccgcgaagctgcgctggttcgttgaacggaaccttgtcaagcccgagggcaaggtaatcgacctgggatgcggccgcggtgggtggagctactactgtgccggcttaaagaaggtgacggaggtaaaaggatacacgaagggaggccccgggcacgaggagcccatccccatggctacctacgggtggaatatcgttaagctgcactccggacgggacgtgttcttcactccacccgagaagtgcgacaccctgctctgtgacatcggagaaagctcccccaatcctaccatcgaggaggggcgcaccctgcgggtcctgaagatggtggagccctggttgcgcggcaaccagttctgcatcaaaatactgaatccctacatgcccagcgtggtcgagacgctggagcagatgcagcggaagcacggcgggatgctcgtccggaacccgttgagccgcaacagcacccacgagatgtactgggtctcctgcggcaccggaaacatcgttagcgccgtgaacatgacctcccggatgctgctcaaccgcttcaccatggcccaccggaagcccacttacgagcgcgacgtggacctgggcgccggcacacgtcacgtcgcggtcgaacccgagacggccaacctggatatcataggccagagaatcgagaatatcaaaaacgagcataagagtacatggcactacgacgaagacaatccctacaagacctgggcgtaccacggctcttatgaggtgaagccgagcggctccgcgtcgtccatggtgaacggcgtcgtccggttattgactaaaccctgggacgtgatccccatggtgacccaaatcgccatgaccgacacaaccccgttcgggcaacagcgagtcttcaaagagaaggtcgacacccggacgccgcggccgaagcgcggcacagcccaaatcatggaagtcacggcgaagtggctgtggggattcctctcgcgcaacaagaaaccccggatctgcacccgcgaggagttcacgcggaaggtccgctcgaacgccgcgatcggagccgtctttgtagacgagaaccagtggaactccgcgaaggaggccgtcgaggacgagcggttctgggacctggtgcacagggagcgggagctgcacaaacagggtaagtgcgcgacctgcgtgtacaacatgatgggaaaacgtgagaagaagctcggggaattcgggaaggctaagggcagccgggccatctggtacatgtggctgggcgcccgcttcctggagttcgaagccctcggcttcatgaacgaagaccactggttctcccgcgagaacagcctgtctggcgtagagggggaaggccttcacaaactcgggtacattttacgggacatcagtaaaatcccgggcggtaatatgtacgcagacgataccgccggctgggacacccggatcacggaggatgatctgcagaacgaggccaaaatcactgacataatggagcccgagcacgccctcctggccacctccatctttaagctgacctaccagaacaaggtggtgcgggtacagcgccccgccaagagcggcacggtgatggacgtgatatcacggagggaccagcgggggagcggacaagtgggcacctacgggctaaacaccttcaccaacatggaggtgcaattaatccgacagatggagtccgagggcatattcagcccatccgagctggagaacagtaacctcgcggagcgggtcttggactggctggaaaaacacggggtcgagcgcctcaagcggatggccatctccggagatgactgcgttgtgaagccaaccgacgaccgctttgctaccgccctgaccgcactaaacgacatggggaaggtccggaaggatataccccagtgggagcccagcaagggctggaacgactggcagcaggtccccttctgcagccaccacttccaccaactcattatgaaggacggacgcgagatcgtggtcccgtgccggaaccaggatgaactggtgggtagagcccgggtgagccaaggcgcggggtggtcactgcgcgagaccgcgtgtctcggcaagtcctacgcccagatgtggcaactgatgtactttcacaggcgcgacctgcgcctcgcggctaacgccatctgcagcgcagtgcccgtgaactgggtgcctacttcccggacgacctggagcatacacgcccaccaccagtggatgaccactgaggacatgctgtccgtgtggaatcgcgtgtggatcgaggagaatccctggatggaggacaagacgcacgtcagctcctgggaggacgtgccgtacctggggaagcgggaggaccaatggtgcggcagcctcatcggtctgaccgcacgcgccacctgggcgaccaacattcaggtggccattaaccaagtgcggcgcctgatcgggaatgagaactacctcgactacatgacatcaatgaagcggttcaagaacgagtctgaccccgagggcgcgctatggtga

SEQ ID NO: 24750 - RNA, 9879 nt, synthetic construct
  misc_feature 1..9879: note = derived and/or modified CDS sequence (opt11) from DENV-1__KM403577__SS-prME
  source 1..9879: mol_type = other RNA
agcgtgaccatgctgctcatgctcctgcccaccgccctcgccttccatctgaccacccggggaggggagccccacatgatcgtcagcaagcaggagcgcggcaagtcactcctcttcaagacctccgcgggggtgaacatgtgcaccctgatagccatggaccttggggagctctgcgaggatacgatgacctataagtgcccccggattaccgaggccgagcccgacgacgtagattgctggtgtaacgccactgacacctgggtgacctacgggacttgctctcaaaccggcgagcatcgacgtgataagcgctccgttgccttagcgccccacgtgggcctggggctcgagacgcgcaccgagacctggatgtcttcagagggtgcctggagacagatccagaaggtcgagacctgggcgctgcgccaccccggtttcacggtgatagccttcttcctggcgcatgctatagggaccagcatcacccagaagggcataatcttcatccttctgatgctggtgaccccctccatggccatgcggtgcgtcgggatcggaaaccgcgacttcgtggaggggctcagcggcgccacctgggtggacgtcgtgctggagcacgggtcctgtgtgaccaccatggccaaaaacaaacccaccttagacatcgagcttctgaagacggaggtgactaatcctgccgttcttcggaagctatgcatcgaggcgaaaatcagcaacactaccacggactcccgctgccccacccagggcgaggccaccctggtggaggagcaggacgccaacttcgtctgccggcgcaccttcgtggaccggggctgggggaacggctgcgggcttttcggcaaggggagcttactgacgtgcgccaaattcaagtgcgtgaccaagctggagggcaaaatcgtccagtacgaaaacctcaagtacagcgtgattgtgacagtccacaccggggaccagcatcaggtcgggaacgagacgaccgagcacggcaccatcgcgaccattacaccccaagcccccacgagcgaaatacagctgaccgactacggggcactgaccctcgactgctctccgcggaccggattggacttcaacgaaatggtgctacttacgatgaaggagaagtcctggctggtccacaagcagtggttcctggacctcccgctgccctggacctcaggggctagcacttcgcaggagacctggaaccggcaggacctgttggtgacgttcaagaccgctcacgcgaaaaagcaggaggtagtggtgctgggttcccaagagggcgcaatgcacacagccctgaccggggccacggagatacaaaccagcggcaccaccaccatattcgcagggcacctcaagtgccgcttaaagatggacaagctgaccctcaagggagtcagctatgtgatgtgcaccgggagcttcaagctggagaaagaagtggcggagacccagcacggaacggtgttggtccaagtgaagtacgagggcaccgacgcgccgtgcaagatacccattagcactcaagacgagaagggggtaacccagaacggccggctgatcacagcgaaccccatcgtaaccgacaaggagaagcccgtgaacattgagaccgagccgcctttcggggagagctacatcgtaatcggcgccggtgagaaggcgctgaagctgtcgtggttcaagaaggggagttccatcggtaagatgttcgaagcgactgcacgcggggcacggcgcatggccatcttgggcgacacggcatgggattttggtagcatcggcggggtgttcacctccgtcggcaaattagtccaccaagtgttcggcaccgcctacggggtactgttcagtggtgtctcgtggacaatgaagatcgggatcggcatcctgctcacgtggctggggttgaactcgcgctcgactagcctcagtatgacctgcatagcagttggcatggtgacgttataccttggtgtgatggtgcaggccgactcggggtgcgtgatcaattggaagggccgggagctcaagtgcgggtccggcatctttgtcacgaacgaggtgcatacctggaccgagcagtacaagttccaagcagatagcccgaagcgcttgtctgcggccatcgggaaagcctgggaggagggagtgtgcggcatccggtccgcaacacgcctggagaacatcatgtggaagcagatctcaaacgagttgaatcacatactgctcgaaaacgatatgaagttcaccgtcgtggtgggggacgccaacggcatcctgactcagggcaagaagatgattcggccccagcccatggagcacaaatactcctggaagagttggggcaaggcgaaaatcatcggtgccgatacccagaataccaccttcatcatcgatgggcctgacaccccggagtgccccgacgatcaacgcgcatggaacatatgggaggtcgaggactatggcttcggagtgttcacgacgaacatctggctgaagctccgggactcctatacccagatgtgcgaccaccgtctcatgagtgcagcgatcaaggactccaaggcggtgcatgccgatatgggctactggatcgaatcggaaaagaacgagacgtggaagttggcgagggcctcgtttatagaagtaaagacatgcatctggccccgcagccacactctgtggagtaacggcgtgctcgagtcagagatgatcatacccaagatctacgggggcccaatatcccagcacaactaccggcctgggtacttcacacagacggcgggcccgtggcacctgggaaaacttgagctcgactttaacttatgcgagggcaccacggtggtcgtcgacgagcactgcggcaaccgggggccgagcctgcgcaccacaaccgttaccggcaagattatccacgaatggtgttgccgctcctgtacactgccgcctctgagatttcgcggagaagacggctgttggtacgggatggagatccggccggtcaaggagaaggaggagaacctggtcagaagcatggtttccgccggcagcggcgaagttgacagcttctctctagggcttctgtgcgtgtcgatcatgattgaagaggttatgcgcagtcgatggtctcgcaagatgcttatgacgggcaccctggccgttttctttctgctcatcatggggcagctgacctggaacgacctgatccggctatgcatcatggtgggtgcaaacgtgtccgaccgcatgggcatgggcaccacgtaccttgcgctgatggctaccttcaagatgcggccgatgttcgccgtcggcttgctatttcgccgtttgaccagccgcgaagtgctcttgctgaccattgggctctccctggtcgcgagcgtggagctgcctaattccctcgaggaactgggcgatgggctggccatgggaattatgatgctcaagctgctcaccgacttccaaagccatcagctctggaccaccctgctgtccctcactttcattaagacgaccctgtcccttgactacgcctggaagaccatggcgatggtgctatccatagtaagcctattccccctgtgtctctccacaacgagccaaaagactacatggctacccgtcctgctcggttccttcgggtgcaaaccacttaccatgttcctaatcaccgaaaacaagatctggggccgcaagtcatggccactcaatgaggggatcatggccgtgggcatcgtctccattctgctgagcagcctactgaagaacgatgtgcccctggccgggccgctcatcgccggcgggatgctaatcgcgtgttacgtgatctccgggagcagcgccgacctgagtctagaacgcgcagcggaggttagttgggaggaggaggccgagcacagcggcgcgtcccataacatcctggtggaagtgcaggacgacgggacgatgaaaatcaaggacgaggaacgtgacgacactctgaccatcctcttaaaagccacattgctcgcagtcagcggcgtgtacccgatgtccatccccgctacgctgttcgtatggtacttttggcagaagaagaagcagcggtcgggggtcctctgggacacgcccagtccacccgaggttgaacgagccgtgctcgacgatggcatataccgcatcctgcagcggggattactagggagaagccaagtcggcgtcggggtgtttcaggacggcgtattccacacgatgtggcatgtgactcgcggggctgtgttaatgtaccaagggaagcgcctggaaccatcctgggccagcgtcaagaaagacctgatcagttacggcgggggctggcggtttcaagggagctggaatactggcgaggaggtccaggtgatcgccgtcgagcccgggaagaaccccaagaacgtacagaccacccccggcaccttcaaaacgcccgagggagaggtgggggccatcgccctcgatttcaagcccggtacgtccgggagccccatcgtgaaccgcgaaggcaagatcgtgggcctgtacgggaacggcgtggtaaccacctccgggacgtatgtgagcgcgatcgcgcaggccaaagccagccaggagggcccgctgcctgagatcgaggacgaggtgtttaagaagcggaatttgaccatcatggatctgcaccccgggtctggaaagacccgccggtacctgccggccatcgtccgcgaggcaattaagcgcaagctccgaaccttaatcctcgctccaacgcgcgtcgttgcttcagaaatggcggaggcattaaagggcatgcctatcaggtaccagaccaccgccgtcaagtccgagcacaccgggaaagagatcgtagatctgatgtgccacgccacgttcaccatgcgcctgctaagccccgtgcgagttccgaactataacatgataatcatggatgaggcccatttcaccgaccccgcctccatcgcggcgcgcggctacatcagcacacgggtgggtatgggggaagcggccgccatattcatgacggcgacgccacccggttcagttgaagccttcccgcagagcaatgccgtcatccaggatgaagaacgagacattcccgagcggtcctggaacagcggctacgactggataacggacttccccggcaagacagtatggttcgtgccctccattaagtcggggaacgacatcgccaactgcctgcgcaagaacggcaagcgagtcatccaactgtcacgcaagacattcgacacggagtaccagaagaccaagaataacgactgggattacgttgtgactacggacattagcgaaatgggggccaatttccgagcagaccgcgtgatcgacccacggcgctgcctcaagcccgtgattctgaaggacggccccgaacgggttatattagcaggccccatgccggtgaccgcggcctctgctgcccagaggcggggccgcatcggccgcaaccagaacaaggagggggatcagtacatctacatgggccaaccactcaataatgacgaggaccacgcccactggaccgaggccaagatgcttctggacaacatcaacacgcccgaggggatcatccccgccttgtttgagcctgagcgggagaagtccgcggccatcgacggcgagtaccgactgcgcggggaggcccgcaagacattcgtcgagctgatgcggaggggcgatctccccgtctggctctcctacaaggtggccagcgagggttttcagtactccgaccgaaggtggtgcttcgacggggagaggaataatcaggtgttggaggagaacatggacgtcgagatctggaccaaggaaggcgagaggaagaagctccggccccgctggctagatgcccggacatacagcgacccgttagcgctccgcgagttcaaagagttcgccgctgggcggcgaagcgtgagtggcgatctgatcctggaaatcggaaagttaccgcagcacctgacactgcgggcccagaacgccctcgacaacctggtgatgctgcacaattctgagcagggtgggaaagcgtacagacatgccatggaggaactccccgacaccatcgagactctaatgctgctcgctctgatcgccgtcctcacagggggcgtcaccctcttcttcctgtccggaaagggactgggcaagaccagcatcggcctcctgtgcgttatggcgtcctcagtcctgttatggatggcatccgtggaaccccattggatcgctgccagcataatcttggagttcttcctaatggtgctactgatccccgagccagaccggcagcgcacgccccaggacaaccagctggcttacgtcgtgattggcttactgtttatgatcctgaccgtggcggcgaatgagatgggcttactggaaaccaccaaaaaggacctcggaatcgggcatgtcgttgccgagaaccaccaccacgccacgatgctcgacatcgacctgcaccccgccagcgcgtggaccctgtacgcagtggccaccaccataatcacgccaatgatgcggcataccatcgaaaacaccaccgccaatatcagcctgacggccatcgcgaaccaggcagccatactgatgggactggataagggctggcctatctccaagatggacatcggggtccccctactggcccttggctgctacagccaggtcaaccccctcaccctgaccgccgcggtgctgatgctcgtcgcccactacgccatcatagggcccggtctgcaggccaaagcgacgcgcgaagcccaaaagcgcacggccgccggtattatgaagaaccccacagtggacggcatcgtggccatcgacctggaccccgtcgtgtacgacgctaagttcgagaagcagctcggccagatcatgcttcttatcctctgcacctcccagatactgttaatgcgcacgacgtgggctctgtgcgagagcatcaccctagccaccggacccctgactacgctctgggagggctccccggggaagttctggaacaccaccattgcagtgagcatggctaatatcttccgaggatcatacctggcgggagccgggttagccttcagcctcatgaaaagcctaggagggggccggcgcggcaccggagcacagggtgagacgctgggggagaagtggaagcggcagctcaaccagctgagtaagagcgagtttaacacctacaagaggtctggcatcatggaggtcgaccggagcgaggccaaggaggggctgaagcgaggcgagacaaccaagcatgcggtgtcgcgggggacggccaagttgcgctggttcgtagagcggaacctcgtgaaaccagagggcaaagtgatcgacctggggtgcgggcgcggcgggtggagctactactgcgcgggcctaaagaaggtgaccgaagtcaaggggtacacaaagggcggccccgggcacgaggaacccatcccgatggccacctacggttggaatatcgtcaagctccactccgggcgggatgtgttcttcacccctcctgagaagtgcgatacgctgctgtgcgacatcggcgaaagctccccaaacccgaccatcgaggaggggaggacgctccgggtcttgaagatggtggagccctggctgcgcggcaatcaattctgcatcaagatccttaacccatacatgcccagtgtggttgagaccctggagcagatgcagaggaaacacggcggcatgctggtgcgcaacccgttgtcccggaacagcacgcacgagatgtactgggtgtcgtgtggcaccgggaatatcgtctcagccgtgaatatgacctcccgcatgctgttaaaccgcttcaccatggcccaccggaagccaacctacgagcgcgacgtggatctcggcgccggtacccgccacgtcgccgtggagcccgagatcgccaatctggacatcatagggcagcggatcgagaacatcaagaatgagcataagagcacttggcattacgacgaggataacccttacaaaacatgggcctatcacggctcctacgaagtgaagccgagcgggtccgccagctccatggttaatggcgtagttcggctgcttacaaagccctgggacgtcatcccgatggtgacccaaatcgccatgaccgacaccacgcccttcggccagcagcgcgtcttcaaggagaaggtggacactagaaccccgcgtcccaagcggggaaccgcccagatcatggaggtgactgccaagtggctgtggggcttcctgagccgcaacaaaaagccccggatctgcacccgcgaggagtttactcgtaaggtccgaagcaacgcggccattggtgccgtgttcgtcgacgagaaccagtggaatagtgcaaaggaggccgtagaagacgaacggttctgggacctggtgcaccgcgagagggagctgcacaagcaaggtaagtgcgcgacctgcgtttacaacatgatggggaagagggagaagaagctgggtgagtttgggaaagccaaaggcagccgagctatctggtacatgtggctcggtgccagattcctggagttcgaggcactgggtttcatgaatgaggatcactggttttcccgagaaaacagcctctccggggtcgagggggaaggactgcacaaactggggtacatcctacgcgacataagcaagatcccgggcggcaacatgtacgccgacgacaccgccgggtgggatacccggattactgaagacgacctgcagaacgaggccaagatcaccgacatcatggagccggagcacgccctgttggcgacttccatattcaaacttacctaccagaacaaggtggtgcgtgtccagcgccctgccaagagtggcaccgtgatggacgtcatatccaggcgcgaccagcggggctctggtcaggtcggaacatacgggctgaacacattcaccaatatggaggtgcagttaatcaggcagatggagtccgagggaatcttctctccctccgagctcgagaatagcaacctggccgagcgggtcctcgactggctggaaaagcacggtgtcgagcgcctgaagcgtatggctatctcaggcgatgactgcgtagtcaagccaaccgacgaccgcttcgccacagccctgacggcccttaatgacatgggaaaggtccggaaagacatccctcagtgggagcccagcaaggggtggaatgactggcaacaggtccccttctgctcccaccacttccaccagctgatcatgaaggacggcagagagatcgtggtcccgtgccggaaccaggacgaactggtggggcgcgcccgcgtgagccaaggtgccgggtggtcactgcgcgaaaccgcgtgcctgggcaagtcctacgcccagatgtggcaactaatgtatttccaccgacgcgacttgcggctggccgccaacgctatttgcagcgccgtccccgttaactgggtgcccacctcccgcactacgtggagcatccacgctcaccaccagtggatgactaccgaggacatgctctccgtttggaatcgcgtgtggatcgaggagaacccctggatggaggacaagacccacgtgtcctcctgggaggacgtcccttacctggggaagcgggaggaccaatggtgtggctcgctgatcggtctcaccgcccgcgccacatgggcgactaacattcaggtggcgataaaccaggtgcgtcgcctgatcgggaatgagaactatctggactatatgacttccatgaagcggttcaagaatgagagcgatccagagggtgccttatggtga

SEQ ID NO: 24751 - RNA, 9879 nt, synthetic construct
  misc_feature 1..9879: note = derived and/or modified CDS sequence (opt11) from DENV-1__KM403631__SS-prME
  source 1..9879: mol_type = other RNA
agcgtgaccatgttactcatgctgctgccgaccgccctcgccttccacctgaccacccggggcggggagccgcacatgatcgtgagcaagcaggagcggggcaagagcctcctgttcaaaacatccgcgggggtgaacatgtgtaccctgattgccatggatctgggcgagctctgcgaggacacgatgacctataagtgccctcggatcaccgaggctgagccagacgacgtggactgctggtgcaacgccaccgacacctgggtcacctacgggacatgtagccagaccggcgagcaccgaagagacaagcggtccgtggcactggcgccccacgtgggcctggggctcgagacacgcacagagacctggatgagctcggaaggagcctggcggcagatccagaaggtcgagacctgggccctgcgccaccccgggttcacggtgatcgctctgttcctcgctcacgccataggcaccagcatcacccagaaggggatcatcttcatcctgttgatgttagtgaccccgtccatggccatgcggtgcgtgggcatcggcaaccgcgactttgtggaggggctcagcggcgccacgtgggtggacgtcgtgctggagcacgggtcctgtgtgaccaccatggccaagaacaagcccaccctcgacatcgagctactgaagacggaagtaaccaaccccgcggtattacggaagttgtgcatcgaggccaagattagcaacacaactactgactcccgctgccccacccaaggcgaggccaccctggtggaggagcaggacgccaatttcgtctgccggcgcaccttcgtggaccgggggtgggggaacggctgtggcctctttggtaaggggtcgctgctgacgtgcgccaaatttaagtgcgttaccaagctcgagggtaagatagtccagtacgagaacctgaagtactccgtgatcgtcaccgtccacaccggcgaccagcaccaagtggggaacgagacgaccgaacatggcaccattgcgaccattacgccccaggccccgacgagcgagattcagttgaccgactacggagccctcaccctggactgcagtccccgcaccggcttggacttcaatgagatggtcctcctgacgatgaaggaaaagtcctggctggtgcacaagcagtggtttctcgacctgccgttaccctggacctccggggcctctaccagccaggagacgtggaacagacaggacctcttagtgacgttcaaaaccgcccacgcgaagaaacaggaggtcgtagtactgggcagccaagaaggcgccatgcacaccgctctcaccggggccacggaaatccagacgtcgggtacgaccacgatcttcgccgggcacctgaagtgtcgcctgaaaatggacaaactcaccctgaagggcgtgtcttacgtgatgtgcaccgggagtttcaagttagagaaggaagtggcggagacccagcacggcaccgtcctggtccaggtgaagtacgagggcaccgacgcgccctgcaagatccccatctccacccaggacgagaagggggtcacccagaacggaaggctgatcacggccaacccgatcgtgacagacaaagaaaagcccatcaacatcgagaccgagccgcccttcggggagagctacattgtgatcggcgccggcgagaaggcgctgaagctgagctggttcaagaaagggagctcaatcggcaagatgttcgaggccaccgcccgcggggcccggcgcatggctatactcggcgacacggcgtgggacttcgggagcataggcggcgtcttcaccagtgtaggcaagctggtgcaccaggtcttcgggaccgcgtacggggtgctgttcagtggcgtgtcctggactatgaaaatcgggatcggcatcctcctgacgtggctaggtctcaacagccgcagtaccagcctgtccatgacctgcatcgcggtagggatggtgaccctgtacctcggtgtgatggtccaagctgacagcgggtgcgtgatcaattggaagggccgggagctgaagtgcgggagcgggatctttgtgacgaacgaggtccatacctggacggagcagtacaagtttcaggcggacagcccgaagcgcctcagcgcagccatcggcaaggcctgggaggaaggcgtgtgcggcatccggtccgccactcgcttagaaaacatcatgtggaagcagatctcgaacgaactgaaccacatcttgctcgaaaacgatatgaagtttaccgttgtcgtgggggatgccaacggcatcctgacgcaggggaagaagatgattcggccccaaccaatggaacacaagtactcctggaagtcctggggcaaagctaagatcatcggcgctgatacccagaatacgacctttatcatagacgggcccgacacgccggagtgccccgacgaccagcgggcctggaacatctgggaggtggaagattacggcttcggcgtcttcaccaccaacatctggctgaaattacgtgattcctacacccaaatgtgcgatcacagattgatgtcggccgcgataaaagactccaaggccgtgcacgctgacatgggctattggatcgagagcgagaagaacgagacgtggaagctggcccgggcatccttcatcgaagttaagacatgcatctggccgcgcagccacaccctctggtccaatggtgtgctggagtctgagatgatcatcccgaagatctacgggggaccaatctcccagcataactatcggcccggctacttcacccagacggcgggcccctggcacctggggaagctcgagctggacttcaacctgtgcgagggcaccaccgtggtggttgacgagcactgcggcaaccgcgggcctagcctccggactacaacagtgaccggcaagatcatccacgaatggtgctgccggtcctgcaccctgccgcccctgcggttccgcggggaggacggatgctggtacgggatggagatacggcccgtaaaggaaaaggaagagaacctcgtccgcagcatggtgtctgccggcagcggtgaggtagacagcttctccctggggctgctctgcgtcagcataatgattgaggaggtgatgcggtcgcgctggagcagaaagatgctgatgacggggaccctggccgtgttcttcctcctcatcatggggcagctgacatggaacgacctcatccggctgtgcatcatggtcggcgccaacgtgtccgacagaatggggatgggcaccacgtatctggcattaatggcaaccttcaagatgcggccgatgttcgccgtggggctgctgttccgccggctcaccagccgcgaggtcctgctcctcacgatcgggctctccctggtggcgagcgtagagctccccaactccctggaagagctgggcgacgggctcgcaatgggcatcatgatgctgaagctgctaaccgactttcagagccaccagctgtggaccaccctgctctccctgaccttcatcaagacgactctgtcgctcgactacgcctggaaaaccatggcgatggttctgtcgattgtgagcctgttccccctctgtctgtcgacaacaagccagaagactacgtggctgcccgttctcctgggctccttcgggtgcaagccgttaactatgtttctcatcacggaaaataagatctggggccgcaagagttggcccctgaacgaagggatcatggccgtgggcatcgtgtccatcctgctgtcctcgctacttaagaacgacgtcccgctcgcagggcccctgatcgccggcgggatgttaatcgcttgctacgtgatctccggaagctccgccgacctcagccttgagcgcgccgccgaggtgtcctgggaggaagaagccgagcacagcggcgcatcccacaatatcctggtcgaggtgcaggacgacgggacgatgaagatcaaggacgaagagagggacgataccctaaccatcctgctgaaggccaccctcttggccgtgagcggcgtctaccctatgtccatccccgcgacgctgttcgtctggtacttctggcagaagaagaagcagcgtagtggggtgctctgggacaccccctcaccgcccgaggtcgagcgggccgtgctggacgacggcatctatagaatccttcagcgcggcctgctaggacgctcgcaagtgggcgtcggagtgttccaggatggtgttttccataccatgtggcacgtcacccggggggcggtgctgatgtaccagggcaaacgcctggaaccatcctgggccagcgtgaaaaaggacctcatctcctatggcgggggatggcggttccaggggtcatggaacacgggcgaggaggtccaggtgatcgccgtggagcccgggaagaaccccaagaacgtccagaccacgcccggcaccttcaagacgcccgagggcgaggttggtgccattgcgctggacttcaaacccggcaccagcgggagccctatcgtgaaccgcgagggcaagattgtcggcttatatgggaatggcgtggtgaccacctctgggacgtacgtcagcgcgatcgcccaggcgaaggcctcgcaggagggccccttacccgagatcgaggacgaggtgttcaagaagcggaacctgaccatcatggacctgcaccccgggtcggggaagacccgccgttacctccccgccattgtgcgcgaggcgatcaagcgcaagctgcggaccctgatcctcgcccctacccgtgtcgtggcctctgagatggccgaggcgctgaagggcatgcccatacgctaccagaccaccgcagtgaagagcgagcacaccgggaaggagatcgtcgatctgatgtgccatgccacgtttaccatgcgcctcctgagccccgtgcgggtaccaaattataacatgatcatcatggacgaggcccactttaccgaccccgcctccattgcggcccgcggctatatttccacacgggtgggaatgggcgaggccgcagccatcttcatgaccgcaacgccgccagggtccgtggaggcctttcctcaaagcaacgctgtgatccaggatgaagagcgcgacatccctgagcggtcctggaacagcggctacgactggatcacggacttccccggcaagaccgtctggttcgtcccctccatcaagagcgggaacgacatcgccaactgcctgcgcaaaaacggcaaacgggttatccagttgtcccgcaagacgttcgacacggagtaccagaagactaagaataacgactgggactacgttgtcactacggacatcagcgagatgggggccaactttcgggcggaccgcgttatcgacccacggcgctgcctgaagcccgtcatcctgaaggacggccccgagcgggtgatcttagccgggcccatgccagtcaccgccgccagcgcggctcagcgccggggcaggataggccgtaaccagaacaaggagggggaccagtacatctacatgggccagcccctgaacaatgacgaggaccacgcccactggaccgaagccaagatgctgctcgacaacatcaacacccccgaggggatcatccccgcgctgttcgaaccggagcgggagaagtccgcggccatcgatggcgagtaccgcctgcgcggggaggctcgcaaaacgtttgtggaactgatgcgtcgcggcgatctgcccgtgtggctgtcctataaggtcgccagcgagggcttccagtattcggaccggcgctggtgcttcgatggggaacgaaacaatcaagtcctagaagagaacatggacgtcgagatctggaccaaggagggtgaacgcaagaagttacgtccccgctggctggacgcccggacctattccgaccccctcgcactgcgcgagttcaaggaattcgccgccgggcgacgcagcgttagtggcgacctgatcctcgagatcggtaagctgccgcagcacttgaccctccgggcacagaacgccctggacaatttagtcatgctccacaacagcgagcagggcggcaaggcataccgccatgccatggaggagctgcccgacaccatagagacgctgatgctcctggccctgatagccgtgctcaccgggggcgtcaccctgtttttcctgagtgggaagggactcggcaaaacatcgatcggtctcctgtgcgtgatggcgtccagcgtgctactgtggatggcctcggtcgaaccccactggattgccgccagcataatactggagtttttcctcatggtgcttctgatcccggagccagacagacagcgcaccccacaggacaaccagctcgcctacgtggtaatcggcctcctgttcatgatcctaaccgtggcggccaatgagatggggctgttggagacaaccaagaaggaccttggcatcgggcacgttgtcgccgagaaccaccaccacgcgacgatgctggacatcgatctgcaccccgcttccgcgtggaccctctacgcggtggctacgacgattatcaccccgatgatgagacacacaatcgagaacactacggccaacatctcactgaccgccatagcgaatcaggccgccattttgatgggcctcgacaaaggctggcccatatccaaaatggatatcggggtgcccctgttggccctcgggtgctatagccaggtcaacccactgaccttaaccgccgcggtgctcatgctggtcgcccactacgccattatcgggccgggcctgcaggcaaaggcgacccgcgaggcccagaagcggaccgccgccggtatcatgaagaaccctaccgtcgacggcatcgtggcgatcgacctcgaccccgtcgtatacgacgcgaagttcgagaagcagctcggccagatcatgctgctcatcctgtgcacctcccagatcctgctcatgcgtaccacatgggccctgtgcgagtccatcaccctggccaccgggcccctcactactctctgggaggggtccccggggaagttctggaacaccaccatagccgttagcatggccaatatcttccgcggctcctacctagcgggcgccgggttagccttcagtctgatgaagagtctgggcggggggagacgcgggacaggtgctcagggcgaaacgctcggggagaagtggaagcgacaactgaaccaactgagcaaaagcgagttcaacacgtataagcgctccggaataatggaagtggaccggagcgaggccaaggaagggttgaagcgaggcgagaccaccaagcacgcggtctcccgggggaccgccaagctgcgctggttcgtggagcggaacctggtgaagcccgagggcaaggtcatcgacctgggctgcgggcgcggcggatggagctactactgtgctggcctaaaaaaggtgaccgaggtgaaggggtacaccaagggcggccccggccatgaggagcccatcccgatggccacctacggctggaacatcgtcaagctacattccgggcgggacgtgttcttcacccctccagagaagtgcgacacgctgctatgcgacatcggcgaaagctctcccaacccgaccatcgaggaggggcgcaccctgcgcgtgctgaagatggtcgagccctggctccgcggcaatcaattctgcattaagatcttgaacccctacatgcccagcgtggtagagacactggagcagatgcagcggaagcatggcgggatgcttgttcgcaacccgctgtcccggaacagcacgcacgagatgtactgggtgagttgcggtaccgggaacatcgtgagcgccgtcaacatgacctcccgcatgctactcaaccgcttcaccatggcccaccggaagcccacttacgagcgcgacgtggacctgggcgccggtacccggcacgtggcggtggaaccggaaattgccaacctggatatcatcgggcaacgcatcgagaacatcaagaacgagcataaaagcacctggcactacgatgaggacaacccctacaagacctgggcgtaccacggttcatacgaggtcaagccgagcgggtctgccagctccatggttaacggagtcgtgcggctcctgacgaaaccctgggacgtcattccgatggtcacccagatagccatgaccgacaccacgcccttcgggcagcagcgcgttttcaaggagaaggtggacacccggaccccgcgccccaagcggggcaccgcacagatcatggaggtgacagccaagtggctttggggctttcttagccgcaacaagaagccccggatatgtactcgcgaggaattcacacggaaggtgcgctctaatgcggccatcggagccgtcttcgtggacgagaatcaatggaattccgccaaggaggccgtggaagacgaacggttctgggatctggtccaccgcgagagagagctgcacaaacagggcaagtgcgctacctgcgtgtacaacatgatggggaagcgcgagaagaagctcggcgagttcgggaaggccaagggcagccgggccatctggtacatgtggctgggcgcccgcttcctggagtttgaggcgctcgggtttatgaacgaggatcactggttctcccgggagaatagcctgtccggggtggagggggaaggcctgcacaaactcgggtatatcctgcgcgacatctcgaagatcccgggcgggaacatgtacgccgatgacacggccggttgggacacccgcatcaccgaggatgacttacagaacgaagccaagatcacagacatcatggagcccgagcacgccctcctagcgacctccatattcaagctgacctatcagaataaggtcgttcgtgtacagaggcctgccaagagcggcaccgtcatggatgtgatctcccggcgcgaccagcgggggtcaggtcaggtgggcacctacggcttgaacacgtttaccaacatggaggtccagctgatcagacagatggaatccgagggcatcttcagtccctccgagctggagaacagcaacctcgccgaacgggtgctagactggctggagaagcacggggtggagcgcctcaagaggatggccatctcaggcgacgactgcgtggtcaagccgaccgacgaccgcttcgccaccgcgctgacggccttaaacgacatgggtaaggtgcggaaggacattccccagtgggaaccctcaaagggctggaacgactggcagcaagtccccttctgcagccatcactttcaccagctgatcatgaaagatggtcgcgagatcgtggtgccgtgccggaaccaggacgagctggtcgggcgcgcccgagtgagccagggcgccgggtggtccctgcgcgagaccgcctgcctgggcaaatcctacgcgcaaatgtggcagctgatgtactttcataggcgcgatctccggctcgccgcaaacgcaatctgcagcgctgtccccgtcaactgggtgcccacttcccgcaccacctggagcatccacgcgcaccaccagtggatgactaccgaggatatgttatccgtgtggaaccgcgtgtggatcgaggagaatccatggatggaggacaaaacccacgttagcagttgggaggacgtgccttacttggggaagcgggaggatcagtggtgcggcagccttatcggcctgaccgctcgcgccacgtgggctaccaacatccaggtagcgatcaaccaggtgcggcgtctgatcgggaatgagaactatctcgattatatgacctccatgaagcgcttcaagaacgagagcgaccccgaaggcgccctatggtga

SEQ ID NO: 24752 - RNA, 9879 nt, synthetic construct
  misc_feature 1..9879: note = derived and/or modified CDS sequence (opt11) from DENV-1__KM403632__SS-prME
  source 1..9879: mol_type = other RNA
agcgtcaccatgcttctgatgctgctgccaaccgccctcgccttccacctaaccactcgtggcggtgaaccccacatgatcgtttcaaagcaggaacggggtaagtctctcctattcaagacctccgcgggggtgaacatgtgcaccttaatcgccatggacttgggcgagctctgtgaggacactatgacctacaagtgccccaggataaccgaggccgagcccgacgacgtggattgctggtgcaacgccaccgacacctgggtgacatacgggacctgctcgcagacaggcgagcaccgccgcgacaagcggtccgtggccctggcgccccacgtgggattggggttagagacccgaaccgaaacctggatgagcagcgagggcgcctggaggcaaatacaaaaggtagagacttgggccctcagacacccggggttcacggtgatcgccttgttcctcgcgcacgctatcggcaccagcatcacccagaagggaatcatcttcatactgctgatgctcgtgaccccctccatggccatgcggtgcgtcggcatcggcaaccgcgacttcgtggaggggctgtcgggagccacatgggtggacgtcgtgctggagcacgggtcatgcgtgaccaccatggcgaagaacaagcctaccctcgacatagagctgttgaaaacggaggtcaccaaccccgcggtcctccggaagctgtgcatcgaggccaagatcagcaacactacaacggactcccgctgccctacccagggcgaggccacactcgtggaagagcaggatgcaaacttcgtctgccggcgcaccttcgtggaccggggctgggggaacggctgcggcctgttcggcaaggggtctctgctgacgtgcgcaaagttccgctgcgtgacaaagctcgaagggaagatcgtccagtacgaaaacctgaagtactccgtgattgtgactgtccacaccggcgaccaacaccaggtggggaacgagacgactgagcacggcaccatcgctaccatcacgccgcaggcccccacgagtgaaatacaactcaccgactacggggccctcaccttggattgctcgccccggaccggccttgacttcaacgagatggtcctcctgaccatgaaggaaaagtcctggctggtgcacaagcagtggtttctcgacctaccgctgccttggacctccggtgccagcaccagccaggaaacctggaaccgccaagacctccttgtgacgttcaaaaccgcccacgcgaagaagcaggaggtcgtggtgcttggctcgcaggagggcgcaatgcacaccgccctcactggggccacggagatacagaccagcggtacaaccacaatcttcgccgggcatctgaagtgccggctgaagatggataagctcaccctgaagggcgtgtcctacgtgatgtgcaccggcagctttaagctggaaaaggaggtggcggagacccagcacggcacggtcctagtccaagttaagtatgagggcactgacgccccctgtaagattcccatctccacacaggacgagaagggggtcacccagaatggccgcctcatcacggccaacccgatagtgaccgacaaagagaagcccgttaatatcgagaccgaaccgcccttcggggagagctacatagtcatcggcgccggcgagaaggctctgaaactgtcctggttcaaaaaggggagctccataggcaagatgttcgaggccaccgcccgcggggctcgccgcatggcgatcctcggtgatacggcatgggacttcgggtcaatcggaggcgtgttcacgtccgttgggaaactggtccaccaggtgtttggcaccgcctacggcgtgctgttcagtggggtctcctggaccatgaagatcgggatcggcatcctcctgacgtggttgggtctcaacagccggtcaactagcctgtccatgacctgcatagccgtggggatggtgaccctgtacctcggcgtcatggtgcaggctgacagcggttgcgtgattaactggaagggccgcgaactgaagtgcgggtcgggcattttcgtgacgaacgaagtgcacacctggactgagcagtataaatttcaggccgatagccccaaacggctctcggcggccataggcaaggcatgggaggagggcgtgtgcggcatcagatcggccacccggctcgaaaacatcatgtggaagcagatcagcaacgagttaaaccacatcttactagaaaacgacatgaagtttacggtcgtcgtaggggatgccaacggcatcctgactcaggggaagaagatgatacgtccccagcccatggagcacaagtactcctggaagtcctgggggaaggccaaaataattggcgcagacacccagaacacaaccttcatcatcgatgggcccgatacgccggagtgccccgatgaccagcgggcctggaacatttgggaggttgaggactacggcttcggagtgttcaccacaaacatctggctgaaactcagagactcctacacccagatgtgcgaccaccggctgatgagcgcggcgatcaaggactctaaggcggtgcacgccgacatgggctattggatcgagagtgagaagaacgagacgtggaagttggccagggcgtcgttcatcgaggtcaagacctgcatctggccccggagccacactctctggtccaacggcgtgctggagtcagagatgataattcccaagatctacgggggcccgatctcccagcataattaccgccccgggtacttcacccagacagcaggcccctggcacctggggaagctcgagctggacttcaacctatgtgagggcactaccgtggtcgtagacgagcactgcggcaatcggggtcccagcttgcgcaccacgaccgtgactggcaagattatccacgagtggtgctgccgatcctgcacgctgccgcccctgagattccgcggggaggacgggtgctggtatgggatggagatccgccccgtcaaagagaaggaggaaaacctggtgcggagcatggtgtccgccggcagcggcgaggtcgactcattttccctagggctgctctgcgtgtcgatcatgatcgaagaggtgatgcgctctcgctggtctcgaaagatgcttatgacggggacactggcggtcttcttcctcctgatcatggggcagttgacgtggaatgacctcatccgtttatgtatcatggttggagccaacgtgtccgaccggatggggatgggaacgacgtacttagccctaatggcgacattcaagatgcgcccgatgttcgccgtcgggctgctgttcagacgcctcaccagcagagaggtgctgctgctaacaatcgggctgagcctggtagccagcgttgagctgcctaactccctggaggagctgggcgacggtctcgccatgggtatcatgatgctgaagctgctcacggacttccagagtcatcagctgtggacgaccttactgagtctgaccttcataaagacgaccctgagcctcgattatgcctggaagactatggcaatggtgctgtccattgtcagcctattccccctctgcctgtccaccacgagccagaaaacaacctggctccccgtgctcctgggttccttcggatgtaaaccgctgaccatgttcctcatcaccgagaacaagatatggggccgcaaaagttggcccctgaacgaggggatcatggccgtgggcatcgtctccatcctgctcagctcgttacttaaaaacgacgttcccttggccgggcccctgatcgcaggcggcatgctgatcgcgtgctacgtgatttccgggtcatccgccgacctctccttagaacgggccgccgaggtctcatgggaggaagaggccgagcacagcggcgcgagtcacaacatactggtggaggtacaagacgacggaacgatgaagatcaaagacgaggagcgcgacgacacgctcaccatcctgctgaaggccaccctcctggccgtcagcggcgtgtatccgatgtccatacccgccactctgttcgtgtggtacttctggcagaaaaagaagcagcggtctggagtcctctgggacacccccagcccgcccgaggtggagcgcgccgtgctcgacgacggcatctaccggatcctgcagcgcggcttactcgggcggagccaagtcggcgtgggagtgttccaggacggagtcttccacaccatgtggcacgtaacccgaggggcagtgctgatgtaccaaggcaaacggctggagccctcctgggcctcggtcaagaaggaccttatctcctacggcgggggctggcgcttccaggggtcctggaataccggcgaggaggtccaggtgatcgcggtcgagccagggaagaaccccaagaacgtgcaaaccacgcccggcacattcaagacgcctgagggcgaggttggcgccatcgcccttgacttcaagcccggcacctccgggtccccaatcgttaatcgggagggcaagatcgtgggactgtatggaaacggagtggtcacgacctccgggacatacgtcagcgccattgcccaggctaaagccagccaggagggcccgttaccggagatcgaggacgaagttttcaagaagcgtaacctgaccataatggacttacatccgggatccggaaaaacccggcgatacctccccgcgattgtcagagaggccatcaagcggaagctgcgcaccctgattcttgcccccacccgggtggttgccagcgaaatggccgaggcgctgaagggtatgcctatccgttaccagaccaccgccgtcaagtccgaacacactgggaaggagatcgtggacttaatgtgccacgccacgttcaccatgcggttactgagccctgttcgcgtcccgaactacaacatgatcatcatggacgaggcccacttcaccgatcccgccagtatcgcggcccgaggttacataagcacccgtgtggggatgggggaggccgccgcgatcttcatgacggcgacaccgcccgggtccgtggaggcattcccccaaagcaacgccgtcatacaggacgaagagagagatatccccgagaggtcctggaactcgggctacgactggattacagacttccctggcaagacggtgtggttcgtgccctccataaagtcaggtaacgacatcgccaactgcctacgtaagaacggcaagcgcgtcatccagctctcccggaaaacgttcgacaccgagtaccagaaaacgaagaacaacgattgggactacgtggtgacgacggacatctctgaaatgggggctaacttccgcgcggatagggtgatcgacccgcgccggtgtctgaaacccgtgatcctgaaggacggccccgagcgagtcatcctcgccgggcccatgccagttaccgccgcatccgcggctcagcgacggggtcgcatcggccggaaccaaaacaaggagggcgaccagtatatctacatgggccagcccctcaacaatgacgaggaccacgctcattggaccgaggccaagatgctgctcgataacatcaatacacccgaggggataatccccgccctgttcgagccggagcgcgagaagtccgcggctatcgatggcgagtaccggctgcgcggcgaggcccggaaaacgttcgtggagctcatgcgcagaggcgacctgcccgtctggctgtcctacaaagtggccagtgagggcttccagtactccgaccgcaggtggtgcttcgatggcgagcggaataaccaggtgctcgaggagaacatggacgtcgagatctggaccaaggaaggcgagcgtaagaagctgagaccccggtggttagacgcccgcacctacagcgaccccctcgcactgcgagagttcaaggaattcgctgcagggcgcaggagcgtgtcaggggatctgatcctcgagatcggcaagcttccgcagcacctaacccttcgcgcgcagaatgcattagacaacctggtgatgttgcacaacagcgagcaaggcgggaaggcgtaccggcacgccatggaggagctgcccgacactatcgagactctgatgttactcgccctgatcgccgtcctcacagggggcgtgactctgttcttcctaagtgggaaaggacttgggaaaaccagtatcgggctcctgtgcgtcatggcgtccagtgtcctcctgtggatggcctccgttgagccccactggatcgctgcctccatcatcctggagttcttcctaatggtgctgctgatccccgagccggaccgccagcggactccccaagacaaccaattagcctacgttgtgatcggcttgcttttcatgatcctcaccgtggctgccaacgagatgggattattagagaccaccaaaaaggacctcggcatcgggcacgtcgtggccgaaaaccaccaccacgccaccatgctggacatcgatctgcacccagcctccgcttggaccctctatgccgtcgccactaccatcatcacgccgatgatgcgtcacactattgagaacactactgctaacatcagcctcacagccatcgcgaaccaggccgctatcctgatggggctcgacaagggttggcccatctccaagatggacatcggggtgcccctgttagccctcggctgctacagccaggtgaatcccctgacactgaccgcagcggtgcttatgctggtcgcccactacgccatcatcgggccaggcctgcaggcgaaggcgacccgcgaagcccagaagcggacggcggccgggataatgaaaaatcccaccgtggacggcattgtagccatagacctcgaccccgtcgtgtacgacgcgaagttcgagaagcagctcggccagatcatgctcctcatcctgtgcacgtcccagatcctgctcatgcgcaccacgtgggccctgtgtgagagcattaccctggcgaccggcccactgaccacgctgtgggagggctccccgggaaagttctggaacaccaccatcgccgtgtcaatggccaacatcttccgtggctcctacctagcgggagccgggctcgccttcagcctgatgaagtccctgggagggggccgcagggggaccggcgcccaaggagagacgctcggggagaagtggaagagacagctgaaccagctgagcaagagcgagttcaacacctacaaaaggtctggcatcatggaggtagatcggagcgaggccaaggagggtctcaaaagaggcgaaaccaccaagcacgcagtgtccagggggacggccaagctgcgttggttcgtagagcggaatcttgtcaaacccgagggcaaggtaatcgaccttggatgtgggcggggagggtggagctactactgcgccggcttgaaaaaggtgaccgaggtcaaggggtacacgaagggcggccccgggcatgaggagcccattccgatggccacctatggctggaacatagtgaagttacactccgggcgcgacgtatttttcacgccgcccgagaagtgcgatacgttactctgcgacatcggcgagagttccccaaacccgacaatagaggaggggcggaccctgcgcgtcctgaagatggtggaaccctggctccggggcaatcagttctgcatcaaaatcctgaacccttacatgccctcggtagtcgaaaccttggagcagatgcagcgcaagcatggcgggatgctggtgcgcaacccgctgtcacgcaacagcacccacgagatgtactgggtgtcctgcgggaccgggaacatcgtcagcgccgtgaacatgaccagtcgaatgctgttaaaccgtttcaccatggcccaccgcaagcccacgtacgagcgggacgtggacctgggcgccggtactcgccacgttgctgtagagcccgagattgccaatctagacattatcggccagagaatcgagaacatcaagaacgagcacaagagcacctggcactatgacgaggacaacccctacaagacctgggcatatcacggctcgtacgaggtgaagccgagcgggtccgccagctccatggtcaacggcgtggtccgcttgctcacgaaaccctgggatgtgatccccatggttacccagatcgccatgactgacaccacgcccttcgggcagcagcgggtcttcaaggagaaggtagacactcgaaccccgagacccaagcgcggcaccgctcaaatcatggaggtgacagccaagtggctgtggggctttctaagccggaacaaaaaacctcggatctgcactagggaggagttcacccgcaaggtccggagcaatgcggccatcggcgccgtttttgtggacgagaatcagtggaactccgctaaggaggccgtcgaagacgagcgcttttgggacctggtgcaccgggaacgcgagctgcacaagcaaggaaagtgcgcgacttgcgtgtacaatatgatgggaaaacgcgagaagaaactcggcgagttcgggaaggctaagggctcgcgcgccatctggtacatgtggctgggagcccgcttcctggaatttgaggcgctcgggttcatgaatgaagatcactggttctcccgcgagaacagcttgtccggcgtcgagggggagggcctacacaagctcgggtacatcctgcgcgacatcagcaagatcccgggcggtaacatgtacgccgatgacacggccgggtgggacacccggatcaccgaggatgacctgcagaacgaggcgaagatcaccgacatcatggaaccagaacacgccctactggcgacctccatcttcaagctgacatatcagaacaaggtcgttcgcgtccagcggcccgccaagtcaggcacggtgatggacgtaatatcccgcagagaccagcgcgggagcggccaggtaggcacttatgggctcaacacgttcactaacatggaggtgcagctcatacggcaaatggagtccgaaggcatattctcgccctccgagctggagaatagcaacctagccgagcgcgtcctcgattggcttgagaagcacggggtcgagcggttaaaacgcatggcgatctccggcgacgactgtgtcgtcaagccgacagacgatcggtttgccacggccctgacggcactgaatgacatggggaaggtccgtaaggatatcccacagtgggagcccagcaagggctggaacgattggcagcaggtccccttctgctcgcaccattttcaccagctcataatgaaggacggccgggagatcgttgtcccgtgccgcaatcaggacgaactagtagggcgagcccgcgtgtcgcagggcgcaggttggagccttcgggagacggcctgcctcggcaagtcatacgcccagatgtggcagctaatgtacttccacaggcgagaccttcgactcgccgccaacgccatctgtagtgccgtccccgtcaactgggtgcccacctcccgcaccacctggagcatccacgcacaccaccaatggatgacgactgaggatatgctatccgtctggaaccgggtgtggatagaggaaaacccctggatggaggataagacgcacgtgtctagttgggaggacgtcccgtacctggggaagcgcgaggatcagtggtgtggcagtctcataggcctgaccgcgcgggccacgtgggccaccaacatccaggtcgcgatcaaccaggtgcgcagactcattggtaacgagaactatctcgattacatgacctccatgaagcgcttcaagaacgaaagcgaccccgagggagccctgtggtga

SEQ ID NO: 24753 - RNA, 9879 nt, synthetic construct
  misc_feature 1..9879: note = derived and/or modified CDS sequence (opt11) from DENV-1__KM403583__SS-prME
  source 1..9879: mol_type = other RNA
agcgtgaccatgctgctcatgctgttgcccaccgccctggccttccacctgaccaccaggggcggggaaccccacatgatagtgtctaagcaagagcggggcaagagcctcctattcaagaccagtgcgggggtgaacatgtgcactctcatcgccatggacctgggcgagctctgcgaggacacgatgacctacaagtgcccccggatcactgaggccgaacccgacgacgtggactgctggtgcaacgccaccgacacctgggttacctacgggacctgcagtcagaccggcgagcaccggcgcgaccgtcgatccgtggccctggcgccccacgttggcctcgggctcgagacccggaccgagacctggatgtcgtccgagggcgcctggcgccagattcagcgagtcgagacctgggccctgcgccaccccgggttcacggtgatcgccctgtttctcgcgcatgccatcggcaccagcattacccagaaggggatcatcttcatactgctgatgctcgttaccccctctatggccatgcggtgtgtgggcatcggcaaccgcgatttcgtcgaggggctgagcggcgcaacgtgggtagacgtcgtgctggagcacgggagctgcgtaaccaccatggccaagaacaagcccaccctagacatcgagctgctgaagacagaggtcaccaaccctgcggtactccggaagctatgtatcgaggccaagatcagcaacaccaccacggactcccgctgccctacccagggcgaggccacactggtggaggagcaggatgccaacttcgtctgccggcgcactttcgtggacaggggctgggggaatggatgcggcctcttcggtaaggggagcctgttaacgtgcgccaagttcaagtgtgtgaccaagctcgaaggcaagatcgtccagtatgagaacctgaagtacagcgtgatcgtgaccgtacacaccggagaccaacaccaggtagggaatgagacgaccgaacatggcacgatcgcgaccatcacgccccaggctcccacgagcgagatccagctgaccgactacggtgctctcactctggactgcagcccgcggaccggcctggacttcaacgagatggtcctactgacgatgaaagagaaatcctggcttgtacacaagcagtggtttctcgacctgccgctgccctggacctccggggccagcacgagccaggagacctggaaccggcaggacttgctggtgacgttcaagaccgcacacgcgaaaaagcaagaagtagtggtgctgggctcccaggagggcgccatgcacaccgcactcacgggggccacggagatccaaaccagcggcaccaccacaatcttcgccgggcacctgaaatgccgcctgaagatggacaagctcaccctgaagggagtctcctacgtgatgtgcaccgggagctttaagctggagaaggaggtggcggaaacccagcacggcacggtcctggtccaggtgaagtacgaaggcaccgatgccccctgcaagatccccatatccacccaagacgagaagggggtcacccagaacggccgcctgatcacggcgaacccgattgtcacagacaaggagaagcccgtgaacatcgagaccgagccgcccttcggggagagctatattgtcataggtgccggcgagaaggcgttgaagctgagttggttcaagaaagggagctcgataggtaagatgttcgaggccacagcccgcggggcccgccggatggcaatcctcggcgacacggcgtgggacttcgggagcatcggcggcgtgttcacctccgtggggaaactggtccaccaggtgttcggcaccgcctacggggtgttatttagtggcgtctcctggaccatgaaaatcgggatcggcatcctcctgacgtggctgggcctcaacagccgctccacaagcctgagcatgacctgcatagccgtcgggatggtgaccctgtacctcggcgtcatggtgcaggccgacagcggatgcgtgatcaactggaagggacgggaactgaagtgcgggagtggcatctttgtcacgaacgaggtgcacacctggaccgaacagtacaagttccaggccgacagcccgaagcgcctgagcgcggccatcgggaaggcgtgggaggaaggggtgtgcggcatccggtccgcgacccgcctcgagaatatcatgtggaagcagatcagcaacgagctgaaccacatcctgctcgagaacgacatgaagttcaccgtcgtggtgggggacgccaacggcatcttgacccaggggaagaaaatgatccggccccagcctatggagcacaagtacagttggaagtcctggggcaaggctaagattatcggcgcggacacccagaacactaccttcatcatcgacgggcccgatactccagagtgccccgacgaccagagggcctggaatatctgggaggtggaggactacggcttcggggttttcaccaccaacatctggctgaagctccgggactcctacacacagatgtgcgaccataggctgatgtcggccgcgatcaaggactccaaggcggtgcacgccgacatgggctactggatcgagagcgagaagaacgagacgtggaagctcgccagagcctccttcatcgaggtgaagacctgcatctggccccgcagccacaccctctggtccaatggcgtgcttgagagcgagatgatcatccccaagatctacggaggcccgatctcccagcacaactaccggcccggatatttcactcaaacggcgggcccttggcaccttgggaagctcgagctggattttaacctgtgtgagggcaccaccgtagtagtcgatgagcactgtggcaaccgcgggccgagcctccggaccacgaccgtgacgggcaagataatccacgagtggtgctgcagatcctgcacgctgccgccccttcggttccgcggggaggacggctgctggtacgggatggagatccggcccgtcaaggagaaggaggagaacctcgtgcgcagcatggtgtccgccggcagcggggaggtcgacagcttctcccttgggctgctctgcgtgagcatcatgatcgaggaggtgatgcgctcccgatggagccgtaagatgctgatgacgggcacccttgctatcttcttcttgttaatcatgggtcagctgacctggaacgacctcatccgtctgtgtattatggtcggcgccaacgtgtccgaccggatggggatgggcaccacctacctggccctcatggcgaccttcaagatgcggccgatgttcgccgtgggcctgctgttccgccggttaacctctcgcgaggtactgctgctcaccatcgggctgtccctggtggcatccgtcgagctccccaactccctggaggagttaggcgacgggctcgccatgggcataatgatgctgaaactgttaacggacttccaaagccaccagctctggaccaccctgctctcgctgacattcatcaagacgaccctgagcctcgactatgcctggaagaccatggcgatggtgctgtccatcgtgagcctcttccccctctgcttaagtacgacgagccagaagacgacttggctgcccgtcctcctgggctcattcggctgcaaaccgttgaccatgttcctcatcaccgagaataagatctggggccgcaagagttggcccctgaacgagggtatcatggccgtcggcatcgtgtccatcctgctcagcagcctgctgaagaacgatgtccccttagccgggccactaatagccggcggcatgctgatcgcgtgctacgtgatctccgggagcagcgccgacctcagcctggagcgcgccgccgaagtgtcctgggaggaagaggccgagcatagcggcgcgtcccacaacatactggtcgaggtgcaggatgacggtacgatgaagatcaaggacgaggagcgggacgacaccctcactatactgctgaaagccaccctcctggccgtgtcaggcgtctacccgatgtccatacccgccacactgttcgtctggtatttctggcagaagaagaagcagcgctcgggggtgctttgggacacccccagcccgcccgaggtcgagcgggccgtgctggacgacggcatctaccgcatacttcagcggggcctgctcgggcgcagtcaggtgggagtcggggtgttccaggacggcgtgttccacaccatgtggcacgtcacccgcggggcggtgctgatgtaccagggcaagcgcctggagccctcctgggccagtgtgaagaaggacctcatctcttacggagggggctggcggttccaggggagctggaacacgggcgaggaggtccaggtgatcgcggtggagcccgggaagaaccccaagaacgtccagacaacccctggcacctttaaaacgcccgagggcgaggtgggggctatagccctggacttcaagcccggtacctccgggagtcccatcgtgaaccgcgagggcaagatcgtaggcctatatgggaacggcgtggtgaccacctccggcacatatgtctctgcgatcgctcaggcaaaggccagccaggagggcccgctccccgagatcgaggacgaggtgttcaaaaaacggaacctgaccatcatggacctgcatcccggatccggcaagacaagacgctacctcccggctatcgtacgggaagcaatcaagcgcaagctgcgcactctgattctcgcgccaactcgcgtcgtggccagcgaaatggccgaggcgctgaagggcatgcccatccggtaccaaaccacagccgtgaagagtgagcataccgggaaggagattgtcgacctgatgtgccacgccacgttcaccatgcgcctactgagcccggtgcgagtcccgaactacaacatgataatcatggacgaggcccactttaccgaccccgcctccatcgcggcccggggctacatcagcacccgggtcgggatgggggaggccgccgccatcttcatgacggcgacaccgcccgggtcggtggaggcgttcccgcaaagcaacgccgtgatccaggacgaggagcgcgacatccccgagcggtcctggaacagcggctacgactggatcaccgacttccccggcaagaccgtctggtttgtcccctccatcaagtctgggaatgacatcgccaattgcctgcggaagaacggcaagcgggtgatccagctttcccgcaagacgttcgacaccgagtatcagaagacaaagaacaacgactgggactacgtagtgaccacggacatcagcgagatgggggcaaacttccgggcggaccgcgtgattgaccctcggcgctgtctgaaacctgtcattctgaaggacggccccgagagagtgattctagcagggcccatgccggtcacggccgcctccgcagcccagaggcgcggccggatcggacgcaaccagaacaaggagggggaccagtacatctacatgggccagcctctaaacaacgatgaggaccacgctcactggactgaggccaagatgctcctagacaacatcaacacccccgaggggatcatccccgccctgtttgaaccggagcgggagaagtccgcggccatcgacggcgagtaccgcctgcgcggcgaggctcgcaagacgtttgtggagctcatgcggcgcggcgacctgcccgtgtggctttcctataaggttgccagtgagggcttccagtactccgatcggcgctggtgcttcgacggggagcgtaacaaccaggtgttggaggagaacatggacgtggagatctggaccaaggagggcgagaggaagaaactgcggcccagatggctggacgcccggacatacagcgacccccttgccctaagggagtttaaggaattcgcggccggacggcgcagcgtctccggcgacttaatcctggagatcggcaaattgccgcaacacctgaccctccgggcccagaacgccctggacaacctggtgatgctccacaatagcgagcagggcgggaaggcgtaccgtcacgccatggaggagctgcccgacaccatcgagacgctgatgctccttgccctgatagccgtgctcaccgggggcgtcaccctgttcttcctgtccgggaagggcctcggcaagacctcaatcgggctgctgtgcgtaatggcgtccagcgtgctcctgtggatggcctccgtggagccccactggatcgccgccagcataatcctcgagttcttcctcatggtgctgctaatccccgagccggaccggcagcgcacgccccaagataaccagctcgcctacgtggtcattggcctgctcttcatgatcctcaccgtggcggcaaatgagatggggcttctggagaccaccaaaaaagacctaggcatcgggcatgtggtcgccgagaaccaccaccatgctacgatgctggacatcgacctgcacccggccagcgcgtggaccctctacgccgtggccaccacaataatcacgccgatgatgcgccataccatcgagaacaccaccgccaacatcagcctgacagccatcgcgaaccaggccgccatcctcatgggcctcgacaagggctggcccatctccaagatggacatcggtgtgcccctgctggccctcggctgttacagccaggttaaccccctgacgcttaccgccgcggtactcatgctggtagcccactacgccatcatcgggccgggcctgcaggccaaggcgacccgggaggcccagaagcgcacggccgccgggatcatgaagaaccccaccgtcgacggcatagtggccatcgatctcgaccccgtggtctacgacgcgaagttcgagaagcagctgggccagatcatgttactcatcctctgcacttcccagatcttgttgatgcggaccacgtgggccctgtgcgagagcatcaccctagccaccgggcccctgaccacgctgtgggagggctcccccgggaagttctggaacaccaccatcgccgtgagcatggctaacatcttccgcggctcctacctggcgggtgccggactcgccttcagcctgatgaagtccctgggcgggggccggcgtgggaccggcgcccagggcgagacgctcggggagaagtggaagcggcagctgaaccagctgagcaagagcgagttcaacacgtacaaacgctccggcataatggaggtggaccggagcgaggccaaggaggggctcaagcgcggagaaaccaccaagcacgcagtctcccggggtaccgccaagctgaggtggttcgtcgagcgaaacctggttaagcccgagggcaaggtcatcgatctgggctgcgggcgtggcgggtggagctactactgcgccggcctcaagaaggtgaccgaggtgaaggggtacaccaagggtggccccgggcacgaggaaccgatcccgatggccacctacggctggaacatcgtcaagctgcactccgggcgagacgtgttcttcacgccgccggaaaagtgcgacacgctgctctgcgacatcggcgaaagctcccccaaccctaccatcgaggaggggcggaccctgcgggttctgaagatggtcgagccctggctccgcggcaaccagttctgcatcaagatcctgaacccctacatgcccagcgtggtggagaccctggaacaaatgcagcggaagcatggcgggatgctcgtacgcaacccgctgtcccgcaacagcactcacgagatgtactgggtgtcctgcggcaccggaaacatcgtgagcgcggtcaacatgacctcccggatgttgctcaaccgcttcaccatggcccaccgtaagccgacgtatgagcgcgacgtcgacctgggcgccggaacccggcacgtggccgtggaacccgagatcgcgaacctggatatcatcgggcagcgcattgaaaacatcaagaatgagcacaagagcacctggcactacgacgaggacaacccctataagacctgggcgtaccatggctcttacgaagtgaagcccagtgggtccgccagcagtatggtgaacggcgtcgtgcggctcctgacgaagccctgggacgtcattcccatggttacccagatcgctatgaccgacaccacgcctttcgggcaacagcgcgtgttcaaagagaaggtagacacccggaccccgcgccccaaaagaggaaccgctcaaatcatggaggtaacggccaagtggctgtggggcttcctctcacgcaacaagaagccaagaatctgcacccgcgaagagttcaccagaaaggtacgcagcaacgcagccataggggccgtcttcgtggacgagaaccagtggaactccgccaaggaggctgtggaggacgagcggttctgggatttagtccaccgcgagcgggagttgcacaagcagggcaagtgcgcgacgtgcgtgtacaacatgatggggaagcgcgagaagaagctcggcgagttcgggaaggcaaagggcagccgggccatctggtacatgtggctcggcgcccgcttcctggagttcgaggcgctcgggttcatgaacgaggaccactggttctcccgggagaatagcctgtccggcgtggaaggcgagggactgcataagctcgggtacatcctgcgggacataagcaagatcccgggcggcaacatgtacgccgacgacacggccgggtgggacaccaggatcaccgaggacgacctgcagaacgaagccaagatcaccgacatcatggaacccgagcacgccctccttgctacgtccatcttcaagctgacctaccagaataaagtcgtacgggtccaacgccccgccaagagcggcaccgtgatggacgtgatctcacgtcgcgaccagcggggaagcggccaagtgggcacctacgggcttaacacgttcaccaacatggaggtccagttaattcgccagatggaatccgagggcatcttcagcccctccgagcttgagaacagcaacctcgcggagcgggtgcttgactggctggagaagcacggtgtggagcgccttaagcggatggccatctcgggcgacgactgcgtggtcaagccgactgatgaccgcttcgccaccgcgctgacggccctgaacgatatggggaaggtccggaaggacatcccccagtgggagcccagcaagggctggaacgactggcagcaggtccccttctgctcccatcactttcaccagctcatcatgaaggacggtcgcgagatcgtggtaccgtgccggaaccaagacgagctggtcgggcgcgcccgggtgagccagggcgctgggtggagcctgcgcgagaccgcctgcctcggcaagtcctacgcgcagatgtggcagctgatgtacttccatcggcgcgatctgcgcctcgccgccaatgccatctgctccgccgtccccgtcaactgggtgcccacctcccggaccacctggagcatccacgcgcaccaccagtggatgacgaccgaggacatgctgtcagtctggaaccgcgtctggatcgaggagaatccctggatggaggacaagacccacgtgagtagttgggaggacgtgccttacctggggaagcgggaggatcagtggtgcggttcgttaatcggcttaactgccagggccacgtgggccaccaacatacaggtcgcgatcaaccaggtgcggcgcctgatcgggaacgagaactacctcgactacatgacctccatgaagcgtttcaagaatgagagcgaccccgagggcgccttatggtga

SEQ ID NO: 24754 - RNA, 9879 nt, synthetic construct
  misc_feature 1..9879: note = derived and/or modified CDS sequence (opt11) from DENV-1__KM403579__SS-prME
  source 1..9879: mol_type = other RNA
agcgtgacgatgctactcatgctcctgcccacggccctagccttccacctgaccacccgtggcggggagccccacatgatagtgtccaagcaggaacggggtaagtccctcctatttaagacctcggcgggggtgaacatgtgcaccctcatcgcgatggacttaggcgagttgtgtgaggacacgatgacctacaagtgcccacgcataactgaagccgaaccggacgacgtggattgttggtgcaatgccaccgacacctgggtgacttacggtacgtgtagccagaccggcgaacaccggcgcgacaagcgttccgtagccctggcgccccacgtgggcctgggcctggaaacgcgcaccgagacttggatgtcgtccgagggggcctggcggcagattcagaaagtagaaacctgggcactacgccatcctgggtttacagtgatcgctttgttcttggcgcacgccatcggcacctctattacccagaaggggattatctttatacttctaatgctagtgaccccatccatggccatgcgttgcgtcggtatcggaaaccgcgacttcgtcgaggggctcagcggcgccacgtgggtggatgtcgtgttagagcacggctcctgcgtgacaactatggctaagaacaaacccaccctcgacatcgagctgcttaagacggaggtaacgaaccccgcggtactgcggaagctctgcatcgaggccaagatctcaaacactaccacggactccagatgtccgacccaaggggaggctacattggtcgaggagcaggacgccaacttcgtctgcagacgtaccttcgtagaccgggggtggggtaacggctgtggactcttcggcaaggggagcttgttaacttgcgcgaagttcaagtgcgtcaccaagctcgagggcaaaatcgtacaatacgagaatctcaagtactccgtgattgttaccgtgcatacgggagaccaacatcaggtcggtaacgaaacgacagagcacggcacgattgctacaatcacgccccaagcccctacaagcgagatccagctcacagactacggggcactcaccttggactgcagcccacggaccggactggatttcaacgagatggtcctcctgacgatgaaggaaaaatcctggctggtgcacaagcagtggttcctcgacctaccgctgccttggacttccggtgcgtcgaccagccaggaaacctggaaccggcaggacctcctggtgacgttcaagaccgcacacgcaaagaagcaggaggtagtggtgctgggatcccaggaaggtgccatgcacactgcgctcaccggggccacggagatccaaacaagcgggacaacaaccatcttcgcagggcacctgaagtgccgcttgaagatggacaaattgaccctcaagggagtcagttacgtgatgtgcaccggcagcttcaagctggaaaaagaagtcgcggagacccagcacggcacggtccttgtccaggtgaaatatgagggcacagacgccccctgtaagatccccatctccactcaggacgagaagggggtcacccagaacgggaggctcatcactgccaaccccatcgtgaccgacaaggagaaacctgtaaatatagaaaccgagccgccttttggagagtcttacatagtaatcggcgccggcgaaaaagcgctaaagctatcctggtttaagaaggggtcatctatcgggaaaatgttcgaagcgactgcccgcggcgctcgtcgcatggccatcctcggcgatacggcctgggacttcgggagcatcggtggcgtgttcacctcggtggggaagctggtccaccaagtatttggcaccgcgtacggggtgctattctcgggcgttagctggaccatgaagattgggataggcatcctcctcacctggctaggcctcaacagccgctccaccagcctgtccatgacctgcatcgccgttgggatggtgaccctttacttaggcgtaatggtccaggcggatagcgggtgcgtcataaactggaagggccgggaactcaaatgtgggtccggcatcttcgtcacaaacgaggtgcatacctggaccgagcagtataagttccaggccgactcgccgaagcgcctaagcgcggccatcggtaaggcttgggaggagggggtgtgtggtattcgatccgccacgcgccttgagaacatcatgtggaagcagatcagcaatgagctgaaccacatactgctcgagaacgacatgaagtttacagtcgtcgtgggcgatgcgaacggcatactgactcaggggaagaagatgatccggccccagcctatggagcacaagtacagctggaaaagttggggcaaggcgaagatcatcggggccgatatccagaacactaccttcataattgacgggcccgatacaccggagtgccccgatgatcaacgtgcatggaacatctgggaggtcgaggattacggcttcggggtttttacaaccaacatctggctgaaactcagagattcatacactcaaatgtgcgatcaccgactgatgtcagccgcgatcaaagacagcaaggccgttcacgcagacatgggctactggatcgaaagcgagaagaacgaaacatggaagctggcccgcgcttcttttatcgaagtcaagacgtgtatctggcctaggtctcacacgctttggagcaatggcgtgctggagagcgagatgatcatcccgaagatctacggaggccctatctcacagcacaactaccggcctgggtacttcacgcaaaccgcggggccgtggcacctaggaaagctcgaattggacttcaacctgtgcgaaggtactaccgttgtcgtggacgagcattgcggcaacagagggccgtcgctccggaccacaacagtcacgggcaaaatcatccacgagtggtgctgtcgctcctgcacccttccgcccctgcgttttcgcggggaggatggttgttggtacggaatggagatacggccagtcaaggagaaggaagagaacctcgtccgcagcatggtgtccgccgggagcggcgaggtcgactctttcagcctggggttactctgtgtgagcatcatgattgaagaagtgatgcgttcccggtggtccagaaaaatgctgatgaccggcaccttagccgtcttctttctgctgatcatggggcagctcacttggaacgacctcatacgcctgtgcatcatggtgggggctaacgtatctgaccgcatgggtatggggactacgtacctggcactcatggcaaccttcaaaatgcggcccatgtttgccgtcggtctgttatttcgacggcttactagcagagaggtgctgttgctcacgatcggcctgagcctggttgctagcgtagagctacccaatagtcttgaggaattaggggacggcctcgccatgggcatcatgatgctgaagctgctcaccgattttcagagccatcagctatggacgactttgctctccctgaccttcatcaagaccacattgtcccttgactacgcctggaagaccatggcaatggtgctgtccatcgtttcactcttccccctctgcctgtccacgacctcgcagaagacgacctggctgcccgttctcctgggctccttcgggtgcaaacctctgaccatgttcctcatcaccgagaacaagatctggggtcgcaagtcctggccactgaatgaggggattatggccgtgggcatagtctccatcctgctcagcagcttattaaagaatgacgtgccactcgcagggccgctgattgccggcggcatgctgatcgcctgctatgttatctccggaagctccgcagacctcagcctggaaagggccgccgaagtctcttgggaagaggaagccgagcacagcggagcttcccataacattctggttgaggtccaggatgacgggaccatgaagataaaggatgaggagcgcgacgacacgctcaccattctgctgaaggccaccctcctggccgtctctggcgtgtacccgatgtctatcccagccaccctgttcgtgtggtacttttggcagaagaagaagcaacgcagcggcgtactgtgggacacgccttctccgcccgaggtggaaagagctgtgctggacgatggcatttaccgaatcctgcagcgagggctgctcgggcgcagccaggtcggcgtgggagtatttcaggacggcgtctttcacaccatgtggcacgtgacaagaggggcggtgctaatgtaccagggcaagcgcctagagccctcctgggcctcagttaagaaagacctcatctcctacggtggaggctggcgtttccagggcagttggaacacgggcgaggaggtacaggtgatcgcggtcgagcccggcaaaaaccccaagaatgtgcagacgacgcccggcactttcaagacccccgagggcgaggtaggggcgatcgcactggacttcaagcctggcacgtccgggagccccatcgtaaaccgcgagggcaagatagtagggctgtatgggaacggtgtcgtcaccacctccggtacctacgtgagcgccatcgcccaggctaaagccagccaggagggcccactccccgagatcgaggacgaggtgtttaaaaagcggaacctgaccataatggacttacatcccgggagtggcaaaacccgccggtacctcccggcgatcgtgcgcgaagcgatcaagcgcaagctgcggaccctaatcctcgccccaactcgcgtggttgccagcgagatggccgaggcactcaagggtatgcccatacgataccagacgaccgccgtaaagagtgaacacaccggaaaagagatcgtggatctgatgtgtcacgccacattcacgatgcgtttgctgagtccggtccgcgtcccgaactacaacatgattatcatggatgaggcgcacttcaccgatcccgcttccatcgctgcgcgtggatacatctcaaccagggtgggaatgggcgaggccgccgccatcttcatgactgctacgccgcccgggtccgttgaggcattccctcagagcaacgccgtcatccaagatgaggagcgagatattccggagcgttcgtggaacagcggctatgactggatcacagatttcccaggcaaaaccgtctggtttgtccccagtattaagtcaggtaacgacatcgccaactgtctgaggaagaacggcaagcgggttatccagctctctcgaaagaccttcgacacagagtaccagaagaccaagaacaacgattgggactatgttgtgacgaccgacatttcggaaatgggggccaacttcagagcggatcgcgtcattgaccctcgtcgctgcctgaagcccgtaatcctgaaagacggccccgagcgggtcatcctcgcgggtcccatgccggtaacagcggcctcggcggcccagcgccggggccgcatcggccggaaccagaacaaggagggagaccagtacatctatatggggcagcctctgaacaatgacgaggaccatgcccactggaccgaggccaaaatgcttctcgacaacatcaacacgcccgaagggatcattcccgcgctgtttgagccggagcgagagaagtccgcagccatcgacggggaataccgccttcgcggggaggcgcgaaaaactttcgtggaattaatgcgccgcggagaccttcccgtctggctgtcctataaggttgccagcgagggctttcagtactcagatcgtaggtggtgctttgacggggagcgtaacaatcaggtgctcgaagagaatatggacgtcgagatctggacgaaggagggcgagagaaagaaacttcggccgcggtggctcgacgcccggacctactcagatccactcgcgttacgcgagttcaaggagttcgccgccggtcgacgatcagtttccggcgacctgattttagaaatcggcaagctgccgcagcacctgaccttacgggcccagaacgcacttgacaacttagtgatgctccacaattcggagcaaggagggaaagcgtaccgccacgcaatggaagaactcccggacaccatcgagaccctcatgttgctcgccctcattgccgtactcacagggggagtaacactcttcttcctgagcgggaagggcttaggtaagaccagcattgggctcctgtgcgtcatggcgtcttcagttctcctctggatggcatcagtggagccccactggatcgccgcctcgatcatcctcgaatttttcctgatggtgctgctgatccccgagccggaccgacagcgaactccccaagacaaccagctagcctacgtcgtgatcggtttgctgtttatgatccttacggtcgcggcgaacgagatggggctgcttgagaccactaagaaggaccttggcatcggtcatgtcgtggccgagaaccatcaccatgccactatgttggatatcgacctgcaccccgcttccgcgtggaccttgtacgccgtagcaaccaccatcatcacccccatgatgagacacacgatcgagaacaccaccgccaacatcagcctgacagccatcgcgaaccaggctgccatcctgatggggctcgataaaggctggcctatctccaaaatggatatcggtgtccccctgttggccctcggatgctatagccaggtaaaccccctgactctaacggctgcggtgctcatgttagtcgcccactacgccatcatagggccgggcctgcaggccaaggccacacgcgaagcgcagaaacgcaccgcggcagggattatgaagaaccccacggtggatggcatcgtggcgatcgatttagatcccgttgtgtacgacgcgaagttcgagaagcagcttggacagatcatgctgcttatcctgtgtacctcccaaatcctgctcatgcggaccacctgggcactgtgcgagagcatcaccctcgccaccgggccgctcacaaccctatgggaaggctccccagggaagttctggaacacgacgatcgccgtctcgatggccaacatctttcgcggctcttatcttgcaggcgccgggctcgcgttctctctcatgaaatccctgggcgggggccgcagaggaacaggcgcccagggagagaccttgggagagaaatggaagcgacaactaaaccagcttagcaagtcggagttcaacacctacaagcgctccggcatcatggaggtcgacaggtcagaagccaaggaggggctcaagaggggagaaaccacaaagcacgctgtgtcccggggcaccgctaagctacgctggttcgtggaacggaatctggtcaagcccgagggtaaggtgatcgacctgggctgtggacgtggcgggtggagctactactgcgcgggcctcaaaaaggtgacggaggtcaaggggtacaccaagggaggccccggtcatgaggaacccataccgatggcaacctacggctggaacatcgttaaattacattcagggagggacgtcttctttacgccgccagaaaagtgcgacaccttgctctgcgacatcggggagtcgtcccccaaccctacgatcgaggaagggcgcaccttgcgggtcctgaaaatggtagagccctggctccgcggcaaccagttttgcatcaagattctgaacccctacatgcccagcgtggtcgagacactggaacagatgcagcgaaaacatggtggaatgctggttaggaatccgttatcccgcaactcgacgcacgagatgtactgggtgagctgcggtacggggaacatcgtctctgccgtgaacatgacttcgcgcatgttactcaaccgcttcacgatggcacaccggaaacccacttatgaacgcgatgtggaccttggcgcaggcacgcggcacgtcgccgtggagcccgagatcgcgaaccttgacattatcgggcagcgcatcgaaaacattaagaatgagcacaagagtacctggcactacgatgaggacaacccctacaagacttgggcgtaccacgggtcctacgaggtgaagccgtcgggctccgccagctccatggttaacggcgtggtccggctcttaactaagccatgggatgtcattcctatggtgactcagatcgccatgacggacaccacccccttcggacagcagcgcgtctttaaagagaaagtagacactcgcacaccgcgccccaaacggggcaccgctcagataatggaagtgaccgccaaatggctgtggggcttcctgagccgcaacaagaagccccgcatctgtacgcgggaggagttcacacgcaaagtgcgatcaaatgcagccataggggccgtttttgtggatgaaaaccaatggaactctgctaaggaggccgtcgaggacgaacgcttctgggacctggtgcatcgcgaacgggagctgcataagcaaggcaaatgcgccacatgcgtgtacaatatgatgggtaaacgcgaaaagaagctcggtgagttcgggaaggccaagggctcgcgggccatttggtacatgtggctcggagcccgcttcctggagtttgaggccctcgggtttatgaacgaggaccactggttttccagggagaatagcctgagcggtgtcgagggggagggcctacataagctaggatacattttgcgcgatatatcgaagatcccgggaggaaacatgtacgccgacgacacggctggctgggatacacgtataactgaggacgacctgcaaaacgaggccaaaatcacagatatcatggagcctgagcacgctctactagcgacaagtatcttcaaacttacctaccagaataaggtggtacgcgttcagcggcctgccaagtccgggacggtgatggacgtgatcagtcgacgggaccaacgcgggagcggccaagtcggcacgtacggactcaacacgtttacgaacatggaggtgcagctcatccgacagatggagtccgaaggcatcttcagccccagtgaactggggaacagcaacctggccgagcgggtgctggactggttggaaaaacacggcgtcgagcggttgaagcgcatggcaatcagcggggacgactgcgtggtcaagccgactgatgatcgcttcgccaccgcactgactgccctgaatgacatgggcaaggttaggaaggacattccccagtgggaaccatctaagggctggaacgattggcagcaggtccctttctgcagccaccactttcaccagttgatcatgaaggacgggagggaaattgtggtcccctgccgcaaccaggatgagctagtcggccgagcccgagtgtcgcagggcgctggctggagccttcgagaaacggcatgcctcgggaagtcctacgcgcaaatgtggcagcttatgtactttcacagacgcgatttacggttggccgccaacgctatctgcagcgccgtccctgtcaactgggtgcccacctcgcgcaccacctggagcatccacgcgcaccaccaatggatgacaacggaggacatgttatccgtctggaaccgcgtctggatcgaggagaacccatggatggaggacaaaacacacgtgtcaagttgggaggacgtcccgtacctgggcaagcgggaggaccaatggtgcggcagtcttatcggcctgactgcacgagcaacctgggccacgaatatccaagtggcgatcaaccaggtgcgtaagctaatcggtaacgagaactatttagactacatgacttccatgaaacgtttcaaaaacgaaagcgacccagagggggccttgtggtga

SEQ ID NO: 24755 - RNA, 9879 nt, synthetic construct
  misc_feature 1..9879: note = derived and/or modified CDS sequence (opt11) from DENV-1__HM469968__SS-prME
  source 1..9879: mol_type = other RNA
tcggtgaccatgctgctcatgcttatgcccacggcactggccttccacctcaccacccggggtggggagccccacatgatcgtcagcaagcaggaacgaggcaagtctctgttattcaagaccagcgccggggtgaatatgtgcacgctcattgccatggacctgggagagttatgcgaggacaccatgacctacaagtgcccccgcattaccgaggccgaacccgacgacgtggactgttggtgcaacgccaccgacacgtgggtgacctacgggacctgcagccagaccggtgagcaccggcgcgacaagcgttccgtggccctcgcgccccacgtgggcctggggctggagacgcgcaccgagacctggatgagctccgagggcgcctggaagcagatccagcgggtcgagacctgggccctgcgacaccccgggttcacggttatagccctgtttctggcgcacgccatcggcaccagcataacccagaaggggattatcttcatcctcctgatgctggtgacccccagcatggccatgcggtgtgtcggcatcggcagcagggacttcgtggagggactctccggagccacgtgggtagacgtcgtgctggagcacgggagctgcgtgaccaccatggccaaagacaagcctaccttggacatcgaactcctgaagacggaggtcacgaaccccgcggtgctgcggaagctctgcatcgaggcaaagatctccaacaccacgacggacagccgctgcccgacccagggcgaggcgaccctggtggaagaacaggatgccaacttcgtctgccggcgcaccttcgttgaccgcggctgggggaacggctgtgggctgttcgggaaggggtccctcatcacttgtgctaagtttaaatgcgttaccaagctggaggggaagatcgtccagtacgagaacctgaagtacagcgtgatcgtgaccgtccacaccggagaccagcaccaggtggggaacgaatctacggagcacggaaccactgccaccatcactccccaggcccccacgaccgagatccagctcacggactacggggccctgaccctggactgtagccccagaacgggcctcgacttcaatgaaatggtcctgctgaccatgaaggagaagtcatggctagtgcacaagcagtggttcctggacctgcccctcccttggactagcggggcctcaacctcccaagagacgtggaaccggcaggacctgctggtgaccttcaagaccgctcatgccaaaaagcaggaggtcgtggtgctcggcagccaggagggcgctatgcacaccgccctgaccggggccacggagatccaaacctccgggaccacgaccatattcgcagggcacctgaagtgccgcctcaagatggacaagctgactctcaagggcatgagctacgtcatgtgcaccgggtccttcaaactcgagaaggaggttgcggaaacgcagcacggcaccgtgctggtccagatcaagtacgagggcacggacgccccctgcaagatcccgtttagcacccaggacgagaaaggggtgacgcagaatggccgactgataacagccaacccgatcgtgaccgacaaggagaagcccgtcaatatcgaggccgaaccaccctttggtgagagctacattgtgataggggccggcgagaaggccctgaagctcagttggtttaagaaggggtcaagcatcggcaagatgttcgaggcaaccgcccgcggggcccggcgcatggcaatcctgggagacacggcctgggacttcggttccataggcggtgtcttcaccagcgtcggtaagctggtacaccagatcttcggcaccgcctacggcgtgctgttcagcggcgtaagctggaccatgaagatcgggatcggcgccctgctgacatggctaggcctgaactcccggtccacctccctgagcatgacctgcatcgctgtggggctcgttacgctttacctgggcgtaatggtgcaggcggacagcgggtgcgtgattaactggaaaggccgggagctcaagtgcgggagcggcatcttcgtcacgaacgaggtgcacacctggacagagcagtacaaattccaggccgacagccccaagcgcctctccgccgccattggtaaggcctgggaggagggggtgtgcggcatacggtccgccacccgcctggagaacatcatgtggaagcagatctccaatgagctcaaccatatcctgctggaaaacgacatgaagttcaccgtcgtggttggggacgtcgccggaatcctcgctcaggggaaaaagatgatccggccccaacccatggagtacaagtacagctggaagtcatggggcaaggccaagatcatcggcgcggacgtgcagaatacgactttcatcatcgacgggcccaacaccccggagtgcccggatgaccagagagcatggaacatctgggaagtggaggactatggcttcgggatcttcaccacgaacatctggcttaagctgcgggacagctatacccaggtctgcgaccaccgcctcatgtctgccgccatcaaggacagcaaggccgtgcacgccgatatgggctattggatcgaatccgaaaagaatgagacctggaaattggcccgggcctcctttattgaggtgaagacctgcatatggcccaagtcccacacgctgtggagcaacggcgtcttagaaagcgagatgatcatccccaagatatacggcggaccgatcagccagcacaactaccgccccgggtacttcacccagaccgcgggcccttggcacctggggaaactggagctcgacttcgacctgtgcgagggcacaacggtggttgttgacgagcactgtggcaaccgggggccgtccctgcggaccaccaccgttacggggaagatcatacacgagtggtgctgccggagttgcacccttcctcccctaagattcagaggggaagatggttgctggtacgggatggaaatccgccccgtgaaagagaaggaggagaacctggtcaaatccatggtgtcggcaggatctggcgaggtggactcctttagcttggggttactgtgcatcagcattatgatcgaggaggtcatgagaagccgctggagccggaagatgctcatgaccggcaccctcgcggtgtttttcctgctaatcatggggcaactgacgtggaacgatttgatacgcctctgtatcatggtaggcgcaaacgcctccgaccgtatggggatgggcaccacctacctggccctgatggccacctttaaaatgcggccgatgttcgcggtcggattactgttccgtcggctgacgagccgcgaggtgctcctgctgaccatcgggctcagtctggtggcgagtgtcgagctccccaacagtctcgaggaactgggcgacgggctggccatgggcattatgatcctaaagctgcttaccgacttccagtcccaccagctctgggccaccctgctgagcctcacgtttatcaagaccacattctcactgcactacgcgtggaaaaccatggcaatggttctgagcatcgtttccctcttccccctgtgcctgagcaccacctcccagaagaccacctggctccccgtcctgttgggcagcctcggttgcaagccgctgacgatgttcctgatcgccgagaataagatctggggccggaaatcctggcccctcaacgagggtatcatggccgtgggcatcgtcagcatcctgctgtcgtccctcctgaagaacgacgtgcccctggccgggccgctcatcgcaggcggcatgctgattgcttgctacgtgatctctgggtccagcgccgacctgtccctagaaaaggccgcagaggtcagctgggaggaggaggcggagcactccggcgccagccacaacatcctggtggaggtgcaggacgacgggaccatgaagatcaaggacgaggagcgcgacgacaccctgacaatcctcctgaaggcaaccctgcttgccgtatccggcgtgtacccgctgagcatccccgccacgctgttcgtgtggtatttttggcagaagaagaagcagagatccggggtcctctgggacacccccagcccgcccgaggtggagcgcgcggtgctggacgacggcatttaccggatcatgcagcgcggattgctgggccggagccaggtcggcgtaggggtgttccaggaaaacgtctttcacaccatgtggcacgtaaccagaggcgcagttctcatgtaccaaggaaagcggctggagcccagctgggcctccgtcaaaaaggacctcatcagctacggtggcgggtggcgactccagggctcctggaacactggtgaggaagtccaggtgatcgctgttgagcccggcaagaacccgaagaacgtgcagaccgcccctgggaccttcaagacccccgagggtgaggtgggcgcgatcgccctcgacttcaagcccgggacgagcggcagccccatcgtcaaccgggagggaaagatagtgggcctgtacggcaacggggtggtcaccaccagcggcacctacgtgagcgccatagcacaggcgaaggccagtcaggaggggccactccccgagatcgaggatgaggtgttccgaaaacggaacttaacgatcatggacctgcaccccggcagcgggaagactcgccggtacctcccagccatcgtccgcgaagccatcaagcggaaactgaggactctgatcctcgcccctacgcgcgtggtggcgtccgaaatggccgaagccctgaagggcatgcccatcaggtatcagacgaccgccgttaagagcgagcataccggcaaagaaatcgtggatctgatgtgccacgcaaccttcacgatgcgcctactgtcccccgtgcgggtcccaaactacaatatgatcatcatggacgaggcgcatttcaccgaccccagctcgatcgccgcccgcgggtacatctctacccgggtgggcatgggagaggccgccgcaatcttcatgaccgcaacgccgcccggctcggtggaggccttcccgcaaagcaacgccgtcatccaggacgaagaacgggacattccagaacggtcctggaacagcgggtacgagtggatcaccgacttccccggcaagaccgtgtggtttgtgccctccatcaagagcggtaacgatatcgcgaactgcctgagaaagaatgggaagcgagtcatacaactctcccgcaagacattcgacacggagtaccagaaaaccaagaacaacgactgggactacgtagttaccaccgacatcagcgagatgggcgcaaacttccgggccgaccgcgttatcgacccgcgacgttgcctgaagcccgtgatcttaaaggatgggccagagcgggtgatcctcgcgggccccatgccagtcacagtggcctcagcggctcagcgccgggggcgaatcggcaggaaccacaacaaggaaggggatcagtacatctacatgggacagcccctgaacaacgacgaagaccacgcccactggaccgaggccaagatgctgctagacaacatcaacacccccgagggcatcattcctgccctgttcgagccggagcgtgagaagtcagcggccatcgacggggagtaccgccttcggggcgaggcacgcaagacctttgtcgagcttatgcggagaggggacctgcccgtgtggttgagttacaaagtggcctccgagggctttcagtacagcgaccggcgctggtgcttcgacggcgagcggaacaaccaagtcctcgaggagaacatggacgtggagatctggacgaaggagggggagcgcaagaagttgaggccccgctggttggacgcccggacctactccgaccctctggcgctgcgcgagttcaaggagttcgccgccggaagacgcagcgtgtccggggacctgattctcgaaataggcaagctgccgcagcacctgacccagcgggcacagaacgcgctcgacaacctggtcatgcttcacaacagcgaacagggcgggcgcgcctaccggcacgccatggaagaactgccggacacgatcgagacattgatgttgttggcgctaatcgccgtgctgaccggaggcgtaaccctgttcttcctgtccggccgcggactgggcaagaccagcatcggactgctgtgcgtcatggcatccagcgtacttctctggatggcctccgtggagccccattggatcgccgcgagcatcatcctggagttcttcctgatggtcctcctgatccctgagccggaccggcagcgcacgccccaggacaaccagctggcctacgtggtgatcgggctcttgttcatgatcctcacagtcgcggccaatgagatgggcctactggagaccactaagaaggacctgggtattggacatgtggcggtggaaaaccaccaccacgccgccatgctcgacgtcgacctgcaccccgcgtccgcctggaccctgtacgccgtggccacgaccatcatcaccccgatgatgcggcacaccatcgagaacacgactgcgaacatcagcctcactgcgatcgccaatcaggccgctatcttgatggggctggacaagggctggcccatttctaagatggacatcggcgtgcctctcctggctctggggtgttacagccaagtcaaccctttgacccttacagccgccgtgctgatgctcgttgcccactacgccataatcgggccggggttacaagcaaaggccacccgcgaagcccagaagcgcaccgccgccggcatcatgaagaaccccaccgtcgatggtatcgtggcgatcgacctggaccccgtggtctacgacgccaagttcgagaagcagctcggccaaataatgctgctgatcctctgcacgtcccagatactgctgatgaggaccacgtgggcactatgcgagagcataaccctggccacgggccccctgaccaccctctgggaggggtcaccgggcaagttctggaacacaacaattgccgtgagcatggcgaacatcttccgcgggtcctatctggccggcgcaggtctggccttcagcctcatgaagtctcttgggggcgggcggcgcgggaccggcgcgcagggtgaaacactgggcgagaagtggaagcggcagctcaaccagctctccaagtcggagttcaatacctacaagcgctccggcatcatggaagtggacagatccgaggccaaggagggcctgaagcgcggggagaccaccaaacacgcggtttcccggggaaccgccaaactccgctggttcgtggagcggaacctggtgaagcccgaggggaaggtcatcgatctgggctgcggccgcgggggctggagctactactgcgccgggctgaagaaggtgaccgaggtgaaaggctacactaaaggcggccccggccacgaggagcccataccgatggcgacctacgggtggaacctcgtcaagctgcactcgggcaaggacgttttctttatcccaccagagaagtgcgacaccttgttgtgcgacatcggggagagctccccaaacccgacgatagaggagggtcggacactccgcgtgctgaagatggtcgaaccctggttgcgggggaaccaattctgcatcaagatcctgaatccctacatgcccagcgttgtggagaccctggagcaaatgcagcggaagtacggcggcatgctcgtccgcaacccgctgtcccgcaacagcacccacgaaatgtactgggtgtcctgcgggaccgggaacatcgtgagcgcggtaaacatgaccagccggatgctgctcaaccggtttacaatggcccaccgcaagcccacctacgagcgggacgtggacctgggagccggtacccgccacgtggcggtggaacccgaggttgcgaacctagacattatcggccagcggatcgagaacataaagcacgagcacaagtcaacatggcactacgacgaggacaacccgtacaagacgtgggcctaccacgggtcctacgaggtgaagccgagcggctccgccagcagcatggtcaacggcgtggtcaagctcctgaccaagccctgggacgtaatccccatggtgacccaaatcgctatgactgatacgacccccttcgggcagcagcgcgtcttcaaggagaaggtggacacgagaactccgaaggccaagcgcgggacggcgcagatcatggaggtgaccgcccggtggttatggggcttcctgagtcgtaacaagaagccccggatctgcacccgcgaggagttcacccggaaggtccggagcaatgcggccataggcgcggtgttcgtggatgagaaccagtggaacagtgcgaaggaggccgtcgaggatgagcggttctgggatttagtgcatcgtgagagagagttgcacaagcaggggaaatgcgccacgtgcgtctacaacatgatgggcaagcgcgagaagaagctcggggagttcggcaaggccaaggggagccgtgcgatctggtacatgtggctgggcgcccgcttcctggagttcgaggccctcggtttcatgaatgaggaccactggttctcccgagagaacagcctgtccggggtcgagggcgaggggctgcataagctcggttacatcttacgcgacatctctaaaatcccagggggcaacatgtacgccgacgacaccgccggctgggacacccggattactgaggacgatctgcagaacgaggcgaagatcacggacatcatggagccagagcacgccctcctggccaaggccatcttcaagctgacttaccagaacaaggtggtgcgcgtccagcgccccgccaagaacggcaccgtcatggacgtgatatcaagacgcgaccagagaggcagcggccaggtggggacctacgggctcaacacgttcaccaatatggaggcccagctgatccgccagatggagtccgaggggatctttctgccctccgagctcgagacccccaacctggccgagagagttctggactggctcgagaagtatggcgtggagagactgaagcggatggcgatctccggtgatgactgtgtcgtgaagccgatcgatgaccgcttcgccaccgccctgacggcgctcaacgatatggggaaagtgagaaaggacatcccccagtgggagcccagcaagggctggaacgactggcagcaggtccccttctgctcccaccatttccaccagctgattatgaaggacggcagggagatcgtggttccgtgccggaaccaggacgagctggtcgggcgggcccgggtgagccagggggcgggctggtccctccgggaaacggcatgcctgggtaagagttacgctcagatgtggcaactgatgtacttccaccggcgcgacctccgtctggccgccaacgcaatctgcagcgcagtgcccgtcgactgggtgcccaccagccgcactacatggagcatccacgcgcaccaccagtggatgaccactgaggatatgctgtccgtttggaaccgggtctggatcgaggagaacccctggatggaggacaagacccacatcagctcgtgggaggacgtgccgtacctcggtaaacgcgaggaccagtggtgcgggagcctgatcggcttgacagcccgcgctacctgggccaccaatattcaggtggccatcaaccaggttcggcgcctcataggcaacgagaattacttagactacatgacctccatgaagcggtttaagaacgagagcgacccggagggggcgctgtggtga

SEQ ID NO: 24756 - RNA, 9879 nt, synthetic construct
  misc_feature 1..9879: note = derived and/or modified CDS sequence (opt11) from DENV-1__KC172834__SS-prME
  source 1..9879: mol_type = other RNA
agtgtgaccatgctgctgatgctgatgcccacagccctggcctttcatctcaccactcgcggcggggagccacacatgatcgtcagcaagcaggagcgaggcaaaagtctgctgttcaagacctccgcaggggtcaacatgtgcaccctcatcgccatggacctgggcgagctgtgcgaagatacgatgacctataagtgcccccgtatcaccgaagccgagccggatgacgtggactgctggtgcaacgccactgacacctgggtcacctatgggacatgctctcaggccggcgagcaccggcgggacaaacgctccgtggcccttgcgccgcacgttggcctaggtctggagacccggacggagacttggatgagctccgagggcgcctggaaacaaatacaacgggtggagacctgggccctccgccaccccggtttcacggtgatcgctctgttcctggctcacgcaatcggcactagtatcacgcagaagggaattattttcatcctactgatgctggttacaccctccatggccatgcggtgcgtcggcatcggcagccgcgactttgttgaggggctctccggtgctacctgggtggacgtcgtgctcgaacacgggagctgtgtgacgaccatggcgaaggacaagccgacgttggacatagagctcttaaagaccgaagtcacgaaccccgccgtgcttcggaagctctgcatagaggccaagatctccaacaccaccacggacagccgctgccctacgcagggcgaggccaccctggtagaggagcaagacgccaacttcgtctgtcggcgcacattcgtggaccgaggctgggggaacggctgcgggctgttcggcaaagggtccctcctgacttgcgcgaagttcaagtgcgtcacgaagctggagggcaagatcgtccaatacgagaacctcaagtacagtgttatcgtgacggttcacaccggcgaccagcaccaggtcggtaacgagtccaccgagcacggcactacagccaccatcacgccccaggcccccaccacggagatccagttgacagactacggcgcattgaccctcgactgcagcccacgcaccggcctggacttcaatgagatggtactgctcaccatgaaagaaaagtcctggctggtacacaagcagtggttcttggacctcccactcccttggaccagcggcgccagcacctcccaggagacctggaaccggcaggacctcctcgtgacgttcaagaccgcgcacgccaagaagcaggaggtggtggtgctcggctcccaggagggcgcaatgcacaccgcactgaccggggccacggaaattcagacctccggcaccaccaccatcttcgcggggcacctcaagtgccgcctgaagatggacaagctgactctcaagggcatgagttacgtcatgtgcaccgggtcattcaaacttgagaaggaggttgccgaaactcagcacgggactgtgctggtacagatcaagtacgaaggaaccgatgccccctgcaagataccctttagcacccaagatgagaagggggtgacccagaacggccggctcatcacggccaacccgatcgtgaccgacaaggagaagcccgtcaatatcgaggcggagccgcccttcggggagtcctatatcgtgatcggcgccggagagaaggccctcaagctgagctggtttaagaaggggtcgagcatcgggaaaatgttcgaggcgaccgctcgcggggcgcgccgcatggctatcctgggtgacaccgcctgggatttcgggtccattggcggcgtgtttaccagcgtcggcaaactcgtacaccaaatcttcggtactgcctatggggtactcttttccggcgtcagctggaccatgaagatcgggatcggcgtcctcctcacctggctgggcctgaattctcgctcaacctccctaagcatgacctgcatagcagtggggttagtcacactgtaccttggcgtgatggtccaggcggactccgggtgcgtcatcaactggaagggccgtgaattaaagtgtgggtctggaatattcgtgaccaacgaggtgcacacgtggaccgagcagtacaagttccaggccgacagccccaaaagactttccgcagctatcgggaaggcttgggaagaaggggtctgtggtatccggtcggcaacccgcctcgagaatataatgtggaagcagatctccaatgagctaaaccacatccttctggagaacgacatgaagtttaccgtggtggttggggatgtggccggcatcctggcccaagggaagaagatgatccggccccagcccatggagtacaagtacagctggaagtcctggggcaaggccaagatcattggcgcagacgtgcagaatagcacgtttatcatcgacgggcccaacacgccggaatgccccgacgaccagcgcgcatggaatatctgggaggtcgaggactacggcttcgggatcttcacgaccaacatctggctgaagctccgggattcctacacacaggtgtgtgaccacagactgatgagcgccgccatcaaagactcgaaggcagtacacgcggacatgggctactggatcgagagcgagaagaacgagacttggaagctggccagagcctccttcattgaggtcaaaacctgcatttggcccaagagtcacaccctttggtccaacggagtgctcgagagcgagatgatcatccccaagatctacgggggcccgatctcgcagcacaactaccgccccgggtacttcacccagacagccggcccctggcacctggggaagctcgagctcgactttgacctgtgcgagggcaccactgtggtcgtggacgaacattgcggcaatcggggcccgtctctccgaaccacgacagtaaccggaaagatcatccacgagtggtgttgtcggtcttgcaccctgccgcccctgcgcttccgcggggaggacggatgttggtacgggatggagatccgcccagtcaaggagaaagaagagaacctcgtgaaatccatggtgagcgccggctccggcgaggtcgactctttctccctgggactgctatgcatctctatcatgatcgaagaagttatgcgaagtcgctggtcacggaagatgttgatgacgggtaccctggcggtgttcttcctcctgataatggggcagttgacctggaacgatttaatccgcttgtgcatcatggtcggcgccaacgcctctgaccgcatggggatgggtaccacgtacttggcgttaatggccacctttaagatgcgaccgatgtttgctgtgggactgctattccggaggttaaccagccgtgaagtcctactgttgacgattgggctgtccctggtcgccagcgtggagctccccaattcccttgaggaactgggagatgggctcgccatgggcatcatgatactcaagctcttgacggacttccaaagccaccagctgtgggccactctgctctccctgaccttcatcaaaaccactttttctctgcactacgcgtggaagaccatggccatggtgctctccatcgtgagcctgttcccgctgtgtctctccaccaccagccagaagactacctggctgcctgtactactcgggtccttagggtgcaagccgctcaccatgttcctgatagccgaaaataagatctggggccgaaagagctggccgttaaatgaggggataatggccgtcggcatcgtgtcaatcctgctctccagcctgctgaagaatgacgtgcctttagccgggcccctgatagcgggtggaatgctgattgcctgctacgtgatcagcgggagcagcgccgatctcagcctggagaaggccgccgaagtatcgtgggaagaagaggcggagcacagcggcgcgagtcacaatatcctggttgaagtccaggacgacgggaccatgaagattaaggatgaggagcgcgacgataccctcaccatcctcctgaaggccaccctgctggccgtgagcggcgtgtacccgctgtccatccctgcgaccctcttcgtctggtacttttggcagaagaaaaagcagcggagcggggtgctctgggatacgcccagcccgcctgaggtggagcgcgcggtcctggacgatgggatctaccggatcatgcaacgcggcctcctcgggaggagtcaggtcggcgtgggggtttttcaggagaatgttttccacacgatgtggcacgtgactcgaggcgccgtgctcatgtaccaggggaagcgactggagcccagttgggcctccgttaaaaaggacctcatttcctacggcggagggtggcgcttccagggaagctggaacaccggggaggaggtgcaggtcatcgccgtcgagcccggcaagaaccccaagaacgtgcagacagcccccggcacattcaagacccctgagggcgaagtcggtgctatcgcgttagatttcaagcccggaacttccggcagccccatcgtaaaccgggaggggaagatcgtgggcttgtacggaaatggggtcgtgaccaccagcggtacttacgtttctgccattgctcaggctaaggccagccaggagggacctctccctgaaatcgaggacgaggtcttccgtaagcgcaacctgaccatcatggacctgcacccaggctccgggaagacccgacggtacctcccggccatcgtgcgcgaggccattaagagaaaactccgtacgctgatcctcgcacctacccgcgtggtcgcgagcgagatggccgaggccctaaagggcatgccgatccggtaccaaaccaccgccgtcaagtcagaacacacagggaaggaaatcgtggacctaatgtgccacgccaccttcaccatgcgcctcctgagccctgtaagagtaccgaattacaacatgattattatggacgaggcgcacttcacggacccctccagcatcgccgcccgtgggtacatttccacgcgtgtgggcatgggggaggccgccgcgattttcatgacagcaacgccgcctggcagcatggaggccttccctcagtccaacgccgtcatccaggacgaggaacgcgacatccctgagcggtcgtggaacctggggcacgagtggatcacagacttccccggcaagacggtgtggttcgtcccctccatcaaggcgggcaacgatattgctaactgccttcgcaaaaatggcaagagagtcatccagctgtcccgcaaaaccttcgacactgagtaccagaagaccaagaataatgactgggactatgtggttactaccgacatcagcgagatgggagccaactttcgggccgaccgcgtcatcgacccccggaggtgcctcaagcccgtgatcctcaaggacgggcccgagcgggtgatactcgccggccctatgccggtcaccgtggcgtcagcggcccaacgccgggggcgcatcggccggaaccacaacaaggagggcgaccagtacatctacatggggcagcccctgaacaacgatgaggaccacgcgcactggaccgaggccaagatgctcctggacaatatcaacacgccggagggcatcatccccgctctgtttgagccggagcgagagaaatctgccgccatcgacggcgagtatcgcctccggggcgaggcgcgcaagaccttcgtcgagctgatgcggcggggggacctgcccgtgtggctctcctacaaagtggccagcgaggggtttcagtactcagaccggcgctggtgcttcgacggcgagcggaacaaccaggtcctagaggagaacatggacgtggagatatggaccaaagaaggggagcgcaagaagctgcggccacgctggctcgatgcgagaacctacagcgaccccctggcgctgcgcgagttcaaggagtttgccgctggccggagatccgtaagcggggatctaatcctggagatcggcaagctgccgcagcacctaacgcagcgggcgcagaacgcgctggataacctggtcatcctgcacaactccgagcaaggggggcgcgcctaccggcacgccatggaggaactgcccgacaccatcgaaactctgatgcttctggccctaatcgcggtgttaactggcggggtgacgctgttcttcctcagcggtaaggggctcggcaaaacctctatcgggctgctgtgcgtcatggcctctagtgtcctcctatggatggccagtgtggagccccactggatcgccgcttccataatactggagttcttcctcatggtcctgctgatccccgagccggacaggcagcggacgccccaggacaaccagctcgcctacgtggtgatcgggttgctgttcatgatcctcaccgtcgccgccaacgagatgggcctgctagagaccacgaagaaggacctcggtattggtcacgtagccgtcgagaaccaccatcatgccgcgatgctggacgtggacctgcacccagccagcgcgtggactctctacgccgtggctaccacaatcattacgccgatgatgcgccacaccatagagaacaccactgctaacatctccttgacggccatcgccaaccaggccgccatcctgatgggactcgacaagggctggccgatctcgaagatggacatcggcgtacccctactggccttagggtgctactcccaggtcaatccccttaccctgaccgctgctgtgctcatgttagtggctcactacgcgatcatcggacccggtttacaggccaaggccacccgcgaagcccagaagaggacagccgcgggcataatgaagaaccccaccatagacggaatcgtcgcgatcgacctcgaccccgtagtttatgatgccaagttcgagaaacagctgggccagatcatgttattaatcctgtgcacctcccagatcctgctcatgcgcactacgtgggccctgtgcgagtcaataaccctggccactggccccctcacgacgctgtgggaggggtcgccgggcaaattctggaacaccactatcgcggtctccatggccaacatctttagggggagttacctggccggtgccggcctcgcgttctccctgatgaagtccctcgggggggggcgtcgggggactggggcccagggggagacactcggcgagaaatggaagagacagctgaaccagctcagcaaatcagagttcaacacctacaagcggtctggtatcatggaggtggaccgctccgaggcaaaggagggcctcaagcgcggggagaccactaagcacgccgtgagccgcggcacggccaaactgcggtggttcgtcgagcgcaacctggtgaaaccagaagggaaggtgatcgacctggggtgcggccgaggcggctggtcgtactattgcgcgggcctcaaaaaggtcaccgaggtgaagggctacaccaaaggaggccccggtcacgaggagcccataccgatggccacctacgggtggaacctcgtaaagctgcacagcggcaaggacgtcttcttcgtgcctccggagaagtgcgacacgctcctgtgcgacatcggggagagtagccctaatcctacaatcgaggagggccgcactctgcgggtgctcaaaatggtagagccctggctgcgcgggaaccagttctgcatcaagatcctgaacccctacatgccctccgtggtcgagacccttgagcagatgcagaggaagcacggcggaatgctggtccgcaacccgctgagccggaattcgactcatgagatgtactgggtgagctgcggaaccggtaacatcgtgtcagctgtcaacatgaccagccgcatgcttctgaaccgttttaccatggcccaccgcaagcccacatacgaacgcgacgtcgacctgggggccggcacgcggcacgtggcagtggagcccgaggtggcaaacctcgacataatcggccagcgcatagaaaacatcaagcacgagcacaaatccacatggcactacgatgaggacaacccctacaagacatgggcataccatgggtcctacgaggtaaaaccatccggcagcgcctcaagcatggtcaatggggtcgtcaagctgctcaccaagccctgggacgtgatccccatggtgacgcagatcgcaatgaccgacacgaccccctttggccagcaacgggtcttcaaggagaaagtagacacaagaacccctaaggcaaagcggggtaccgcccaaatcatggaggtgacggcccgctggttatggggctttctctcccggaacaagaaaccccgcatctgcacgcgcgaggagtttacccgcaaggtccgctccaacgccgcgatcggcgcagtgttcgtggacgagaatcagtggaacagcgctaaggaggccgtcgaggacgaccgcttctgggacctggtgcaccgggaacgcgagctccacaagcaggggaagtgcgcgacatgcgtgtacaacatgatgggcaagcgggagaagaagctgggggagtttggaaaggcgaaggggtcacgcgccatctggtatatgtggctgggcgcgcggttcctcgagttcgaggcgctgggcttcatgaacgaggaccactggttcagccgcgagaattccctgagtggggttgagggcgaggggctccacaagctgggctacattctaagggatatctccaagatccccgggggcaacatgtacgccgatgacaccgcgggctgggacacccgaatcacggaggacgacctgcagaacgaagccaagattaccgacataatggagccggagcacgccctgctggccaagagcatcttcaagctaacctaccagaacaaggtcgtgcgggtccagcgccccgcgaagaacgggacagtaatggacgtgatatccaggagggaccagcgcggcagcgggcaggtcggcacctacggcctgaacactttcaccaatatggaggcgcagctcatccgccagatggagagcgagggaatatttagccccaatgagctcgagacgcccaaccttgccgagcgcgtgctagactggctagagaagtacggcgtggaaaggctgaagcgcatggccatttccggggacgactgcgtcgtgaaaccaatcgatgaccggttcgccaccgcgcttaccgcgctcaacgacatggggaaagtgcgcaaggacatcccccagtgggagccctcgaaggggtggaacgactggcaacaggtccccttttgctcccaccacttccaccaattgatcatgaaggatggcagggagatcgtcgtgccgtgtcgcaaccaggacgagttagtcggaagagcccgcgtaagccagggggccggatggggacttcgggagaccgcctgccttggcaagtcttacgcgcagatgtggcagctgatgtacttccatcgccgcgacctccgcctggctgcgaatgccatctgcagtgccgttccagtcgactgggtgcccacaagtcggaccacctggtccatccatgcgcaccatcagtggatgaccacagaagacatgctgagcgtatggaaccgtgtttggatcgaggagaacccctggatggaggacaaaacccggatctcgtcgtgggaggacgtgccgtacctcgggaagcgcgaagaccagtggtgtggctccttgatcggcctgaccgcccgcgccacctgggctacgaatatccaggtcgccatcaaccaggtccggaggttaatcgggaatgagaactacagcgactacatgaccagtatgaagcggttcaagaatgagtctgagcccgagggcgcattatggtga

SEQ ID NO: 24757 - RNA, 9879 nt, synthetic construct
  misc_feature 1..9879: note = derived and/or modified CDS sequence (opt11) from DENV-1__KJ933413__SS-prME
  source 1..9879: mol_type = other RNA
tcggtgaccatgttgttaatgctactgcccacagctctcgcctttcacctgaccacccggggcggggagccccacatgattgtgtccaagcaagagcggggaaaaagcctcctatttaagaccagcacgggggtgaatatgtgcactcttattgcgatggatctgggcgagctgtgcgaggacaccatgacctataagtgcccccgtattacggagacggagccagatgacgtggactgctggtgtaacgcaaccgaaacctgggtgacctacgggacctgtagccagacgggagagcaccggcgcgacaaacggtcggtggcactggcgccccacgttggcctggggctagagacgcgtacagagacatggatgagctcagagggagcatggcggcaaatccaaaaggtggagacctgggcgctgcgacaccccgggttcaccgtgatcgcactgttcctagcccacgcgattgggaccagcattacacagaaggggatcatattcatactgctgatgctcgtgacgccctccatggccatgcggtgcgtcggaatcggcaaccgcgacttcgtcgagggcttaagcggagcgacctgggtcgacgtcgtgctggagcacggttcttgcgtgaccacgatggcgaaagacaagcccaccctggacattgagctgctgaagacggaggtcactaaccccgctgtgctgcggaagctgtgcattgaggccaagatcagcaatactacaaccgattccagatgccccacccagggcgaggctacgctggtagaggagcaagacacgaacttcgtctgtcgacgcaccctcgtggaccggggctggggcaacggctgtggcctattcggtaagggatcgctgatcacgtgcgccaagttcaaatgtgtgacgaagctcgaaggtaaaattgtacagtacgagaacctgaaatactccgtgatcgtgactgtgcacaccggcgaccagcaccaggtggggaacgagacgaccgagcacggcacaacagccactatcacgccccaagcccctacttcagagatccagctgaccgactatggagcactcaccttggactgcagcccccgcaccggcctggactttaacgagatggtcctcctgacgatgaaggagaagtcttggttagtgcacaagcagtggttcctcgacctaccgcttccctggacatccggtgcgagcacgagccaggagacctggaatcgtcaggacctcctggtgacgttcaaaaccgcgcatgccaagaaacaagaggtcgtggtgctaggctcccaggaaggcgccatgcacactgccttaacgggggctacggagatccagactagcggcaccaccacaatcttcgccggccacctgaagtgccgcttgaagatggataagctcaccctgaagggcgtatcctacgtgatgtgtactggctcatttaagctggaaaaagaggtggccgagacgcaacacggcactgtcctggtccaggtgaagtacgagggcaccgacgccccctgtaagatccccttcaccagtcaggacgaaaagggcgtaacccagaacggcaggctaatcacggccaaccctatcgtgaccgacaaggagaaaccggtgaacatcgaggccgagccgcccttcggtgagagttatctggtcgtaggagccggcgagaaggccctgaagctctcatggttcaagaaagggtcatccatcggtaagatgtttgaagccaccgcgcgcggggcccggcggatggccatcctgggcgacaccgcctgggacttcggtagcataggtggcgtattcacgtccgtagggaagctcatccaccagatcttcggcaccgcctacggggtcctgttcagcggcgtatcctggaccatgaagatcggcataggcatccttctgacgtggctcgggctgaacagtaggtccacatctctttccatgacgtgcattgcggtcgggatggtgaccctctacctgggcgttatggtccaggccgacagcgggtgcgtgattaactggaagggccgggagctgaagtgcgggagcggcatcttcgtgaccaacgaagtccacacgtggacggagcagtacaagttccaggcggacagccccaagcgactctcagccgccattggaaaagcgtgggaggaaggggtgtgtggtatacgatccgttacccgactcgagaacataatgtggaaacagatcagcaacgaactgaaccacatcctcctggagaacgacatgaagttcaccgtcgtggtgggggatgtcaatgggatcttggcacagggtaagaagatgattcggcctcagcccatggagcataaatactcctggaaatcctggggtaaggccaaagtgatcggcgccgacgtgcaaaactccactttcatcatcgatgggccgaacacgccggaatgccccgatgaccagcgcgcctggaacatctgggaggtcgaggattatggcttcgggattttcaccacaaacatttggctcaagctgcgagacagctacacacaagtatgcgaccaccggctaatgtccgcagccatcaaagacagcaaggccgtacacgctgacatggggtactggattgagtccgagaagaacgaaacgtggaagctaacccgggcgtcttttatcgaagtcaaaacctgtgtgtggccgaagtcgcatactctgtggagcaacggcgtgctggagtccgagatgattatacccaagatatacgggggcccgattagccagcacaactacagacccggctacttcacgcaaactgcagggccttggcatctcgggaagttagagctagacttcggactctgcgaaggcacgactgtcgttgtagacgagcattgcgggaaccggggtccgtccctgcgaactaccaccgtcaccgggaagatcatacacgaatggtgttgtcgaagctgcacgctgcctccactaaggttcaagggcgaagacgggtgctggtacggcatggagatccggccggtgaaggagaaggaggagaatctggtgaagtccatggtgagcgctggtagcggggaagttgactccttcagcctgggtctcctttgcatcagtataatgattgaggaggtgatgcgtagccggtggtcccgcaagatgctgatgaccggtaccctcgctgtctttctgctgcttatcatgggacagctgacttggaatgatctcatccgtctctgcattatggtgggggccaacgcgtctgacaagatgggcatgggcacgacctacctggctcttatggccacattccgcatgcgcccgatgtttgcagtcggtcttctgttccgacgcctgacctcccgggaagtgctcctgcttactgtggggctctcactggtcgcctccgtagagctgccgaacagcctggaggagctgggggacgggctggccatgggcatcatgatgctcaagttactgaccgattttcagtcccaccagctctgggccgcattactgagcctaaccttcgtgaaaactacgttctctttacactacgcctggaaaaccatggctatgatcctgtcgatcgtgtccctcttccccctatgcctgagcacaacctcacagaagactacatggctcccggtcctgttaggtagcctcggttgcaagccactgacgatgttcttaatcactgagaaccggatttgggggcggaaatcctggcccctcaacgagggcatcatggccgtgggaatcgtcagcatcctgttgagctccctcctcaaaaacgatgtgcccctggcgggccccctcattgccggcgggatgttaatagcatgttatgtgatcagcggctccagcgcggacctgtccttagagaaggccgccgaggttagctgggaggaggaggccgaacactcgggcgcttcacataacatcctggtggaagtgcaggatgacggcacaatgaagatcaaggacgaggagcgtgacgatacgctgaccattctcctgaaggcgaccctgctcgccatctccggggtctacccgatgagcatcccggccaccctgttcgtctggtacttttggcagaagaagaagcaacggtccggcgtgctgtgggacacgccctctccgcctgaggtcgagcgcgccgtactggacgacggcatctaccgcatcctccagagaggcctgctgggcaagtcgcaggtcggagtcggcgtcttccaggaaggcgtgttccacacaatgtggcacgtgacccggggcgccgttctcatgtaccagggcaaaagactggagccctcctgggcttccgttaagaaggacctgatcagctacggcggcggatggcggttccaaggctcctggaacacgggggaggaggtccaggtaatcgccgtggagccggggaagaaccccaagaacgtccagacggcacccggcacttttaaaacccccgagggggaggtgggcgctattgcactcgacttcaagcccgggacctcaggctccccaatcgtgaatagggagggcaaaatcgtcggtctgtatggcaacggggtggttacgactagcggtacgtacgtatctgctatagcccaggccaaggcatcccaggaggggccattacctgagattgaagatgaagtgttccggaagcgcaaccttaccattatggacctgcatcccggaagcggcaagacgagacgctacctgccggccatcgtgcgggaggcaatcaagcgcaagctccggaccttggtcctggcccctacccgcgtggtggcaagtgagatggcagaggcgctcaaggggatgccgatccgatatcagaccacagccgtgaaatctgagcacaccggcaaggaaatcgtagacctaatgtgtcatgccaccttcaccatgagactgctctctcccgtgcgggtccctaactacaatatgatcattatggacgaggctcatttcacggaccctgcctcaatcgcggctcggggctacatttcaacccgtgtgggcatgggggaggccgcggccatcttcatgaccgcgacacccccgggaagcatggaggccttcccacagtctaacgccgccatccaggacgaggaacgggatatcccagagagatcctggaactcgggctatgattggatcacggacttccccggcaagaccgtgtggtttgtccccagcatcaagtcgggaaacgacatagccaattgcttgcggaagaacgggaaacgcgtagttcagctgagccggaaaacctttgacacggagtaccagaagacgaagaataacgactgggactatgtcgtgaccaccgacatcagcgagatgggcgcgaactttagggccgaccgggtcatcgacccgaggcgatgtctcaagcccgttatccttaaagatggaccggagagagtgatcctggccggcccgatgccggttaccgtcgcttccgcggcccaacggcgcggacgcattggcagaaaccagaataaggagggcgaccagtacatatacatgggacagcccttgaataatgacgaagaccacgcccattggacggaggctaagatgttgctggacaacatcaacacgccagagggtataatcccagccctcttcgaaccagaacgggagaaaagtgcggccatcgacggggaatatcgcctgcgcggcgaggcccggaagacgttcgtagagctgatgcgcagaggcgacctccccgtctggctgagctacaaggtcgcttccgaggggttccagtatagcgacagacggtggtgcttcgacggggagcggaacaatcaagtgctggaggagaacatggacgtcgagatctggaccaaagagggggagcggaagaaactgcgtccccggtggctagacgcgcgaacgtacagcgaccccctggcactcagagagtttaaggagttcgccgccggccgcagatccgtcagcggcgacttgatcctggagatcgggaagctcccgcaacacctgacccagcgcgcccagaacgcccttgataacctcgtgatgcttcataactccgaacagggcgggaaggcgtaccggcacgccatggaggaactgccagacacgattgagacgctcatgctgctggccctcatcgcggtcctcaccggcggcgtgacattgttcttcttaagcggcagagggctgggaaagacctccatcgggttattatgcgtgatggcaagcagcgccctactctggatggccagtgtcgaaccccattggatcgccgcctccatcatactcgagttctttctgatggtgctgctaatccccgaaccggaccggcagaggacgccccaagataaccagctcgcgtacgtggtcatcgggcttctcttcatgatcctgactgttgccgccaatgaaatgggcttactggaaacgaccaagaaagacctgggtataggacacgtggccgccgagagccaccatcacgcggcaatgctggatgtagacctccaccccgcatccgcctggaccctgtacgctgttgcgaccacggtgataacgccgatgatgcggcatacgatagagaacaccacggccaatatttccctgaccgccatcgctaaccaggccgcgatcctcatgggcttagacaaagggtggcccatatccaaaatggacattggcgtacccctgttggccctgggctgctacagccaggtaaaccccttaacgctcaccgccgccgtcctgatgctggtagcgcactatgcgattatcggccctgggctccaggctaaggcgacacgcgaggcccagaagcggaccgcggcggggataatgaagaaccccacggtggacggcatcgtggccatcgacctggaccccgttgtgtacgacgccaagttcgaaaagcagttaggtcaaatcatgcttctgatactgtgcacctcgcagatccttttgatgcgcacgacctgggcattatgcgagtccatcaccctcgctactggacccctaacgaccctgtgggaggggagcccaggaaagttctggaacaccaccatcgccgtgagcatggccaacatcttccggggttcgtacctcgccggcgcaggcctcgcgttctcgctcatgaagtccctcgggggcgggcggcgcggcacgggcgcccagggtgaaaccctgggggagaagtggaagaggcagttgaaccagctctccaagagcgagttcaacacctacaagcgctcaggaatcatagaggtggaccggtccgaggctaaagaaggcttgaagcgcggggagaccacgaagcacgccgtgtcccggggcaccgccaagctgagatggttcgtagagcggaacctcgtcaaacccgagggcaaggtgatcgacctcgggtgcgggcgcggcggctggagctactactgcgctgggctgaaaaaggttaccgaagttaagggctacacgaagggcgggcccggccacgaggagcccatcccgatggccacgtacgggtggaacctagtgaaactccacagtggcaaggacgtattcttcaccccgcccgagaagtgcgacacgctgctgtgtgatatcggggagagctcccccaacccgacgatcgaggaaggccggaccctcagagtcctgaagatggtcgagccgtggcttcgaggtaatcagttctgcatcaaggtgctgaacccctacatgccgagcgtcgtggaaacgctggagcagatgcaaagaaagcacgggggcatgctcgtgaggaacccgctcagtcgcaacagcacacacgagatgtactgggtctcgtgtgggaccgggaacatcgtgagcgccgtcaatatgacctcccgaatgctgcttaaccgctttacgatggcacatcggaagcccacatatgagcgcgacgtcgacctgggcgcggggacccgccacgtggccgtcgaaccggaggtggctaacctagatatcatcggccaacggatcgagaacatcaagaacgagcacaagtctacatggcactatgatgaagacaacccgtacaagacgtgggcctatcacgggagctacgaggtgaagccaagtggctccgcatccagcatggtcaacggagttgtgaggctcctcaccaagccatgggatgtcatccccatggtgacccagatagcaatgactgacacgacaccgttcggccagcaacgcgtgttcaaggagaaggtcgacactcggacaccgaaggccaagcggggcacggcccagataatggaagtgactgcccgttggctgtgggggtttctctcccggaataagaaaccccggatctgcacgcgggaggagtttaccaagaaggtgcgcagcaacgccgcaatcggagccgtgttcgtggacgaaaaccagtggaactcagcaaaagaggcagttgaggacgagcgtttctgggatttggttcacagagagcgcgagctgcacaagcaagggaagtgcgccacgtgcgtgtacaacatgatgggcaagcgtgagaagaagctgggggagtttggcaaagccaagggcagccgggccatatggtacatgtggctcggggcccgcttcctggagtttgaggctcttggctttatgaacgaagaccactggttctccagagagaacagcctctccggggtggagggcgagggccttcataaactaggctacatactccgcgatatcagcaagatccctggtggtaacatgtacgcggatgacacagcaggttgggacacccgcatcactgaggacgacctccaaaacgaggctaagatcacggatatcatggagccggagcacgcgctgctcgcaacctccatctttaagctgacctatcagaacaaggtcgtccgcgtgcagcggcccgcgaaaaacgggaccgtaatggacgtgatctcgcgccgcgaccagaggggctcgggccaggtggggacgtacggcctgaacaccttcaccaacatggaggctcagctcatacgccaaatggagagtgagggtatcttcttgccaagtgagctggaaacccctaatctcgccgagcgggtcttggactggttggagaagtacggcattgagcgcctcaagcgaatggccatctcgggcgatgactgcgtggtgaagccgatcgacgatcgctttgccacggcgctgaccgcactcaacgatatgggcaaggtcagaaaggacatcccccagtgggagccgagcaagggctggaacgactggcagcaagtacccttctgctcccaccacttccaccagctcatcatgaaggacgggcgcgaaatcgtggtcccgtgccggaaccaggacgagctggtgggcagggccagggtgagtcagggggccggctggagcctgcgcgagaccgcctgcctcggcaaatcttacgcgcagatgtggcagctgatgtacttccaccggcgggacctgagacttgccgcgaacgccatctgcagtgcggtccccgtagactgggtccccaccagccgcacgacctggtccatccacgcacaccaccagtggatgaccaccgaggacatgctgagcgtctggaatcgggtgtggatcgaagagaacccctggatggaggataagacccacgtgtcctcctgggaggacgtcccttatttgggaaaacgcgaggaccagtggtgtgggtctctcattgggctgacagcccgggcaacctgggccaccaacatacaagttgcgataaaccaggtgcgccgactgataggtaacgagaattacctggactacatgacgagtatgaaacggttcaagaacgagtccgacccggagggggcactgtggtga

SEQ ID NO: 24758 - RNA, 9879 nt, synthetic construct
  misc_feature 1..9879: note = derived and/or modified CDS sequence (opt11) from DENV-1__KU666942__SS-prME
  source 1..9879: mol_type = other RNA
tcagtcacgatgctgcttatgttaatgcccactgccctcgctttccacctcaccactcggggtggggaaccccacatgattgtgtctaagcaagagcgggggaagagcctgctgttcaagacctcagccggagtgaacatgtgcaccctcatcgccatggacctcggggagctctgcgaagacaccatgacttacaagtgcccacggatcacagaggccgagcccgacgatgtagactgctggtgtaacgcgaccgacacctgggtgacctacgggacctgcagccagacgggcgagcaccggcgcgacaagcggagtgtggcactcgcaccgcacgtgggtttagggctggagacgcgcaccgaaacctggatgtcgtccgagggcgcttggaagcagatccagcgggtagagacctgggccctacggcacccgggctttacggtgattgccctgttcctagcgcacgccatcggcaccagcatcacccagaaggggatcatcttcatcctcctgatgctggtgaccccctccatggccatgagatgtgttggcataggctcgagggacttcgtggagggactctccggcgccacgtgggtagatgtggtgctggagcacgggtcttgcgttaccaccatggccaaggacaagcccaccctggacatagaactcctgaagacggaagtgaccaacccagccatcctgcggaagctctgcatcgaggcaaaaatctccaacaccacgacggactcgagatgcccgacccagggagaggccaccttggtcgaagagcaggacgcaaacttcgtgtgccggcgcacctttgtcgaccgggggtgggggaatggttgcgggctgtttggcaaggggtccctcattacatgtgccaaattcaagtgcgtgaccaagttggagggcaagatcgtacaatatgagaacctaaaatattcagtaatcgtgaccgtgcacactggggaccagcaccaggtcgggaacgagtccacggagcacggcaccacggcgaccataacgcctcaggctcccacgacagagatccagttgaccgactacggggccctcactctggactgcagccctcgcaccggtctagacttcaacgagatggtgctgctgaccatgaaggagaagtcttggctcgtccacaagcagtggttcctggacctgcctctcccctggaccagcggggcgtcgacctcccaggagacgtggaaccgacaggacctgctggtgaccttcaagaccgcccacgcgaagaagcaggaggtggtcgtgcttggatctcaagagggcgctatgcacaccgccctgactggggccaccgagatccagacgtccggcaccaccaccatcttcgccggtcatctgaaatgccgtctcaaaatggacaagcttacactgaagggcatgagctacgttatgtgcaccgggagctttaagctcgagaaagaggtggcggaaacgcagcacggtaccgtgctggtgcagatcaagtacgagggcaccgacgctccctgcaagatcccctttagtacccaggacgagaaaggagtcacacagaacggcaggctcatcacggccaacccgatagtgaccgacaaggaaaagcctgtgaatattgaggccgagccccccttcggggagtcctatattgtgattggcgcgggggagaaggccctgaagctcagttggttcaagaaaggctccagtatcgggaaaatgttcgaggccacagcgagaggggctcggagaatggcgatcttaggcgacacagcctgggacttcggctcgatcggcggcgtgttcactagcgtggggaagctggtgcatcagattttcggcaccgcatacggggtactgttctccggagtgagttggacaatgaagatcgggatcggcgtcttgctgacgtggctaggcctaaactcacgcagcacctccctgagcatgacctgcatagccgtgggtctcgtgaccctatacctcggcgtaatggtgcaggccgactccggttgcgtgatcaactggaagggccgggagctcaagtgcgggtcaggcatctttgtcacgaacgaagtgcacacgtggaccgagcagtacaagttccaggcggattccccgaaacgtctctctaccgccatcgggaaggcctgggaagagggcgtatgcggtattcggagtgccacccgccttgaaaatatcatgtggaagcagatctccaacgagctcaaccacatcctgctggagaatggcatgaagttcacggtggtcgtgggcgacgttgcgggaatcctcgcgcagggcaagaagatgattcggccccaacccatggagcataagtacagctggaagtcctggggcaaagccaagatcatcggagccgacgtacagaataccacctttatcatcgacggccccaatactccagagtgcccagacgaccagcgcgcctggaatatctgggaggtggaggactacggcttcggcatcttcacgaccaatatctggctgaagctgcgcgatagctacacccaggtctgtgaccaccgcctcatgtccgcagccatcaaggatagcaaggccgtgcacgcagacatgggctactggatcgagtcggagaagaatgagacctggaagctggcacgagcgtccttcatcgaggtgaagacatgtatctggcccaaatcccataccctgtggagcaatggggttctcgagtccgagatgatcattccaaagatctacggcgggcctattagccagcacaactaccgccccggttacttcacacaaacggctggtccctggcacctgggcaaactggaactagatttcgacctttgtgagggcacgaccgtggtcgtcgacgagcattgtgggaaccggggaccgtccttacgcaccaccacagtaaccgggaaaatcatccacgagtggtgttgccggagctgcaccttgccgccactacgatatcggggcgaggacgggtgctggtacggcatggagattagacccgtgaaggagaaggaggaaaacctggtcaagtccatggtcagcgccggcagcggggaagtcgacagcttcagcttagggctactctgcataagtatcatgatcgaggaggtcatgcgatcccgctggtcccgtaagatgttgatgaccggtacgcttgccgttttctttctgctcatcatggggcaactgacctggaacgacctaatcagactttgcatcatggtgggagccaacgcgagcgaccggatgggcatgggaaccacatacctggccttaatggccacattcaaaatgagacctatgttcgccgtcgggttattgtttcgtcgcctgacctcgcgggaggtgttattgctcacaatcggcctcagtctggtggcgtcaatggaactgcccaatagcctcgaggagctgggggacgggttggccatgggcattatgatcctcaagttattgaccgacttccagtcccatcagctctgggctaccctgttaagcctcaccttcataaagaccacgttcagtttacactacgcgtggaagaccatagcaatggtcctgtcgattgtgtccctcttcccactctgcctgagcaccacctcccagaagaccacttggctccctgtcctgctgggtagcttgggctgcaaaccgctgaccatgttcctgatcgccgagaacaagatctggggccggaagtcctggccattgaacgagggcatcatggccgtagggatcgtgagcatcctgctgagctctctcctgaagaacgacgttccgctagccggccccttaatcgccggaggtatgttaattgcctgttacgtgatcagcggctctagcgcggatctgagtttagagaaggccgccgaggtgagctgggaggaggaagccgagcactccggggccagccacaacatcctggtcgaggtgcaggacgacggcacaatgaagatcaaggacgaggagcgcgacgacaccctgaccatcctactgaaagcaacgctcctggcggtgtccggggtctacccgttatcgattcccgcaactctgttcgtgtggtatttttggcaaaaaaagaagcaacgttccggcgtgttatgggacaccccctcgccgcctgaggttgagcgggctgtgctcgacgacggaatctatagaataatgcaacgcgggctgcttggacggtcccaggtgggggtcggagtgttccaggagaacgtgtttcataccatgtggcacgtgacgcgcggggccgtactcatgtatcagggcaagcggctagagcccagctgggcgtccgtgaaaaaggatctgatcagctacggcgggggctggcggttacaggggtcgtggaacaccggggaggaggtgcaggttatcgccgtagaacccgggaaaaaccccaagaacgtccaaactgcaccgggcacctttaagacgcccgagggcgaagtgggggccatcgctctggacttcaagcccggcaccagcgggtcccctatcgtgaaccgggagggcaagatcgtcggcctgtacgggaacggcgtggtcaccacgtctgggacgtacgtcagcgcgatcgcccaggccaaggccagccaggagggcccacttcctgagatcgaggacgaggtctttcgcaagcgcaacctgaccataatggacctgcatcccgggagcggcaaaacccgccggtacctcccggctatcgtgcgtgaggctatcaaacggaagttacggacactgatcctagcccccacgagggtcgtcgcctcggaaatggcagaggcgctgaagggcatgcccatacgttaccagacgaccgccgtcaagagcgaacacacggggaaggaaatagtcgatctgatgtgccacgccacgtttaccatgcgcttattaagtcccgtgcgcgtgccaaattacaacatgattatcatggacgaggcacacttcactgaccctagctccatcgcggcgcgtggctacatttccacacgggtggggatgggagaggctgccgccatctttatgacggccacgccgccagggtccgtcgaggcgtttccgcagagcaacgcagtcatccaagacgaggagagggacatccccgagcgctcctggaatagcggctacgaatggatcaccgattttcccggcaagactgtctggttcgtcccgtccatcaagtccgggaacgacatcgccaactgcctgaggaagaacggtaaacgggtcatccagctctcccgcaagacctttgacactgaataccaaaaaaccaagaacaacgactgggattatgtcgtgaccacggacatcagcgagatgggggcgaatttccgggcggaccgcgtgatcgacccccgccgctgcctgaagcccgtcatactgaaagacggccccgagcgggtgatcctcgccgggcctatgccggtcaccgtggcctccgccgcccagcgtcggggccgcatagggcgtaatcacaacaaggagggggaccagtacatctatatgggtcagcccctgaataacgacgaggaccacgcgcactggacagaggcgaagatgctgcttgataacatcaacaccccagaaggcattatccccgccctgttcgagccggagcgcgagaagagcgccgccatcgacggcgagtaccgtctgcgcggggaagcgcgcaagacgttcgtagaactcatgcggcgcggcgacctgcccgtttggctgagttacaaggttgcctcagagggcttccagtacagcgaccggagatggtgcttcgacggggagagaaacaaccaggtgctggaggagaatatggatgtcgaaatctggaccaaggagggcgagcggaagaaactgcggccccgctggctggacgcccggacatacagtgaccccttggccctgcgcgagttcaaggagttcgcggcgggtcgccgcagcgtttccggcgacctgatcctggagatcgggaaactgccgcagcacctcactcaacgggcccagaacgccttagataatctggtgatgctgcacaacagcgagcagggcggtcgagcctaccggcacgcaatggaggaattgcccgacacgatcgagaccctgatgctgctcgccctgatcgccgtcctgacaggcggcgtgacattgttcttcctgtccgggaagggcctcggcaaaacttctatcggcctcctctgcgttatggcgtccagcgcccttctctggatggcgtccgtcgagccccactggatagcagcaagcatcattctggagttcttcctgatggtgctcctgatccccgagccagacagacagcggacgccccaagacaaccagctggcatacgtggtaataggcctcctgttcatgattctgacggtggccgccaatgagatggggttgctggaaaccactaagaaagacttaggcatcggacatgtagccgtagagaaccaccaccacgccgcaatgctggacgtagacttgcatccggcgtccgcctggacgctatacgcagtagccaccaccatcatcacccctatgatgcgccatacgatcgagaacaccaccgccaacatcagtctcacggcaatcgcgaaccaggcggccattttgatgggcctggacaagggctggcccatctccaagatggatataggggtgcccctactggcgctgggatgctacagtcaggtgaatcctctcacgctgaccgcagcagtgctgatgctcgtggcccactatgccatcatcggaccagggctgcaagccaaagcaacccgggaggcccagaagcgcacagccgccgggatcatgaagaaccccacggtggatggcattgtagcgatcgacctcgacccagtcgtgtatgacgctaaatttgaaaagcagctcggccagatcatgctgctgatcttgtgcacatcccaaatactgctgatgcgtaccacctgggccctgtgcgaaagcatcacgctggcaaccggacccctcacaaccctctgggaaggttccccggggaagttctggaacacgaccatcgccgtgtcaatggccaacatcttccggggctcctaccttgcaggcgccggtctggccttcagcctcatgaagtccctgggcgggggacgccgggggaccggcgcacagggagagaccctaggggagaagtggaagcgccagctcaatcagctgtccaagtctgagttcaacacgtacaagcggtccggcatcatggaggttgatcgcagcgaagccaaggaggggctgaagcgaggcgagaccaccaagcatgccgtgtccagaggtaccgccaagttgcgatggttcgtagaacgcaatctggtgaagccggagggcaaggtgatcgacctcgggtgcgggcgcggcggatggagctactactgcgccggactgaaaaaggttacggaggtcaaggggtacaccaagggcggccccggtcacgaggagcccgtcccgatggcaacctacggctggaacctcgtgaagctacattccgggaaggacgttttcttcatcccgccggagaagtgcgacactctgctctgtgatatcggcgagagcagtcctaacccgactatcgaggagggccgtaccctgcgggtgctgaagatggtggagccctggttgaggggcaaccagttctgtatcaaaatcctaaacccttacatgcccagcgtcgtagagacgctggagcagatgcagcgaaagcacggcgggatgttagtacgcaatcccctgtctcgcaatagcacccacgagatgtattgggtctcctgcggcacggggaacatcgtcagcgcgattaacatgacgtcccgcatgctgctcaatcgatttaccatggcccaccgcaagcccacctacgagcgcgacgtggacttaggcgccggcacaagacacgtcgccgttgagcccgaggtggccaacttggacatcatcgggcagcgcatcgaaaacataaagtgcgaacacaaaagcacatggcactacgacgaagacaacccttacaaaacttgggcatatcacggttcttacgaggtcaaaccgagcggctccgccagctctatggtgaacggagtggtcaagctcctaaccaagccctgggacgtgattcccatggtcacccagatcgccatgacggacaccacccccttcgggcagcagagggtgttcaaggagaaagtggacacccgcaccccgaaggccaaacggggcaccgctcagataatggaggtcaccgcgcgctggctgtggggcttcctctcgcgaaataagaaacccagaatctgcacccgagaagaattcacgcggaaggtacggagcaacgccgccattggcgccgtgttcgtcgacgaaaaccagtggaactctgcgaaggaagcagttgaggacgagaggttctgggacctcgtgcaccgggagcgcgagctgcacaaacaaggcaaatgcgcaacctgcgtctataatatgatggggaagcgggagaagaagctcggggaattcggtaaagcgaagggcagcagagccatctggtacatgtggttgggtgcgcgcttcctggagtttgaggcccttggtttcatgaacgaggaccactggttctccagggagaacagcctgtccggcgtggagggggagggcctacacaaactcgggtacatcctgagagacatcagcaagatctcgggcggcaacatgtacgctgacgacaccgcagggtgggacacccgcatcacggaggatgaccttcagaacgaagccaagatcaccgagatcatggagcccgaacatgcccagctcgccaaggccatcttcaagttgacctaccagaacaaggtcgtccgcgtgcagaggccggccaagaacggaaccgtgatggatgtcatcagccgccgggaccaacgcggttctgggcaggtaggcacttacgggctgaacaccttcactaatatggaggcccagctaatccggcagatggagagcgaaggcatcttctcccccagcgagctggagacgcccaatcttgcagagcgtgtgctcgactggctggagaagtacggcgtagagcggctgaagcgcatggccatcagcggggatgactgtgtagtgaagcccatagacgatcgttttgccacggccctcacggccctgaacgacatggggaaagtccgcaaggacatcccccagtgggagcccagcaagggctggaacgactggcagcaggtccccttctgctcacaccatttccaccagctgatcatgaaggacggccgggagatcgtggtcccctgccgcaaccaggacgagttagttgggcgggcacgcgtgagccagggcgccggttggtccctgcgggagaccgcctgccttggcaagagctacgcccagatgtggcagcttatgtacttccaccgacgggacctaagactggcggccaacgcaatatgctccgccgtcccggttgattgggtgcccacctcccggacgacctggagtatacatgcccaccaccagtggatgaccaccgaggacatgttatccgtctggaaccgcgtttggattgaggagaatccgtggatgaaggacaagactcatatcagcagctgggaggacgtgccatacctgggaaagagggaagaccagtggtgcggcagcctgatcggcctcacggcacgcgccacctgggccacgaatatccaggtcgcgatcaaccaagtacgccggctgatcgggaacgaaaactacctcgactacatgactagcatgaagcgcttcaaaaacgaaagcgaccccgagggcgcactctggtga

SEQ ID NO: 24759 - RNA, 9879 nt, synthetic construct
  misc_feature 1..9879: note = derived and/or modified CDS sequence (opt11) from DENV-1__KU666939__SS-prME
  source 1..9879: mol_type = other RNA
agcgtgaccatgctgctcatgctgatgcccaccgccctggccttccatctgacaacgcgcggcggggagccacatatgatagtgagcaagcaggagcggggtaagtccctgctgttcaagaccagcgcgggagtgaatatgtgcaccctcatcgccatggaccttggtgagctgtgtgaagacaccatgacgtacaagtgtccccggatcaccgaagccgaacccgacgacgtcgactgctggtgcaatgccaccgacacgtgggtgacctacgggacctgcagccaaaccggcgagcaccggagagacaagcgttctgtggcgctcgcgccccacgtcggcctggggctggaaacgcgcaccgagacctggatgagctccgagggggcctggaagcagatacagcgagtcgagacttgggttctccgccaccccgggtttacggtgatcgcactttttctcgcccatgcaatcggaacctccattactcagaaggggattatcttcattctcctgatgcttgtcacgccatctatggcgatgcggtgcgtcggtatcggcagccgggactttgttgagggtctttccggcgccacgtgggtcgatgtggtgctggaacatggcagctgcgtgaccaccatggccaaggataagcccaccttggacatcgagctactgaagacggaggttacaaatcccgccgtactgagaaagttatgtatcgaggcaaagatcagtaacaccaccacggacagccgctgcccaacccagggcgaagcgaccctggtcgaggagcaggacgccaacttcgtgtgccggcgcaccttcgtggatcgtggctgggggaacggctgcgggctgttcggcaaggggtcgctgataacatgcgccaagttcaagtgtgttaccaagctggaaggcaagatagttcagtacgagaacttgaaatactcagtgatcgtaaccgttcacaccggtgaccaacatcaggtcgggaacgaaagcacggaacacggaaccacagccaccatcacgccccaggcgcccaccaccgagatccaactcacagactacggggccctgacgttagactgccttccccgcacgggccttgacttcaacgagatggtgctgttgaccatgaaagaaaagtcctggctagtgcacaaacaatggttcctggacctccctctgccttggacctccggagccagcacctcgcaggaaacgtggaatcgtcaggacctgctcgtgaccttcaagaccgcccatgccaagaagcaagaagtggtggtgctgggcagtcaggagggcgcgatgcataccgccttgacaggggcaactgagatccagacctcaggcaccacgaccatcttcgcagggcatttgaagtgccgcctgaagatggacaagctgacgctcaaggggatgtcctacgtgatgtgcacagggtcgttcaagcttgaaaaggaggtagccgagacgcaacatggcaccgtcctggtgcagatcaagtacgaggggaccgacgcgccctgcaagatacctttctcgacccaagacgaaaagggggtgacgcagaacggccgtctaatcaccgcgaatccgatcgtcaccgacaaggaaaaacccgtcaacatcgaggccgagccgcccttcggggagagctacatagtgatcggcgccggcgagaaggcgctcaagctgagctggttcaagaaggggagctccatcgggaaaatgttcgaggccacggcccgcggggcccggcgcatggcaatcctgggtgatacggcctgggactttgggagcatcggaggagtgttcacctccgtagggaagctcgtgcaccagatcttcggcaccgcctacggcgtgctattcagcggtgtgtcctggaccatgaagatcgggatcggcgtgctgttaacgtggctaggactaaacagccgttccaccagcctctctatgacctgcatcgctgtcgggctggtcaccctttacctcggcgtgatggtccaggccgactcggggtgcgtgatcaactggaagggccgggagctgaagtgcgggtccggcatcttcgttacgaacgaggttcacacctggaccgagcagtacaaattccaagcggacagcccgaaacgcctgagcgcggccatcgggaaggcgtgggaggagggggtttgcggcatccggtccgccacccgcctcgaaaacatcatgtggaagcagatcagcaacgaactgaaccatatcctgctcgagaacgacatgaagttcaccgtggtcgtcggggatgtagcaggcatcctggcgcaaggtaagaagatgatccgtcctcagcccatggagcacaagtactcctggaagtcctgggggaaggccaaaattatcggtgccgacgtccagaacacgacctttatcatcgacgggcccaataccccggagtgccccgacgaccagcgcgcctggaacatctgggaagtagaggattacggtttcgggatattcactacgaatatctggctgaagctccgggacagctatactcaggtgtgcgatcacaggttgatgagtgccgccatcaaagacagtaaggccgtccacgccgatatgggctactggatcgagagcgaaaagaacgagacctggaaactggcccgggcgtccttcattgaagtgaagacctgcatttggcccaaatcccatacgctctggtccaatggagtattagagagcgagatgatcatccccaagatctacggggggccgatatcccagcacaactaccggcccgggtatttcacacagaccgccggcccctggcacttgggtaagttggagttagacttcgatctgtgcgagggcaccactgtcgtggtggacgagcattgcggcaaccggggcccgtcactccgcaccaccaccgtaacgggcaagataatccatgagtggtgctgccgtagttgcacccttccgcccctgaggttccgcggggaggacggatgctggtacggcatggagatccgccccgttaaggagaaggaggaaaacctcgtcaagagcatggtctctgcaggcagcggcgaagtagacagcttctcactgggactgctctgcatcagcattatgatcgaggaggtgatgcggtcacggtggagccggaagatgctgatgaccggaaccctagccgtcttcttcctcctgattatgggccagctgacgtggaacgacctcatccgcctttgcatcatggtgggcgccaacgcgagcgaccgcatgggcatggggaccacctacctggccctcatggccacgtttaagatgcgcccgatgttcgcggtcggcctgttattccgccggctcactagccgcgaggttctcctgttgaccatcgggttgtcccttgttgccagcgtagagctccccaactccctggaggagctgggggacgggttggcgatgggcatcatgattttaaagcttctcaccgacttccagagccaccagttgtgggccacccttttgtccctaacgttcatcaagaccaccttcagcctgcactacgcctggaaaaccatggcgatggtgctctccatcgtgagcctgatccccctgtgtctctccacgaccagccagaagaccacctggctgccggtcctgctcggcagcttagggtgcaagccgctaacgatgttcctcatcgcggagaataagatctggggtcgcaagagctggccgctgaacgaagggattatggccgtgggcatagtttccatcctattaagcagcctactgaagaacgacgtccccctagccgggcctctaatcgccggcggcatgctgattgcctgttatgtgatcagcggaagctccgcggacctcttgctggagaaagcggccgaggtgtcatgggaggaggaggccgagcactccggggccagccacaacatcctcgtcgaagtgcaggacgacgggacgatgaagatcaaggacgaggagcgcgacgacaccctgaccatcttactcaaggcaaccctgcttgctatatccggcgtctatccgctcagcattccggccaccctatttgtctggtacttctggcagaaaaagaagcaacggtccggggtgttgtgggacacgccaagcccacccgaggtggagcgcgccgtgctggacgacgggatctacagaatcatgcagcgcggcctcctggggcggtcccaggtaggcgtgggggtatttcaagagaacgtgtttcacaccatgtggcacgtgacacgcggcgctgtcctgatgtatcaggggaaacgcctcgaaccctcatgggcgtccgtaaagaaggatctaatcagctacggcggcgggtggcgcctgcagggctcctggaacaccggggaggaagtgcaggtcatcgccgtggagcccggcaagaacccaaagaacgtgcagaccgctcccgggaccttcaagacacccgagggtgaggtcggcgccatcgccctcgatttcaagccggggacgagcggatcccccatagtgaacagagaggggaaaatcgtgggcctgtatggaaatggagtcgtgactaccagtggcacctacgtgagtgcaatagctcaggcaaaggcctcacaggaggggccgcttcccgagatcgaggacgaggtcttccgcaagcgaaatctcacgatcatggacttgcacccgggcagcgggaagacacgccggtatctgccagctatagtgcgtgaggccataaagcggaagcttcgaactctaatcttagcacccacccgcgtggtcgcctccgagatggctgaggcgctcaagggaatgcccatccggtaccagactacagctgtcaagagcgagcacaccggaaaggagattgtggatctgatgtgtcacgccaccttcacgatgcgcctgctctcccccgttcgagtgccgaactacaacatgatcatcatggacgaggcccacttcaccgacccatcctcaatcgccgctcgcggatacataagcacccgtgtggggatgggggaggccgccgcaatattcatgaccgcgaccccgcccggctccgtcgaggcgttcccccaaagcaacgccgtgatacaggacgaagaacgcgacatccccgaacggtcctggaactcagggtatgagtggataaccgacttcccgggaaagaccgtgtggttcgtcccctcgatcaagagcggcaacgacattgccaactgcctgcgcaagaacgggaagcgtgtgatccagctatcccgcaagacctttgacacggagtatcagaagaccaagaacaacgactgggactacgtggtcacaaccgatattagcgagatgggggccaacttccgggcggaccgcgtcatcgacccccggcgctgccttaagcccgtgatcctgaaagacggccccgagcgggtcatcctggccggccccatgccggtaaccgtcgccagcgcagcacagcgcagagggagaataggccggaaccacaacaaggagggtgaccagtacatctatatgggccagcccctcaacaatgacgaagaccacgcgcactggaccgaggctaagatgctgttggacaacatcaacaccccggagggcatcatcccagccctcttcgagccggagcgcgagaagtccgccgccatcgacggggagtaccgcctgagaggcgaggcgcgcaagaccttcgttgagctgatgcggcgcggtgacctccccgtgtggctgtcctacaaggttgccagcgaggggtttcagtactccgaccggaggtggtgctttgacggtgaacggaacaaccaggtgcttgaggagaatatggacgtggagatttggacgaaggagggggagcgcaaaaagctccgacccaggtggctggacgcccgtacgtacagcgaccccctggccctccgcgagttcaaggagttcgccgcgggccgtcgctctgtctcaggggacctgatcctggagatcggcaagttaccgcaacatctgacccagcgggcccagaacgccctggataacctcgtcatgttacacaacagcgagcaagggggacgggcctacaggcacgcaatggaggagctgcccgacacgatcgagacactcatgctgctggctctcattgctgtgctcaccgggggggtcaccctgttcttcctctccggacgcgggctgggcaagaccagcatcgggctgctctgcgtgatggcttccagcgtgctgctgtggatggcgtccgtcgagccacactggatcgcggccagcatcattttggagttctttctgatggtgctgctgatccccgagccggaccgacagcgcacgccccaggacaatcagctagcctacgtggtcatcgggttacttttcatgatactgacagtggcagccaacgagatgggcctactcgaaacgaccaaaaaggacctaggcatcggccacgtggcagtggaaaaccaccaccacgctactatgttggacgtggacctccatcccgcctccgcctggacgctgtatgccgtagcgacaactatcatcaccccgatgatgcggcacacgatagagaacacaaccgccaacatcagtctaactgccatcgccaaccaggcggcgatcctcatgggcctggacaagggctggcccatctccaagatggacatcggcgtccccctgttggcactggggtgctacagccaagtgaacccgctgacgctaaccgccgccgtgctgatgctggtcgcgcactacgccataatcggcccgggtctccaagccaaggccacccgcgaagctcagaagcgcaccgcggccggcataatgaagaatccaaccgtggacgggatagtggccatcgacctggatccagtcgtgtacgacgccaagttcgaaaagcagctgggccagatcatgctcctgatcctatgcacctcccagatcctactgatgcggaccacctgggccctgtgcgagagcatcacgcttgcgacgggtcccctgaccaccctgtgggaggggtccccggggaagttctggaacacgaccatagcagtgagcatggccaacatcttccgcgggtcctacctcgccggcgccgggctggcgttcagcttaatgaagagtctcgggggcgggcggcgcgggaccggggcccagggcgagaccctgggcgagaaatggaagcggcaattgaaccagctcagcaaatcggaatttaacacgtacaagcgctctggtatcatggaggttgatcgtagcgaggcaaaggagggcctgaaacggggggagaccaccaagcatgccgtatcccggggcaccgcaaagctgcgctggttcgtggagagaaacctggtcaagccagaggggaaggtgatagacctcggctgcggcaggggcggctggagctattactgtgccggactcaaaaaggttacggaggtgaaaggctacaccaagggcgggcccggccacgaggaaccgatcccgatggccacctatggttggaacctagttaaactttattctggaaaggacgtgttcttcatcccccctgagaagtgtgacaccctgctttgcgatatcggggaaagctcccccaacccgacgatcgaagagggtcggaccctccgtgtgctgaagatggtggaaccctggcttcggggtaatcagttctgcatcaagatcctcaacccatacatgccatcagtagtcgaaacgctggagcagatgcagcgcaagcatgggggcatgctggtacggaacccgctatcacgcaacagcacccacgagatgtactgggtgtcctgcgggaccggcaacatagtcagcgccgtgaacatgacgtcccggatgctgctgaaccgctttacgatggcccaccgcaaacccacctatgagcgggacgtggatctcggggcgggcacccgccacgtcgcagtggaacccgaagtggccaacctggatatcatcggccagcggatcgagaatatcaagcatgagcacaagtccacgtggcactatgatgaggacaatccctacaagacctgggcttaccacgggtcctacgaggtcaagccgtctggctcagccagctccatggtgaacggggtcgtaaagctgctcactaagccctgggacgtgataccgatggtgacgcagattgcgatgacggatactacccccttcggccaacagcgcgtcttcaaggagaaggtcgatacccggacgccgaaggcgaaacgcggtaccgctcagataatggaggtaaccgcccggtggctgtgggggttcctttcgcgcaacaagaagccacggatttgcacccgtgaggagtttacgcgaaaggtgcgcagcaatgccgcgatcggcgccgtgttcattgacgagaaccagtggaacagcgcaaaggaggccgtcgaggacgagaggttctgggacctcgtccaccgcgagcgggagctccacaagcagggcaagtgcgcgacctgtgtctacaacatgatgggtaagcgcgagaagaagctgggggagttcggcaaggccaaggggagtcgggccatctggtatatgtggctgggcgcccgctttctggagttcgaagcgctgggattcatgaacgaggatcactggttctcccgggaaaatagcctctctggggtcgagggcgaggggctacacaaactgggatacatcctccgcgatattagcaagatcccgggaggaaacatgtacgcggacgacacggccggctgggacactcgtatcacggaggacgacctgcagaacgaagccaaaatcaccgatatcatggagccggagcacgccctgttggccaaggcgatttttaagttaacctaccagaacaaggtagtgcgcgtacaacgcccagcgaagaacgggaccgtgatggacgtgatcagccggcgcgaccagcggggctctggtcaggtcgggacgtacggtctgaacacatttaccaacatggaggcccagctgatccgacagatggagtccgaggggatcttttcaccttcggagctggagaccccaaaccttgctgagagggttttagactggctgggtaaatacggggtggaaaggctgaagcggatggccattagcggcgacgactgcgtagtgaaaccgatcgacgaccgctttgcaacagcgctgaccgccctgaacgatatggggaaagtacggaaagacatcccgcagtgggagccctccaagggctggaacgactggcaacaggtccctttctgcagccaccacttccaccagctgatcatgaaggacggccgtgagatcgtggtgccgtgccggaaccaggacgagctagtcgggcgcgcccgggtatcccaaggggccgggtggagcctgcgcgagactgcttgtttaggcaaatcctatgcccagatgtggcaactcatgtacttccaccggcgcgacttgaggctcgccgcgaacgcgatctgttccgccgtgcccgtcgactgggtgcccacctctagaacaacctggtccatccacgcccaccatcagtggatgaccaccgaggacatgctctcggtgtggaaccgtgtatggatcgaggagaacccctggatggaggacaagacacacatcagtagttgggaggacgttccgtacttagggaagcgcgaggaccagtggtgcggctcactaataggcctcacagcccgcgccacctgggcgaccaatatacaggtggccatcaaccaggtccggcgcctgatcgggaacgaaaactacctggactacatgaccagcatgaagcggttcaagaacgagtccgaccccgagggcgccctctggtga

SEQ ID NO: 24760 - RNA, 9879 nt, synthetic construct
  misc_feature 1..9879: note = derived and/or modified CDS sequence (opt11) from DENV-1__KU666940__SS-prME
  source 1..9879: mol_type = other RNA
tcagtcaccatgttgctcatgttgacccccacggccctggccttccacttaacaacccggggtggggagccccacatgattgttagcaagcaggagcgtgggaagagcctgctattcaagaccagcgccggagttaacatgtgcaccctcatcgccatggaccttggcgagctgtgcgaagatacaatgacatataagtgcccgcggatcaccgaggcagagcccgatgacgtggactgctggtgcaacgcgacggatacatgggtgacctacgggacctgttcgcagacgggcgaacaccgacgcgacaaacgatctgtggccttagccccccacgtcggcttagggctggagacgcggaccgagacctggatgagctccgagggggcctggaagcagatccaacgggtcgaaacctgggctttacgccaccccggcttcaccgtgatcgcccttttcctggctcacgccatcggcaccagcataacccagaaggggatcatattcattctgctgatgctggtgacgccttcgatggcaatgcgatgtgttggcatcggaagccgcgacttcgtggaggggctatccggggccacctgggtcgacgtagtgctcgagcacggttcttgcgtgaccacaatggccaaggacaaacccacgctagatatcgagttgctgaagaccgaggtaaccaaccccgccgttctgagaaagctttgtatagaggccaagatctccaacaccacgaccgacagccgctgcccgacacagggcgaggccaccttggttgaggagcaggacgccaacttcgtttgcaggcgcacgttcgttgatcggggctgggggaacggctgtggattgttcggcaaggggtccttgattacgtgcgcaaaatttaagtgcgtgacaaaactcgagggcaagatcgtccagtacgagaatttgaaatacagcgtaatcgttacggtccacacgggtgaccagcaccaagtggggaatgagagtaccgagcacggcaccaccgcgacaatcacgcctcaagctcccaccaccgagatccagttgactgactacggtgccttaacgctagactgttctccccggaccggcctcgacttcaacgaaatggtcctcctgacaatgaaggagaaatcttggctcgtgcacaagcagtggttcttggacctgcccctgccctggacgtcaggggcgtcgacctcccaagagacttggaataggcaagatttgctggtcaccttcaagacggcccacgctaagaagcaggaggtcgtggtgctcgggagccaagagggagcgatgcacacggccttgaccggggccaccgagatccaaacttccggcacgacaaccatcttcgccggacacctgaagtgtcgtctcaagatggacaagttgaccctgaagggcatgagctacgtgatgtgtacggggtccttcaagctagagaaggaggttgcagagacccagcacggcacggtcctcgtccagatcaaatacgagggtactgacgccccctgcaagattcccttcagcacgcaggacgaaaagggtgtgacccagaacggccggctgatcactgcgaacccaattgtaaccgataaggagaagccagtcaacatcgaagctgagccgccgttcggggaatcctacatcgtgatcggagctggcgagaaggcgctgaagctcagctggttcaagaaagggagcagcatcggtaagatgtttgaggccacggcccgcggggctagaagaatggcaatactgggagataccgcttgggacttcgggtctatcggcggcgttttcaccagtgtcggtaagctggtacaccagatctttggcaccgcttatggggtgctgttctccggcgtgagttggacgatgaaaatagggatcggcgtcctgctcacctggctaggcctcaactcccgctcgacgtccctgtcgatgacctgtattgccgttgggctcgttacgctatatctgggcgtgatggtgcaagccgactcaggatgtgtaattaactggaaaggccgggagctgaagtgcggatctggaattttcgtgactaatgaagttcacacttggactgagcagtacaagttccaggcggatagtccaaagcgcctgtcggccgccatcggcaaggcctgggaggaaggggtctgtgggatccggtctgctactagactggagaacatcatgtggaagcagatttccaacgagttgaaccacatcctgctggagaacgacatgaagttcacggtggtggtaggggacgtggcgggcatcctcgcccaagggaagaaaatgatccggccccagcccatggagcacaagtactcctggaagtcctggggcaaagccaaaattatcggcgccgacgtgcagaacactaccttcataatcgatggacccaacacccctgaatgcccagacgaccagcgcgcgtggaacatctgggaggtagaagactacggattcgggatcttcaccaccaatatctggctgaaactgcgggacagctacacccaggtgtgcgatcaccggctcatgtccgcggccatcaaggactccaaggccgtgcacgctgacatgggctactggatagagtcggagaagaacgagacctggaagctcgcgcgcgcctccttcatcgaagtcaagacatgcatctggcctaagagccatactctctggagcaacggcgtgctcgagtccgaaatgataatccccaagatctacggtgggccgatttctcaacacaactacaggcccgggtacttcacccagactgccggtccctggcatttagggaaactggagctggacttcgacctttgtgaaggcacgaccgtggtcgtggatgagcattgcggaaaccgggggccatccctgcggacgaccacagtaaccggcaaaatcatccacgagtggtgctgccggtcatgcaccctcccgcctctccgctatcgaggcgaggacgggtgctggtatgggatggagatccgccccgtgaaagaaaaggaggagaacctggtcaaatcgatggtgagcgccggaagcggagaggtcgactcctttagccttggactgctgtgtatctctatcatgatcgaagaagttatgcggagccgctggtcacggaagatgttaatgacaggcacgctggcggtgttcttcctgcttatcatgggacaactgacctggaacgacctcattcgtctgtgcatcatggttggagccaacgcaagcgaccgcatggggatgggcaccacatatctggccctaatggcgacgttcaagatgcggcccatgttcgcggtgggcctcctttttaggcggctgactagcagggaagttttactgctgaccatcgggttatcgctggtcgcctccgtggagctgccgaatagcctcgaggagctgggagacggcctagccatgggaattatgatcctcaaacttctgaccgacttccagtcccatcaattgtgggccacgcttttgtcccttactttcatcaagaccaccttcagcctgcactacgcatggaagacgatcgcgatggtcctgagcatagtttcactcttccccctgtgcctatccacgaccagtcagaaaaccacatggctcccggtacttctgggctcgctcggatgtaagccgttgaccatgttcctgatcgccgagaataagatctggggcagaaagtcatggccgcttaacgaaggaataatggcggttggcatagtgtctatcctgctgagctccctcctgaagaatgacgtgcccctagcggggcccctcatcgctggcggcatgctcattgcgtgctacgtcatcagcgggtccagcgccgatctttccctagagaaagccgcagaggtgtcgtgggaggaggaagccgagcactccggcgcctcacacaatatcctggtcgaagtccaggacgacgggaccatgaagataaaggatgaggagcgcgatgacacattgacaatcctccttaaggccacactgctcgctgtttccggcgtctacccgctatcgatcccagcaaccctgttcgtctggtatttttggcaaaagaagaagcagagatccggggtgctctgggacacgcccagcccgcccgaggtagagcgcgccgtcctggacgacggcatctaccggatcatgcagcgcggactgctgggtcggtcccaagtgggcgtaggggtgtttcaggaaaacgtgttccacaccatgtggcacgtaacgcgcggcgcagttctgatgtaccaagggaagcggctagaaccctcttgggcctcggtcaagaaggacctaatctcatatggtggcgggtggcgcctccagggctcatggaacaccggggaggaggtgcaggtaatcgccgttgagcccggaaagaaccccaaaaacgtgcagaccgctccaggtacctttaaaacgcccgagggggaggttggggccatagcgctggatttcaagcccggaaccagcggctccccaatcgtaaaccgtgaagggaagatcgtcggtttatacggcaatggtgtcgtaaccacctcagggacgtacgtgagcgcgatagcccaggctaaggcgtcacaagaagggcccctccctgagatagaagacgaagtcttccgcaagcggaacctgacaatcatggacctgcaccccgggagcggaaaaacgcgccgatacctccctgccatcgttcgcgaggccataaaacgtaagctccgcaccctgatcctcgccccgacgcgagtcgtcgcctccgagatggccgaggcgctgaagggcatgcccattcggtatcagaccacggccgtcaaatcggagcacaccggcaaggaaatcgtggaccttatgtgccacgccacgtttacgatgcgcctcctgtcccccgtgcgtgtaccgaactacaacatgataattatggatgaggcccacttcaccgatccatcatccattgcggcccgtgggtacataagtacccgggttggcatgggggaggcagctgcgatctttatgacggcgacgccgcccggcagcgtcgaagcgttcccgcagtctaacgccgtgatccaggacgaagaacgcgatattcccgagcggtcctggaacagcggctatgagtggattaccgactttcctggtaagaccgtgtggttcgtccccagtatcaagtccggaaacgatatagccaactgcctgcgcaagaacgggaagcgagtgatccagctgtcccgcaagaccttcgacaccgagtaccagaagaccaagaataacgattgggactacgtggtcaccacggacataagtgagatgggcgcaaacttccgggccgaccgggtgatcgacccgcggagatgcctgaagcccgtaattctgaaggatggtcccgagcgggtcatactcgcaggccccatgccggtgaccgtggcatccgccgctcagcgtcgggggcgcattggccggaaccacaacaaggagggcgaccagtacatctacatggggcaacccctgaacaatgacgaggaccacgctcactggaccgaagcaaagatgctgctggacaacattaacactccggagggcataatcccagccctgttcgagccggagcgggaaaaatccgccgcgatcgacggggagtaccgcctacggggcgaggcacgcaagacatttgtcgaactgatgcgtcgcggggacctgcccgtgtggctgtcatacaaagtcgccagcgaaggcttccagtacagcgataggcgctggtgcttcgatggtgaacgaaataatcaagtgctcgaagaaaacatggatgtggagatctggactaaggagggggagcgtaagaagttgcggccccgctggctagacgcccgtacgtactccgaccccctggccctgcgcgagttcaaagagtttgctgcaggccggcgtagcgtctccggggacttgatactcgagataggcaaactcccgcagcacctaacacagcgggcacaaaacgctctggacaacctggtgatgctgcacaactcagaacagggggggagagcataccgacatgccatggaggaattgcccgacacgattgaaacattgatgctgctcgccctgatcgccgtgctgaccggcggcgtcaccttgttctttctgtccggaaagggtctgggcaagacctctataggcctcctgtgcgtaatggcctcaagcgtgcttttgtggatggcgagtgtcgaacctcactggatagctgcctcaattatattagagttcttcctgatggtgcttctgatccccgaaccggaccgccagcgaacgccccaagacaaccagctggcctatgtcgttatcgggctcctgttcatgatcctgaccgtagccgcgaacgaaatggggctcctggagaccaccaaaaaggatctggggatcggccacgtcgccgtcgagaaccaccaccacgctgccatgctggatgtcgacctgcaccctgcctccgcgtggacgctgtatgccgtggccaccactattatcacgccgatgatgagacacacgatagagaataccaccgccaacatctcgctaactgctatcgctaaccaggccgcgattctaatggggctggacaaaggctggccgatctccaaaatggacatcggcgtccctctcctggcccttgggtgctacagccaggtgaacccactaacactgactgcagccgtgttgatgctcgtcgcccactacgccatcatcgggccgggacttcaggcgaaggcgaccagggaagcccagaaacgcaccgcagccggcatcatgaagaacccgactgtggacgggatcgtggccatcgacctggaccccgttgtgtacgacgcgaagttcgaaaagcagctcggtcagataatgctgctgatcctctgcacgtcacagatcctgctaatgaggaccacgtgggccctgtgtgagagtatcactctggcgaccggaccattaacaaccctttgggagggtagcccgggcaagttctggaatacgaccatcgcagtgagcatggcaaatatattccgtggatcctacctggcgggggccggtctggccttctctctcatgaagtcccttgggggcgggcgccggggtacaggggcccagggcgagaccctgggcgaaaagtggaagcgccagctcaatcagcttagcaagagcgagttcaacacctataagcgcagcggcataatggaggtcgaccgcagcgaggcaaaagaagggctgaagcggggagagacaaccaagcacgccgtgtcccgcggcaccgctaaactgcggtggtttgttgagcgcaatctcgtcaagcccgaggggaaggtcatcgacctggggtgcggccgtgggggctggtcctattactgcgccggactgaagaaggtgacggaggttaagggctacactaaggggggcccaggccacgaggagcccgtcccaatggctacctacgggtggaacctcgtgaagcttcactcgggcaaagacgtctttttcatccctccggagaagtgcgataccctgctctgcgacatcggcgagagctcccccaacccgacgatcgaggagggaaggacgctgcgggtactaaaaatggttgaaccgtggctccgcgggaaccagttctgcattaaaatccttaatccgtatatgccgagcgttgttgagactctggagcaaatgcagcgtaaacacggcggcatgctcgtgcgcaacccgctgtcgcgtaatagcacccatgaaatgtactgggtctcctgcggcaccggaaatatcgtgtccgcgatcaatatgacgtcccgcatgctgctcaaccgattcaccatggcccatcggaagcctacatatgagcgcgacgtggatctgggcgccggcacccgacacgtcgccgtagagcccgaggtcgcgaacctggatataattggccaacgcatcgagaacatcaagtgcgagcacaagagcacgtggcactacgacgaggacaatccctacaaaacttgggcctaccacgggtcatatgaagtaaagccgtctggaagtgcctcaagcatggtgaatggggttgtgaagcttttgactaagccatgggacgtgatccccatggtaacccaaatagccatgacggatacgacccccttcgggcagcagcgggtgttcaaggagaaggtggacacccggaccccgaaggccaagcgtggaaccgctcagattatggaggttactgcccgctggctttggggcttcctctcccggaacaagaagccgcgcatctgtacccgcgaagaattcacgaggaaggtgcggtcaaacgccgccattggggccgtgttcgtcgacgagaatcaatggaattctgcgaaggaagcagtggaggacgagcgattctgggacctagtccaccgcgagcgcgaactccacaagcagggtaaatgcgcaacgtgtgtttacaacatgatgggcaagcgcgagaagaagttgggggagttcggcaaggcaaaggggagccgcgccatctggtatatgtggctcggcgcgcggttcctcgagttcgaggccctgggattcatgaacgaggaccactggttctcgcgcgaaaacagcttaagtggggtggagggcgagggcctgcacaaattgggatacatccttcgggacataagcaagatatctggcgggaacatgtacgcggacgacaccgctggttgggacacccgcatcacggaagacgacctgcaaaacgaagccaagatcaccgagatcatggagccggaacacgcgcagctcgccaaggcgatattcaagctaacctaccagaacaaggtggtccgcgtgcagcgcccggccaagaatgggaccgtaatggacgtcatcagccgccgagatcagcggggcagcggccaggtggggacgtatgggctgaacacctttaccaacatggaagcccagctcatccggcaaatggagagcgaggggatcttctctcccagcgagctggagacccccaacctggcggagcgcgtgctggactggctggagaaatacggcgtagagcggctgaaacgcatggccatctccggggacgactgcgtggtgaagccaatcgatgaccggtttgccactgcgctcaccgcccttaacgacatgggcaaggtccgcaaagacatccctcagtgggaaccctctaagggatggaatgactggcagcaggtccccttctgctcccaccacttccaccagctaatcatgaaggacggccgggagatcgtggttccctgccgcaatcaggatgagctcgtgggccgtgcgcgcgtgtcacagggggctgggtggagcctgcgggagaccgcgtgccttggtaagtcctacgctcaaatgtggcagttgatgtacttccatcgccgggacctgcgcctggccgcaaacgctatatgtagcgccgtccccgtagattgggtgcccacctcccgcacgacctggtcgatccacgcccatcaccagtggatgaccaccgaagacatgttgtctgtctggaacagggtctggatcgaagaaaacccgtggatgaaggacaagacacatatcagctcgtgggaagacgttccctacctaggtaaacgtgaggaccagtggtgcgggagcctgatagggctcaccgcacgcgcgacgtgggccaccaacatccaggtagcaatcaatcaggttcgccggctgatcggtaatgaaaactacctcgactatatgacgagcatgaaacgcttcaagaacgagagcgacccagagggggcactatggtga

SEQ ID NO: 24761 - RNA, 9879 nt, synthetic construct
  misc_feature 1..9879: note = derived and/or modified CDS sequence (opt11) from DENV-1__KU666941__SS-prME
  source 1..9879: mol_type = other RNA
agcgtgaccatgctgctcatgctgatgcccaccgccctggccttccatctcacgaccagaggcggggagccccacatgatcgtcagcaagcaggagcggggcaaaagcctcctgttcaagacaagcgctggggttaacatgtgtactctcattgccatggacctgggcgagctgtgcgaggacacgatgacctacaagtgcccccgcatcaccgaggccgagcccgatgacgtcgactgctggtgcaacgccaccgatacgtgggtgacctatggcacctgcagccagacaggcgaacaccggcgcgacaagcggtctgtggcccttgctccacacgtaggcctggggctggagactcgcactgagacctggatgagctccgagggcgcctggaagcagatccaacgggtggagacctgggccctccgccaccccggttttacggtgatcgcgctgttcctggcgcacgccataggcaccagtatcacccagaaggggatcatctttatccttctgatgctggttaccccgagtatggccatgcggtgtgtcggcatcggctcacgcgatttcgtggaggggctctccggtgcgacgtgggtggacgtcgtgctggagcacgggtcttgcgtgacaaccatggcgaaggacaagcccaccttggacatcgagcttctgaagacggaggtcaccaaccccgcggtgctgcggaagctgtgcatcggcgcgaagatctccaataccaccacggacagccgatgccccacccagggtgaagctaccttggtggaggagcaggacgccaatttcgtctgccggcgcacgttcgtggaccgggggtggggcaacgggtgcggtctgttcggcaagggctccctcatcacgtgcgccaagttcaagtgcgtgaccaagctggaaggcaagatcgtccagtacgagaacctgaagtacagcgtgatcgtgacggtccacacgggggaccagcaccaggtgggaaacgaatccaccgaacacgggaccacggcgacgatcacgccccaggctcccacgaccgagatccagctcaccgactacggcgctctgacactagactgctcgcctcgcacggggctcgacttcaacgagatggtcctgttgaccatgaaggagaagagttggctcgtccacaagcagtggtttctggacctgccgctcccctggaccagcggagcaagcacctctcaggagacgtggaaccgtcaggacctgctggtgaccttcaagacggcccatgcgaagaaacaggaggtcgtggtgctcggtagccaggagggtgccatgcacaccgccctgaccggcgccaccgagatccagacctctggcaccacgaccatattcgccggccacctgaagtgccggctcaagatggacaagttgaccctgaagggtatgagctacgtcatgtgcaccggcagcttcaagctggagaaggaggtggcggaaacgcagcacggcaccgtgctggtccagatcaagtacgaggggacggacgccccctgcaaaatccccttcagcacccaggacgagaagggcgtaacgcagaacgggcggctgatcaccgccaacccgatcgttacggacaaggagaaacccgtcaacatcgaggccgagccgccctttggcgagtcctacatcgtgattggcgcgggggagaaggccctgaaacttagctggttcaagaaaggctccagcatcgggaaaatgttcgaggccacggcccgcggcgcccgtagaatggcgatccttggggatacggcctgggacttcggctccatcggcggggtttttaccagcgtcggcaagctggtgcaccaaatctttggaaccgcctacggcgtcctcttctccggtgtgagctggaccatgaagataggaatcggcgtcctgttaacatggctcggcctcaattcccgcagcacctccttgtccatgacctgcattgccgtgggcctagttaccttatacttaggtgtgatggttcaagcggactccgggtgcgtcatcaactggaaggggagagagctcaagtgcggcagcggcatcttcgttacaaacgaggtgcacacctggaccgagcagtataagttccaggcggacagcccgaagcgcctgtcagccgccattgggaaggcctgggaggagggcgtctgcgggatcagaagcgccacccgcctggagaacattatgtggaagcagatctctaatgagctcaaccacatcctattagaaaacgacatgaagtttaccgtggtggtgggcgacgtggcagggatcctcgcccagggcaagaagatgatccgtccacagcccatggagcacaagtacagttggaagtcctggggtaaggccaagatcatcggggccgacgtgcagaacacgaccttcatcatcgacggtcccaacactccggagtgccccgacgaccagcgcgcgtggaacatctgggaggtcgaggattacgggttcggcatcttcaccactaacatatggctgaagctccgggacagctacacccaagtgtgtgaccaccgcctcatgtccgccgccatcaaggacagcaaggccgtgcacgctgatatgggctactggatcgaatccgaaaagaacgaaacctggaagctggcgcgggccagctttatagaggtcaaaacttgcatctggcccaagtcccatacgctttggtcaaatggggtgctcgagtctgagatgatcatccccaaaatctacggcggtccgatctcacagcacaattatcgccccgggtactttacccagaccgccgggccctggcatctgggtaagctggagcttgacttcgacctgtgtgagggcaccacggtggttgtggacgagcactgcgggaaccggggaccatccctgcgcactacaaccgtgactgggaagattatccatgagtggtgctgccggagctgcaccctgccgcccttgcgctaccggggcgaggacgggtgttggtatggcatggaaatcagaccggtcaaggagaaggaggagaacctggtgaagtccatggtgtcagccggcagcggggaagttgacagtttcagcctcggcctgctgtgcatctccatcatgattgaggaggtgatgcggagccgttggtcgcggaagatgctcatgacaggcaccctagccgtgttcttcctgttaatcatgggccagctgacgtggaacgacctaattcgcctctgtatcatggtcggagctaatgcctcagaccgcatgggcatgggcaccacatacctggccctgatggccaccttcaagatgcgtccgatgtttgccgtggggcttttgttccggcggctgacttcacgcgaggtgctcctcctgaccatcggcctcagcctggtcgcctctgtggagctgcccaacagcttagaggagctgggtgacggcctggccatgggcataatgatcctcaagctactgaccgactttcaatctcatcagctctgggccacattactgagcctcactttcatcaagacgaccttctccctgcactacgcatggaagacgatcgcgatggtcttaagcatcgtgtccctcttccctctgtgcttaagcacgacctcccagaagaccacctggctgcccgtgctgttagggtccctcggctgcaagccactgacgatgttcctaatcgccgagaacaagatctgggggcggaagtcctggccactcaacgagggcattatggcggtcgggatcgtgtcgatactgctgtcctccctcctgaaaaatgacgtgcctctggccggcccccttatcgccggcgggatgctcatcgcgtgctacgtcatcagcggatccagcgccgacctgtccctcgagaaggccgccgaggtaagctgggaagaggaggccgagcactctggggcgagccacaacatcctggtcgaggtccaggacgacggcaccatgaagatcaaggacgaggagcgtgacgacaccttaaccatcctcctgaaggccactctgctcgccgtgtccggggtgtacccgctatctatccccgccacgctcttcgtctggtacttctggcagaaaaagaagcagaggtccggagtcctctgggacacccccagcccgcccgaggtcgagcgcgccgtcctggacgacggcatctaccggataatgcagagggggctgctgggccggtcccaggtgggggttggcgtcttccaggagaacgtgttccatactatgtggcacgttacacgcggggcggtactcatgtaccaagggaagcggctcgaacccagctgggcctccgtgaagaaggacctgatcagctacggcgggggctggcgtctccaagggtcctggaacacgggtgaggaagtgcaagtcatcgccgttgagcctggcaagaaccccaaaaacgtgcagactgcccccggaaccttcaagacccctgaaggtgaggtgggggccatcgcgctagacttcaagccaggcacgagtgggtcgcccatcgtgaatcgggagggcaagatcgttggcctgtacgggaatggcgtcgtgaccaccagcgggacctatgtgagcgctattgcccaggccaaggcgtcacaggagggccctttacctgaaatcgaggacgaagtcttccgcaagcggaacctgaccatcatggacctgcaccccgggagcggcaagacccgccggtatctcccggccatcgtgcgcgaggccatcaaacgtaaactgcgcaccttgatcctcgcccccacgcgcgtggtcgccagcgagatggcggaggccctaaagggcatgcccatccggtaccaaacgaccgccgtcaagagcgagcacaccggcaaggagatcgtggacctgatgtgccacgccacgttcacgatgaggctactgtcccccgttagagtgccgaactacaatatgatcatcatggacgaggcacacttcaccgatccaagctccatcgcggccagaggctacatcagcacgagggtggggatgggcgaggcagcggccatcttcatgaccgcgacgccgcccggctcggtcgaggccttcccgcagagcaatgccgtgatccaggacgaggagcgcgacatccccgagcggtcctggaacagcggctacgagtggatcaccgacttccccggtaagaccgtgtggttcgtaccctccattaagagcgggaacgatatcgccaactgtctgagaaagaacggcaagcgggtgatccagctctcccgcaagacattcgacactgagtaccagaagaccaaaaacaatgactgggactacgtggtcaccaccgacatcagcgagatgggggccaacttccgggccgaccgggtgattgacccgcggcgctgcctgaagcccgtgattttgaaagacggcccggagcgggtcatcctcgccgggcccatgccggtgacggttgcctccgcagcgcagcgtcggggccgcatcggccggaatcacaacaaggagggggaccaatacatatacatgggccagcccctgaacaacgacgaggaccacgcccactggaccgaagccaaaatgctgctcgacaacattaacacacccgaaggcatcatccccgccctattcgagccggagcgagagaagtcggccgcgatcgacggcgagtatcgcctgcgcggggaagcccgcaagaccttcgttgagctaatgcggcgcggcgacctgcccgtgtggctgagttacaaggtcgccagcgagggcttccagtacagcgaccggcgctggtgcttcgacggggagcggaacaaccaggtgctcgaggagaacatggacgtggagatttggacaaaggagggcgagcgcaagaagttaagaccccgctggctggacgcacggacttactccgaccccctcgcgctgcgcgagttcaaggagttcgcggctgggcgccgcagcgtctccggcgacctgattctcgagataggcaaactgccgcaacacctcacccagcgggcccaaaacgctttggacaatcttgtgatgctgcacaacagcgagcagggcgggcgggcgtaccggcacgccatggaggagctccccgacaccatcgaaaccctgatgctgttagccctaatcgccgtcctgactgggggagtcaccctctttttcctgtccgggaagggcctgggcaagacaagcatcgggctcctgtgcgtgatggcatccagcgtactgctctggatggcatccgtcgagcctcattggatcgccgccagcattatccttgaattcttcctgatggtcttgctgatccccgagccggaccgccagcggacgccccaggataaccagctggcctacgtggtcatcggcctcctgttcatgatcctgacggtggcggcgaacgaaatggggctcctggagaccaccaagaaggacttgggcatcgggcacgtggcggttgagaaccaccatcacgccgccatgctcgacgtagacctccaccccgccagcgcgtggaccttatacgccgtggccacaaccatcatcaccccgatgatgcgccacaccatcgagaacacgactgcaaacatctctctgactgccatcgcaaatcaagccgccatcctgatgggcttggacaaaggctggcccatctccaagatggacatcggggtccccctcctggccctgggctgctacagccaggttaaccccctcacccttacggcggccgtgctaatgctcgtcgcccactacgccatcatcgggccgggcttacaggccaaggcgacgcgtgaggctcagaagcgcaccgccgccgggatcatgaagaacccaactgtggacggcatcgtggccatcgacctggaccccgtcgtgtacgacgcgaaattcgaaaaacagttaggccagatcatgctgctgatactgtgcacatcccagatcctgctgatgcggaccacctgggctctctgcgaaagcatcaccctggctaccgggcccctgaccacgctatgggagggctccccgggcaagttctggaataccacgatcgccgtgagtatggccaacatcttccggggctcctacctggcgggcgccgggctggccttctctctcatgaagtccctgggcggcggccgcagagggaccggcgcccagggcgaaaccctgggggagaagtggaaaaggcagctcaatcagctgtccaagtcagagttcaacacctataagagatccggaatcatggaggtcgatcgcagcgaggcgaaggaggggctgaagcggggcgagacgacaaagcacgccgtctcccgcgggaccgccaagttgcggtggttcgtagaacggaacctggtcaagcccgaaggcaaggtcatcgacctcggctgcggacggggcgggtggagctactactgcgccggcctgaaaaaggtgaccgaggtcaaggggtacacgaaaggtgggccagggcacgaggagcccgtgccgatggcgacctacggctggaacctcgtgaagctgcactccgggaaggacgtcttcttcatcccgcccgagaagtgtgacacgctgctctgtgacatcggcgaaagctcccccaacccgaccatcgaggagggccgcacgctgcgcgtcctgaagatggtggagccctggttgaggggcaaccagttctgcataaagatcctgaacccctacatgcctagcgtggtggagaccctggagcagatgcagagaaaacacgggggtatgctcgtgcgcaaccctctgtcacggaatagtacccatgagatgtactgggtatcctgcggaactgggaacatcgtgagcgcgatcaacatgacctcccgcatgctgcttaaccggttcacgatggcacaccgcaagcccacctacgagcgcgacgtggacctgggcgccggcacccggcatgtcgccgtggagcccgaggtggcaaacctggacatcatcgggcagcgcatcgagaatattaagtgcgagcacaagagtacctggcactacgacgaggacaatccgtacaaaacttgggcctatcacggctcctacgaggtcaagccgagcgggtccgcctcctcaatggtgaacggcgtcgtaaagctcttgacaaagccctgggacgtgatacccatggtcacccaaatcgccatgacggacacgaccccctttgggcaacagcgggtgttcaaagagaaagtggacacccgtacacccaaggccaagcggggaacggcccagattatggaagtcaccgcacgctggctgtggggcttcctctcccggaataagaagccacgaatctgcacccgagaggagttcacccgcaaagtgcggagcaatgccgccatcggggccgtgttcgtcgacgagaaccagtggaactccgcgaaggaggccgtggaggacgagcgcttctgggatctggtccaccgggagagagagctgcacaagcagggcaagtgcgccacgtgcgtctataatatgatggggaagcgggagaagaaactcggtgagttcgggaaggccaagggcagccgcgccatctggtatatgtggctgggcgcccggttcctggagttcgaggccctcgggttcatgaacgaggaccactggttctcgcgcgagaactcgctaagtggcgtggagggtgagggactgcacaagctcgggtacatcctgcgggacattagcaagatctccggcggcaacatgtacgccgacgacaccgccgggtgggacacacgcatcaccgaggatgacctgcagaacgaggcaaagatcacggagataatggagcccgagcacgcacagctagccaaggccatcttcaagctgacctatcagaacaaggtggtccgggtgcagcgcccagcgaagaacggcaccgtcatggacgtgattagccgccgggaccagcgcgggtccggccaggtgggcacttacgggctgaacacgtttacaaacatggaggcccagctcatccggcaaatggagagcgagggaattttttcccccagcgaactggagaccccaaacctggcggagcgcgtgctcgactggctcgagaagtacggggtcgagcgattgaagagaatggcaatctccggggacgactgcgttgttaagcccatcgacgaccggttcgccaccgccctcacggccctgaacgatatgggaaaggtccgcaaggacattccacagtgggagccctcaaagggctggaacgactggcagcaggtccccttctgctcccaccacttccaccagctgatcatgaaagacggacgggagatcgtggtcccctgcagaaatcaggacgagttagtcgggcgggcgcgcgtgagccagggcgctggatggagcctccgtgagaccgcctgcctgggcaagtcctacgctcagatgtggcagttgatgtacttccaccgcagagacctgcgcctggcggccaacgccatctgcagcgccgtccccgtggactgggtgcccacctcccggacaacctggagcatccacgcccaccaccagtggatgaccaccgaagacatgctatccgtatggaaccgcgtgtggatcgaagagaacccctggatgaaagacaagacccacatctcgtcctgggaagacgtgccctacctggggaagcgggaggaccagtggtgtggcagcctgattggcctcacggcacgcgccacctgggcaaccaatatccaggtcgccatcaatcaggtgcgccggttaatagggaatgaaaactacctggactacatgacctccatgaaacgctttaagaacgagagcgacccggaaggtgccctctggtga

SEQ ID NO: 24762 - RNA, 9879 nt, synthetic construct
  misc_feature 1..9879: note = derived and/or modified CDS sequence (opt11) from DENV-1__KC172835__SS-prME
  source 1..9879: mol_type = other RNA
tctgtaaccatgttgctgatgttgatgcctaccgccctggcgttccacctcaccacccgcggcggggagccgcacatgatagtgagcaagcaggagcggggtaagagcttactgttcaagacgagcgcgggggttaacatgtgcaccttaatcgccatggacttgggcgagctgtgtgaagacaccatgacctacaagtgcccccgcatcaccgaagccgagcccgacgacgtggactgctggtgcaacgcaaccgacacttgggtcacctacgggacctgcagccaaaccggcgagcaccgtcgcgacaagcggtccgttgcacttgcgccccacgtgggcttaggtctggagacccgcaccgagacttggatgagctccgaaggcgcgtggaagcagatccaacgggtcgagacctgggccttacgccaccccgggtttacggtgatcgccctgttcctggcgcacgccataggcaccagcattacccagaaggggatcatcttcatcctcctgatgctagttactcccagcatggcaatgcggtgtgtcggcatcggctcacgcgatttcgtagaggggctctccggcgccacgtgggtggacgtcgtactggagcacggttcctgcgtgactactatggcgaaggacaagcccaccctggatatcgagctcctcaagaccgaagtgaccaaccccgcggttctgagaaagctctgcattgaggccaagatcagcaacaccaccacggatagccgctgtccgacgcaaggcgaggccaccctagtcgaggagcaggacgccaacttcgtctgtcgccgcacattcgtggatagaggctggggaaacggctgcgggctgttcggcaaggggtcgctcatcacgtgcgccaagttcaaatgcgtgactaagctcgagggaaagattgtccagtacgagaacctgaagtacagcgttatagtgacggtccataccggcgaccagcaccaagtaggcaacgagtccacggagcacggcaccactgcgaccatcacgccacaagcgccaacgaccgagatccagctcaccgactacggtgccctcaccctggactgcagcccacgcacaggcctcgacttcaacgagatggtactgctgaccatgaaagagaagagttggctcgtgcataaacagtggttcctcgacctgccgttgccttggacaagcggggcctctacctcccaagaaacgtggaaccggcaggacctcctagtgacctttaagaccgcccacgcgaagaagcaagaggtggtggttctcggcagccaggagggcgccatgcataccgccctgacgggcgccaccgagatacaaacatctggcaccaccaccatcttcgcggggcacttaaaatgccgcctcaagatggacaagctgaccctgaaaggaatgagctatgtcatgtgcacgggttccttcaaactcgagaaggaggtggctgagacacagcatggcaccgtcctggtccagatcaagtacgaaggaacggacgctccttgcaaaatccccttcagcactcaggatgaaaaaggggtcacgcagaatggcaggctgatcacagccaaccccatcgtcacagataaggaaaagccggtcaatatcgaggcggagccgcccttcggggagtcctacatcgtgatcggcgcgggggagaaggcactgaagctcagctggtttaagaaggggtccagcatcgggaagatgttcgaggccaccgcacgcggggcccggcgcatggccatcctgggcgacacggcctgggacttcggaagcatcggcggcgtgtttacaagtgtcgggaaacttgttcaccaaatcttcggcactgcctacggtgttctgttctccggcgttagctggaccatgaagatcgggatcggcgtgctgttgacgtggctaggacttaacagtcgctccacctctctgtcgatgacatgcatcgccgtggggctggtgaccctgtatcttggcgtgatggtgcaggctgactccgggtgtgtcgtgaactggaaaggtcgggagctcaagtgcgggagtggcatcttcgtgacgaacgaagtccacacatggaccgaacagtacaagttccaggccgactctccgaagaggctgtccgcagccatcggcaaggcctgggaggagggggtgtgtgggatccggtctgccacgcgcctggagaacgttatgtggaagcagatctccaatgagctaaaccacatactgttagagaacgacatgaagtttaccgtcgtcgtgggtgacgtggctggcatcctagcccaggggaagaaaatgatcagacctcagccaatggagtacaagtacagctggaagagttggggcaaagccaagatcatcggcgccgacgtgcagaacaccaccttcataatagacgggcccaacaccccggagtgccccgacgatcagcgcgcgtggaacatctgggaggtggaggactacggcttcgggatcttcacaaccaacatctggttacggttgcgcgacagctacacccaggtctgtgaccaccggctcatgtccgccgccatcaaagacagcaaggccgtgcacgccgatatgggctactggatcgagtccgagaagaacgaaacctggaagctggcgcgagcctccttcattgaggtgaagacctgcatctggcccaagagtcacaccctgtggagcaacggcgtcctcgagtccgaaatgatcatccccaagatatacgggggaccaatctcccagcataactaccggcccggctacttcactcagaccgccggcccctggcacctagggaagctcgaactcgatttcgacctatgtgagggcaccacggtggtggttgacgaacactgcggcaaccgtggcccgtccttacggacgaccaccgtgacgggcaagaccatacacgagtggtgctgtcgcagctgcaccctgccgcccctccggttccgcggggaggacggctgctggtacgggatggagatcagacccgtgaaggagaaggaggagaacctggtcaaatccatggtaagcgccggcagcggcgaggtggactccttcagcctcggtcttctttgcatcagcattatgatcgaggaagtcatgcgcagccggtggtcccgcaagatgctcatgaccggcacgctggccgtgttctttttactgattatcggccagctgacctggaacgacctgatccgcctcagcatcatggtgggggcgaacgcctccgacaagatggggatgggaacgacatacttagccctgatggccaccttcaagatgcggccgatgtttgccgtcggcctcctgttccgccggctgacctctcgtgaggttctcctgctgaccatagggctctcactggtcgcgagcgtggagctgcccaactccctcgaagaactcggcgacgggctggccatgggcatcatgatcctaaagctgctgaccgatttccaaccgcaccagctgtgggccacgctgctgagcctcacatttatcaagaccaccttttctctgcactacgcctggaaaacgatggcaatggtgctgagcatcgtctcactcttccccctgtgcctgtcaacaacttcccagaagaccacgtggctcccagtgctcctgggtagcttagggtgcaagccattaacgatgttcctgatcaccgagaacaaaatatggggccgcaagagctggcccctcaacgagggaatcatggcagtgggcatagttagcatcctgctgagttccctcttgaagaacgacgtgcccctggcggggccgctcatcgccggcggcatgctgatcgcctgctacgtgatcagcgggtcctccgcggacctgtcgctcgagaaggccgccgaggtaagctgggaggaggaggccgagcactccggcgctagccacaacatcctcgtggaggttcaggatgacggcaccatgaagatcaaggacgaggaacgggacgacaccctgacgatccttctgaaggcgaccctgctcgccgtctccggcgtttatcccctgagcatcccagccaccctgttcgtgtggtacttttggcagaagaagaagcagcgtagtggggtactctgggacacacccagccctccggaggtggagcgtgctgccctggatgacggcatctaccggatcatgcagcgcggcctattgggccggtcccaagtgggggtcggcgtgttccaggaaaacgtgttccacacgatgtggcacgtcactcgcggcgccgtgctgatgtaccaagggaagagactggagcccagctgggcctccgtgaagaaggacctgatctcatacggcggcggctggcgtctccagggatcctggaacaccggggaggaggtccaggtgatcgcagtggagcccggcaagaacccgaagaacgtccagaccgcccctgggacgtttaaaaccccggagggggaagtcggtgcaatcgcactggacttcaaacccgggacctctgggtcccctatcgtcaacagagaggggaaaatcgttggcctgtacggcaacggcgtcgtgacaacgagcggcacctacgtcagtgccatcgcccaggccaaagcctcccaggagggccccctccccgaaatcgaggacgaggtgttccgaaagcggaacctgactatcatggatctacaccccggcagcggtaagacccgccggtatttaccagccatcgtgcgcgaggccatcaagcggaagctgcggacgcttatcctcgctcccacccgcgtcgtggcctctgagatggccgaggccctgaagggtatgccgataagataccagaccaccgccgttaagtcagagcacacgggcaaagagatcgtcgacctgatgtgccacgcgacctttaccatgcgactcctatccccggtgcgggtgcccaactacaacatgatcataatggacgaagcacactttaccgaccccagctcgatcgcagcgcgagggtacatcagcacgcgggtaggcatgggcgaggccgcggcaatctttatgaccgccactccgcccggctccgtggaggccttcccccagagcaacgcagtgatccaggacgaggaacgcgacatccccgaacggagctggaactcgggctacgagtggataaccgacttccccggcaagacggtctggttcgtgccctccatcaagagcggcaacgacatcgccaactgtctgcgtaagaacggcaagagagtaattcagctctcccgcaaaaccttcgacaccgagtaccagaagaccaagaacaacgactgggactatgtcgtgacgaccgatatctcggagatgggagcgaacttccgggccgaccgtgtgatcgaccccagacgctgcctgaagcccgtaatcctcaaggacggtcccgagagagtgatcttggccggcccaatgccagtcaccgttgcctccgccgcgcagcgccgggggcgcatcggccgaaatcacaacaaggaaggcgaccagtacatctacatggggcaacccctgaacaacgacgaggaccacgcgcactggaccgaggcgaagatgcttctcgacaatatcaacacccccgaaggcatcatccccgccctgttcgagcccgagcgggagaagtcggccgcgatcgacggggagtaccgccttcggggcgaggcccgcaaaaccttcgtcgagctcatgcggcgcggtgaccttcccgtctggctgagttacaaagttgcatccgagggcttccagtacagcgacagacgctggtgcttcgacggcgaacggaacaaccaagtgctcgaggagaacatggacgtcgagatctggaccaaagagggggagcgcaagaaactgcggccacgctggctggacgcccggacctactcggacccgctcgccttgcgcgagttcaaggagttcgccgccggccggcgcagtgtgtccggggacctgatcttagagatcggcaagttgccccagcaccttacgcagagggcccagaacgccctcgacaacctagtcatgctgcacaacagtgagcagggtgggcgcgcctaccggcacgcgatggaggagttgccggacaccatagagacactgatgctgctggccttgatcgccgtcctgaccggcggggtgacactgttcttcctgtccggccgcggcctgggcaaaacaagcataggtctcctgtgtgtaatggcctccagcgtcctgttatggatggcgtccgtggagcctcactggattgcagccagcatcatcctggagttcttcctgatggtgttgctcattcctgagcccgaccgtcaacggacgccccaagataaccagctggcctatgtcgtgatcgggctcctgtttatgatcctaaccgtggccgccaatgagatgggattacttgagacaacgaagaaagacctcggcatcggccacgtcgccgacgagaaccaccaccatgccgccatgctcgacgtggacctgcacccggcctccgcgtggaccctgtacgccgtggcgaccacgatcattacgcccatgatgcggcacaccatcgagaacaccaccgccaacatcagcctcacggccatagcgaaccaagctgccattctgatggggctggacaaaggctggcccatctccaagatggatatcggcgtccccctactggcccttggttgctacagccaggtgaatcctctcaccttaaccgcggccgtactgatgctggtggcccattacgccattatcggtcccgggctgcaggccaaggcaacccgcgaggcccaaaagcgcacggcagccgggatcatgaagaaccctaccgtggacgggatcgtggccatagacttagacccagtcgtgtacgacgcgaaattcgagaagcagctcggccagatcatgctgctgatcctctgcacttcacaaatcctgctgatgcggaccacgtgggccctttgtgagagtattaccctggctaccggcccgctgaccacgctctgggaggggtcccccggcaaattctggaacactacaatagccgtatcaatggccaacatcttccgcgggagttacctggcgggtgctggcctggccttcagcctcatgaagtcactcgggggcgggcgacgcgggaccggggcgcagggcgagacgctcggcgagaagtggaagcggcagctcaaccagttgtccaagagcgagttcaacacctacaagcgctccgggatcatggaagtcgaccgcagcgaggcgaaggagggtctgaagcgcggggaaaccacgaagcacgccgtgagccggggaacggccaaactccggtggttcgtggagaggaacctggtcaagccagaggggaaggtgatagacctgggatgtggccgcgggggctggtcctattactgcgccggtctgaagaaagtgaccgaagtaaagggctacaccaaaggagggcccggccacgaggaaccgattcccatggctacctatggttggaatctcgttaagctgcattccggcaaggacgtgttctttataccgccggaaaagtgcgacactcttctttgcgacatcggcgagtcttccccgaaccctaccatcgaggagggccgtaccctgcgcgtgctgaagatggtagagccctggcttcggggtaaccagttctgcatcaagatcctgaacccctatatgccgagcgtggttgagacactggagcaaatgcagcggaagcacggaggcatgctcgtgcggaaccccctgtcccgcaactcgacccacgagatgtactgggtatcctgcgggacgggcaacatcgtgagcgcggtaaacatgacgtcccggatgctgctcaaccgctttaccatggtgcaccgtaagccaacttacgagcgggacgtcgacctgggggcaggcacgcgccacgtggccgttgagcccgaggtcgccaatctggacatcataggccagcggatcgagaacataaaacacgagcacaagagcacctggcactacgacgaagataatccctacaagacctgggcctaccatgggtcgtacgaggtgaagccaagcggctccgcgagcagcatggtcaacggagtagtgaaactcctgacgaagccctgggatgtcatcccgatggtgacgcagatcgccatgacagacactacgccgttcggccagcagcgggtatttaaggagaaagttgacactagaacccccaaggccaagcgcgggaccgcccagatcatggaggtcaccgcacggtggctgtggggcttcctcagtcgcaacaagaagccccggatctgcacgagggaggagttcacccggaaagtgcgctcaaatgcggccatcggcgccgtcttcatcgacgagaatcagtggaactccgccaaggaggcggtggaggacgagaggttctgggaccttgtgcaccgcgaacgagaactacacaagcagggtaaatgcgcaacctgcgtatacaacatgatgggcaagcgcgagaagaagctcggggagttcggcaaggccaaagggagccgggcaatctggtacatgtggctgggcgcgcgcttcctggagttcgaggcgctcgggttcatgaatgaggatcactggttcagccgggaaaatagcctaagcggggtggagggagaggggctgcataagctcggctatatcctcagggacatttcaaagatccccggcgggaacatgtatgcggacgacacagccgggtgggacacgcggatcaccgaggatgacctgcagaacgaggccaaaatcaccgacatcatggagtccgagcacgccctcctggcgaagtctatctttaaactgacttaccagaataaagttgtgcgcgtgcaacgcccagcgaagaacggcacagttatggacgtcatctctcggcgtgatcagcggggttctggccaggtgggcacctacggcctcaacaccttcacgaatatggaagcccaactgatccgccagatggagtctgaggggattttcagcccctccgaactggagacgcccaacctggctgaacgggccctagattggctggagaagcacggcgtggagaggttaaagcggatggcgatcagcggggacgactgcgtcgtaaagccgatagacgaccgctttgcgaccgccctgaccgccctgaacgacatgggcaaggttaggaaggacatcccccagtgggaaccgtcaaagggttggaacgactggcagcaggtccccttttgttcgcaccattttcaccaactaattatgaaggacggacgcgagatcgtggttccgtgccggaaccaggatgagctggttgggagggcccgcgtgagccagggggcggggtggagtcttcgcgagaccgcttgcctcggcaagagctacgcccagatgtggcagctgatgtacttccaccggagggacctgaggctcgccgccaacgctatatgctcagcggtaccagtcgattgggtcccgacgagtcgcacaacctggtccattcatgcgcatcaccagtggatgaccacggaggatatgctgagtgtctggaacagagtctggatcgaggagaacccctggatggaggataaaacccacatttccagttgggaggatgtcccatatctgggcaagagggaggaccagtggtgcggatccctgatcggcctgacggcgcgtgccacctgggctaccaacattcaggtggctatcagccaggtccggcgcctcatcggcaacgagaactacctcgactacatgacatctatgaagcggttcaagaacgagagcgaccccgagggggccctatggtga

SEQ ID NO: 24763 - RNA, 9879 nt, synthetic construct
  misc_feature 1..9879: note = derived and/or modified CDS sequence (opt11) from DENV-1__EU848545__SS-prME
  source 1..9879: mol_type = other RNA
agcgtgacgatgctcctgatgctgttacccacagccctagcctttcacttgacaacaagaggaggggagccacacatgatcgtgagcaagcaggagaggggcaagagcctgctcttcaaaaccagcgccggggtaaatatgtgcacgataatcgcaatggacttgggcgagttgtgcgaggacacgatgacctacaagtgcccaaggataacgaaagcagagcccgacgacgtggactgctggtgtaatgccaccgatacgtgggtgacctacggaacctgcagccggaccggcgagcaccgccgggataagcgaagtgttgccctagcgccccatgtgggactggggctggagacccgtgcagagacatggatgagctccgagggcgcatggaagcagatccagaaggtcgaaacctgggccctacgccacccggggttcaccgtaatcgcgctgtttcttgcccatgcgatcggaactagcatcacccaaaagggtatcatcttcatcctcctgatgctggttaccccctccatggccatgcgctgcgtgggcatcggaaaccgagacttcgttgagggtctaagtggcgcgacgtgggtggatgtagtgctcgagcacgggtcctgtgtgacgaccatggcgaaggacaaacccaccctagacattgagctcctgaagaccgaggtcacgaaacccgcggtactgaggaagttgtgtatagaggccaagataagcaacacaaccaccgactctcgctgcccgacgcagggcgaggccacactggtggaagagcaggacgccaatttcgtctgccggcgcaccttcgtggaccggggctggggaaacggctgcggcctattcggaaagggatccctcattacttgcgcgaagttcaagtgcgttacaaaacttgaggggaagatcgtccagtacgagaatctgaagtattccgtcatcgtgaccgtccacaccggcgaccaacaccaggtcgggaacgagactactgagcacggcaccatagctaccatcaccccacaggcacccacaagcgaaatacagttgaccgactacggggcactgaccctggactgctctccccgcaccggcctcgacttcaatgagatggtcttactgaccatgaaggaaaagtcctggctcgtgcacaagcagtggttcctggacctgccgctcccctggacctccggggcctcgaccccgcaggagacctggaaccgagaagacttattggtgacatttaagactgcgcacgccaagaagcaagaagtggtcgtgctcggaagccaggagggcgccatgcataccgccctgacaggagccaccgagattcagacgtccggcaccacgaaaatcttcgccgggcatctgaagtgtagactcaagatgaataagctgactttgaaaggcatgtcttacgttatgtgtacggggtccttcaagctcgaaaaggaggtggccgagacccagcacggcaccgtgctggtccaagtgaagtatgagggcaccgacgcaccctgcaagatcccatttagcacgcaggacgagaaaggagtgactcagaatggccggctgataaccgccaacccaatcgtcaccgacaaggagaaaccggttaatattgaggcggagcccccattcggggagagctacatcgtggtcggcgccggggagaaggccctgaagctcagctggtttaagaagggcagtagcatcggcaagatgctggaagccacggcgcgcggtgcacggcgcatggccatcctgggcgataccgcctgggactttggctccataggcggagtattcacctcggtggggaaactcgtacaccagatatttggcacggcctacggggtgctgttctcgggcgtgagctggacgatgaaaatcgggatagggatcctgcttacttggttgggcctaaattcaagaagcgcctccctcagcatgacctgcatcgcggtcgggatggtgaccctgtacctaggcgtcatggtgcaggccgactccgggtgcgttatcaactggaagggccgagaactcaagtgtgggagcggcatctttgtgacgaacgaagttcacacctggaccgagcagtataaattccaggccgattcccccaaaagattaagcgcagccattggaaaggcgtgggaggagggggtttgtggcatccggagcgccaccaggctggagaatatcatgtggaaacaaatctcgaacgagttaaaccacatcttacttgagaacgacatgaagttcacggttgttgtgggggatgtgtcaggaattcttacccagggacgtaagatgatcggcccccaacccatggaacacaagtactcttggaagtcctggggtaaggccaagatcatcggggccgacgttcagaacaccaccttcatcatagacggccctaacacccccgaatgcccagacgaccagcgggcgtggaacatttgggaagtggaagactatgggttcggcatctttacaaccaacatttggctcaagctgagagactcctacacccaggtgtgtgacccccgcttgatgagcgctgccatcaaggacagtaaagcggtccacgccgacatgggttactggatagaatctgagaaaaacgagacctggaagctggcgcgggcatccttcatcgaggtgaaaacgtgcgtgtggcctaagtcgcacacgctgtggtccaacggggtgctcgagagcgagatgatcatccctaagatctacggcgggccgatctcccagcataactaccggccggggtacagcacccagaccgccggtccctggcatctcggcaagcttgagcttgacttcgatctgtgcgagggcacgaccgttgtggtcgacgagcactgcgggaatcgggggccgagcttgcgtacaaccactgtgaccgggaagatcatacatgagtggtgctgcaggagttgcactctgccccctctccgcttcaagggcgaagatgggtgctggtacggcatggagatccggcccgtgaaagacaaggaggaaaacttggttaaatccttggtgagcgccgggtctggtgaggtggactcattctcactggggcttctatgcatttcgatcatgatcgaggaggtaatgcgctcgcgatggtcgcgtaagatgctgatgaccgggacactagccgtgttcctccttttgatcatggggcagctgacgtggaacgatttaattcggctttgtatcatggtgggggcgaacgccagcgatcgcatggggatgggaaccacataccttgcccttatggccacattcaagatgcgccctatgttcgcagtcggcctcctgttccggcgcctaacctcccgggaggtactgctcttgactattgggctgagcctcgttgcgagtgtggaactgccaaattccttagaggaactcggcgacgggcttgccatgggcatcatgattctgaagctcctgaccgacttccagtcacaccagctgtgggcagccctgctcagcctgacgttcattaaaactacgttctcgctgcactacgcgtggaaaaccgtagctatggtcctgagcatcgtgtccctattcccgctttgcctgagcacaacttcccaaaaaacgacctggttaccggtgctattaggcagccttggatgcaagccgctcactatgtttctaatcgccgagaataagatttggggacgcaaatcctggcccctgaacgagggcatcatggccgtcgggatcgtcagcatcctcctgagtagcttactcaaaaacgacgtcccgttagcgggtcccctcatcgcggggggaatgctaattgcttgctacgtgatcagcgggtcgtcggccgacctgtcactagagaaagccgccgaaatcagttgggaggaggaggcagagcactccggagcctcacataacatcctcgtggaggtgcaggacgacggtaccatgaagatcaaggacgaggagcgcgacgacaccctgacgatactgctcaaggccacgctgctggccgtttccggggtttaccccatcagcatcccggccaccctcttcgtgtggtacttttggcaaaaaaaaaagcagcgctccggcgtcctgtgggatactccgagcccgcccgaggtggaacgggcggtcctggacgacggcatctaccgcatcttgcagcgggggctcctgggcaggtcccaggtcggcgtgggcgtgttccaggagggggtctttcacaccatgtggcacgttaccaggggcgccgttctcatgtatcaaggcaagcgccttgagccttcatgggcctctgtcaaaaaggatctgatctcctacggcggcgggtggcggttccaaggctcctggaacacgggggaagaggtccaggtgatcgctgtcgagccgggcaagaatcccaaaaacgtgcagaccgcgcccggcaccttcaaaacccccgagggggaggtgggcgcgatcgccttggactttaagcccggaacttcgggctcccccatcgtgaaccgcgaggggaagatcgtcggcctctacggcaacggggtggtcaccacttcggggacctacgtgagcgccattgctcaggctaaggccagtcaggaggggcccctaccagagatcgaagacgaagtgtttcggaagcggaacttaacgatcatggacctccaccctggcagcggcaagacccggcgctacctacccgcaatcgtccgggaagccattaagcgtaagctccggacgttgatactggcccctaccagagtggtggcatccgaaatggccgaggccctgaaggggatgccgatccgctatcagacgaccgccgtaaagtcagagcacacaggcagagagattgtggatctcatgtgtcacgcgacgttcacgatgcgcctgctgtccccggtgagagtacccaactacaacatgatcatcatggacgaggctcattttacggaccccgccagcatcgccgcccgcgggtacatctccacccgggtgggcatgggtgaggccgcggcgatcttcatgaccgcgacaccgcccggtagcgtggaggccttcccccagtccaatgcggtcatccaagatgaggagcgcgacattcccgaacggagctggaactccggttatgactggatcaccgacttcccgggcaagacggtgtggttcgtcccgagcatcaagtcgggtaatgacattgccaactgcctgcgcaagaacgggaagcgggtcattcagctgagccgcaaaacgttcgacaccgagtatcagaaaaccaagaacaacgactgggactacgtggttaccacagacatttccgagatgggagctaacttccgggcagaccgcgtgatagacccccgtcggtgcctgaagcctgtgatcctgaaggacggaccggagcgagtgattctggcaggcccgatgcccgttactgtggctagcgcggctcagcgccgtggccgcatcgggaggaaccagaacaaggagggcgaccagtatatctacatggggcagccccttaacaatgacgaggaccacgcccactggacagaagccaagatgttactggacaacatcaacacccctgagggaataatacccgctctattcgagcccgagcgtgggaagtcggcagcaattgacggcgagtaccgcctccgaggcgaagcccgcaagaccttcgttgaactgatgcggcgcggggacctccctgtttggctatcctacaaagtggcttccgagggcttccagtacagcgaccgcaagtggtgctttgacggggagcgcaacaaccaagtcttggaggagaacatggacgtagaaatctggacgaaagagggcgagaggaagaaacttaggccgcggtggctcgacgcgcgcacctatagcgacccgcaggctctgcgtgagttcaaggaattcgccgccggccgacggtcggtgtcgggggatctgatcctcgaaatcggcaagctaccacagcatctgacccagcgggcacagaatgccttggacaatctggtcatgctgcacaacagtgagcagggaggaaaagcgtaccggcatgccatggaggaattacctgatacaatcgagacgttaatgctattggcactgatcgctgttttgaccgggggcgtgacgttgttctttctaagcggcagggggcttgggaaaaccagtatcgggctcttgtgtgttatggccagttccgtgctgctctgggtggcttctgtcgagccacattggatagcagccagcattatcctagagttcttcctgatggtgctcctaatacccgaacccgatcggcagcgtacaccgcaggataaccagttagcgtacgtagtcatcggactcctctttatgatcttgacggttgccgccaacgagatggggctcctggagaccaccaaaaaggacctgggtataggtcacgttgccgttgaaaatcaccaccacgccaccatgttagatgtggacttgcggcccgcgagtgcctggacactgtacgccgttgccaccacgatcataactcctatgatgcgccacacgatcgagaacaccaccgcgaacatctccttgactgcgatcgcaaaccaggccgccattctgatgggcctggacaagggctggccgatctcgaaaatggacatcggcgtccccctcctggcgctgggttgctactcccaggtgaacccactgacgctgatcgcggccgtgctgatgctcgttgcccattacgcaatcattgggcccggattacaggcgaaggccacccgcgaggcccagaagcgcaccgcagcagggatcatgaagaaccccacggttgacgggattgtcgcgatcgacctggacccggtcgtgtacgacgccaagttcgagaagcagctcggccagatcatgctactgatcctctgcacgagccaaatcctgctaatgcgcaccacctgggccctctgcgagagtattaccctggccacggggccgctgaccactctttgggagggcagccccgggaagttttggaacaccactattgcagtgtccatggcgaatatctttcgggggagctatctggccggcgcggggctggccttctccttgatgaaatccctgggcggaggacgccgaggtactggggcgcagggcgagaccctgggggagaagtggaagcgccaattgaaccagttatctaaatccgaattcaacacctataagcgtagcggcataatggaggtcgaccgctccgaggctaaagaggggctgaagcgcggtgagacgaccaagcacgccgtcagccgcggcacggctaagctcagatggttcgtagagcgcaatctggtgaaacccgaaggcaaggtgattgacctgggctgcggtaggggtggatggtcatactactgcgcgggactaaagaaagtgaccgaggtaaaggggtatacgaagggcggcccgggccacgaagagcccatcccaatggccacctacggctggaacttggtgaagctccacagcgggaaggacgtgtttttcacacccccagagaaatgcgacaccctcctctgcgacatcggggaatctagccccaaccctacgatcgaggaaggcagaaccctgagagttctgaagatggtagagccttggctcagaggaaatcagttctgcatcaagatcctgaacccatacatgccatccgtggtggagaccctggagcagatgcagaggaagcatggcgggatgctcgttcgcaacccgctgtcgcggaacagtacccacgagatgtactgggtcagctgcggaacaggcaacatcgtatccgccgtgaacatgacctcgcgcatgctgctcaaccgattcaccatggcccaccgcaagcccacgtacgagagagacgtagacctgggggccggtaccaggcatgtcgccgtggagcccgaggtcgcgaacctggacataatcggtcaacgtatcgagaacatcaaaaacgagcataagtccacttggcactacgacgaggacaacccctacaagacgtgggcatatcatggcagctacgaggtgaagccctccgggtctgcctccagcatggtgaacggcgtcgttcgcctcctgacaaagccctgggatgtgattccgatggtcacccagatcgccatgacggacaccactcccttcggccagcaaagggtgttcaaggagaaggtggacacccggacgccgaaggcaaagcgcggcactgctcaaatcatggaggtcaccgccagatggctttggggcttcctcagccgcaacaagaagccccggatttgtactcgggaagagttcacgcggaaggtgagatccaacgcggcaatcggggcggtgttcgtggacgagaaccaatggaacagcgccaaggaggcggtcgaggacgagcgcttctgggatctggtccatcgggagcgggagctgcacaagcagggaaagtgcgcgacgtgcgtctacaacatgatgggaaagcgtgagaaaaagctcggcgagttcggaaaagctaaagggagtcgggcgatatggtatatgtggctgggcgcacgcttcctggagttcgaggccctcgggtttatgaatgaagaccactggttctcacgggagaactccctatccggcgttgagggggagggcctgcacaagctggggtacatcctgcgcgacatctcgaagatccccgggggaaacatgtacgctgatgacactgccgggtgggacacccggatcacggaggatgaccttcagaacgaggcaaagatcaccgacatcatggaaccggaacacgcacttcttgcaactagcatcttcaagctaacatatcagaacaaagtggtccgcgtgcaacgccctgccaaaaacggcacggtcatggacgtaatctcccggagggaccagcggggatcgggacaggtgggtacctatgggctcaacacatttaccaacatggaggttcagctgatccggcagatggaatccgagggcatcttctcaccgtctgagctagagacgcccaacctagccgagagggttctggactggctggagaagcacggcgtggagcgcctgaagcggatggccatatcgggcgacgactgcgtggtaaagccaaccgacgaccgattcgctaccgccctgactgccctcaatgacatgggcaaggtgcggaaggacatcccccaatgggagccgtccaaggggtggaacgactggcagcaagtccccttttgcagccaccattttcatcagctcataatgaaggacggccgtgagatcgtggtaccctgccggaaccaggacgagcttgtggggcgagcccgggtctctcaaggcgcagggtggtccctgcgcgagacggcctgtctgggcaagagctatgcccaaatgtggcagcttatgtatttccaccggcgcgacttacgtctcgccgcgaacgccatctgttctgctgttccgatcgactgggtcccgaccagccgcaccacctggagtatacacgcccaccatcagtggatgacgaccgaggacatgctgtcagtgtggaaccgggtgtggatcgaggaaaatccctggatggaggataaaacccacgtgtcctcctgggaggacgtcccctaccttggcaagcgggaagatcagtggtgcgggagcttgattggcctgaccgcccgcgcgacgtgggcgactaacatccaggtagcgatcaatcaggtgcggcgcttaattgggaacgagaactacctggactacatgacctccatgaaaagattcaaaaacgagtccgacctggaaggcgccctctggtga

SEQ ID NO: 24764 - RNA, 9879 nt, synthetic construct
  misc_feature 1..9879: note = derived and/or modified CDS sequence (opt11) from DENV-1__KR024708__SS-prME
  source 1..9879: mol_type = other RNA
tcggtgaccatgctgctcatgctattacccacggccctcgctttccatttgacgacccgaggcggggaaccgcacatgatcgttagcaagcaagagcgtggcaagtcgttactgtttaagaccagtgccggtgtgaacatgtgcacactaatcgcaatggatttgggcgagctctgcgaggatacgatgacctacaagtgcccccgcattaccgaggccgaaccagacgacgtcgactgttggtgcaacgccaccgacacctgggtcacctacggtacgtgttcccagacaggcgagcaccggcgcgacaaacgctccgtggctctggcgccacacgtgggactggggctcgagacccgcaccgaaacgtggatgagctccgagggcgcctggaaacagatccagaaggtggagacatgggcactgcggcaccccgggttcacggtaatcgctcttttcctcgcgcacgccatcggcacctcgattacacaaaagggcatcattttcattctgctgatgttggtgaccccctccatggccatgcgctgcgtcggcatcggcaaccgcgacttcgttgagggcctgagcggcgcgacgtgggttgatgtcgtgctggagcatggttcctgcgtaaccaccatggcgaagaacaagcccacactagacatcgagctgttgaagacggaggtaacgaatccagcggttctgcgcaagctttgcatcgaggccaagatatcaaacaccactactgactcccggtgtccaacgcaaggcgaagccaccctggtggaggaacaggatgctaacttcgtgtgccgacggacctttgtcgaccgcggctgggggaacgggtgtggtctcttcggcaagggaagcctgctgacgtgcgccaaattcaagtgcgtaacgaaactggagggcaagatcgtccagtacgaaaatttgaagtacagtgtcattgtgaccgtgcacaccggggatcagcaccaggtgggcaatgagacgacagagcacggcacgatagcgaccatcaccccccaggcacccacctcggagatccagcttacagactacggggccctcacgctggactgcagcccaagaaccgggctggacttcaatgagatggtgttgctgaccatgaaagagaagtcctggctggtacacaagcagtggttcctcgacctgccgctgccctggacttctggggcgagcactagccaggagacttggaaccgccaggacctcttagtgacgtttaagaccgcccatgcgaagaagcaggaggtggtggtactgggctcccaagaaggcgcgatgcacaccgctctcaccggagccacggagatacagacctcgggcaccaccacgatcttcgctgggcatctcaaatgccgcctcaagatggacaagctcacgctgaagggcgtgagctacgttatgtgcaccggtagcttcaagctagaaaaggaagtcgctgagacccagcatgggaccgtcctggtccaggtgaagtatgagggcaccgacgccccttgcaagatcccgatatcgactcaggacgagaagggggtcacccagaatggtcgcttaatcaccgccaaccccatcgtgaccgacaaggaaaaaccagtaaatatcgagactgagccgccctttggggaaagctacatcgtcattggcgccggtgaaaaggctctgaaactgagttggttcaagaaggggagcagcatcggtaaaatgttcgaggccaccgcgcgcggcgcccgccgcatggccatcctcggcgacactgcctgggactttggaagcataggaggcgtgttcacctccgtgggtaagttagtccaccaggtgttcggtaccgcctatggggtgctatttagcggcgtctcctggaccatgaaaatagggatcggcatcttgcttacgtggctcggactcaatagcagatccacatcgctgtctatgacctgcatcgcggtgggcatggtgaccctgtacttaggcgtcatggtgcaggctgacagcgggtgcgtgatcaactggaaaggccgcgagcttaagtgcgggtccggcatctttgtcacaaacgaggtgcatacctggaccgaacagtacaaattccaggccgacagcccgaagcggctgtcggcggcaattggcaaggcatgggaggagggggtgtgcggaatccgctccgctacgcggctcgagaacatcatgtggaagcaaataagcaacgagctgaaccacatcctgcttgagaacgacatgaagttcaccgtcgtggtgggggatgccaacggcatcctgacgcagggcaaaaagatgatccgacctcagcccatggagcataagtactcctggaaatcttggggtaaggccaaaatcatcggcgccgacacgcagaacaccaccttcatcatagatgggcccgacacgcccgagtgccccgacgaccagagggcctggaacatctgggaggtagaggactatgggttcggagtgttcaccactaatatctggctgaagcttcgcgactcttacacccagatgtgcgaccatcggctgatgagcgccgcgatcaaggactccaaggccgtccacgcggacatgggctactggatcgagagcgaaaagaacgagacctggaagctggcccgcgcgtccttcatcgaagtcaagacttgcatctggccacggtcccacaccctctggtccaatggcgtactggagtccgagatgatcatccccaagatatacggcgggccgatctcccagcataactatcgcccgggatacttcacgcagacggccgggccctggcacctggggaagctcgagctggactttaacctctgcgagggcactaccgtagttgtggatgagcattgtggtaaccgtgggcccagcctccgcaccacgacggtaactgggaaaatcatccatgagtggtgttgtcggtcatgtacccttccccccttgcgcttcaggggggaagacggctgctggtacgggatggagattcgccccgtcaaggagaaggaggagaacctcgtgaggagcatggtatccgccggctcaggcgaggtcgacagcttttcccttggcctgctctgtgtgagcattatgatcgaggaagtgatgcgttcccgatggagtcgcaaaatgctgatgacgggcaccctggctgtgttcttccttttaatcatggggcaattgacatggaacgacctgatccggctgtgtatcatggtgggcgccaatgtgtccgaccggatgggtatgggtaccacttatctggccctgatggcgaccttcaagatgcgcccgatgttcgctgttgggctactgttccggcgcttgacaagtagagaagtgctgctgctcaccattgggctgtccttagttgcctcagtggagctccccaactcgctggaggaactgggtgacggacttgccatgggcattatgatgctgaaattactcacggatttccagagccaccagttatggacgacgctgctttccttgaccttcatcaagacgaccctgagccttgattacgcttggaagacaatggcgatggtgctgtccatagtcagcctattccccttatgcctgtccaccacgagccaaaagactacctggctgcccgtcctactgggctctttcggctgcaagccactgaccatgtttctgatcacagaaaacaaaatatggggtcgcaagagctggcccctgaacgaggggatcatggcggtgggcatcgtctccattctgctttcctcactgctaaagaatgacgtgcccttagctggccccctgatcgctggcggaatgctgatcgcatgctatgtcatatccgggagctcagccgacctcagtctggaaagagccgcggaggtatcctgggaagaagaggccgaacacagcggcgcatcgcataacatactggtggaagtgcaggacgacggtacgatgaaaattaaggacgaggagcgtgatgacaccctcaccattctgctgaaggccacacttctggcagtcagcggcgtttaccctatgtccatccctgccacgctgttcgtttggtacttctggcagaagaaaaaacagcgttcgggagtgctctgggacactcccagcccacccgaggttgagcgcgcggtgttagacgatggaatctaccggatactgcagcgcggcttactcgggcggagccaggtcggcgtgggagtgtttcaggacggagtctttcacactatgtggcacgtgacacgcggggcagtgctgatgtaccagggcaagcggctggagccctcatgggcgagcgtgaagaaggaccttatctcctacggcggaggctggcgattccaagggagctggaacacaggtgaggaggtccaagttatcgccgttgagcccggtaaaaaccccaagaatgtgcaaaccacccccgggacatttaaaacccccgagggagaagtgggcgccatcgccctagacttcaagcccggcacctcagggagtcccatcgtcaaccgcgagggaaagatagttggtctgtacggaaacggcgtagtaactacgtccggaacgtacgtgagcgcgatcgctcaggccaaggccagccaggaaggtcctctccccgagatcgaggacgaggttttcaagaagagaaacctaaccatcatggatttgcaccctggatctggcaagacccgtcgctacctcccagcgatcgtcagagaggcgataaagcgcaagctccgcaccctgatcctcgctcccacgcgggtagtggctagcgagatggccgaggcgctgaagggcatgcccatccgctaccagaccaccgccgtaaagtccgagcacaccggcaaggagatcgtcgatctgatgtgccacgcgacattcaccatgcggttgctgagccccgtaagagtcccgaactacaacatgatcatcatggacgaggcccatttcacggaccccgcctccatcgctgcacggggctacatcagcacgcgcgtgggaatgggcgaagcggcagccatctttatgacggcgacaccgcccggatccgtcgagagcttcccgcagtccaatgctgtcattcaggacgaggagcgggacataccggagcgctcatggaactccggctatgactggatcaccgacttcccgggcaagacggtttggttcgtgcccagtatcaagtccgggaacgacatcgccaattgcttacggaagaatggcaagcgggtcatccaactctcacggaagacattcgataccgagtaccaaaagaccaagaacaatgactgggactatgtcgttaccacggacatatccgagatgggggcgaacttccgcgcggaccgggtgatcgacccacgccggtgcctcaaacccgtgatactgaaggacggccccgagagggttatacttgcgggtccgatgccagtgaccgccgctagcgctgcacaacggagaggtaggatagggcgcaaccagaataaggagggtgaccagtacatctacatgggccaacctttaaacaacgacgaggaccacgcacactggacggaggccaaaatgctgctagataatatcaacacccccgaggggattatccccgctctgttcgagcccgagagagagaagtccgctgctatcgacggcgagtatcgcttgcgcggagaggctcggaaaacattcgtggagctgatgcggcgaggtgacctgcctgtatggttaagctacaaggtggctagcgagggttttcaatacagcgacagacggtggtgtttcgacggggagcgcaacaaccaggtattagaggagaacatggacgtcgaaatctggaccaaagagggcgaacgaaaaaagctgagaccccgctggctggacgcccgtacctacagcgaccccttagcactgcgggagttcaaagagtttgcagccgggcgccggtcagtaagcggcgacctgatcttggaaatcggaaagctaccgcagcacctgacactacgcgcccagaacgccctggataacttggtgatgctccacaacagtgagcagggcggtaaggcctacaggcacgcgatggaagaactgcccgacaccatcgaaacgcttatgctcttggcgctgatcgccgtgctaacagggggagtgaccctgttcttcctctccggaaaaggcttaggaaaaacctccatcgggctgctgtgcgtgatggccagctccgtcctcttatggatggctagcgtggagccccactggatcgccgccagtatcatcctggagtttttcctcatggtgctgctgatccccgaaccggaccgacagcggacgccccaggataaccagctcgcctacgtcgtgatcggattactgttcatgattttaaccgtggccgccaacgagatgggtctgttggagacgacgaaaaaggacttgggcattgggcacgtagtagccgaaaatcatcaccacgctaccatgctggatattgacttgcacccagctagcgcctggaccctctacgctgttgcaaccaccataataacaccaatgatgcgacacaccatcgagaataccactgccaacatatcactgactgctatagcaaaccaggcggccatacttatgggtctcgacaaagggtggcccattagtaagatggacatcggggtcccgctgctcgccctcgggtgctattcgcaggtgaaccccctcacccttaccgccgccgtgctcatgctggtcgctcactacgccatcattgggcctgggctacaggccaaggccacccgggaggcgcagaaacgcacggccgccgggatcatgaaaaaccccacagtggacgggatcgtggccatagatctcgaccccgtcgtgtacgacgccaagttcgagaagcagttgggccaaatcatgctcctcatattgtgcactagccagatattattgatgcgaaccacgtgggcgctgtgcgagagtataacactggcaacagggccactcaccacgctgtgggaaggatccccgggcaagttttggaatactaccatcgctgtatccatggccaatatcttccggggcagttacctggccggcgcagggttagcatttagcttgatgaagtccctaggtgggggacgccgcggtaccggcgcccaaggagagacgctcggcgagaagtggaagcgccagctgaaccagctgtcgaagtccgagtttaatacctacaagcgcagcggaatcatggaagttgacagatccgaggccaaagagggtctcaagcgaggtgaaaccacgaaacacgctgtgagcagagggacggcgaagcttcgctggttcgtcgagcgcaatttggtgaagcccgagggaaaggtgatcgaccttgggtgcggacggggggggtggtcctattactgcgcgggcctgaagaaagtgacagaagtcaaggggtacaccaagggtggccccgggcacgaggagccgatccctatggccacttacggctggaacatcgtgaagctgcactctgggcgcgacgtgtttttcacgccgcccgagaagtgcgacacgctgctgtgcgacattggggaatcaagtcccaacccaaccatcgaggagggccggacactacgcgtcctgaagatggtggagccctggctccgcggcaaccagttttgcataaagatcttgaacccgtacatgccctccgtggtcgagaccttggagcagatgcaaaggaagcatggcgggatgcttgtgcgtaacccactgtctcgcaactccacgcatgagatgtactgggttagctgtggcaccgggaatatcgtctccgccgtgaacatgaccagccgaatgttgctcaaccgcttcaccatggcgcaccgcaagcccacatacgagcgtgacgtcgacctgggcgcgggcacccgccacgttgcggtagagcccgaaatcgccaacctagacatcattgggcagcggatagagaacattaagaacgagcataagtccacctggcattacgacgaagacaatccctataaaacttgggcctaccacggctcgtacgaggtgaaaccgtctgggagcgcgtccagtatggtcaacggcgtggtccgtctcctgacgaagccctgggacgtgatcccaatggtgacccagatcgccatgaccgacacgacgcctttcgggcagcagcgggtcttcaaggaaaaggtcgacacccggactccgcggcctaaaaggggcaccgcgcagattatggaggtgactgcaaaatggctgtgggggttcctcagccgaaataagaaaccccgcatctgtactagggaggagttcacccgcaaggtccggtccaacgccgcgatcggtgccgtgttcgtggatgaaaaccagtggaacagcgctaaagaagcagtcgaggacgagcgcttctgggacctggtgcaccgggaacgcgaactgcacaagcaaggcaagtgcgcgacctgcgtttacaatatgatgggcaaaagggagaagaagctcggagaattcggtaaagcgaagggctcccgtgctatctggtatatgtggctgggtgcccggttcctggagttcgaggcgctcgggttcatgaatgaggatcactggttcagccgcgaaaacagtctgagcggtgtcgagggagaaggcctacacaagctcggatacattctgagagacatctccaagatcccgggcggtaatatgtacgcggacgacacggccgggtgggacacacgcatcaccgaggacgacctgcagaacgaagccaagataacggatattatggagcctgagcacgcactcctggccactagcattttcaaactgacctatcagaacaaggtggtacgcgtccagcgccccgcgaagtctggcactgtgatggacgtgatatctagacgggaccagcgcggtagtggccaggtcggaacctacggcctcaacacgttcactaacatggaggtgcagctaatccggcagatggagtcggaaggcattttcagcccaagcgagctggagaactccaacctagccgagcgcgtactggactggctggagaagcacggggtagaacgtctcaagcgtatggccatcagcggcgacgactgcgtggttaaacctacggatgatcgcttcgccacggccctgacggctctgaatgacatgggaaaggtaagaaaggacattccgcagtgggagccgtccaaggggtggaacgactggcagcaggtccccttctgcagccaccactttcatcagctcattatgaaggatggccgggagattgtggtcccttgccggaaccaggacgaactggtgggccgggcccgggtgtctcagggcgcgggttggagtctgagagagaccgcctgcttaggaaagtcttacgcccagatgtggcagctgatgtacttccaccgccgggacctgcgactggcggccaatgcgatctgttccgctgtcccggtcaactgggttcccaccagcagaaccacctggtccatccacgcccatcatcagtggatgacaaccgaggacatgttatcagtttggaaccgcgtgtggatcgaggagaacccctggatggaggacaagacgcacgtgtcctcttgggaggacgtcccgtacttagggaaacgcgaagaccaatggtgcggctctctcattggcctgaccgcgcgggccacgtgggccaccaacatacaggtggcaatcaatcaggtccgccggcttatcggaaacgaaaactatcttgactacatgacctcaatgaagcgcttcaagaacgagtccgaccccgagggcgcgctgtggtaa

SEQ ID NO: 24765 - RNA, 9879 nt, synthetic construct
  misc_feature 1..9879: note = derived and/or modified CDS sequence (opt11) from DENV-1__KR024705__SS-prME
  source 1..9879: mol_type = other RNA
tctgtcaccatgctgctcatgctgctgcccaccgccctcgcattccatctgacaacgcgggggggtgaaccccacatgattgtgagcaagcaggagcgtggcaagtcactcctgttcaagaccagcgcaggggtgaacatgtgcaccctgatcgccatggatcttggcgagctctgcgaggacacgatgacctacaagtgcccccgtatcaccgaggccgagcccgacgacgtggactgctggtgcaacgccaccgacacttgggtgacatatggtacatgcagccagaccggagagcaccggcgcgacaagcggtccgtggccctggccccccacgtggggctggggctagagacgcggaccgagacctggatgtcgtccgagggcgcctggaagcagatccagaaggtggagacatgggccctacgccaccccggattcacagtgatcgccctgttcttagctcacgccataggcaccagcataacccagaaggggatcatctttatcctgttgatgctcgtgaccccctccatggccatgcgctgcgtcggcattggcaaccgcgacttcgtggaagggctaagcggcgcgacgtgggtggatgtcgtgctggagcacggttcctgcgttacaactatggccaagaacaaaccaaccctcgacatcgagctgttgaagacggaggtcaccaaccccgcggtgctccgcaagctgtgtatcgaagcaaagatcagcaatgcaaccaccgactctcggtgccccacgcagggcgaggccaccctggtcgaggagcaggacgccaacttcgtctgccgccggaccttcgtcgaccgcggctgggggaatggctgcggcctcttcggcaaaggctctctgctaacgtgcgcgaagttcaaatgcgtgactaagctcgagggaaaaatcgtccagtacgagaatctgaagtactccgtgatcgttaccgtccacaccggtgaccagcaccaggtggggaatgagaccacggaacacggcaccatcgccaccataacgccccaggcccccaccagcgagatccagctgacggattacggggcccttaccctggactgcagcccccggaccggcctggactttaacgagatggtcctcttgaccatgaaggagaagtcctggctcgtgcacaaacagtggttcctcgacctgccgctaccctggacgtcaggagccagcaccagccaagagacctggaaccgccaggatctcctagtgaccttcaagacggcgcacgccaagaagcaagaggtcgtggtgctgggctctcaagagggcgccatgcacaccgccctcaccggggccacggagatccaaaccagcggcaccaccaccatcttcgcgggacacctgaaatgccggctgaagatggacaagctcacgctgaagggcgtctcctacgtgatgtgcaccgggagtttcaagctggagaaggaggtggctgagacccagcacggcaccgtcctggtccaggtgaagtatgagggtacggacgccccctgcaagatccctatttctactcaggacgaaaagggggtcacacagaacggccgactcatcaccgccaacccaatcgttacggacaaggagaagcccgtgaacatcgagaccgaaccgcctttcggagagagctacatcgtcatcggcgcgggcgagaaggccctgaagctatcctggttcaagaaagggagctccatcggcaaaatgttcgaggccactgcacgcggggccaggcggatggcgatcctcggggacaccgcctgggacttcgggagcatcggaggtgtgttcacgtcggtggggaagctggtccaccaggtattcggcaccgcctatggggtgctgttcagcggcgtctcctggaccatgaagattgggattggcatcctcctgacctggctgggcctcaacagccgctccacatcgctttccatgacctgcatcgccgtagggatggtaacactgtacctcggcgtcatggttcaggcagatagcgggtgcgtgatcaactggaagggccgcgagctgaagtgtgggagcggcatattcgtcaccaacgaggtgcacacgtggaccgagcagtacaagtttcaggcggactcgccgaagcggttaagcgctgccattggcaaggcctgggaggagggggtgtgcggcatccgctccgccacccggctcgagaacatcatgtggaagcagatctctaacgaacttaaccatatcctgctcgagaacgacatgaagttcactgtcgtggttggggacgcgaacggaatcctgacacagggaaagaagatgatccgcccccagcccatggagcacaagtactcttggaagtcctggggaaaggccaagatcatcggcgccgacacacaaaacaccacattcatcatcgatgggcccgacacccctgagtgcccagacgaccaacgggcctggaacatctgggaggtggaggactacggtttcggggtgttcactaccaacatctggctgaagctgcgcgactcctatacccaaatgtgcgaccatcggctgatgagcgcggcgattaaggactccaaggctgtgcacgccgacatgggctactggatcgagagcgagaagaacgagacgtggaaactggcccgcgcgtccttcatcgaggtaaagacgtgcatctggcccaggagccacacactctggagtaacggcgtgctggagagcgagatgatcatccccaagatctacgggggcccgattagtcagcacaattaccggcccgggtacttcacccagaccgccggcccatggcacctagggaagttagagctggacttcaacctgtgcgagggaacgacggtggtcgtggatgagcactgcggcaaccgtgggccgagtctccgtaccaccacggtgactgggaagatcatccacgagtggtgctgcagatcctgtacgctcccgcccctacgcttccgtggggaagacggctgctggtacgggatggagatacgccccgtaaaggagaaggaggagaacctcgtccggagcatggtgtccgccggcagcggcgaggtcgacagcttctccctggggctgctctgcgtatctatcatgatcgaggaggtaatgcgcagccggtggagcagaaagatgctgatgaccggcacgctggccgtcttcttcctcctgatcatgggtcagctgacctggaatgacctcatccgcctgtgcataatggtaggtgctaacgtgtccgaccgcatggggatggggaccacctatctggccctcatggccacgttcaagatgcgcccgatgttcgccgtcggtctgttgttccggcgcctcaccagccgggaggtgctgctgcttaccatcgggctgtccctggtcgccagcgtcgaactccccaattccctggaagagctgggcgacgggctcgcaatgggcatcatgatgctgaagctgctcacggacttccagagccatcaactgtggaccacccttctcagccttaccttcatcaagaccacgttgtccttggactatgcgtggaagaccatggccatggtgctatctatcgtcagcttgttccccctctgcctgtccacgacaagccagaagactacctggctgcccgtacttctagggagcttcgggtgcaagccgttaacgatgttcctcatcaccgaaaacaaaatctggggacgcaagagctggcccctgaacgaggggataatggccgtgggcatcgtcagtatccttctcagtagcctgctcaagaacgacgtgcccctcgccgggcccctgatcgcgggcggcatgctgatcgcatgttatgttatcagtggcagctctgctgacctcagcctcgaacgggcagcggaggtctcatgggaggaggaggcggagcacagcggcgcctcccacaacatcctggtggaagtgcaggacgatgggacaatgaaaatcaaggacgaggagcgcgacgacacgctcaccatcctgctgaaggctaccctgctggccgtcagcggcgtatacccgatgagcatccccgccacgctgttcgtgtggtacttctggcagaagaagaagcagcggagcggagtcctctgggatacgccctctcctcccgaggtggagcgcgcggtgctggacgacggcatctaccggatcttgcaacgcggcctgctcgggcggtcgcaggtcggcgtgggggtgttccaggacggcgtcttccacaccatgtggcacgtcacccgcggggccgtgcttatgtaccagggcaagcggctggagccttcctgggccagcgtcaagaaggacctgatctcctacggcgggggctggcgcttccagggtagctggaacactggcgaggaggtccaagtgatcgccgttgaacccgggaagaaccccaagaacgtgcagacgactcccggtaccttcaaaacccctgagggcgaggtgggcgccatcgcgctggattttaagccaggcacgtccgggagccccatcgtcaatcgggagggcaagatcgtaggcctgtacggcaacggcgtggttacaacctccgggacctacgtgagtgccatcgcccaggccaaggccagccaggagggcccgctccccgagatcgaggacgaggtgttcaagaaacgcaacctgacgatcatggacctccacccggggtccggcaaaactcgtagatacctcccggcgatcgtccgggaggccatcaagcgcaagctgcgcaccttaatcctggctcccacccgggtggtcgccagcgagatggcggaggccctgaagggaatgcccatccgctatcagacgaccgccgtaaagtcggagcacaccgggaaggagatcgtggacctgatgtgccacgcgaccttcacgatgcgtctcctgtcccccgtgcgcgtcccgaactacaacatgatcatcatggatgaggcccacttcaccgatccagcttccatcgccgcacgcggctatatctctacccgcgtggggatgggcgaagccgccgcgatatttatgaccgcgacgccgcccgggtccgtggaggcctttccgcagagcaacgcggtcatccaagacgaggaacgggacatccctgagcgctcctggaacagcggctatgactggattacggacttccccggtaagaccgtgtggttcgtgccctccatcaagagcgggaacgacattgccaactgcctgcgtaagaatggcaagcgcgtcatacaactctcccggaagaccttcgacacagagtaccagaagactaagaataacgactgggattacgtggtaaccaccgacatcagcgagatgggggcgaacttccgcgcggaccgggtcatagacccgcgccggtgcctgaagcctgtgatcctgaaggacggcccagagagagtgatcctcgcagggccaatgccggtgacggccgcgtccgccgcacagcgtcgcggtcggatcggcaggaaccagaacaaggagggggaccagtacatttacatgggccagcccctgaacaacgacgaagaccacgcacattggacagaggccaagatgctgctcgacaacatcaacacgccggagggtatcatccccgcgctatttgagccggagcgcgaaaagtccgctgccatcgacggcgagtaccggctcaggggcgaggcccggaaaaccttcgtggagctcatgcgccggggcgatctgccagtctggttatcctacaaggtggcttcagagggctttcagtactcagacaggcggtggtgcttcgacggggagcgcaacaaccaggtattagaggagaacatggacgtggagatctggacgaaagagggagagcggaagaagctgagaccccgctggttggacgcgcgcacctattccgaccccctagccctgcgggagttcaaggagttcgccgccgggcgccggtcggtgtctggcgacctgattctcgagataggaaagctgccgcagcatctaacgcttagggcccagaacgcgttggacaacctggtgatgctccacaactcagagcagggcggcaaggcatatcggcacgcgatggaggagctgcccgacaccatcgagaccctgatgctcctggccctgatcgcggtgctcaccgggggggtgactctgtttttcctgagcgggaaggggctcggcaagaccagcatcggtctgctgtgcgtgatggcctccagcgtgctcctgtggatggccagtgtagagccccactggatcgccgcaagcatcatcctggagttcttcctcatggtgctactgatcccggagccggaccgccaacgtaccccccaggataaccagctcgcatacgtggtgatcggcctattattcatgatcctcacggtggccgccaacgagatggggttactggagaccaccaagaaggatttaggcatcgggcacgtagtggccgagaaccaccaccacgccacaatgctggacatcgacttacatcccgcgtccgcctggacgctctacgccgtggccacaaccataattaccccaatgatgcggcacactatcgagaataccaccgccaatatcagcctgactgcgatagccaaccaagcggccatcctgatgggcttggataagggctggcccatctccaagatggacataggcgtacccctgcttgccctcggctgctacagccaggtgaaccccctcaccctgaccgcggccgtgctcatgttggtggcccattacgccatcatcgggccgggcctgcaagcgaaggccacccgggaggcccagaagcgcaccgcggcggggatcatgaagaaccccacggtggatggcatcgtggcgatcgacctcgacccagtcgtctacgacgccaagttcgagaagcagcttggccagatcatgctgcttatactgtgcacctcccagatcctgctcatgcgcaccacctgggccctgtgtgagagcatcacgctggcgaccgggccgctcaccaccttatgggagggctccccggggaagttttggaacacgaccatcgccgtgagcatggcgaacatcttccggggaagctacctggccggcgccgggctcgccttctccttgatgaaatccctgggcggaggccgacgggggaccggtgcccagggcgagaccctcggggagaagtggaagcgccagctgaatcaactgagcaagagcgaattcaacacttacaagcggagtggaatcatggaggtcgaccgcagcgaggcgaaggaaggactcaagcggggcgagaccaccaagcacgccgtgtcccgaggaaccgctaagctgcgatggttcgtggagcgaaacctggttaagcccgagggcaaggtcatcgacctgggctgcgggcggggggggtggtcctactactgcgctgggctcaagaaagtgactgaggtgaaaggttacaccaagggcggccccggtcatgaggagcccataccgatggcgacctacggctggaacatcgtcaagttacactccgggcgcgacgtgttcttcacgccgcccgagaagtgcgacaccctactctgcgacataggcgaaagctcccccaacccgacgatcgaggaggggcggacccttcgcgtactgaagatggtagagccctggctgcggggcaaccagttttgcataaagattctgaacccctacatgcccagcgtggtcgagaccctggaacagatgcagcgcaagcacggcggcatgctagtgcgtaacccgctgtcccgaaacagcacccacgagatgtactgggtctcctgcggcacggggaatatcgtcagcgccgtaaacatgacgtcccggatgctgctcaaccgcttcaccatggcccaccgcaaacccacctacgaacgtgacgtggacctgggcgcaggcacccgccacgtcgcggtggagcccgaaatcgcaaacctggacatcattgggcaacggatcgagaatatcaagaacgaacataagagcacatggcactacgacgaggacaacccctacaagacctgggcctaccacggctcctacgaggtcaagccgagcgggtccgcctcctccatggtcaacggtgttgtcagactcctcaccaagccctgggacgtgatccccatggtgacgcaaattgcgatgacggatactacccccttcggtcagcagcgggtctttaaggagaaggtggacacgaggaccccgagacccaagcgcggcaccgcccagataatggaggtgaccgcgaagtggctgtggggcttcttatctcggaacaagaagccccgcatctgtacgcgggaggaattcacccgcaaggtccggtctaacgcagctatcggggccgtgttcgtggacgagaaccagtggaacagtgccaaggaggcggttgaggacgagcgcttctgggacctggtccatcgggagcgcgagctgcacaagcagggtaagtgcgcaacctgtgtgtacaatatgatggggaagcgggagaagaagctcggggagttcgggaaggccaagggcagccgcgccatctggtacatgtggctgggcgcgcggtttctagagttcgaggcgctggggttcatgaacgaggaccattggttctcccgcgagaactcgctgtccggcgtcgagggggaaggcctgcacaagcttggctatatcctgcgggatatcagcaagatcccgggcggtaatatgtacgccgacgacaccgctgggtgggacacgcgtatcaccgaggacgacctgcagaacgaggccaagatcaccgacatcatggaacccgagcacgcactgctggcaacatctatattcaagctgacgtaccagaacaaggtggtgcgcgtccaaaggccagccaagagcggcaccgtgatggatgtcatcagccgccgggaccagcgcgggtccggccaggtcgggacctacggactcaataccttcacaaacatggaggtgcagctgatccggcagatggaatccgagggcatcttctcgccctccgagctggagaactcgaatctcgccgagcgcgttctggactggctggagaaacacggggtcgaacggctcaagcgcatggccatttccggcgacgactgtgttgtgaagccgaccgacgaccggttcgcgaccgccctgaccgccctgaacgacatggggaaggtgcgcaaggacataccccaatgggagcccagcaaaggctggaatgactggcagcaggtccccttctgctcccatcatttccaccaactcatcatgaaagatggccgggagatcgtcgtcccgtgccgcaaccaggacgagctagtcgggcgggctcgggtgtcccagggcgccggctggagccttagagagaccgcgtgcctcggcaaatcctacgctcagatgtggcagctaatgtacttccaccgccgggacctgcgactcgccgccaatgccatctgcagcgcggtccccgtaaactgggtgcctacctcccggacaacgtggagcattcacgcccaccaccagtggatgactacggaggatatgttgtccgtttggaaccgcgtatggatcgaggagaacccctggatggaggacaagacacacgttagcagctgggaggatgtcccatacctagggaagcgcgaggaccagtggtgcggctcacttatcggcctgaccgcacgggccacctgggcgacgaacatccaggtcgccatcaaccaggtgcgcagactgatcgggaacgagaactacctcgactatatgacctccatgaagcgcttcaagaacgagagcgaccccgagggcgcactgtggtga

SEQ ID NO: 24766 - RNA, 9879 nt, synthetic construct
  misc_feature 1..9879: note = derived and/or modified CDS sequence (opt11) from DENV-1__KR024706__SS-prME
  source 1..9879: mol_type = other RNA
tccgtgaccatgctgctcatgctgctgccgaccgccctcgcattccacctgaccacccgcggcggcgaaccccatatgatcgttagcaagcaagagcggggcaagagcctcctgttcaagacctccgcgggggtaaacatgtgcaccttaatcgccatggacctgggcgagttatgcgaagacacgatgacctacaagtgccctagaatcaccggggcggagcccgacgatgtggactgctggtgcaacgccacggacacctgggtgacatatgggacgtgcagccagaccggagagcaccggagggacaagcgttccgtggctctggcgccccacgtggggctggggctcgagacccggaccgagacctggatgtcgagtgagggcgcgtggcggcagatccaaaaggtcgagacctgggccctccgccatcccggcttcactgtcatcgctttctttctggcgcacgccatcgggacgtccatcactcaaaagggcatcatcttcatcctgcttatgctggtaacccctagcatggccatgaggtgcgtaggcatcggaaaccgtgatttcgtggagggactcagcggggccacgtgggtggatgtcgtcctggagcatggatcctgcgtgacaaccatggccaagaacaagcccaccctcgatatcgagctcctgaagacggaggtgaccaaccccgcggtactacggaagctctgcatcgaggctaagatctcgaacaccaccactgattcccgctgtccgacccaaggagaggccaccctggttgaagaacaagacgcgaacttcgtctgccgccgcacgctggtcgaccgcgggtggggtaacgggtgcggcctcttcgggaagggcagcctgctgacgtgcgcgaagttcaagtgcgtgaccaagctggagggtaagatcgtccagtacgagaacttgaaatactccgtgatcgttaccgtccacacaggggatcagcatcaggtgggcaacgagacgaccgaacacgggaccatcgcgaccattactccccaggcccccacatccgagatccagctgaccgactacggcgcccttaccctagactgcagcccccggaccgggctggacttcaacgagatggtcctcctcacgatgaaggaaaagagctggctggtgcacaagcagtggttcctcgacctgccgctgccctggaccagtggcgcgtcaaccagccaggagacctggaaccggcaggacctcctggtgactttcaagaccgcccacgcgaagaagcaagaagtagtggtgctggggtcccaagagggggccatgcacacagcactcaccggcgccacggagatacaaaccagcgggaccaccacaattttcgccggccacctgaagtgccgcctgaagatggacaagctcaccttaaagggggtaagttacgtgatgtgcacgggcagcttcaaactggagaaggaggtggcggaaacccagcatggcacggtcctggtccaggtgaaatacgaggggacggacgcaccatgcaaaatccccatctccacacaagatgagaagggcgtcacccagaacggacggctcatcacggccaatccaatcgtgaccgataaggagaagcccgtgaacatcgagaccgagccgccatttggcgaaagctacattgtcatcggtgccggggagaaggcgctgaagctgtcctggttcaagaaaggaagttccatcgggaagatgtttgaggccaccgccagaggggcccggcgaatggccatcctcggagacacggcgtgggactttggcagcattggtggggtgtttacctccgtgggcaagctggtgcaccaggtgttcgggaccgcatacggcgtgttgtttagcggcgtcagttggaccatgaagatcggcatcggcatcctcctgacctggctggggttgaactcacgctccacaagcctatccatgacctgcatcgccgtgggcatggtgaccctatacttaggggtcatggtgcaggcggatagcggctgtgttatcaactggaaggggcgtgagctgaaatgcggctctggcattttcgtcacgaacgaagtgcacacttggaccgagcagtacaagttccaagctgacagccctaaacgtctgtccgcggcgattgggaaggcatgggaagaaggcgtgtgtgggatccggtccgctacgcggctcgagaacattatgtggaagcagatcagcaacgagctgaaccacatactgctggaaaacgacatgaagttcacagtcgtggtgggcgacgccaacgggatcctgacgcaagggaagaagatgatccggccccagccaatggagcacaagtattcctggaagagctggggcaaggctaagatcatcggagcggacacccagaacactaccttcatcatcgacggacccgatacgccggagtgtcctgacgatcaacgcgcctggaacatctgggaggttgaggattacgggttcggagttttcacgactaacatctggttaaagctccgggactcctacacccagatgtgcgaccaccgcctgatgagcgccgcgatcaaggacagtaaggccgtgcatgcagacatgggctactggatcgagagcgagaaaaacgagacgtggaaactggctcgggctagtttcatcgaggtcaagacctgcatctggccgcgcagtcacaccctatggagcaacggggtgctagagagcgagatgatcatccccaagatctacggcgggccgatctcccagcacaattaccgacccggatatttcacccagacagcggggccctggcatcttggtaagctcgagctggacttcaatctctgtgagggcacgaccgttgtcgtggacgaacactgcggcaaccgaggaccgagcctcaggacaactaccgtgaccgggaaaatcattcatgagtggtgctgcagatcttgcaccctgccgcccctgcgattccgcggcgaggacgggtgttggtacggaatggaaatccggcccgtcaaggaaaaggaggagaacctcgtgcgcagcatggtctccgccggcagcggtgaggtcgactccttctccctgggcctgctctgcgtgtccatcatgatcgaggaggtgatgcggagtcgatggagcagaaagatgctaatgacggggacgctggccgtcttcttcctcctgattatgggccagctgacgtggaacgacctcatccgcctgtgtatcatggttggggccaatgtatcagaccgaatgggcatgggcactacgtacctggccctcatggcaaccttcaagatgcggccgatgttcgccgtgggcctgctgttcagacggctcaccagccgcgaggtgctgctgttaacaatcggcctgtccctggtcgcctcagtagagctccccaactccctggaggagctgggggacggcctcgccatgggcatcatgatgctgaagctgctcaccgactttcagagccaccagctgtggacaaccttgctctccttaacgttcatcaagacgaccttaagcctagactacgcctggaagaccatggctatggtgctgtccatcgtgagcctcttccccctctgcctgtccaccacgtctcagaagaccacctggctgccggtgctcctgggctccttcggctgcaagcccctcaccatgtttctcataaccgagaacaagatctgggggcgcaaaagctggcctctgaatgaaggaatcatggccgtggggatcgtgtccatcctgctgagctcgctgctgaaaaacgatgtgcccctcgccggacccctgattgccggcgggatgctgatcgcatgctacgtgatcagtggcagctccgccgatctcagcctggagcgcgccgccgaggtgtcttgggaggaagaggccgagcactcgggtgcctcccacaatatcctggtggaagtgcaggacgacggcacgatgaagatcaaagacgaggagcgggacgatacccttactatcctgctgaaggctaccctcctggccgtgtcgggggtgtacccgatgagtatacccgccactctgttcgtgtggtacttctggcagaagaagaagcagcgcagcggcgtcctctgggacacgccctcgccgcccgaggtggaacgggccgtgctggatgacggtatctaccgcatcctgcaacgcggccttttaggccgtagccaagtcggtgttggagtgttccaggacggagtcttccacaccatgtggcacgtgacccggggcgcggttctgatgtaccagggcaagcgcctagagccctcctgggctagtgtcaagaaggatctgatctcctatgggggcgggtggcgcttccagggatcctggaatacgggggaggaggtccaagtgatagccgtcgaacccggcaaaaaccccaagaacgtgcagaccacccccggtaccttcaagactcccgagggggaggtgggcgccatcgccctggatttcaagccggggacctccggcagccccatcgtcaaccgcgagggtaagatcgtggggctgtacggcaacggggtggtcacaacctcgggcacttacgtaagcgcgatcgcccaggccaaggccagccaagaagggccgctccccgagatcgaggacgaagtgttcaagaagcggaacctgaccattatggacctgcaccccggcagtggcaagaccaggcggtacctgcctgccatcgtccgcgaagctattaagcgcaagctgcgcacccttatcctcgcccccacacgcgtggtggccagcgagatggcagaagcgttgaagggaatgcctatcagataccagactaccgccgtcaagtccgaacacaccggcaaggaaatcgtggacctgatgtgccacgccacgtttaccatgcgccttctgagccctgtccgggtgcctaattataatatgatcattatggacgaggcccactttaccgaccccgcctccatcgccgccagggggtatatcagtacccgggttggcatgggggaggccgccgccatcttcatgacggcgacgccgcccggctccgtggaggccttcccgcagagtaacgcagtcatccaagacgaggaacgcgatatcccagagcgatcctggaactcaggctacgattggatcaccgattttcccgggaagacggtgtggttcgtgccctcgatcaagagcgggaacgacatcgctaattgcctgcggaagaacgggaagcgggtcatccagttatcccgcaagaccttcgataccgagtatcaaaagaccaagaataacgactgggattacgtggtgaccacggatatcagcgagatgggtgccaacttccgggcggaccgcgtaatcgatccgcgacgctgcctgaagcctgtcatcctgaaggacggccccgagcgcgtaatcctcgccggccccatgcctgtgaccgccgcctccgcggcccaaagacggggccgcatcgggcgcaaccagaacaaggagggcgaccagtacatctacatggggcagccgctcaacaacgacgaggaccacgcccactggaccgaagccaagatgctactcgacaacatcaacactcccgaaggcattatcccggcgctgtttgaaccggagagggagaagtccgcggcaatcgacggagaataccgcttagggggcgaggcccgaaagacgttcgtagagttaatgaagcgcggggacctgcccgtctggctgtcatacaaggtggcctcagagggctttcagtactccgatagacgctggtgcttcgacggggagaggaataatcaggttttggaggagaacatggacgtcgagatctggaccaaggagggtgagcgcaagaagctacggccccgttggctggacgcccgcacctatagcgatcccctcgctctccgggagtttaaagagttcgcagccggcagacgctcggtgtcaggggacctgatcctagaaatcggtaagctaccgcagcacctgaccctacgcgcccagaacgccctggataacctggtgatgctccacaactctgaacagggggggaaagcgtatcgccatgccatggaggagctacccgacaccattgaaacgctgatgctcttggccctgattgccgtccttaccgggggcgtgaccctgttcttcctgtcaggcaaggggctcggcaaaaccagcatcggcctgctgtgcgtgatggcgtccagcgtcctcctgtggatggcctccgtggaaccccactggatcgccgccagcatcatcctggagttcttcctaatggttctattaatcccggagccggatcggcagcgcacgccccaagataatcagctcgcctacgtcgtaatcggcctgctgttcatgatcctcaccgtggctgccaacgaaatgggactgctggagaccaccaagaaggacctcggtatcggacacgttgtggccgagaaccatcaccacgccacgatgctggacatcgatctgcaccctgcgagtgcgtggaccttatacgctgtggccaccaccatcattacgcctatgatgcggcacacaatagagaatacgaccgctaacatcagcctgactgccatcgcgaatcaagcagccatcctcatgggcctcgacaagggctggcccatttccaagatggacatcggggtccccttgctggccctcggttgctactcacaagtgaaccccctgaccctgaccgccgcggtgttgatgctggtcgcccactacgccatcatcgggccgggtctgcaggccaaagcgacgcgcgaagcacagaagcggacggccgccggcatcatgaagaatcccacagtggacgggatcgtggccatcgaccttgacccggtcgtatacgacgccaaattcgagaagcagctgggtcagatcatgttgctcatactctgcacctcgcagattcttctgatgcgcacaacgtgggccctgtgcgagagtatcacactggccaccgggccgctcaccacgctgtgggagggctccccgggcaaattttggaacacaaccatcgccgtgagcatggccaacattttccgcgggtcctacctggcgggagcagggcttgccttctctctgatgaaatccctgggcgggggtcgcagagggaccggggctcagggtgagacgctcggggaaaaatggaaacgccagctgaaccagctgtctaagagcgagttcaacacctataagcggtccggaatcatggaggtcgatcggtcggaagccaaggaggggctaaaacgcggtgagaccaccaagcacgcagtatcccgggggacggccaagctgcgttggttcgtcgagcggaacctggtcaaacccgagggaaaagtcatcgatctggggtgcgggcgcggcggatggagctactactgcgcgggcctcaagaaggtgaccgaagtcaagggctataccaaaggcggccccgggcacgaagagccaatcccgatggcaacctacggctggaacatcgtgaaactgcattccgggagagacgtgtttttcacgccgccagaaaagtgcgatactctgctctgcgacattggcgagagctcgcctaaccccaccatagaagagggccgcactctgcgggtcctgaagatggtggagccctggctccgcgggaaccaattctgcatcaagatcctgaacccctatatgcccagcgtggtggagaccctggagcagatgcaacggaaacatggtgggatgctcgtgcgcaacccgctttccagaaatagcacgcacgagatgtactgggtatcctgtggcaccggcaacatcgtcagcgcggtgaacatgacgtcccgcatgctgctcaaccgatttaccatggcccacagaaagcccacgtacgagcgcgacgttgacctgggggccggcacccggcacgtagccgtcgagcccgaaattgccaacctagatatcatcggccagcgcatcgagaatatcaagaacgagcacaagtcgacctggcactacgacgaagataacccctataagacctgggcgtaccacggatcctacgaggtaaagcctagcggaagtgccagctccatggtaaacggcgtagtccgcctcctgaccaagccctgggatgtaatccccatggtgacccagatagccatgacggacaccacgcccttcggacagcagcgcgtattcaaagagaaggtggacacacggaccccgcgccccaaacggggcaccgcccaaataatggaggtgactgcaaagtggttatggggcttcctcagccgcaacaagaagccccggatctgcacccgcgaagagttcactcggaaggttcgcagcaacgcggccataggggccgtattcgtggacgagaaccagtggaactccgccaaggaggccgtggaggacgagcggttctgggacctggtgcacagagagcgggagctgcacaagcagggcaagtgtgcaacctgcgtgtacaatatgatggggaagagagagaagaagcttggcgagttcggtaaggctaaggggagccgggctatctggtacatgtggttgggcgcccgcttcctggaattcgaagcgctcgggttcatgaacgaggaccactggttctcccgggagaactcattgtccggcgtcgagggggagggcctacacaagctcggctacattctacgcgacataagcaagatccccgggggtaatatgtacgccgacgacacggccgggtgggacaccagaattaccgaggacgatctgcaaaacgaggccaagatcaccgacatcatggagcccgaacacgcgctcctagcgacgtccatcttcaagctgacctaccagaacaaggtcgtgcgcgtccagagacccgctaaaagcgggacggtgatggacgtgatcagccggcgggaccagcggggctccggacaggtcggcacctacggattaaacacgtttaccaacatggaagttcagttgatacgacagatggagtctgaaggcatcttcagcccctccgaattggagaacagcaatcttgctgagcgggtcctggactggcttgagaagcacggagtcgagcgcttaaagcggatggccatatccggcgacgactgtgttgtgaagccgaccgatgatcgcttcgctaccgcgctaacggccctgaacgacatgggcaaggtgcgcaaggacataccccagtgggagcccagtaagggttggaacgactggcagctcgtgcctttctgctcccaccatttccaccaacttatcatgaaggacggtcgcgagatagtggtcccgtgccgcaaccaggacgagctggtcgggcgcgcccgggtgagccagggcgccgggtggagcctccgcgaaactgcgtgcctgggtaagtcatacgcgcagatgtggcagctgatgtactttcaccggagggatctccggctcgccgcaaacgccatttgcagcgcggtccccgtgaactgggtacccacgagccgcaccacctggtctatccatgcgcatcaccagtggatgacgaccgaggacatgctgtcggtttggaaccgagtgtggatcgaggaaaatccctggatggaggacaagacccacgtgagctcctgggaggacgtcccgtacctcggcaagagggaggaccaatggtgcgggtccctgattgggctgaccgccagggccacatgggccaccaacatccaggtagctatcaatcaggtgcggcgcttgattgggaacgagaactacctggactacatgacctccatgaagcggttcaagaacgagagcgaccccgaaggcgccctgtggtga

SEQ ID NO: 24767 - RNA, 9879 nt, synthetic construct
  misc_feature 1..9879: note = derived and/or modified CDS sequence (opt11) from DENV-1__KR024707__SS-prME
  source 1..9879: mol_type = other RNA
agcgttaccatgctgctcatgctactgccgaccgccctcgccttccacctgacgacccgggggggggagccccacatgatcgtgagcaagcaggagagaggcaaaagcctcctgttcaagacctccgcgggggtgaacatgtgcaccctcattgccatggatctgggtgagctctgcgaagacaccatgacgtacaagtgcccccgaatcaccgaagccgagccagatgacgtggactgctggtgcaacgcgaccgacacctgggtgacctacgggacctgtagccagacaggcgagcaccggcgcgacaagagatctgttgccctggccccccacgtgggcctgggcctcgagacgcgcaccgagacctggatgagttccgagggcgcctggcggcaaatccagaaggttgagacatgggccctgcgccatcccgggtttacggtgatagccctgttcctcgctcatgccatcggcactagcatcacccagaagggtatcatctttatcctgctgatgctcgtgaccccctccatggcgatgcggtgcgtcggcatcggcaaccgcgacttcgttgaggggctgagcggcgccacttgggtggacgtcgtgctggagcatgggtcctgcgtgacgaccatggccaagaacaagcctaccctcgacatagagctgctaaagacggaggtcacgaaccccgcggtcctccggaagctgtgcatcgaagccaagatctccaacaccacaacggactcccgctgcccaactcagggcgaggcaaccctggtggaggagcaggacgccaacttcgtctgccggcgcaccttcgtggaccggggctgggggaacggctgcggcctctttggcaaggggtctctgctgacgtgcgctaagttcaagtgcgtaaccaagctcgagggtaagatcgtccagtacgagaacctgaagtactccgtgatcgtgaccgtccacaccggcgaccagcaccaggtggggaacgagacgacagagcacggcaccatcgcgaccatcacgccccaggcccccacgagcgagatccagttaaccgactacggggccctcaccctggactgcagccctcggaccggcctggacttcaacgaaatggtcctcctgaccatgaaagagaaatcctggctggtgcacaagcagtggttcctcgacctaccgctgccgtggacctccggggctagtaccagccaggagacctggaaccggcaggacctcctggtgacgttcaaaaccgctcacgcgaagaagcaggaggttgtggtgctgggctcacaggagggcgccatgcacactgccctcaccggggccacggagatccagaccagcggcaccaccacgatcttcgccgggcacctaaagtgccgcctgaagatggacaagctcaccctgaagggcgtctcctacgtgatgtgtaccgggagcttcaagctggagaaggaggtggcggaaacccagcatggcacagtcctggtccaggtgaagtatgagggcaccgacgccccctgcaagatccccatatccacccaggacgagaagggggtcacgcagaacggccggctcattacggcaaatccgatcgtcaccgacaaggagaaacccgtgaacatcgagaccgagccaccgttcggagagagctacatagtcatcggcgccggcgagaaagcgctgaagctatcctggttcaagaaggggagctccatcggcaagatgttcgaggccacagcccgcggggctcggcgcatggccatcctcggcgacacggcgtgggacttcgggtctatcggcggcgtgttcacctcagtggggaagctggttcaccaggtattcggcaccgcctacggggtgctgttcagcggcgtctcctggacaatgaagatcgggatcggcatcctcctgacgtggctaggcctgaacagccgctccaccagcctgtccatgacctgcatcgccgtggggatggtgaccctgtacctcggggtcatggtgcaggccgattcggggtgtgtgatcaactggaaaggcagggaactaaagtgcgggagcggtatcttcgtcacgaacgaggtgcatacctggaccgagcaatacaagttccaggccgacagcccgaagcgcctgtccgctgctatcggtaaagcctgggaggagggggtctgcggcatacgatccgccacccgcttggagaacatcatgtggaagcagatctcgaacgagctgaaccacatcctgctcgagaacgacatgaagttcaccgtcgtggtaggggacgccaacggcatcctgacgcaggggaaaaagatgatccggccccaacctatggagcacaagtactcctggaagtcctgggggaaggccaagatcatcggagctgacacccagaacaccacctttatcatcgacgggcctgacacgccggagtgcccagacgaccagcgcgcctggaacatctgggaggtagaggactacggcttcggggttttcaccaccaacatatggctgaagctaagagactcctacacccagatgtgtgaccatcggctgatgagcgcggcgatcaaggactccaaggccgttcacgctgacatgggctactggatcgagagcgagaagaacgagacgtggaagctggcccgtgcctctttcatcgaggtcaagacctgcatctggccccgcagccacaccctctggtccaacggcgtgctggagagcgagatgatcatccccaagatttacggggggccgatctcccagcacaactaccggcccgggtacttcacacagactgcgggaccctggcacctggggaaactggagctggatttcaacttgtgcgagggcaccacagtggtcgtggacgagcactgcggcaaccgcgggccgagcctccggacgacgaccgtgaccggcaaaatcatacacgagtggtgctgccgctcctgcacgctcccgcccctgcggttccggggagaggacggatgttggtacggcatggagatccggcccgtcaaggagaaggaggaaaacctggttcgcagtatggtgtcagccggcagcggtgaggtggacagcttctctctgggtctgctctgtgtgagcataatgattgaggaggtcatgcggagccgctggagccgtaagatgctgatgacgggcaccctggccgtcttctttctcctgatcatggggcagctgacctggaacgaccttatccggctatgcatcatggtgggcgctaacgtgagcgaccgcatggggatgggcaccacgtatctggccctcatggcgacgttcaagatgcggccgatgttcgccgtcggcctgctgttccgccggctcacgagccgcgaggtgctgttactcaccataggactgtccctggtcgccagcgtggagttacccaactccctggaagagctgggcgacggcctcgccatgggcatcatgatgttgaagctgctcaccgacttccaaagccaccagctgtggaccaccctgctctccctgaccttcatcaagaccaccctgagcctcgactacgcctggaagaccatggcgatggtgctgtcaatcgtcagcctgttccctctctgtctgagcaccacgagccagaagaccacctggctgcccgtgctcctgggctccttcgggtgcaagccgctgaccatgttcctcatcaccgagaacaagatctgggggcgcaagagctggccactgaacgaggggatcatggcagtgggcatcgtctccattctgctaagcagcctcctgaagaacgacgtacccctcgccgggcccctgatcgcaggtggcatgctgatcgcttgctacgtgatctccggtagcagtgccgacctcagcctggagcgcgccgcggaggtctcctgggaggaggaggccgaacacagcggcgcgtcccacaacatcctggttgaagtgcaggacgacgggacgatgaagatcaaggacgaggagcgagatgacaccctcaccatcctgctgaaggccaccctcctcgcagtcagcggcgtatacccgatgtccatccccgccacgctgttcgtgtggtacttctggcagaagaagaagcagcgcagcggggtcctctgggacacccccagcccgcccgaggtggagcgggccgtgctggacgacggcatctaccgaatcctgcaaagaggcctgctggggcgcagccaggtcggcgtgggggtgttccaggacggcgtcttccacaccatgtggcacgtcacccgcggggccgtgctgatgtaccagggcaagcgcctggagccctcctgggccagcgttaagaaggacttaatctcctacggcgggggatggcgattccaagggagctggaacacgggcgaggaggtccaggtgatcgcggtcgagcccggaaaaaaccccaagaacgtgcagaccactcccggcacctttaagacgcccgagggcgaagtgggggccatcgccctggacttcaagcccggcacatccgggtcccccattgtcaaccgcgagggcaagatcgtgggcctgtacgggaacggcgtcgtcaccacctccgggacatacgtgagcgctatcgcccaggccaaggccagccaggagggcccgctgcccgagatcgaggacgaggtgttcaagaagcggaacctaaccatcatggacctgcaccccgggtccggcaagacccgccggtatttaccggccatcgtccgcgaggcgatcaagcgcaagctgcggactctgatcctcgcccccacgcgcgtggtggcctccgagatggccgaggcgctgaagggcatgccgatccgataccagaccaccgcggtcaagtccgagcataccgggaaggagatcgtggacctgatgtgccatgccacgttcaccatgcgcctcctgagccccgtgcgggtcccgaactataacatgatcatcatggacgaggcccacttcaccgaccccgcatccatcgcggcaaggggctacatcagcacccgggttgggatgggcgaagccgccgccatcttcatgacggctacgccgccagggtccgtggaggccttcccgcagagcaacgccgtcatccaggacgaagagcgcgacatcccagagcgctcctggaacagcggctacgactggatcaccgacttcccgggcaagaccgtgtggttcgtaccttccatcaagagcgggaacgacatagccaactgcctgcgcaagaacgggaaacgggtcatacagctcagccgcaagacgttcgacaccgagtaccagaagacaaagaacaacgactgggactatgtggtgaccacggacatctctgaaatgggagccaatttccgggcggaccgcgtcatagacccgcggcgctgcctaaaacccgtgatcctgaaggacggacctgagcgggtcatcttagccgggcccatgccggtgaccgccgccagcgcggcccagcgccgcggccgcatcggccgaaaccagaacaaggagggcgaccagtacgtgtatatgggtcagcccctgaacaacgatgaggaccacgcccactggaccgaggccaagatgctgttggataacatcaacaccccagaggggatcatccccgccctcttcgagccggagcgggagaagtcggcggccatcgacggcgagtaccgtctgcgcggggaggcgcgcaagacgttcgtcgagctaatgcggcgcggcgaccttcccgtctggctttcctacaaggtggctagcgagggctttcagtactcagaccggcgctggtgcttcgacggggagcggaacaaccaggtcctcgaggagaacatggacgtggagatctggaccaaggagggagagcgcaagaagctgcggccccgctggttggatgcccggacctattctgaccccctcgcgctgcgcgagtttaaggagttcgctgccgggcggcggtctgtgtccggcgacctgatcctcgagattgggaagctgccgcagcacctgaccttacgggcccagaacgccctggacaacctggtgatgctccacaacagcgaacagggggggaaggcttacagacacgccatggaggagctgcccgatactatcgaaacgctgatgctattaaccctcatcgccgtgctcaccgggggcgtgaccctgttcttcctgtcggggaagggcctcggtaagacgagcattgggctactgtgcgtaatggcgtcctcagtgctcctgtggatggcgtccgtggagcctcactggatcgccgccagcatcattctggagttcttcttaatggtcctgctaatcccggagccggaccggcaacgcacgcctcaggataaccagctcgcgtacgttgtgatcggcctgctgtttatgatactcaccgtcgctgcgaacgagatggggttgctggagaccacgaagaaggacctgggcatcggacacgtggtggccgagaaccaccaccacgccaccatgttggacatagacctccaccccgcctctgcctggaccctctacgcggtcgcaaccacgatcattactccgatgatgcggcataccatcgagaacaccacggccaacatctcgctgaccgccatcgccaatcaggcggccatcctgatgggcctcgacaagggctggcccatctccaagatggacatcggggtgcccttgctcgccctcggctgctacagccaggtcaacccactgacgctgaccgccgctgtcctcatgctggtagcgcactacgccataatcgggccgggccttcaggccaaggccacgcgcgaggcgcagaagcgcaccgccgccgggataatgaaaaaccccaccgtggatggcattgtcgccatcgacttggaccccgtggtgtacgacgccaagttcgaaaaacagctgggccaaattatgctgctcatcctgtgcacctcccaaatcctgctgatgcggacgacctgggcgctgtgcgaaagcatcaccctggccaccgggcccctaacgacactgtgggagggttccccggggaaattctggaacaccacgatcgccgtatccatggccaacatcttccgcggcagctacttggccggcgcagggctcgccttctcgctgatgaagtcactcggcgggggccggcgcgggacgggcgcccagggcgagaccctcggggagaagtggaagcggcagctgaaccagctgagcaagagcgagtttaacacatataagcggtccggcatcatggaagtggaccggagcgaggccaaggaggggctgaagcgcggcgagacaacgaagcacgccgtttcccgggggaccgcgaagctgcgctggttcgttgagcggaacctggtgaagcccgagggcaaagtgatcgacctgggctgcggacgcggcgggtggagctactactgcgccggcctcaaaaaagtcaccgaggtgaaggggtacaccaagggcggccccgggcatgaggagcccatcccgatggccacctatggctggaacatagtgaagctacactccggccgcgacgtcttcttcacgccgcccgagaagtgcgacaccctgctctgcgacatcggcgagagctcccccaacccgaccatagaggaggggcgcaccctgcgggtgctgaagatggtggagccctggctccgcggcaaccagttctgcatcaagatactcaacccctacatgcccagcgtcgtagagacgctggagcagatgcaacggaagcacggtgggatgctcgtccgcaacccgctgtcccggaacagcacacacgagatgtactgggtctcctgcggcaccgggaacatcgtgagcgccgtaaacatgacttcccgcatgctgttaaaccgcttcactatggcgcatcggaagcccacctacgagcgcgacgtcgatttaggcgctggcacccggcacgtggccgtcgaacccgagatcgccaatctggacattatcgggcagcgcatcgagaacatcaagaacgagcataagtccacctggcactacgacgaggacaacccttacaagacatgggcctaccacggctcctacgaggtgaagccgagcgggtccgcgagcagcatggtgaacggggtcgtgcggctcctgaccaagccctgggacgtgatccccatggtcacccagatcgccatgaccgacacgacccccttcgggcagcagcgcgtgttcaaggagaaggtggacacccggaccccgcggccaaagcgcggcacggcccagatcatggaggtcactgcaaagtggctctgggggttcctctctcgcaacaagaagccccggatctgcacccgcgaggagttcacccggaaggtgcgcagcaacgccgcgattggggccgtgttcgtcgacgagaatcagtggaactcagcaaaggaggccgtggaggacgagcgattctgggacctggtgcatcgcgaacgtgagctgcacaagcagggcaagtgcgctacgtgcgtctacaacatgatgggcaaacgcgagaaaaagctcggcgagttcgggaaggcgaaaggcagccgggccatctggtacatgtggctgggcgcccgattcctggagttcgaggcactcgggttcatgaacgaagaccactggttctcccgggagaacagcctgtccggcgtggagggggaggggctgcacaaactcgggtacatcctgcgcgacatcagcaagatccctggcggcaacatgtacgcggacgacaccgccgggtgggacacccgcatcaccgaagacgacctgcagaacgaggcgaagatcacggacatcatggagcccgagcacgccctcctggccacctccattttcaagctcacctaccaaaacaaggtggtgcgggtgcagcgccccgccaagagcggcaccgtgatggacgtaatctccagacgcgaccagcgggggagcggccaggttggcacgtatggcctcaacaccttcaccaacatggaggtgcagctgatacgccagatggagtccgagggcatcttcagcccctccgagcttgagaacagcaacctcgctgagcgggtcctggactggctggaaaagcacggggtggaacgcttgaagagaatggccatttccggtgacgactgcgtggtcaagccgaccgacgaccgcttcgccaccgccctaaccgccctcaacgacatgggtaaggtgcggaaggacatcccccagtgggagccctcgaagggctggaacgactggcagcaggtccccttctgctcccaccatttccaccagctcataatgaaggacggccgagagatcgtcgtgccgtgccggaaccaggacgagctggtcggacgagcccgggtcagccagggcgccgggtggagcttacgcgaaaccgcctgtctcggcaagtcctacgcccagatgtggcagctgatgtacttccaccggcgcgatctgcggctcgcggccaacgccatctgcagcgcggtgcctgtgaactgggtccccacatcccgcaccacgtggagcatccacgctcaccaccagtggatgaccaccgaagacatgttgagcgtgtggaatcgcgtctggatcgaagagaacccatggatggaggacaagacccacgtcagctcctgggaggacgtgccgtacttggggaagcgggaggaccagtggtgcggcagcttaatcggcttaacggcgcgcgccacttgggccacgaacatccaggtggcaatcaaccaggtccggcgcctgatcgggaacgagaactacctcgactacatgacctccatgaagagatttaaaaacgaaagcgaccccgagggcgcgctttggtga

SEQ ID NO: 24768 - RNA, 9879 nt, synthetic construct
  misc_feature 1..9879: note = derived and/or modified CDS sequence (opt11) from DENV-1__KC172829__SS-prME
  source 1..9879: mol_type = other RNA
agcgtgaccatgctgctcatgctgatgcccacggcccttgccttccacctcaccacccgcggcggggagccgcatatgatcgtgagcaagcaggaacgcggaaagagcctgctgtttaagacctccgccggggtgaacatgtgcacgctcatcgcgatggacctgggggaactgtgcgaggataccatgacctacaagtgcccccgcatcacagaggccgaacccgacgacgtggactgctggtgcaacgctaccgacacgtgggtaacgtacgggacgtgctcacagacaggtgagcacaggcgcgacaagcgaagtgtcgccctcgcgcctcatgtgggtctggggctggagactcgcaccgagacctggatgagctccgaaggtgcctggaagcagatccagcgggtggagacctgggccctccgccatccgggtttcacagtgatcgccctattcttggcgcacgccatcggcaccagcatcacccagaaagggatcatcttcatactcctgatgctggtgaccccctcgatggccatgaggtgcgtcggcataggcagccgcgacttcgtggaggggctctccggcgccacgtgggtggatgtcgtgttagaacacgggagctgcgttacgacaatggctaaggacaagcccaccctggatatcgagctcctgaaaactgaggtcaccaaccccgctgtgcttcggaagctctgcatcgaagccaagatatctaataccaccacagatagccgctgcccgacacagggcgaggccacactggtggaggagcaggacgccaacttcgtctgccgccgcacctttgttgaccggggctgggggaacggctgcgggctgtttggtaaggggtccctgatcacttgcgccaagttcaagtgcgtcaccaagctcgaaggcaaaattgtccagtacgagaatctcaaatacagcgtgatcgtgaccgtccacaccggcgaccagcaccaggtggggaacgagtccacggagcacggcacgacggcgaccatcacgccccaggcccccaccactgagatacaactcaccgactatggcgcgctcaccctggactgcagcccccgcacgggtctcgacttcaacgaaatggtcctcttaaccatgaaggaaaagagctggctcgttcacaagcaatggttcttggacctgccgctaccctggaccagcggggccagcacctcccaggaaacttggaaccggcaggacctgctggtcactttcaagaccgcccacgcgaagaaacaagaagtcgtggtgctcggcagtcaagagggcgccatgcacaccgccctgacgggtgccacggagatccagacctccggcacaacgaccatcttcgccgggcacctaaagtgccgcctcaaaatggataagctgacactaaaaggcatgagctatgtcatgtgcacaggcacgttcaaactggagaaagaggtggcggagacgcagcacggcaccgttttagtccagatcaagtatgaaggcaccgacgcaccctgtaagatccccttctccacccaggacgagaaaggagtgacccaaaacggtaggttaatcaccgccaatccgatagtgaccgacaaggagaagcccgtcaacatagaggccgaaccgcccttcggggagagctacatcgtgataggcgcgggcgagaaggcactgaagctctcctggtttaagaagggcagctccatcggcaagatgttcgaggccacagcccgcggggcccggcggatggcaatcctaggggacaccgcctgggacttcggaagtatcgggggcgtctttacctccgtcgggaagctggtgcaccagatcttcgggaccgcctatggggtcctgttcagcggcgtcagctggacgatgaagatcgggatcggcgtgctgctgacatggctcggcctcaactcgcggtcaacctcgttatccatgacctgcatcgccgttgggctcgtgacgctgtacttaggcgtgatggttcaggccgatagcgggtgcgtggtgaattggaagggccgcgagctcaaatgcgggtccggcatcttcgtgaccaacgaggttcatacatggactgagcagtacaagttccaagccgacagcccgaagcgcttgagcgccgccattggcaaggcatgggaagagggcgtctgcggcatccggtccgccacccgactggaaaacatcatgtggaagcagatctcaaacgaattgaaccacatactgctggagaacgacatgaagttcacggtggtagtaggggacgtagcgggcatactcgcccaggggaagaaaatgatacggccccagccaatggagtacaagtactcctggaagtcctggggcaaggccaagatcatcggcgccgacgtccagaacaccaccttcatcatagatggcccgaacaccccggagtgccccgacgaccagcgcgcgtggaacatatgggaggtggaggactatggctttgggatatttacgaccaacatttggctgagacttcgcgactcctacacccaggtgtgtgaccaccgtctcatgagcgccgccatcaaggattccaaagctgttcatgccgacatgggctattggatcgagtccgagaagaacgaaacctggaaactggcgcgcgcttccttcatagaggtgaagacgtgcatctggcccaagagccacactttgtggtccaatggggtgctcgagagcgaaatgatcatcccgaagatctacggcggccccatctcccagcacaactaccggcccggctatttcacgcagaccgccggcccgtggcacctggggaaactggagctcgatttcgacttatgcgagggcacgaccgtcgtggtagacgagcactgcggaaaccgcgggcccagcctgcgtaccaccacggtaaccggcaagatcatccacgagtggtgctgccgctcctgcaccctgccgcctctgcggttccgcggggaagacggctgctggtacgggatggagatccggcccgtgaaggagaaggaggaaaacttggtcaagtcaatggtctcagcagggagcggagaggttgacagcttctcgctcgggctgctgtgcatcagcatcatgatcgaggaggtcatgcggtcccggtggagccgtaaaatgctcatgaccggcacgctggccgtattctttttgctcatcattgggcagctgacatggaacgacctgatccgcttatctatcatggtgggcgcgaacgcctcagacaagatggggatggggactacctacctggcactgatggccacgttcaagatgcgccccatgttcgccgtggggctcctgttccggcggcttacctcccgcgaggtcctcctgcttaccatcgggctcagcctggtggcgtctgtcgaactgcccaactctctcgaggaactgggtgacggcctggccatgggcatcatgatcctcaaactgctgacagactttcagtcccatcagctctgggcgacgcttttatctttgaccttcatcaagaccaccttcagcctgcactacgcctggaagacgatggcgatggtgctcagcattgtgtccctcttccccttatgcctgagcacgacctcccagaagaccacgtggctgccagtcctgctgggcagcctcgggtgcaagccgctgaccatgttcctgattacggagaacaagatttggggtcgcaagtcctggcccttgaacgagggcatcatggccgtgggtatagtaagcatcctgctctcatcgctcctcaagaacgacgtcccactggccgggcccctcatcgctggcggcatgctgatagcctgctatgtgatcagcgggagtagcgcggacctgtccctcgagaaagccgccgaggtgtcatgggaggaggaagccgaacactccggcgccagccataacattctggtcgaggtgcaggacgatggcaccatgaaaatcaaggacgaggagcgtgacgacaccttaacgatcctcttaaaggcgaccctgctcgccgtgtccggcgtctacccgttgagcatcccagccaccctatttgtgtggtacttctggcagaagaagaagcagcggtccggggtattgtgggacactccgtcaccgcccgaggtcgagcgagccgtgctggacgacggtatctaccgaatcatgcagcgcggtctgctggggcggtcccaagtgggtgtgggagtgttccaggagaacgtgttccacacgatgtggcacgtgacaaggggcgccgtgctcatgtaccaggggaagcgactggagcccagctgggcgtcggtgaagaaggaccttatctcgtacggcggcgggtggcgtttacagggctcctggaacaccggggaggaggtccaggtgattgccgtggagcccggcaagaatcctaagaacgtccagacggcccctggaacgttcaagacgaccgagggggaagtgggcgccatcgccctggacttcaagcccgggactagcgggtcccccatcgtgaaccgggaggggaagatcgtcgggctgtacggcaacggggtggtgacgacctcagggacctatgtcagcgcgatcgcccaggccaaggcctcccaggagggccccctcccagaaatcgaggacgaggtgttccgtaagcgtaacctcaccatcatggaccttcaccctggtagtgggaaaacgcgtcggtacctcccagcgattgttcgcgaggccatcaagcggaagctgcgcaccctgatcctcgccccgacccgcgtagtggcaagtgagatggccgaggcgcttaagggcatgcccatccgttaccagacgacggccgttaaaagcgagcataccggcaaggagatcgtcgatctgatgtgccacgcgacattcaccatgcgcctcctgtcccccgttcgggtgcccaactacaacatgatcatcatggacgaggcccacttcacggacccgagctccatcgccgcgcgcggctacatctcaacaagagtgggcatgggggaggccgccgcaatcttcatgaccgccacgccacccggctccgtagaggccttcccccagagcaatgccgtgattcaggacgaggagcgcgacatcccggagcggtcttggaacagcggatacgagtggatcaccgacttttccggcaagaccgtctggttcgtgcccagtattaagtcaggcaacgacatcgccaactgcctgcgtaagaacgggaagcgggttatccagctgtcacgcaagaccttcgacaccgagtaccagaagacgaagaataacgactgggattatgtagtcactaccgacatatccgagatgggagctaacttccgggcggaccgcgtcatcgacccccgacgctgcctgaagcccgtcattttgaaagacgggcctgagcgggtgatcctcgccggtcccatgcccgtcaccgtggccagtgccgcacagcgccgggggcgcataggccggaaccacaacaaggagggcgaccagtatatttatatgggccagcccctgaacaacgatgaggaccacgcgcactggacagaggcaaagatgcttctggataacatcaataccccggaggggatcatacctgccctgtttgagcctgagcgcgagaagtccgcggccatcgacggggagtatcgcctacgcggcgaggcgaggaaaacctttgttgagctcatgcgtcgcggggacttacccgtatggctgagctacaaggtggccagcgagggattccagtactccgaccgccgttggtgcttcgacggcgagaggaacaaccaggtgcttgaagagaatatggatgtcgagatctggaccaaggagggggaacgcaagaagctgcgtccgcgctggctggacgcccggacgtatagcgaccctctcgccctgcgcgagttcaaggagttcgcggcgggccggaggtccgtgagcggggacctgatcctcgagatcggcaaacttccgcagcatctcacgcaacgggcgcaaaacgccctcgacaaccttgtaatgttacacaactccgagcagggcgggcgtgcctaccggcatgcgatggaggaattgccagacaccatagagaccctgatgctgctcgcactgatcgcagtcctgaccggcggggtgaccctcttctttctgagcggccgcggtctgggcaagacgagcataggcctcctctgcgtgatggccagctctgtcctgctctggatggcgtccgtggagcctcactggatcgcggcatctatcatcctggagttctttctgatggtgctcctgatccccgagcccgaccggcagcgcactcctcaggataaccagctggcctacgttgtgataggattgctgtttatgatcctgaccgtagccgcaaatgagatgggtcttctggagacgaccaagaaagaccttggaatcggccacgtagcggacgagaaccaccaccatgccgccatgctggacgtggatctgcaccccgcgagtgcttggactctgtacgcggtggccaccacgatcataaccccaatgatgcggcacacgatcgagaacaccacagccaacatatctctgaccgcgatcgctaatcaggcggccatcctgatggggttggacaaaggctggccgatctcgaagatggacataggggtccctctcctggccctggggtgctattcccaggtgaacccgctcaccctgacagccgccgttctgatgttagtcgctcactacgctatcatcgggcctggactgcaggcgaaggcaacgagagaggcgcagaagcgcaccgcagcaggcattatgaagaaccccactgtggacgggatagtggccatcgatctggacccggtcgtgtacgacgccaagttcgagaagcagctcggccaaatcatgctgctgattctctgtaccagtcagatcctactgatgcgcacgacctgggcgctctgtgagtccattaccctggctaccggcccgctcacgaccttgtgggagggaagccccggcaagttctggaacaccaccatcgctgtgtccatggccaatatcttccgcgggagctacctggccggcgccggcctggccttcagcctaatgaaatccctcgggggagggcggcgtggaacgggcgcacagggtgagaccctgggcgagaagtggaagcgtcagcttaaccagctgagcaagtccgaatttaacacctacaagcgctcagggatcatggaggttgaccggtctgaggccaaggagggactgaagagaggggagaccacgaagcacgcggtgagccgcggcactgccaagttgcgttggttcgtagagcggaacctggtcaagccggaggggaaggtgatcgacctgggctgcggtagagggggctggtcctactactgcgccggcctgaagaaggtaaccgaggtaaagggatacaccaagggagggccgggtcacgaggaacccatccccatggcaacgtacgggtggaacctcgtcaagctccacagcggcaaggacgtgttctttataccgcctgagaagtgcgacaccctgctttgcgacatcggggagtcgagcccaaacccaaccatcgaggagggccggaccctgcgcgtcctgaagatggtggagccatggctccgggggaaccagttctgtatcaagatcctgaacccctacatgccctccgtagttgagaccttagagcagatgcaacggaagcacggtggtatgctcgtgcggaaccccctgagccgcaactccacccacgagatgtactgggtgagctgcgggaccggcaacatcgtctccgcggttaacatgaccagccggatgttgctcaacagattcaccatggtgcaccgcaagcccacgtacgagcgggacgtcgacctgggggcgggcacccgccacgtggccgtcgagccggaggtcgccaacctggacatcatcggccagcgaatcgagaacatcaagcacgagcacaagtccacctggcactacgacgaggataacccctacaagacctgggcataccacggtagctacgaagtgaagcctagtgggagcgccagttccatggtcaacggggttgtgaagctactgacgaagccctgggacgtcatccccatggtgacccagatcgcgatgaccgacacaactcccttcggtcagcagcgcgtgttcaaggagaaggtggacacacgtactcctaaggccaaacgagggaccgcacagattatggaggtgacggctcggtggctgtggggtttcctcagccgcaacaagaagccccggatatgcacccgcgaggagttcaccaggaaggtcaggtccaacgcagcgatcggcgccgtcttcgtggatgaaaatcagtggaacagcgccaaagaagccgtggaggacgagcggttctgggacctggtccacagggagcgggagctgcacaagcaggggaagtgcgcaacctgcgtgtacaacatgatgggcaagcgcgagaagaagctcggagagttcggcaaggccaagggctcccgggcgatctggtacatgtggctgggcgccaggttcctggagttcgaagcactcggcttcatgaacgaggatcactggttctctcgtgaaaacagtctgtctggggtagagggcgaagggctgcacaagctaggctacatcctgcgtgatatctcaaagatccccggtggcaacatgtacgcggacgacacggccgggtgggacacccggatcaccgaggatgacctgcagaacgaggccaagattaccgatataatggagtcagagcacgccctccttgccaagtccatcttcaagctgacttaccagaacaaggttgtgcgcgttcaacgccccgcgaagaacgggaccgtcatggacgtaatcagccggcgcgaccagcggggctctggccaagttggcacgtacggtctcaacaccttcacgaacatggaggcgcagctgatccgccagatggagtcagaggggatcttctcccccagtgagctcgaaacgccaaacctcgccgagcgggccctggactggctggagaagcacggcgtcgaacgcctcaagcggatggcgatctccggggacgactgcgtggttaagcccatcgacgatcgctttgctactgccttaaccgctctgaatgacatgggcaaagtccggaaagacattccccagtgggagcccagcaagggatggaatgactggcagcaggtcccgttctgtagccaccacttccaccagctcatcatgaaagacggtcgcgaaatcgtggtgccctgcaggaaccaagacgaactggtgggccgcgcccgggtgtcccagggggcggggtggagtttgcgcgagacggcgtgcctcgggaagtcatatgcccaaatgtggcagctgatgtactttcaccggcgcgatctgcggctggcggccaacgctatctgcagcgccgttcccgtggactgggtgcctacaagtcgcaccacctggagcatccacgcccaccaccagtggatgacaacagaggacatgctgtccgtctggaatcgcgtgtggatcgaggagaacccgtggatggaggataagacccacatcagctcctgggaggacgttccctacctaggcaagcgcgaggaccagtggtgcggtagtttgattggcctgaccgcccgcgccacgtgggcaacgaatatacaggtggccatttcccaggtccggcgcctaatcggcaacgagaactacctcgactacatgaccagcatgaagagattcaaaaacgaaagtgaccccgaaggtgctttgtggtga

SEQ ID NO: 24769 - RNA, 9879 nt, synthetic construct
  misc_feature 1..9879: note = derived and/or modified CDS sequence (opt11) from DENV-1__EU359008__SS-prME
  source 1..9879: mol_type = other RNA
tccgtgacgatgctgctcatgctgatgcccaccgccttagccttccacttgaccaccagaggtggggagccccacatgattgtgagcaagcaagagagaggtaagagcctgctgttcaagacctccgccggagtgaacatgtgcaccctcatagccatggacctgggcgagctgtgtgaggacaccttgacctacaagtgcccacggattacggaggccgagcccgacgatgtggactgctggtgcaacgcaaccgatacttgggtcacctacgggacttgtagccagaccggcgagcaccgacgggacaagcggtcggtggccctggcgccccacgtgggtcttgggctcgaaacccgcaccgaaacctggatgagctccgagggtgcctggaagcaaatccagcgggtcgagacctgggcactccgccaccccgggttcaccgtcatcgctctgtttctcgcgcacgctatcggtacaagtatcacacagaaggggatcatcttcatcctgctgatgctcgtgaccccctccatggctatgcggtgcgttggcatcggcagccgagatttcgtggaggggttgagcggggctacttgggtggacgtcgtgcttgagcatggaagctgcgtcactacaatggccaaggacaagcccacccttgacatcgagttgctgaagacggaagtcaccaaccccgcggtgctcagaaagctgtgcatcgaggcgaaaatctccaacaccacaacggattctcgctgcccgacccagggcgaagctaccctggtggaggagcaggatgccaactttgtgtgccggcgtaccttcgttgaccggggctgggggaacggatgcgggcttttcggcaagggctccctgattacgtgcgccaagttcaagtgcgtcacgaagttggagggcaaaatcgtccaatacgagaacctcaagtatagcgtaatcgtgaccgttcacaccggcgaccagcatcaggttgggaacgagtccactgagcacggcaccaccgcgaccatcacaccccaggcccccacaaccgaaatccagctgactgattacggtgcgctgaccctcgactgcagccctaggactggcctggactttaacgaaatggtattgctcacaatgaaggagaagtcctggctggttcataagcaatggtttttagacctcccccttccctggaccagcggggcgtctacgacccaggagacgtggaaccggcaggatctgctcgtgacattcaagacagcccacgcgaaaaagcaggaagtagtggtgctgggctcccaggagggtgcgatgcatacggccctgaccggggccacagaaatccagacctctggtacgaccaccatattcgcagggcacttaaagtgtcgcctcaagatggacaagctgacactcaaaggcatgtcctacgtaatgtgcacgggttcgttcaaacttgagaaagaggtagcggagacccagcacgggaccgtactggtgcagatcaagtacgaaggcaccgacgccccctgcaaaatccccttcctcacgcaggacgagaagggggtcacccaaaacggccggctcatcaccgccaacccgatcgtgaccgacaaggagaagcccgtcaacatcgaggccgaaccgcccttcggcgagagctacatagtaatcggtgctggcgaaaaggctctgaaacttagctggttcaagaaggggtcctcgatcggaaagatgttcgaggcgacggcccgcggggcccgccgcatggcgatcctcggggataccgcctgggatttcgggagtatcggcggagtgttcaccagcgtcgggaaacttgtccaccagatattcggcacggcatacggggtgctattctccggcgtaagctggacgatgaagatcggcatcggcgccctgctcacatggctgggcttaaactctcgcagcacttccctgagcatgacatgcatagcggtggggcttgtgactttgtacttgggcgtcatggtgcaggcggactcggggtgtgtgatcaactggaagggccgggaacttaagtgcggatctggtattttcgtcacgaacgaagttcacacctggactgaacagtacaagttccaggccgactcaccgaagcgcctcagcgccgccattggaaaggcctgggaggagggggtgtgtggcatccggagcgcgacccgcctggaaaacattatgtggaaacagatcagtaacgagctgaaccacatcttgctggaaaacgacatgaagttcacggtagtggtgggggatgtggcgggcatacttgcccaaggcaaaaagatgatccggccccagcccatggaacacaaatactcgtggaagtcctggggcaaggccaagatcataggagcggatgtccaaaacactaccttcatcatcgacgggcccaacacgcctgagtgtcccgacgaccagcgcgcctggaatatttgggaggtagaggactacggatttggaatcttcacgacaaacatttggctaaagttgcgggatagctatacccaggtctgcgaccacagattgatgtccgccgctatcaaggacagcaaggcagtgcatgctgacatgggctactggatcgagtccgagaagaacgaaacttggaagctcgcgcgggcgagcttcattgaggtgaagacgtgcatctggcccaagtcccacaccctgtggagcaacggggtcttggagtccgaaatgatcatccctaagatctacggagggccgatcagccaacacaactaccgccccggatacttcactcagaccgcgggcccatggcacctcgggaagctggaactggacttcgacctatgtgagggcacgactgtggtggtggacgagcactgcggtaatcgggggccgtccctgcgcactaccactgtgacaggcaaaatcattcacgaatggtgctgccgcagctgcaccctaccgccccttcgtttccgcggtgaggatggatgctggtacggtatggagattcgccctgtgaaggaaaaggaggagaacctggtcaagtccatggtgagcgccggatcgggtgaggtagacagcttttccctgggacttctgtgtatctctatcatgatcgaggaggtcatgcggagccgctggtctcggaagatgctcatgacaggtactctagcggtgttctttctgctgatcatgggccaggtgacctggaatgacctcattcgcctttgcatcatggtcggcgccaacgccagcgaccgcatgggtatgggcaccacctacctggccctcatggccacgttcaaaatgcggccgatgttcgcggtcggcctgctgtttcgccgcctcacgtcgcgcgaggtgctgctcctcaccatcgggctgtccctggttgcttccgtagaattaccgaacagcctagaggagctgggtgacgggctcgcaatgggcattatgatcctgaaactgctcactgattttcagtcgcaccagctatgggccacactactcagcctgaccttcatcaagaccacgttttccctacactacgcgtggaagacgatggccatggtcttgtccatcgtgtcccttttccccctttgtctctctaccacctcccagaagaccacatggctgcccgtcctgttagggagcttagggtgcaaaccgctgaccatgtttctcatcgccgagaacaagatctggggcagaaagtcttggcctctaaacgaggggataatggcggtcggcatcgtaagcatcctgctctcgagcttactgaagaacgacgtgcccctcgccgggcccctgatcgccggcggcatgctgatcgcctgctacgtcatcagcgggtccagcgcggacctctccctagagaaggctgccgaggttagctgggaagaggaggcggagcattccggggccagccacaacatcctagtagaggttcaggacgatggcaccatgaaaattaaggacgaggaacgagacgacaccctcacgatcctgctgaaggccactttgctggccgtgagcggtgtgtaccccctgtcgatccccgccaccctgttcgtctggtacttctggcagaagaagaagcagcggtctggggtcctgtgggatactccaagcccgccggaagtagagcgcgcggtccttgacgacggcatctaccggatcatgcagcgcggcctgctcggacggtcacaggtgggcgtaggtgtgttccaggagaatgtatttcacaccatgtggcatgtgacccgcggcgccgtcctgatgtaccaagggaaaaggctggagcccagctgggcctccgtcaagaaggacctcatcagctatggaggcgggtggcgccttcagggctcatggaacaccggggaggaggtacaggtgatcgccgtggagcccggaaagaacccgaagaacgtgcagaccgcacccgggactttcaagacgccggagggtgaggtcggcgcaatcgctctggactttaaacccgggaccagcggcagtcccattgtgaatagagagggaaagatcgtgggactctacggcaacggggtcgtgaccacgagcggcacatacgtgtccgcgatcgcccaggcgaaggcatcacaggaaggaccgctgcccgagatcgaggacgaggtcttccgcaagcggaacctgaccatcatggacctccaccccggaagcgggaagacgcgccggtaccttccagccatcgtgcgcgaagcaatcaagcggaaactgcgcaccctcattctggcccccacgcgcgtggtcgcgtccgagatggctgaggcactgaagggaatgcccattcgctaccagaccacagccgttaagagcgagcacaccggcaaggaaatcgtggatctcatgtgccacgccactttcaccatgcgcctgctgtcccccgtgcgagtgccgaattacaatatgatcataatggacgaggcgcatttcaccgacccctcctccatagccgcccgcgggtatatcagcacacgggtgggcatgggggaggccgcagcgatcttcatgacggccactccacccggctccgtcgaggctttcccccagagcaacgcggcgatacaggacgaggaacgcgacatccccgagcggtcctggaacagcgggtacgagtggataactgatttccccggcaaaaccgtgtggttcgtgccttccatcaagagcggcaacgacatcgccaactgcctgcgcaagaatgggaagcgggtaatccaactgtcccgaaagactttcgacaccgaataccaaaagactaagaacaacgattgggactacgtagtgaccacggacatctctgaaatgggcgccaacttccgggccgaccgtgtcatcgacccgcggcgatgcctgaagccagtcatcctaaaggacgggcctgaacgggtcatcctggccggccctatgccggtcacggtggcatccgccgcccagcgccgggggcgcatcggccggaaccacaacaaggagggcgaccagtacatctacatggggcagcccctgaataacgacgaagaccacgcccattggaccgaggccaagatgttactggataacatcaacacccctgaagggataattcccgcgctgtttgagccggagcgcgagaagtcagccgccatagacggcgaatacaggcttcggggcgaggcccgcaaaacgttcgttgagcttatgcggcgtggggacctaccggtttggctctcctacaaggtcgcgtctgagggcttccagtactccgaccggaggtggtgcttcgacggtgagcggaacaaccaggtccttgaggagaacatggacgttgaaatctggacaaaagagggcgagcgcaagaaactgcgtccccgctggctcgatgcaaggacctacagcgacccgctagccctgcgcgagtttaaggagttcgccgccggcagaaggagcgtgtcgggtgacctcatcctggaaatcggtaagttaccgcagcaccttacgcagcgggctcagaacgctctggacaacctcgtcatgttacataacagcgagcagggcggtagggcctatcggcacgccatggaggaattacctgacacaatcgagacgctgatgttactggccctgattgcggtgctcaccggtggggttaccttgttcttcctgtccggccgcggcctcggcaagacctccattggcctcctatgtgtcatggcctcatcagtactcctctggatggcctccgtggagccgcactggatcgctgccagcatcatcctggagttcttcttgatggtattactgatccccgagccagaccggcagcgcacgccccaagacaaccagctcgcgtatgtagtgattgggttgctgttcatgatactcaccgtcgccgcgaatgaaatgggcctgctggaaaccactaaaaaggaccttggtatcggacacgtggccgtggaaaaccatcaccacgcggcaatgctcgacgtcgacctgcaccccgcatccgcctggacgctctacgccgtggcaaccaccatcatcactccgatgatgagacacacaatcgagaataccaccgcgaacatcagcttaacggccatcgcaaatcaagccgcgatcctcatgggactagacaagggatggcccatctccaaaatggacatcggcgtgcccttattggcattagggtgctactcgcaagtcaaccccctgacgctgaccgccgccgtactcatgctggtggcccactatgctatcattggtccggggctacaggccaaggccacccgggaagcccagaagcgtaccgccgcgggcataatgaagaaccccacggtcgacggtattgtggcaatcgacctcgaccccgtcgtttacgacgctaagttcgagaagcagttgggccagatcatgctgctcatcctgtgcacctcccagatactgctcatgcgcactacatgggccctgtgcgagagcatcactctggccaccggcccccttacgaccctgtgggagggaagcccgggcaaattctggaacacgaccatcgcggtctccatggcaaatattttccgcgggtcctacctggcgggcgctggactcgcgttttctttgatgaagtccctcgggggagggcggcgcgggaccggggcacaaggcgagacactcggagagaagtggaagcggcagcttaaccagctgtcaaagtcagagttcaacacctacaagcgctccggaatcatggaggtggaccggtcagaggccaaggagggcttaaagcgcggggagaccaccaaacatgccgtcagccggggcaccgccaagctccgctggttcgttgagcggaatctggttaagccagaggggaaggtcatcgacctaggctgcggccggggcgggtggagctactattgcgcgggcctcaagaaggttacggaggtgaaggggtacacgaaaggcggcccaggccacgaggagccaatcccgatggcgacttacgggtggaacctggtaaagctgcattccgggaaggacgtgttcttcatcccgcctgagaagtgcgacaccctattatgcgatatcggggagagctcccccaacccgaccatcgaggagggccggacgctgcgcgtactcaagatggttgagccctggctgcgcgggaaccagttctgcatcaagatcttgaacccctacatgcccagcgtcgtagagaccctcgagcagatgcagcgcaagcacggcggtatgctggttcggaacccgttgtctcgcaactcgacccacgaaatgtattgggtgtcgtgtggcaccggcaacattgtcagtgcggtcaacatgacgtcccggatgctcctgaacaggttcaccatggcccaccgcaagcccacttacgagagagacgtggacctcggcgccggcactaggcacgtggcggtcgagcccgaagtggccaacctagacatcatcggacagcggatcgagaacattaaacacgagcacaagtctacgtggcactacgatgaggataatccctacaaaacctgggcatatcacggctcgtatgaggtgaagccgagtggctctgcctcgtctatggtcaacggggtcgtcaagctgctgacgaagccttgggacgttatccccatggtgacccagatcgccatgactgacaccacccccttcggccaacaaagagtatttaaggagaaggtggacacgcggacgccgaaagcgaagcgcgggaccgcgcagattatggaggtgacagcacgctggctctggggctttctaagccgcaacaaaaagccccggatctgtacccgagaggagttcacgcgaaaggtccgctcaaacgccgcgatcggggccgtgttcgtggacgagaaccagtggaactccgccaaggaagccgtagaggacgagcgcttttgggaccttgtgcaccgtgaacgagagctccacaagcaggggaagtgcgcaacctgtgtgtacaacatgatgggcaagcgcgaaaagaaacttggggagttcggcaaggcgaagggcagccgggccatctggtacatgtggcttggcgcccgcttcttagagtttgaagccctcggctttatgaatgaggaccactggttcagcagggaaaatagcctgtccggagtcgagggcgagggactccacaaactgggctacatcctgcgcgacatcagcaagatccccggaggcaacatgtatgccgacgacacagcgggctgggacacccgaatcacggaggacgacctgcagaatgaggccaagatcacagatatcatggagccggagcacgccctattagccaaggccatcttcaagctcacctaccagaacaaggttgtccgcgtccaacgcccggcgaaaaatgggacagtgatggatgtgatcagccggcgagaccagcgaggcagcggtcaagtcggcacgtatggccttaacaccttcaccaatatggaggcgcaactgatacgccaaatggagtccgaggggatctttagcccatccgagcttgagacccccaacctggccgagcgggtgctggactggctagagaagtacggggttgagcgcctgaagcggatggccattagcggggacgactgcgtcgttaagccaatcgacgaccggttcgccacggctcttactgccttaaacgacatgggaaaagtccgaaaggacatcccccagtgggagccctccaaggggtggaacgactggcagcaagtccccttttgctcacaccattttcaccagctaatcatgaaggacggccgcgagatcgtggtaccgtgtcggaaccaggacgagctagtcgggcgagccagagtttcccagggtgccggctggagcctccgcgaaacagcgtgtctggggaagtcatacgctcagatgtggcagctgatgtacttccatcgccgagacctacggctggctgccaacgccatatgtagcgcggttcccgtcgactgggtacccaccagccggacaacatggtcaatccacgcccaccaccagtggatgaccaccgaagacatgctgagcgtgtggaacagagtctggatcgaggaaaacccttggatggaggacaagacgcatatctcctcatgggaggacgtgccatacctcggcaagcgcgaggaccagtggtgcggatccctgatcggcctgactgcccgcgccacgtgggcaaccaatattcaggtcgcgatcaatcaggtccggcgcctaattggcaacgagaactatctggactacatgaccagcatgaagcggttcaagaacgaatccgatcccgagggggctttgtggtga

SEQ ID NO: 24770 - RNA, 9879 nt, synthetic construct
  misc_feature 1..9879: note = derived and/or modified CDS sequence (opt11) from DENV-1__AY835999__SS-prME
  source 1..9879: mol_type = other RNA
agcgtaaccatgctgctgatgctcatgcccaccgccctggccttccatctgaccacgcggggcggggaaccccacatgatcgtgtcaaaacaagagcggggcaagtccctgttgtttaagacgagcgcgggggtgaacatgtgcaccctcatcgctatggacctaggggagctctgcgaagataccatgacttacaagtgcccccggatcaccgaggccgagcctgacgacgtggattgctggtgcaacgctaccgacacctgggtcacctacggtacctgcagccagaccggcgagcaccggcgcgacaagcgctccgtggctctcgcgccccacgtgggtctgggactggagacgcggaccgagacttggatgagctcagagggcgcctggaaacaaatccagcgggtcgagacttgggcgctccgccacccggggttcacggtgatcgccctattcctggcgcatgcgatcggcaccagcatcactcagaaggggataatcttcatactcttgatgcttgtaaccccctccatggccatgcggtgtgtcggtatcggctctcgcgacttcgtggaggggctctccggagccacgtgggttgacgtcgtgctggagcacggtagctgtgtaaccacgatggccaaggacaagcccaccctggacatagaactcctgaagacggaggtcactaatcccgcggtcttacgaaaactatgcatcgaggccaagatatcgaacaccaccacggacagccggtgcccgacccagggcgaggccaccctcgtggaggagcaggatgccaacttcgtctgccggcgaaccttcgttgaccggggctggggtaacggctgcgggttattcggcaaggggagtctgctgacgtgcgcaaagttcaagtgtgtaaccaagttggagggcaagatcgtacagtacgagaacctcaagtatagcgtgatagtgaccgtccacaccggtgaccagcaccaagtagggaacgagtccaccgagcacggcacaaccgcgaccataacgccccaggcccccacgaccgagatccagctgaccgactacggggcgctgacattagattgcagcccccgtacgggtctggatttcaacgagatggtcctgcttaccatgaaagagaagagttggcttgtgcataagcagtggttcctggacctccccttgccctggacgtcaggcgcgtcgacatcacaggaaacgtggaaccggcaggatctgctcgtaacctttaagaccgcccacgccaagaagcaggaggttgtggtgttaggcagccaggagggcgccatgcacactgcccttactggggccacagagatccagacttctggcaccacgacaatttttgccgggcacctcaagtgccgcctgaagatggacaaactgaccctcaaaggcatgagctacgtgatgtgcaccggatccttcaagctagagaaggaagtggcggagacgcagcacggcaccgtgctggtccaaatcaagtacgagggtaccgacgccccctgcaagatcccgttcctgactcaggatgagaagggggtgactcagaacggtaggttgatcacggcgaacccgatagtaactgacaaagagaagccagtcaacatagaggccgaaccacccttcggagaaagctacattgtgatcggcgcgggtgagaaagcgctgaagctatcctggtttaagaaggggagctccatcggcaagatgttcgaggccacagcccgcggggcccggcgcatggcgatacttggagacacggcctgggattttggcagcgtgggcggcgtcttcacctcagtgggcaagctggttcaccagatcttcggcaccgcctacggcgtactgttcagcggcgtatcctggaccatgaagctggggatcggggtgctgctgacgtggctgggcctgaacagccgctccacctccctgtccatgacatgcatcgccgttgggctcgtcactctgtacctaggcgtgatggtccaggccgattcggggtgcgtgattaactggaagggccgggagctcaagtgcggctccggaatcttcgtgacgaatgaagtgcacacctggaccgagcagtacaaattccaggcggacagcccgaaaaggctgagcgccgccatcggtaaggcctgggaggagggggtgtgcggcatccgatccgccacccgcctggagaacattatgtggaaacagattagcaacgaactcaaccacatactgctggagaatgacatgaaattcactgtggtcgtcggggacgtggcgggcatcctcgtccaggggaagaagatgattcggccccagcccatggagtataagtactcctggaaatcctggggcaaggccaagatcatcggcgccgacgtgcagaactccacgttcatcatcgacgggcctaacacccctgagtgtcccgacgatcagcgcgcttggaatatctgggaggttgaagactacggattcgggattttcaccaccaacatctggctgaagttgcgggacagctacacgcaagtctgtgatcaccgactcatgtccgcggccatcaaggactcgaaggccgtgcacgccgacatgggctactggatagaatccgagaagaacgagacctggaagctggcccgtgccagcttcatcgaggtgaagacctgtatctggcccaagagccacaccctgtggagcaacggcgtcctcgagagtgagatgattattcccaagatctacgggggtcccataagccaacacaactaccgccccgggtactttacgcagactgccggtccctggcacctggggaagctggagctagacttcgacctctgtgagggtaccaccgtggtcgttgacgagcactgcggaaacagggggccgtccctgcgcacaaccaccgtaacgggcaagattatccacgagtggtgctgccggagctgcaccctgccgcccctgcgctttagaggggaaaacgggtgctggtacggaatggagattcgccccgtgaaagagaaggaggagaacctggtaaagtccatggtgagtgccggctctggcgaagtggattccttcagcctcgggctcctgtgcatctccataatgatagaagaggtcatgcgtagtaggtggtcccggaagatgctcatgaccggcattctggccgtgttcttccttctcatcatgggtcagctgacctggaatgacctgatccgactctgcattatggttggcgccaacgccagcgacaggatggggatgggcaccacgtaccttgccctgatggcgacgttcaagatgcggccgatgttcgccgtaggacttctgttccgccgtctgacctcccgtgaggtcctcctactgacgatcgggctcagcctggtcgcctccgtggagctgccaaatagcctcgaagaactgggcgacgggctggcgatgggcataatgatcttaaagctactaacggacttccagtctcaccagctctgggccactcttctgagcctcaccttcatcaagaccacgttcagcttacactacgcctggaagaccatggccatggtgctgtcgattgtttcactcttccccctgtgcctgagcaccacctcccagaaaaccacctggctgcccgtgcttttgggcagccttggatgcaagccgctaactatgttcctgatcgccgagaacaagatctggggtcgaaaatcctggcccctgaatgaggggatcatggcggtgggtatcgtatccatcctgttatcatccctcctcaagaacgatgtgcccctagccggcccgctcatcgccggcggcatgctcattgcctgttacgtgattagcggttctagcgcggacctgtccctcgagaaggcagccgaggtgagctgggaggaggaggccgagcactccggagcaagccacaatatcctggtggaggtgcaggacgatggcaccatgaagatcaaggatgaggagcgcgacgacacgctaaccatcctcctgaaggcgaccctgctcgcagtatccggagtgtacccgctttcgattcccgcaacactgttcgtgtggtacttctggcagaagaagaaacagcggtccggggtcctttgggatacccccagcccgcccgaagtggagcgcgcagtgctcgacgacgggatctaccgcatcatgcaacgtggtctgctggggcgttcccaggtcggcgtgggggtgtttcaggagaacgtcttccacacaatgtggcatgtaacccgcggcgcggtgctcatgtaccagggaaagagactggagccctcatgggcgtccgtcaagaaagatctgatctcttacggcggcgggtggcgcctacagggctcctggaataccggggaagaagtccaggtgattgcggtcgagcccggcaaaaaccccaagaacgtccagaccgcccccggcactttcaagactcccgagggcgaagtaggcgcaatcgccttagacttcaagcccgggaccagcggctcacccatcgtcaaccgggaggggaagatcgtgggcctttacggcaatggggtagttaccacaagcggcacatacgtgagcgcgatagcccagaccaaggcctcgcaggaggggccgctccctgagatcgaagacgaggtgttccgcaagcggaacctgaccattatggacctgcaccccggcagcgggaagacgcgcagatacctcccggccatcgttcgcgaggcgatcaagcggaagctgcgcaccctgattctcgctccgacccgggtggtggcttcggagatggcggaagccttaaagggcatgccaattcgttaccagaccacggcggttaagagcgagcacactggcaaggagattgtggacctcatgtgccatgccaccttcacgatgagactcctgtcacccgtgcgggtaccgaactacaacatgataatcatggacgaagcccactttacggaccccagctcgatcgctgcccgaggatacataagcacccgggtgggcatgggagaggcggccgccattttcatgaccgccacaccgcccggctccatggaggccttcccgcagagcaacgcggtgatccaggacgaggagcgcgacattcccgagagaagctggaacagcgggtacgagtggattacggatttccccggcaagaccgtctggttcgtgccctccatcaaggccggcaacgatatcgcgaactgcctgcgcaagaacgggaagagagtgatccagttaagcaggaagaccttcgataccgagtatcagaagacgaaaaacaacgattgggactacgttgtgactaccgacatctcggagatgggagctaacttcagggcggaccgggttatcgatccgcggcgctgcttgaagcccgtcatactgaaggacggtcctgagcgtgtgatcttagcgggccccatgccggtcaccgtagcgagcgccgcccagcggcgggggcgcatcggccgaaaccacaacaaagagggcgatcaatacatctacatggggcagcctttaaacaacgacgaggatcacgcgcactggacggaggccaagatgctgctcgataacatcaacacacccgagggcatcatccccgccctgttcgagccggagcgcgagaagtccgccgccatagacggggagtaccgactccggggcgaggcgcgcaagacgttcgtggaactcatgcggcgcggggacctgcccgtctggctcagctacaaagtggcatccgagggcttccagtacagcgatcggcgctggtgcttcgatggcgagcggaacaaccaggtgctcgaggagaacatggacgtggaaatctggaccaaggagggggagcgtaagaagctgcgcccacgctggctggacgcccggacgtacagcgaccccctggctctaagagagttcaaggagttcgccgcaggcagacgctccgttagcggggatcttatcctcgagatcggcaagctgccacagcacctgacccagcgagctcaaaacgccctcgataacctggtaatgctgcacaactccgagcagggtgggcgcgcctatcggcacgcgatggaggagctccccgacactatcgagaccctgatgctgcttgccctcatcgcggtcctgacgggcggggtgacgctctttttcctgagcggcaagggattgggcaaaacctccatcggcctcctgtgcgtgatggcctcgtccgtccttctctggatggcctcggtggaaccgcattggatcgcggcatccattattttagagttctttttgatggtgctccttattcccgaaccggatcgccagcggacaccccaggacaatcagctggcctacgtcgtgatcgggttgctttttatgatcctgaccgtagccgccaatgagatgggcctccttgagacgactaagaaggacctggggatcggccacgtcgcggtggaaaaccaccaccacgctgccatgctcgatgtcgacctgcacccggctagcgcctggaccttatatgctgtcgccaccacgatcatcaccccgatgatgcgccacaccatcgagaataccacggccaacatttccctgacagccatagccaatcaagcggcaatcctcatggggttagacaagggctggcccatcagcaaaatggacatcggagtgccgctcctggctctggggtgctactcccaggtgaatcccctcaccctgacagccgcgctgctcatgctggtcgcccactatgccatcatcggtccggggctacaggcgaaggccacacgcgaggcgcagaagcgcaccgccgccgggattatgaagaaccccaccatcgacggaattgtggcaattgacctcgacccggtggtgtacgacgccaagttcgaaaagcaactgggccagatcatgctgctcattctgtgtaccagccagatcctgttgatgcgcacgacatgggcgctgtgcgagtcgatcaccctggccaccggacccctcacaactctgtgggaagggtctccgggcaagttctggaacaccacgatcgccgtctccatggcaaatatcttccgggggagctacttagccggagcgggcctcgccttctcgctgatgaaatccctcgggggaggccgccgtggtaccggcgcccagggcgagaccttaggcgagaagtggaagcggcagttaaaccagctgagcaagagtgagttcaacacctataagcggtcaggaataatggaggtggaccggagtgaagcaaaggaagggctaaagcgcggtgaaaccacgaagcatgcggtcagccgcggcaccgccaaactccggtggttcgtggagcgcaacctggtgaaacctgaggggaaggtcatcgacctgggttgcggccgcggaggctggtcgtattactgcgccggcctcaaaaaggtgaccgaagtaaaggggtacaccaaaggcggtcccggccacgaggagcccatcccgatggctacgtacggatggaacttagtcaaacttcacagcgggaaagacgtgttcttcatcccgcccgagaaatgcgacaccctcctgtgcgacattggggagtccagccccaatccgaccattgaggagggacgcaccctgcgggtgctcaagatggttgagccttggctgcgcgggaaccaattttgcatcaagattctgaacccctacatgccctccgtggtggagactctcgagcagatgcagcgcaagcacggcggcatgctggtgcgcaacccgctgtcacggaactccacccacgagatgtactgggtgtcgtgcggcaccgggaacatcgtgtccgccgtcaacatgaccagccgcatgttacttaacagattcactatggcgcaccgcaagcccacttacgagagggacgttgacctgggggccggcacacggcacgtggcagtcgagccagaggtggctaacctcgacatcataggccaacgcatcgagaacataaagcacgagcacaagtccacctggcactacgacgaggataacccttacaagacctgggcctaccatgggagctacgaagtgaagccttccggcagtgcctcctcgatggtgaacggggtggtcaaactgctgacaaagccatgggacgtcataccaatggtaacacagatcgccatgaccgatacgacgcccttcggccagcagcgggtcttcaaggagaaagtagacacgcgcacccccaaggccaagcgggggactgcgcaaatcatggaggtgactgctaggtggctgtgggggttcctgagccggaacaagaagccccgcatctgcacccgggaggagttcacacgcaaagtacggtccaacgccgctataggagccgtgttcgttgacgaaaaccagtggaatagcgccaaggaagcggtggaggatgaccggttctgggatctggttcaccgggagcgcgaattgcacaagcaagggaaatgcgctacgtgcgtgtacaacatgatgggcaagagagagaagaaattaggggagttcggtaaagccaaggggtcccgagcaatctggtacatgtggctgggcgctcgcttcctcgagttcgaagcacttggcttcatgaacgaggaccactggttcagccgcgaaaactcgctaagcggggtcgagggcgaggggctacacaagctagggtatatcctgcgggacatctccaaaatccccgggggtaacatgtatgccgacgacacggccggatgggacaccaggatcaccgaggacgacctccagaacgaggccaaaatcaccgacatcatggagccggagcatgcccagctggcaaagagcatctttaagctgacgtatcagaacaaggtggtgcgggtccagcgcccagccaagaacgggaccgtgatggacgtgatatcccgccgggaccagcgcggaagcgggcaggtcggtacctacggcctcaacaccttcacgaatatggaggcccaactgattcgccaaatggagtccgaagggatcttcagccccaacgagctggaaacacccaacctcgccgagcgagtgcttgattggctcgagaaatacggcgtcgagcgcctcaagaggatggcgatctccggggacgactgcgtagttaagcccatcgacgaccggttcgcgaccgcgctaacggcccttaacgacatgggaaaagtgcgcaaggacatcccccagtgggagcccagcaaggggtggaatgactggcaacaggtccccttctgctcccaccacttccaccagctcatcatgaaggatggccgggagatcgtggtgccttgccgcaaccaggatgagctggttggccgcgcccgtgtgagtcagggagctggctggtccctacgggagacggcttgtctcggcaagagctatgcccagatgtggcagctgatgtatttccacaggagggacctgcgcctcgccgccaacgcgatatgcagcgccgtgcccgtggattgggtccctacttcccggaccacctggagcatacacgcccatcaccaatggatgacgaccgaggacatgctgagcgtctggaaccgcgtgtggattgaggagaacccgtggatggaggacaaaacgcgaatctcgtcctgggaggatgtgccgtacctggggaagcgcgaggaccagtggtgcggaagcctcatcggcctgacggccagagctacgtgggcgaccaacatccaggtggccatcaaccaggtccggagacttatcgggaacgagaattattccgactacatgactagcatgaagcggttcaagaacgagtccgaacccgagggggcgctttggtga

SEQ ID NO: 24771 - RNA, 9879 nt, synthetic construct
  misc_feature 1..9879: note = derived and/or modified CDS sequence (opt11) from DENV-1__KP686070__SS-prME
  source 1..9879: mol_type = other RNA
agcgtgaccatgctgctcatgctcttgcccacagccctagccttccacctgaccactcggggcggggagccccacatgatagtgagtaagcaggaacggggcaagagcctcctgtttaaaacgagtgcgggagttaacatgtgcaccctgattgccatggacctgggtgagttgtgcgaagatacgatgacctacaagtgcccgcggatcactgaagccgagccggacgatgtggattgctggtgcaacgccaccgacacctgggtgacctacgggacctgcagccagaccggcgaacatcggcgcgataagcggagcgttgctctggccccccacgtcggccttgggctagagacccgcaccgagacttggatgagctccgagggcgcgtggcggcagatccagaaggtggagacctgggcgctgcggcacccggggtttacggtgatcgccctgttcctcgcgcacgccatcggcactagcatcacccagaaaggtatcatcttcattctactgatgttggtgaccccatccatggccatgcggtgtgtcgggatcgggaatcgcgatttcgtggaagggttgtctggagcgacctgggtggacgtcgtgttggagcacgggtcctgcgtgacaacaatggccaaaaacaagcccaccctcgacatagagctgctgaagacagaggttaccaaccccgcggtgctccggaagctatgcatcgaggcgaagatcagcaacaccaccacagactcccgctgtcccacccagggcgaagcgaccctcgtagaagagcaagacgccaatttcgtctgccggcgcacattcgtggaccggggctgggggaacggctgcggcctcttcggcaaggggagcctgctgacgtgtgccaagttcaagtgcgtaaccaagctcgagggcaagattgtccagtacgaaaacctgaagtactccgtgatcgtgaccgtccacaccggagaccagcaccaggtagggaacgagacgaccgagcacggcaccatcgcgactattactccccaggctccgacgagcgagatccagctgaccgactacggtgctctcaccctggactgcagcccgcggaccggtctcgacttcaatgagatggtactcctgacaatgaaggagaagtcctggctggtccacaagcagtggttcctcgaccttccgcttccctggacatccggggcgtccacatctcaagagacctggaaccgtcaggacctcctggtgacgttcaaaaccgcccatgcgaagaagcaggaggtcgtggtactgggctcccaggaaggcgccatgcacaccgccctcaccggggccacggaaatccagacctctggcaccactacgatcttcgctgggcacctgaagtgccgtctgaagatggacaaactcacgctgaagggcgtgtcttatgtgatgtgcaccgggagcttcaaactggagaaggaagtggcggagacccagcacggcactgtacttgtgcaggtgaagtacgagggcacggacgcaccttgcaagatccccatctccacacaggatgagaagggcgtcacccagaatggacggctcatcacggccaacccaatcgtgacggataaggagaagcccgtgaacatcgagaccgagccgccgttcggggagagctacattgtcatcggcgcaggcgagaaggcgctgaagctgtcatggttcaagaaggggagctccatcggcaagatgttcgaggccacagccaggggtgctcggcgcatggccatcctcggcgacactgcgtgggacttcgggtcaattggcggtgtgttcacatccgtggggaagctggtccaccaggtgttcggcaccgcgtatggggtgctgtttagcggcgtgtcctggaccatgaagatcgggatcggcatcctcctgacgtggctgggcctcaatagccgcagcaccagcctgtccatgacctgtatcgccgtggggatggtaaccctatacctcggcgttatggtgcaagccgatagcgggtgcgtgataaattggaaggggcgggaactgaagtgcgggtccgggatattcgtaacgaacgaggtgcacacctggaccgagcagtacaagttccaggccgacagtccaaagcgcttgagcgcggcgatcggcaaagcctgggaagaaggtgtgtgcggcatcaggtccgcgactagacttgagaacatcatgtggaagcagatcagcaacgagctgaaccatattctgctcgagaacgatatgaaattcaccgttgtggtcggtgacgccaacgggatcttgacgcagggtaagaaaatgatccggccccagcccatggagcacaagtactcctggaagtcgtggggcaaggcgaagatcataggcgctgacactcagaacactaccttcattatcgatggtcccgacacgcccgagtgccccgacgatcagcgcgcatggaacatctgggaggtcgaagactacggcttcggggtgttcaccacgaacatctggttgaaattgcgggacagttatacccagatgtgcgatcaccgcctcatgagcgctgcgataaaggactccaaggccgtgcacgccgacatgggatactggatcgagagcgagaaaaacgaaacctggaagctagcccgggcctcctttatagaggttaagacctgcatctggccccgcagccacaccctctggtccaacggcgtgctggaaagcgagatgatcatacccaagatctacggaggcccgatcagccagcataactaccggccagggtatttcacccagacggcggggccctggcatctggggaagctcgagttagacttcaacctttgcgaaggcaccaccgtggtagtggacgaacactgcggcaaccgcgggccctcactccgcactaccaccgtgaccggcaagataatccacgagtggtgctgccgatcatgtaccctaccgccccttcggttccgcggggaggacggctgctggtacgggatggagatccgtcccgtaaaggagaaggaggagaacttggtgcgcagcatggtgtccgccggaagcggagaggttgacagcttctccttgggtttactctgcgtgagcatcatgatagaggaggtgatgaggagccgctggtcacgcaagatgctgatgacgggcaccctggccgtcttcttccttctgatcatggggcagctaacctggaacgacctcatccggctttgtatcatggttggcgctaacgtcagcgaccgcatggggatgggcaccacgtacctggccctcatggcgacattcaagatgcggcctatgttcgccgttggtctgctgttcaggcggcttacatcaagggaggtcctcctgctcacgattgggctctctctggtcgcctcggtggaactcccaaatagtcttgaggagcttggcgacgggctcgccatgggcataatgatgctgaagctgctcacggatttccagtctcaccagctgtggactaccctgctctcgctgaccttcataaagacgaccctgtcgctagactacgcctggaaaaccatggcgatggtgctatcgatcgtcagcctgttccccctctgcttgtccactacgagccagaagacgacctggctgccggtgctcctgggctcctttggttgcaagccgctgacgatgtttctcatcaccgaaaacaagatctggggccgcaagagctggccgctgaacgaaggcataatggccgtgggcatcgtttcgatcctgctgtcaagcctcctgaaaaacgacgtgcccctcgcgggaccccttatcgccggcggcatgctgatcgcgtgctacgtgatcagtgggagcagtgctgacctgagcctggagcgcgcagccgaggtctcctgggaggaagaagccgaacatagcggcgcttcccacaacatcctcgtggaggtgcaggacgacgggacgatgaagatcaaggacgaggagcgggacgacaccctcacaatcctgctgaaggcaactctcctggccgtgagcggggtgtacccgatgtccatccccgccactctatttgtttggtacttttggcagaaaaagaaacagcgcagcggcgtcctgtgggacaccccaagtccccccgaggtggagcgggccgtgctggacgacggaatctatcgcattctgcagcggggtctgcttgggagaagccaggttggcgtgggggtgtttcaagacggagtctttcacaccatgtggcacgtgacccgcggggcggttctaatgtaccaagggaagcgcctggaaccatcctgggccagtgtcaagaaggacttaatctcctacggcgggggctggagattccaggggtcctggaacacgggcgaggaggtccaggtaatcgctgtcgagcccgggaaaaaccccaagaacgtacagacgacacccggcacctttaagacgcccgaaggcgaggtgggtgcaatcgccctggacttcaagcccggcacctccgggagtcccatcgtcaatcgcgagggcaagatcgtgggcctctacgggaacggcgtggtcaccaccagtgggacgtatgtaagcgcgatcgcccaggctaaggccagccaagagggcccgctccccgagatcgaagacgaagtgttcaagaagcggaatctgaccatcatggacctgcatcctgggtccgggaagacacgccgctatctccccgctatcgtccgcgaagcaatcaagcgcaagctgcgaacccttatcctagccccaaccagagtggtggcaagcgagatggccgaggcgctgaagggcatgcccatacggtaccagactaccgccgtcaaatccgagcacaccgggaaagagatcgtggacctgatgtgtcatgccacttttaccatgcgcctgctgagcccggtacgggtcccgaattacaacatgataatcatggatgaagcgcacttcactgaccccgcctccatcgcggcccgcgggtacattagtacccgggtggggatgggcgaggctgccgcgatcttcatgacggcgacgccgccggggtccgtggaggccttcccacagagcaacgccgtcatccaggatgaggagcgcgatatcccggagcggtcctggaactccggctacgactggattaccgatttccccggcaagaccgtgtggttcgtgccctccataaaaagcgggaacgacatcgccaattgcctgcgcaaaaacggcaagcgggtcatccagttgtcccgcaagacgttcgacaccgagtaccagaagaccaagaacaacgactgggactacgtggtgaccactgacatctcggagatgggggcgaacttccgggcggaccgcgtcatcgacccacggcgctgcctgaagcccgttatcctgaaggacggccccgagagagtcatcctcgcaggtcccatgccggtgaccgccgcctccgccgcccagcgccggggccgcatcggccggaatcagaataaggagggggaccaatacatctacatgggccagcccctgaacaacgacgaggaccatgcacactggaccgaggctaaaatgttactcgataacatcaacacccccgaggggatcatccccgccctatttgagccggagcgggagaaatccgcagcgatcgacggggagtaccgcctgcgcggggaggcccgcaaaacgttcgtggagctcatgcggcgcggcgacctgcccgtctggctgtcctacaaggtggcaagcgagggattccagtactccgatcggagatggtgttttgacggtgagcggaacaaccaggtgctcgaggagaacatggacgtcgagatctggaccaaggagggcgagcgcaagaagctgcggccgcgctggctggacgcccgcacctacagtgacccgcttgcgctgcgcgagttcaaagaattcgccgccggaaggcgcagcgtgtccggcgacttaatcctcgagatcggcaagcttccacagcacttaacactccgggcccagaatgccctggacaatctggtaatgcttcacaacagcgagcaaggcgggaaggcatatcgccacgcgatggaagaactgcccgacacaatcgaaacgctgatgctcctggccttaatagccgtcctgaccgggggcgtgactctgttcttcctctccgggaaaggcctcggcaagaccagcataggactgttatgcgtcatggcgtcctctgtcctcctatggatggcatccgtggagccccactggatagccgccagcatcatactggagttctttctcatggttctgctgatccccgagccggaccggcagagaactccccaggacaaccagctagcctacgtcgtaatcggcttgctgttcatgatactcaccgtcgcggcaaacgagatggggctgctggagacaaccaaaaaagatttaggcatcggtcacgtcgtggcggaaaatcaccatcacgcgacgatgctggacatcgatctgcaccctgcctccgcctggaccctctacgccgtggcaaccactatcatcacgccgatgatgcggcacaccatcgagaacacaacggccaacatcagcctcaccgccatcgcaaaccaggcagccatcctgatgggactcgataagggctggcccatctccaagatggacatcggggtccccctgctggcactcggctgctacagccaggtgaaccccctaaccctgaccgccgcggtgtccatgttagtcgcccattacgccatcatagggccgggactgcaggccaaggcgacccgcgaggcccagaagcgcacggccgccgggattatgaagaaccccacagtggacggcatcgtggcaatcgacctggacccggtcgtatacgatgctaagttcgagaagcagttgggccagattatgctgctgatcttgtgcacctcacaaatcctgctaatgcggaccacctgggctctctgcgagtccatcacactggccaccgggcctctgacaacgctctgggagggatcgccggggaaattctggaacaccaccatcgccgtgtcgatggccaacatcttccgcggcagctacctggcgggcgccgggttggctttttccctcatgaagtccctgggcggcggccggcgcggaaccggcgcccagggcgaaacgctgggggagaaatggaagcggcagctcaatcaattaagcaaaagtgaatttaatacatacaagcgcagcggtatcatggaggtcgaccggtccgaggccaaggaggggcttaagaggggcgagaccaccaagcatgcggtcagtcgggggacggccaagctgcgctggttcgtagagagaaacttagttaaacccgagggcaaggtaatcgacctgggctgcggacggggcgggtggtcctactactgcgccggcctgaagaaagttaccgaggtcaaggggtacacaaagggcggcccggggcatgaggaacccatcccgatggccacctacggctggaacatagtaaagctccacagcgggcgggacgtgtttttcacgccgcccgagaagtgcgacacgttgctgtgtgatatcggggagtccagccccaacccgacaatcgaggaagggcgcactctccgggtacttaagatggttgagccctggctgcgcggcaaccagttctgcatcaagatcctcaatccctacatgccttcggtggtcgaaacgctggagcagatgcagcggaagcatggcggcatgctggtgcggaacccgctctcgcggaacagcactcacgaaatgtattgggtgagctgtggcaccgggaacatcgtgtccgcagttaatatgaccagccgcatgctcctgaacagattcaccatggctcaccggaagcccacctacgagcgggacgttgacctcggcgccggcacccggcacgtcgccgtcgagcccgagatcgccaacctggacatcatcggtcaacgcatcgagaatatcaagaatgagcacaagagcacttggcactatgacgaagacaacccatataagacctgggcgtaccacggcagctacgaggtgaagccgtccgggagcgcgtcctctatggtcaacggcgtggttcggctgctcacgaagccctgggacgttatccccatggtgacacagatcgccatgaccgatacaacgccctttggacagcagcgcgtcttcaaggagaaggtcgacacccggactccccgacccaaacggggtaccgcgcagataatggaggtgacggcgaagtggctgtggggattcctgagccgaaacaagaagccccggatctgcacccgcgaggagttcacgcgaaaggtccgctccaacgcggcgattggggcggtgttcgtggacgagaaccagtggaacagtgccaaggaagccgtcgaggatgagcggttttgggatctcgtccaccgcgagcgggagctgcataagcagggcaagtgcgcgacatgcgtctacaacatgatgggcaagcgcgaaaagaagttaggcgagttcgggaaagccaagggctcccgggccatatggtacatgtggctcggcgcccgcttcctggagttcgaagcgttgggatttatgaacgaggaccactggtttagccgggagaactccctctccggagtcgagggtgagggcctgcacaagcttgggtacattctccgcgacatatccaagattccgggcggaaacatgtacgcagacgacacggccgggtgggatacccgcatcaccgaagacgatctgcaaaacgaggccaagatcacggacatcatggagcccgaacacgcccttctcgcgacgtcaatattcaaactgacttatcagaacaaggtcgtgcgggtccagcgccccgccaagtccggtaccgtgatggacgtgatcagccgtcgcgaccagcgagggagcgggcaggtgggcacctacgggttaaacacgttcaccaacatggaggtgcagctcatccgccagatggagtccgagggcattttctcaccgtctgagctcgagaactccaacctcgccgagcgggtgctcgactggctggagaaacacggggtagagcgcctgaagcggatggccatcagcggcgacgactgcgtggtgaaaccgaccgacgaccgattcgccaccgcattaacggccctgaacgacatggggaaggtccggaaggacatcccacagtgggagccctccaagggctggaacgactggcagcaagtcccattctgcagccaccacttccaccagctgataatgaaggacggccgcgagatagtcgtcccctgccggaaccaggacgagctcgtggggcgcgcccgggtaagccagggcgccgggtggtccctgcgcgaaaccgcctgcctcggaaagagctacgcgcagatgtggcagctcatgtactttcaccggagagacttgcggctggccgccaacgccatatgctcagccgtcccagtgaactgggttcccaccagccgcaccacctggtcaatacacgcacaccaccagtggatgacaacagaggatatgctcagcgtatggaaccgcgtgtggattgaggagaatccttggatggaggataagactcacgtgtctagctgggaggatgtcccttacctgggcaagcgggaggaccaatggtgcgggtcccttattggcctcaccgcccgagccacgtgggcaaccaatattcaagtggcgataaaccaggttcggaggttgatcgggaacgagaactacttggactacatgaccagcatgaaacggttcaagaacgaatccgaccccgagggcgctctctggtga

SEQ ID NO: 24772 - RNA, 9876 nt, synthetic construct
  misc_feature 1..9876: note = derived and/or modified CDS sequence (opt11) from DENV-1__KF672760__SS-prME
  source 1..9876: mol_type = other RNA
tcggtcacaatgctactcatgcttctgcccacagcgttggcgtttcacctcacgacccgcggaggcgaaccccacatgatcgtatcgaaacaagaacggggaaaatccttgctattcaaaacaagcgcaggagtgaacatgtgcacgctaatagccatggacctcggcgaactttgcgaagacaccatgacgtataaatgtccacgaataacggaagccgaacccgacgacgtcgactgttggtgtaacgccacggatacttgggtaacctacggaacatgctcacagacgggtgaacaccgcagggagaaaagaagcgtggcactagctccccacgtgggcctaggactagaaacacgcacagaaacctggatgagttcagagggagcatggaaacagatccaaagggttgagacgtgggctctccgacacccggggtttacggtaatcgccttcttcctcgcacatgcgattggcacaagcattactcaaaaaggcatcatcttcatcttactaatgttagtaactccctcaatggccatgcgctgcgttgggataggcaaccgagacttcgttgagggactgtcgggcgcgacctgggtggacgtggttctcgagcacggatcttgcgtaacgactatggctaaaaataaaccgaccctagatattgagctactgaagaccgaagtaaccaacccagccgtcctacgcaaactgtgtatagaagcaaaaatctccaacacaacgacagacagccgctgcccgacacaaggggaagctacgctagtcgaggagcaagatgctaacttcgtctgcagaaggacctttgtggacagaggatggggaaatgggtgcgggctattcggcaaaggaagcctgctaacctgtgcaaaatttaagtgtgttaccaaactggaaggaaaaatagtccagtacgagaatttgaaatactccgtaattgtaactgtgcacacgggtgaccagcaccaagtgggtaacgaaacaacagagcacggcacgatagcaactatcacgccgcaggcgccaacgtcagaaatccagctaacagactatggggccctcacactcgactgttcccccagaaccggccttgatttcaatgaaatggtccttttaacaatgaaagagaaaagttggctagtccacaaacaatggttcctggacctaccgctaccctggacttcaggagcgtcgaccagccaggaaacctggaaccggcaggacttactcgtcaccttcaaaacagcacacgccaagaaacaagaggtagtggtcttaggatcgcaggagggggccatgcacacggccctaacaggagccaccgaaatccagacttcagggacaaccaccattttcgcggggcatctgaagtgccgcctaaaaatggacaaacttactttgaagggcatgagctacgtaatgtgcactggcagcttcaagctagaaaaagaggtcgcggaaacccaacacggcactgtgcttgtccaggtaaaatacgaagggaccgacgcgccatgcaaaatacccttctcgacacaagacgaaaagggagtgacacaaaacggccgcctaataaccgcaaaccccatagttacagataaagaaaaacccgtgaacatagagaccgaacccccattcggtgagagctacatcgtggtcggagccggggaaaaggcactgaaactatcatggttcaaacgggggagcagcataggcaaaatgtttgaggccaccgctagaggcgccaggcgcatggcaatacttggtgacaccgcctgggacttcggctcgatcggcggagtgttcactagcgtcggaaaactcgtacaccaggtgttcggcacagcatacggcgtcctattctcaggcgtctcttggacaatgaaaataggaataggcatcctattaacatggctgggactaaactcccgttcaacgtccctcagcatgacgtgcattgcggtgggaatggtcaccttgtatctaggcgtaatggttcaggctgacagtggctgcgtgattaattggaaaggacgggaactgaaatgtggatctggaatctttgttacaaatgaagtccatacatggacggaacaatataagtttcaagccgacagcccaaaacgcctaagtgcagccatcgggaaggcttgggaggagggggtgtgcggaatccgcagcgcgacaaggcttgagaacatcatgtggaagcaaataagcaatgaactcaaccacatacttctcgagaacgacatgaaattcacagtagtagtgggagacgcgaacggcatcctggcgcaggggaagaaaatgataagaccccaaccaatggagcacaaatactcctggaaaagctggggcaaggccaagatcataggggcagacatacaaaacaccaccttcatcatagacgggcccgacaccccagaatgccccgatggccagcgtgcctggaacatatgggaagtagaggactatggcttcggagtgttcaccactaacatatggctgaaactgcgagactcctacactcagatgtgtgaccataggctcatgagcgctgcaattaaagattcaaaagcagtccatgcggatatggggtactggatcgaatccgaaaagaatgaaacgtggaaattggcacgtgccagctttatcgaggtaaagacatgcacctggccgaaatcgcatactctctggtctaacggcgtactggagagcgaaatgatcataccgaagatattcggcggcccaatttcacaacacaactaccgtccaggctacttcacgcaaacagcagggccatggcacctggggaagctggaactggacttcgacctctgtgaggggacaaccgttgttgtagacgaacactgcgggaatagaggaccgtcactaagaacgactaccgttacaggcaagataatccacgagtggtgttgccgaagctgtacactgcctcctcttagattcagaggcgaggacggctgctggtatggaatggagattaggcccgtcaaagaaaaggaggagaatttagttaggtccatggtaagcgccggctcaggagaggttgattcgttcagcctaggaatcctatgcgtgtcaatgatgatcgaagaggtcatgcgctccagatggagtaggaaaatgctgatgacagggaccctcgcagtctttctactacttattatgggacaactcacctggaacgacttgatccgattgtgtatcatggtgggcgcaaacgctagtgataggatggggatggggaccacatatctggctcttatggccacgtttaaaatgcgcccgatgttcgccgttggactactcttccggagactcacaagtcgagaagtcctactactaacaataggcctaagcctagtcgcatgcgtagaattaccgaacagcctagaagaactcggagacggactagccatgggaatcatgatgctaaaactcctgacggaatttcaaccccaccagttgtggacgaccctgctctccctaaccttcgtaaagaccaccctctccctcgactacgcgtggaaaaccacagctatggtactgtcaatcgtcagtctattccctctatgcctcagtacaaccagccagaaaaccacctggctgccagtgcttctgggctcattcggatgcaaaccactcaccatgtttctgataacggaaaacaagatatggggacgcaaaagttggccactgaatgaagggataatggcgatcggcatcgtaagcattcttctctcatccctgcttaaaaacgacgtgccactggccggacccctcatagctggtggaatgttaatcgcctgctacgtgatcagcggttcgagtgcagatctaagtcttgagaaagcggcggaggtctcatgggaacaggaagcggaacacagcggggcatcgcacaacatattagtagaggtccaagacgacggaacaatgaagatcaaggacgaagaacgagacgatacgctgacgattctcctaaaggcaaccttgctggccgtatcgggagtctaccccatgagtattcccgcgaccctattcgtttggtacttctggcagaagaagaaacagcggtccggagtattatgggataccccaagccctcctgaggtcgaaagggcggtcctagatgacgggatatatcgtattcttcaacgcggcttactaggtagaagtcaagtgggggtcggagtatttcaggacggtgtcttccatacaatgtggcatgtaaccagaggcgcagtcttgatgtaccaggggaaaagactcgaacccagctgggcaagcgtaaagaaggacctgatatcctacggaggaggatggagatttcagggttcttggaatacgggcgaagaagtccaagtcatcgccgtagaacccggcaaaaacccgaaaaacgtacaaaccacacccggcaccttcaaaacacccgaaggcgaggttggagcgattgcgctggactttaaacccggcaccagtggctcaccgatagtaaaccgagaaggaaaaatagtcgggctctacggcaacggtgtcgtaaccacctcggggacgtacgtttcggcaatcgcccaggccaaagcctcgcaagaggggcctcttccggaaatcgaagacgaagtattcaagaaacgaaacctgaccatcatggatctgcacccaggcagcggaaaaacacgacgatacctcccagccatagtccgggaagcaataaaacgaaaactacgcactttgatactggccccaacacgggtcgtggcaagtgaaatggccgaggcattaaaggggatgccaattagataccaaacaacagccgtaaaatctgaacacaccggtcgcgagatcgtcgatctaatgtgccacgcaacgttcaccatgcgactcctttcgccagtacgtgtaccaaactataatatgataatcatggacgaagcgcacttcacggaccccgcgagcattgcggccaggggatacatatcgacaagagtcgggatgggagaagctgcagccatcttcatgaccgccacaccgcccgggtcagtagaagcattcccccaaagcaacgcggtgatacaagacgaagaaagggatatccctgagcggagctggaactccggctacgactggataaccgactttcctggcaaaaccgtctggtttgtaccctcaataaaatcaggcaatgacatcgcaaactgcctccggaagaacggaaaacgggttattcagctgtcgaggaaaaccttcgatactgagtaccagaagactaaaaacaacgattgggattacgtcgttaccacggacataagcgaaatgggggccaacttccgcgcggatagggtcatagacccacgccggtgccttaagcccgtgatccttaaagacggaccggagcgagtaatattagcaggacctatgcccgtcacagtagcatcagctgctcaacgccgcggacgaataggcagaaaccagaataaggaaggggaccagtacgtctacatgggacaaccattaaacaacgacgaggaccacgcacactggacggaggcgaagatgctgctcgacaacatcaatacaccagaggggatcatccccgcgctgttcgaaccagaaagggaaaaatcagcagccatagacggcgaatacagactgcggggcgaagcccgaaagacattcgtagaactaatgcggaggggagaccttcctgtgtggctctcttacaaggtagcaagtgaaggcttccagtacagcgacagaaggtggtgcttcgacggagaaaggaacaaccaggtccttgaagaaaatatggatgtagagatatggaccaaagaaggcgaacgcaagaaactccgccccagatggctcgatgcccgaacatactcagaccctcttgcactgcgagagttcaaggaatttgccgcagggagacgctccgtgtcgggcgatctaatcctagagatagggaagctcccccaacacctgacactacgagcccagaatgccctcgacaacctagtgatgctacacaacagcgaacaaggagggaaggcatacagacacgccatggaggagctaccagacacaatagaaacactcatgcttttagccttaattgcggtactaaccggtggagttacgctctttttcctctccggaaaagggctcggaaaaacaagcatcggactcctatgtgtaaccgcatcctcagcgctactgtggatggcatcggtggagccacactggatcgcagcatcaatcatattggagttctttctcatggtcctactaataccggaaccggacaggcagcgcacaccccaagataatcaactagcctacgtcgttataggcctcctcttcatgatattaaccgtagcggccaatgaaatgggactactagaaacgaccaagaaagatctaggaataggctacgtcgcagcagaaaaccaccaacacgccacgatgctggacgtagatctacacccagcctcagcttggacgctgtacgccgtagcgaccaccgtgattaccccaatgatgcggcataccatcgaaaatacaacggcaaacatttcactcacggccatagccaaccaagctgccatcctaatgggactagacaaaggatggccaatctctaaaatggacattggggtgccgctgttagccttgggatgctatagccaggtaaaccccctcacactaaccgctgcagtccttatgttggtcgcccattacgccatcataggcccgggtctccaagcgaaagcaacccgggaagcacagaaaagaacggcagcggggataatgaaaaaccctacggtagatggaatagtagcgatcgatctcgatcctgtagtctacgacgccaaattcgaaaaacagctcgggcaaatcatgctcctaatactttgcacgagccagatcctgctaatgcgaacgacatgggcactctgcgaatccatcaccctagcgacaggccccctgaccaccctctgggaggggagcccgggaaagttctggaacaccaccatcgccgtaagcatggcaaatatattcagaggcagttacctggccggagcaggactcgcattcagtctgatgaaatcccttggcggaggacggcgcggtacgggcgcacagggagaaacgttaggggaaaaatggaaaagacagttgaaccaactgtctaagtctgaatttaacacctacaaacgatcgggcataatggaggtagatcggagtgaagccaaggagggcttaaagcgtggagaaacaaccaagcacgccgtctcacggggaacagccaaactcagatggttcgtagagaggaacttagttaagcccgaaggaaaggttatagacctgggatgcggtcgaggcggatggagctactattgcgcagggctgaagaaagtgaccgaagtcaaaggttacacaaagggcggccccggccacgaagaaccgatcccgatggcaacctacggctggaacctggtaaagctccattccggaaaggacgtattcttcatgccgcctgaaaaatgcgacacactgctgtgcgatatcggagaatccagccctaatccgacgattgaggagggacggaccctccgggtacttaagatggtcgaaccatggctaagggggaaccagttctgcataaaaatcctcaacccctacatgccctcagtcgtagagacactagaacggatgcaacgcaagcatggaggaatgctagtccggaatcccctctcacggaacagcacccacgaaatgtactgggtttcatgcggcacaggcaacatagtttccgcagtcaacatgacttcgagaatgctactcaatcgcttcacgatggctcaccgcaaaccaacatacgagcgggacgtcgacttgggcgcgggcacaagacacgtagcagtagaaccggaagtagcgaacctcgatatcataggccagcgaatcgagaacatcaagaatgagcacaaatcaacttggcactacgatgaagacaacccatacaagacgtgggcgtaccacggcagctacgaagtcaaacctagcggatctgcgagctcaatggttaatggcgtcgtgaggttactaacaaagccatgggacgtaataccaatggttacgcaaatcgcgatgaccgacactacccccttcggacagcagcgggtcttcaaggaaaaagttgacactagaacccccagagcaaagagagggaccacacaaataatggaagtcactgcaaagtggctatggggatttctaagtagaaataagaaaccccggatctgcacacgcgaggaatttacccgcaaagtcaggagcaacgccgccataggagccgtgttcgtagacgaaaatcagtggaacagcgccaaagaggccgtagaagatgaaaggttctgggaccttgtgcacagagaacgagaactacataaacaaggaaagtgcgcaacctgcgtatataacatgatggggaaaagagaaaagaagctgggagagttcggcaaagcaaaggggtcgagggcaatctggtacatgtggctaggcgcccgctttctcgagttcgaagcactcggtttcatgaacgaggaccactggtttagcagagaaaatagcctttccggggtagagggagaaggcctacacaagctcgggtacatattgcgggacatcagcaaaataccaggcgggaacatgtacgccgacgacacagcaggatgggacacacgaataaccgaggacgatctgcaaaatgaagcaaaaataacagatatcatggaacccgagcatgcactactcgcaacgagtatcttcaagctcacgtaccaaaacaaagtagtgagagtgcagagaccagccaaaaacgggacagtaatggacgttatttcccgtcgggaccaacgaggctcgggccaagtagggacctacggtttaaacacatttacaaatatggaagtgcagctgatacgccaaatggaatccgaggggatattcctacctagtgaattagagaccccaaacctggcagaacgagccctagactggctagaaaaacacggagccgagcgtctcaagcgaatggcaatatctggggacgactgcgttgtgaaacccatcgacgataggttcgccacagccctaactgccctgaatgatatgggtaaagtacgcaaggacatacctcaatgggaaccttcgaagggatggaacgattggcaacaggtccccttttgctcgcaccacttccaccaactcataatgaaagacggacgcgagatcgttgttccctgcagaaaccaagacgagctagtggggcgggccagagtgtcacagggagctggatggtctctgagagaaacagcctgcctcgggaaaagctacgctcagatgtggcaactaatgtactttcaccgcagggacctacgtctggcagcaaacgccatatgtagcgccgtccccgtggattgggttcccgcatcaaggacaacatggagcatacacgcccaccaccaatggatgaccacggaagacatgttatcggtatggaaccgcgtctggatagaagaaaacccctggatggaagacaagacgcacgtctccagttgggaagaggtaccgtacctaggaaaacgagaagaccagtggtgcggaagccttataggacttactgcacgtgctacatgggcgacaaacatacaagtagcgatcaaccaggtccgaagactgatagggaacgaaaactacctagactacatgactagcatgaaaaggtttaagaacgaatcggacccggaaggggcgctctgg

SEQ ID NO: 24773 - RNA, 9876 nt, synthetic construct
  misc_feature 1..9876: note = derived and/or modified CDS sequence (opt11) from DENV-1__KF672759__SS-prME
  source 1..9876: mol_type = other RNA
agtgtgaccatgcttctcatgttactcccgacggccttggcgttccacctaaccacgcgcggcggtgagccacatatgatcgtgagcaagcaggaacggggcaagagcctccttttcaagacctccgtgggggtgaacatgtgcaccctgatcgcgatggacctgggtgagctctgcgaggacactatgacatacaagtgcccccgcataaccgaggccgagcccgacgacgtggattgctggtgcaacgccaccgacacctgggtgacctatgggacctgcagccaaaccggcgagcaccggcgcgacaagcggtccgtggccctggcgccccacgtcgggctgggtttggaaacgcgcacggagacctggatgagcagcgagggcgcctggaaacagatccagaaggtggagacctgggcactgcggcaccccgggttcaccgtgatagccctgttcctggctcacgccatcggcaccagcatcacccagaaggggatcatcttcatcctacttatgttggtgacgccctccatggccatgcgctgtgtgggcatcggcaaccgggactttgtggagggactgtcaggcgcaacgtgggttgacgtggtgctagagcacggttcctgtgtcacaaccatggcaaagaataagcccaccctagatatcgagctcctgaagacggaagttaccaatcccgctgtgcttcgcaaactgtgcatcgaggcgaagatctctaatactaccacagactcccggtgcccgacccagggagaggctactctggtcgaggagcaggatgccaacttcgtgtgtcgccggaccttcgtggaccgcggctgggggaacggctgcggcctcttcgggaagggatccctgctgacgtgcgccaaatttaagtgtgtcaccaagctcgagggaaagatagtccagtacgagaacctgaagtactccgtgatcgtcaccgtccacaccggcgaccagcaccaggtcggcaacgaaacgaccgagcacggcactatcgccaccatcacgcctcaggcgcccaccagtgaaatccagctaaccgactacggggccctcaccctggactgcagcccccgtaccggcctggacttcaacgagatggttttacttacgatgaaggagaagtcctggctggtacacaagcagtggttcctcgatctgccgctgccctggacctccggggccagcacgagccaggagacctggaaccgccaggacctcctggtcacgttcaaaaccgcccacgccaagaaacaggaggtggtggtcttgggatcacaagagggagcgatgcacaccgccctcaccggggcaacggagatacaaaccagtgggaccaccacgatcttcgccgggcacctgaagtgccggctgaagatggacaagctcaccctgaagggtatgtcctacgtgatgtgcaccggttcctttaagctcgagaaagaagtggccgaaacccagcacggcacggtcctggtccaggtgaagtacgagggcaccgacgcgccctgcaagatcccgttcctcacccaggacgagaagggggttacacagaacggccgcttaattacggcgaatccgatcgtgaccgacaaggagaaacctgttaacatcgagaccgaaccgccattcggggagtcctacatagtcgtgggcgccggcgagaaggccctgaaactcagctggtttaagaaggggtcaagcattggcaagatgtttgaggcgactgcccgcggcgcccgccggatggccatcctgggcgacaccgcgtgggacttcgggtccatcggcggcctgttcacaagcgttgggaagctcatccatcaggtcttcggcaccgcgtacggagtgctgttcagcggggtcagctggaccatgaagatcgggatcggtatcctgctcacttggctgggcctgaactcccggagcacctccctctcgatgacctgcatcgccgtggggatggtaaccctgtatctaggcgtgatggtacaggccgactccgggtgcgtgatcaattggaagggcagggagcttaagtgcggcagcggcatcttcgtgacgaatgaggtccacacgtggaccgaacagtacaagttccaggccgactccccgaagaggctgagcgccgcgatcggcaaagcctgggaggagggagtgtgtggcatccgcagcgccaccagactggagaacataatgtggaagcagatctccaacgagctaaactacatcctgctggagaacgacatgaaattcaccgtggtcgtcggggacgtgaacggcatcttagcgcaggggaaaaagatgatccggccccaacccatggagcacaagtatagctggaaaagctggggcaaggccaagatcatcggtgcggatatccagaacacaacattcatcatcgacgggcccgataccccggagtgccccgacgatcagcgggcctggaacatctgggaagtcgaggactacggtttcgggatcttcacaacgaacatttggctgaagttgcgcgacagccatacccagatgtgcgaccatcggctcatgtccgccgcaatcaaggatagcaaagcggtacacgccgacatgggttattggatcgaatccgagaagaacgagacctggaaactagcccgcgctagcttcattgaggttaagacctgcatctggcccaagtcccacacgctgtggagcaacggcgtcttagagtcggagatggtgatccccaagatctatgggggccctatttcgcagcacaactatagacccgggtactttacccagactgccggcccctggcacctggggaaactggaactcgacttcgacctgtgcgagggcaccacggtggtggtggacgaacactgcggctaccgcggaccttccctgagaaccaccaccgtgacgggcaagatcatccacgagtggtgctgccgcagctgtaccttaccgcccctgcggttccgcggtgaggacggctgctggtacggaatggaaatccggcccgtcaaagaaaaggaggagaacctggtacgctccatggtgagcgcgggatccggcgaggtcgacagcttcagcctgggaatactgtgtgtgtccatcctgatcgaagaggtgatgcggagccgctggtcccggaagatgctcatgacaggcaccctcgctgtcttcctgttgctgatcatggggcagctgacgtggaacgacctcatacggctatgcattatggtgggtgccaacgccagcgacaggatgggaatgggcacaacatacctagcactcatggctacgttcaagatgcggcctatgtttgcagtgggcctgctgttccgccggctcacgtgccgcgaggtcctgctgctcactgtgggcctttccctggtcgccagtgtggagctacccaactccctggaggagctgggcgatgggcttgcgatgggcatcatgatgctgaagctgctcacggacttccaaccccaccagctatggaccacactgctctccctgacattcatccggacctccctgtccctcgactacgcctggaagaccatggcgatggcactgtccattgtgagccttttccccctctgcctgtccacgacttctcaaaagaccacttggctaccggtcctcctgggctccttcgggtgcaagcccctgacgatgttcctcataaccgagaacaaaatctggggccgtaagagctggcccatcaacgagggaatcatggcggtgggcatcgtgtcgatcctgctgagctccctgctcaagaacgacgtccccctggccgggccgctcatcgcgggcggaatgttgatcgcctgttacgtgatctccggtagctccgccgacctcagcctcgagaaggcggccgaagtgtcctgggaggaggaggcggagcactcaggaacctcccacaacatcctagtcgaggtgcaagacgatgggaccatgaagatcaaagacgaggagcgggacgacacccttacgattctcctgaaggcgaccctgctcgccgtgagcggcgtctaccccatgtccatacccgcaacactgttcgtgtggtacttctggcaaaagaagaagcagcgctcaggggtgctgtgggacaccccaagtccgcccaaggtcgagcgcgccgtgctggacgacggcatctaccgcatcctccagcggggcctactggggcgcagccaggtgggcgtcggggtttttcaagatggcgtgttccacacgatgtggcacgtgactcgcggggcggtgctcatgtaccagggcaagcgcctggagccctcctgggccagcgtgaagaaggacctgatttcgtacggcggaggctggcgtttccaagggagctggaacaccggcgaagaagtccaagtcatcgcagttgagccggggaagaacccgaagaacgtacagaccacgcctggcaccttcaagacccccgagggcgaggtaggggccattgccctcgactttaagcccggcacctcagggagcccgatagtgaatcgcgagggcaaaattgtcggcctgtacgggaacggggtggtgacgacctcgggcacctacgtcagcgcgatcgcccaggccaaggccacccaggagggacccctgcccgagatcgaggacgaggtgttcaagaaacgtaatcttacgatcatggacctgcacccgggtagtggcaagacccgcaggtatcttcccgccattgtgcgagaagctatcaagcggaagctccgcaccctgatcttagcccccacccgcgtcgtggccagcgagatggccgaggcgctcaaggggatgcccatccggtaccagacgaccgccgtgaagagcgagcacactgggcgcgagatcgtcgatctgatgtgccacgccacattcacgatgcggctgctctccccggtgcgcgtgcccaactacaatatgataatcatggacgaagctcacttcaccgacccagcgtcgatcgcggcccgaggttatatctccacccgcgtggggatgggcgaagccgcggccatcttcatgaccgcgacgcccccgggaagcgtggaagccttcccccagtccaacgctgtaatccaagatgaagaacgggacatccccgagcgcagctggaattcaggctatgactggatcactgacttccctggcaagaccgtttggttcgtgccgagcatcaagtccgggaacgacatcgccaactgtcttcggaagaacggcaagcgcgtaatccagctgagccggaagacctttgacacggagtaccagaagacaaagaataacgactgggactacgtagtaaccactgacatctccgaaatgggggccaacttccgcgcggaccgggtgatcgaccccagacggtgtctcaagccagtcatactgaaggaaggtcccgagagagtaatcctggccgggccgatgcccgtcacggtggccagcgcggcgcaacggcgcggccggatcggccgtaaccagaacaaggagggtgaccagtatatctacatgggccagccccttaacaacgacgaggaccacgcccactggacggaggcaaagatgcttctggacaatatcaacacgccggagggcatcatccctgcactttttgagcctgagcgcgagaagtccgccgccatcgatggcgagtaccggctgcgcggtgaggcgcgaaaaaccttcgtggagctgatgcgccggggcgatctccccgtatggctgagctacaaagtggcctcagagggcttccaatacagtgaccgccggtggtgctttgacggggaaagaaacaaccaagtcctggaagagaacatggacgtcgagatctggacgaaagagggggaacggaagaaactccgcccccgctggttagacgcccgcacctactccgaccccctggctctccgggagttcaaggagttcgcggccggaagacggagcgttagtggcgacctaattctggagatcggcaagctcccccagcacctgacactgcgcgcccagaacgccctcgacaacttagtgatgctacacaacagcgagcagggcgggaaggcctaccggcatgctatggaggagctacccgacaccatcgagaccctgatgctgctcgcactgatcgcagtcctgaccggtggagtgaccctcttcttcctgagcgggaaggggctaggcaagacctctattgggttactgtgtgtgatggccagctccgcgctgctctggatggcctctgtggagccccactggatagccgccagtatcatcctggagttcttcctgatggtgctcctgattcccgagccggacagacagcgaacgccccaggacaaccagctggcctatgtggtcatcggcttgctgttcatgattctgacggtggcggccaacgagatgggactcctggagaccaccaagaaggacctgggcatcgggcacgtggccgtcgagaaccaccaccacgccacgatgttagacgtggacttaagacctgcaagtgcgtggacgttatacgccgtggccacgaccgtcatcacccctatgatgcggcacacgatcgagaacaccaccgccaacatatccctcaccgccatcgcgaaccaagccgccatcctcatgggcctggacaagggctggcccataagcaagatggatatcggggtacccctcctggctctcggatgctactcccaggtaaacccgctcacgttgaccgccgcggtcctgatgctcgtggcccactacgccatcatcggtcctggtctgcaggccaaggcgacccgcgaggcccagaagcgcaccgctgccgggatcatgaaaaacccgacggtggacggcatcgtcaccattgatctggacccagtcgtgtacgacgccaagttcgagaagcagctcggccagatcatgcttctgatcctctgcaccagccaaatcctgctgatgcggaccacgtgggcgctctgcgagtccatcacactggcaacggggccgctgactacgttgtgggagggaagcccaggaaagttctggaacactaccatcgccgtcagcatggccaacatctttcgcggcagctacctggccggcgcgggcctggccttctccctcatgaaatcacttggcgggggccggcgagggaccggcgcccagggcgagacgttgggggagaagtggaagcggcagctcaaccaactgtccaagagcgagttcaacacctacaagaagagtgggatcatggaggtggaccgcagcgaggccaaagaagggctaaaacgcggcgaaaccaccaagcacgccgttagccgcggcacggcgaagctgagatggttcgtcgaacgcaacctcgtgaaacctgagggcaaggtcatcgacctgggttgcgggcggggcgggtggtcatactattgcgccggcctcaagaaggtgaccgaggtgaaggggtacaccaagggcggccccggacacgaggaaccgatcccgatggccacctatggttggaacctcgtgaagctgcatagcgggaaggatgtgttcttcacgccacccgagaagtgcgacacgcttctctgcgacatcggtgagtctagcccgaaccccaccatagaggaggggcgcaccctccgggtgctgaagatggtggagccatggctccgcggcaaccagttttgcatcaagatcctgaacccgtacatgccgtccgtcgtggagaccctcgagcagatgcagcggaaacatggcgggatgctcgtgcgcaaccccctgagccggaactcaacgcacgagatgtactgggttagctgcggcaccgggaacatcgtgagtgccgtgaacatgacgtctcgcatgctgctcaacaggttcaccatggcccacagaaagccgacgtacgagcgcgacgtcgacttaggcgccggcaccaggcacgtggcggtggagccagaggtcgccaatctggacatcatcgggcagcgcatcgaaaacatcaagaacgagcacaagtcgacgtggcattatgacgaggacaatccgtacaagacctgggcctaccacggcagctacgaggtgaagcccagtgggagcgcttccagcatggtcaacggcgtggtgcggctcctgacgaagccatgggatgtcatcccaatggtgacccagatcgccatgaccgacaccactccgttcggtcagcagagggtgttcaaggagaaggtcgacacccggacgcctcgggccaagcggggcacagcccaaataatggaggtgacggcgaagtggctgtggggcttcctctcccgtaacaagaagccccgaatctgcacccgcgaggagttcacccggaaggtccgcagtaacgccgcaatcggggccgtcttcgtggacgagaaccaatggaattccgcaaaggaggccgtagaggacgagcggttctgggatctcgtccaccgcgagcgggagctgcacaagcagggcaagtgtgcgacctgcgtgtacaatatgatggggaagcgcgagaaaaagctcggcgagtttgggaaggcgaaggggagccgggccatctggtacatgtggctgggcgcccgcttcctggagttcgaggctctcggcttcatgaacgaggaccactggttttcacgggagaactccttgagcggcgtggagggggagggactccacaagctcgggtacatcctgcgcgatatctccaaaatcccgggcggcaacatgtacgccgacgacacggccgggtgggatacacggattaccgaagatgacctgcagaacgaggcgaagatcaccgatatcatggagcccgagcacgcgctcctagcgacgagcatcttcaagttgacataccagaataaagtcgtgcgcgttcagcgccccgcgaagtcaggtaccgtcatggacgtcatcagccggagagaccagcggggtagcggacaggttggcacctatgggctcaacactttcaccaacatggaggtccagctgatccgccagatggaatcggagggcatcttctccccaagtgagctggagaccccaaacctcgccaagaaggtactggactggctagagaagcacggggccgagcggctcaagcgcatggcgatctcaggcgacgactgtgtggtcaagccaatcgacgaccgtttcgcgacggccctgacggccctgaacgacatggggaaggttcgcaaggacattccccaatgggagcccagcaaaggctggaatgattggcagcaggtcccgttctgctcccaccacttccaccagctcatcatgaaggacggaagagagatagtcgtgccctgtagaaaccaagacgagctggtggggcgggcccgcgtcagccagggtgccgggtggtcattgcgggagaccgcgtgcctcggtaagagctacgcccagatgtggcagctgatgtacttccaccgccgggacttgcgccttgccgccaacgccatctgctccgcggtgcccgtggactgggtccccacctctagaactacttggagcattcatgcccaccaccagtggatgacgaccgaggacatgctgtccgtgtggaaccgcgtgtggatagaggagaatccgtggatggaggacaagacgcacgtcagctcctgggaggaggtcccctacctgggtaaacgggaggatcagtggtgcggcagcctcatcggcttaaccgcccgcgccacttgggccacaaacatccaagtggccatcaaccaggtccgccggttgattgggaacgagaactacctcgactacatgacctcgatgaaacgcttcaagaacgagagcgaccccgagggcgccctgtgg

SEQ ID NO: 24774 - RNA, 9876 nt, synthetic construct
  misc_feature 1..9876: note = derived and/or modified CDS sequence (opt11) from DENV-1__KF672761__SS-prME
  source 1..9876: mol_type = other RNA
agcgtaaccatgttgttcatgctgctgcccaccgccctggccttccacctcaccacccgcggcggggaaccccatatgatcgtgagcaaacaagagcggggcaagtcgctgctttttaagacaagcgcgggcgttaacatgtgcacccttatcgccatggacctgggcgagctgtgtgaagataccatgacctataagtgccctcgcatcaccgaggccgagccagacgatgtggactgttggtgtaatgccaccgatacctgggtcacgtacgggacctgctcccagacgggtggccaccggagagacaaaaggtccgtggccctcgcgcctcacgtggggctgggactggagacccgcaccgagacctggatgagctccgaaggagcatggaagcaaattcagaaggtagagacctgggccctccgacaccccggcttcacggtaattgcactgttcctggcgcacgccatcggaacctcgatcacccagaaaggcattatcttcatcctcctgatgctagtgaccccctccatggccatgcgctgcgttggcattgggaaccgggacttcgtggagggactgtcgggggccacatgggtggacgttgtgctggagcacggctcctgtgtgaccaccatggccaagaacaaacccacccttgacatcgagctcctaaaaacggaagtcactaaccccgcggtgctgcgcaagctctgcatagaggccaaaatcagcaataccaccacggattcccgctgcccgacccaaggcgaagccactctagtggaggagcaagacgcgaatttcgtctgccgccgcacattcgtggaccgcggttggggaaacgggtgcggcctgttcggaaagggtagcctcctgacgtgcgcaaagttcaagtgcgtgaccaagctagaaggcaagatcgtccagtacgagaatctcaagtactccgtgattgtgactgtacacacgggcgatcagcaccaggtgggcaacgagacgacggagcacggaaccatcgcgacaataacgccccaggcccctacctcggaaatccagttgaccgattatggcgcgttaaccctagactgcagccccaggacggggctggatttcaacgagatggttctattgacgatgaaggagaagtcgtggctggtacacaagcagtggttcctagacctacctctgccttggacctccggcgccagcactagccaggaaacctggaacagacaggacctgctcgtgacgtttaagaccgcccacgccaaaaagcaggaggtcgtagtgctaggctctcaggagggggccatgcacaccgccctgaccggcgccacggagatccagaccagcggaaccaccacgatcttcgccggccacctcaagtgtcggttgaagatggataaattaaccttaaaggggacctcctacgttatgtgcaccgggtcctttaagctggaaaaggaggtggcagaaacgcagcacggcacagtgttggtccaggtgaaatacgaggggaccgacgccccctgcaagattcccttctccacacaggacgaaaagggcgtgactcagaacgggcgcttgatcaccgctaatccgatcgtcacggacaaggagaagcccgtgaacatcgagacagagccccccttcggagagagctacattgtggtcggcgccggggagaaggctctcaaactgagttggttcaagaagggtagctccatcgggaaaatgttcgaggccacggcccggggggcgcgccgcatggccatcctgggggataccgcctgggacttcgggagcatcggcggggtcttcaccagcgtgggcaagctcgtccatcaagtgtttgggaccgcctacggcgtactgttcagcggggtatcctggactatgaagattggtattggcatactgctaacgtggctggggctgaatagccgatcgaccagcctctccatgacgtgcatagccgtggggatggtaacactgtacctgggggtcatggtacaggccgacagcggctgcgtgatcaactggaaaggccgggagctaaagtgcggctccggcatcttcgtcaccaacgaggtgcacacctggaccgagcagtacaagttccaggccgatagcccgaagcggctgagcgcggccatcggcaaggcgtgggaggagggcgtgtgtgggatacggagcgctactcgattagagaacatcatgtggaaacaaatttcaaatgagctcaaccacatcctgctggagaacgacatgaagtttacagtcgtggtgggcgacgccaacgggatcctcgcgcaaggcaagaaaatgattcgaccccagcccatggaacacaagtacagttggaagagttggggcaaggctaaaatcatcggagctgatatccaaaacaccacctttattattgacggccccgacaccccggagtgccccgacgagcagcgggcctggaacatctgggaggtggaagactacgggttcggtatcttcacaaccaacatttggctgaagcttcgggactcctacacccagatgtgcgaccatagactcatgtccgcggccatcaaggactccaaggccgtgcacgccgatatgggctactggatcgaaagcgagaagaacgagacctggaagctggcccgggcgtccttcatcgaagtgaagacgtgtatctggcctaagagccataccctgtggtcgaacggggtcctcgagtcggagatgatcatccccaagatctacggcgggccgatctcccagcataactatcgaccaggctacttcacccagacggcggggccctggcacctggggaagttagagctcgactttgacctgtgtgagggcacgaccgtggtggtggacgagcactgtgggaacagaggtccgagccttcggaccaccacggtaaccggaaagattatccacgagtggtgctgccgctcctgcaccttacctcccctccggttccgaggagaagacgggtgttggtacggcatggagatccggccggtgaaggagaaggaggaaaatctggtccgaagcatggtgtccgccggaagcggggaggtcgacagcttctccctcggcatcctgtgcgttagcatcatgatcgaagaggtgatgcggtcacgctggagccgcaagatgctgatgaccgggacgctcgccgtgttcctgttactgatcatgggccagctgacctggaacgatctgatacgcctttgtataatggtcggggccaacgcgtccgataagatgggcatgggtaccacctatctggccctgatggccacttttaaaatgcgccctatgttcgccgtggggctcttattccggcgcctgaccagtcgagaggtcctgctgctgacaattggtctcagtttggttgcaagcgttgagctgcctaattccctcgaggagctgggagatggcctggctatgggcatcatgatgttaaagctgctaaccgagttccagccacaccaactctggacgaccctgttatccctcacattcattaaaaccacgctgtccctggattacgcctggaaaaccaccgccatggtcctcagcatcgtatcgctgttccccctgtgcctcagcaccacgtcccagaaaaccacctggctaccggtcctgctcggtagctttggctgcaagcccctgaccatgtttctgattaccgagaacaagatctgggggcgcaagagttggcccttaaacgagggcatcatggccatcggcatcgtatcaattctgctgtctagcctcctgaaaaatgacgtgcccctggcgggccctttgatcgcggggggaatgctgatcgcctgctacgttattagcggctcctcggcagatctgtctctggagaaagccgcggaagtgagctgggaagaggaggccgagcactcaggcacgtcgcacaacattctggttgaggttcaggacgacggaaccatgaagatcaaagacgaggaacgggatgacaccctgactatcctcctgaaagcaacgttgctcgcagtttccggggtgtaccctatgagtataccagctacccttttcgtctggtacttctggcagaagaagaaacagcgctccggcgtcctgtgggacaccccctcgccgcccgaggtagaacgggcggtgctcgacgatggcatctaccgcatcctccaacggggtctgttggggcgctcgcaagtcggtgtaggagtgttccaagacggagtattccacaccatgtggcatgtcacgaggggagcagtgctcatgtaccaaggcaagcgactggagcctagctgggcctccgttaagaaggacctgatctcttacgggggcgggtggcggttccagggctcctggaataccggggaagaggtacaagtaatcgccgtcgagcccggcaagaaccctaaaaacgtacaaaccactccaggcacctttaagacaccggagggggaagtgggcgccatcgcgctggacttcaaacccgggacctccggctcgccgattgtaaatcgggaggggaagatcgtcggcctatacggcaacggcgtggttaccacgagcggaacgtacgtatccgccatcgcccaggccaaggcaagtcaggaggggcccctgcccgaaatcgaagacgaggtgttcaagaaacggaacctcacgatcatggatctgcacccgggcagcggcaagacccgccggtacctccccgcgatcgtacgcgaagcaatcaagcggaagcttagaacgttaattctagcgcccaccagagtggttgcctccgagatggcggaggccctcaaaggaatgcccatccgttatcagacgaccgccgtgaagagcgagcacacgggccgggagatcgtagacctgatgtgccacgctaccttcaccatgcggctgctctccccagtgcgcgtccccaactataatatgatcatcatggacgaggcgcactttaccgacccggcgagtatagccgcgcgggggtacatctccacgcgcgtgggcatgggggaggccgcggcgatcttcatgaccgctacgccgcctggcagcgtcgaggccttccctcaatcaaacgccgtcatccaagatgaggaacgggacatccccgaacgcagctggaactccggatacgactggattaccgactttcccggcaagacggtatggttcgtgcccagcatcaagtcaggcaatgacatagccaactgcctgcgtaagaacgggaagcgcgtcattcagctaagccgtaagacctttgacaccgagtaccagaagaccaaaaacaacgactgggattacgtggtgacgacggacatatccgagatgggcgcgaatttcagagccgaccgggtcatcgacccacgccggtgcctaaagccggtgattctgaaggacggtcccgagcgcgtgatcctggccggcccgatgcccgttaccgtggccagcgcggctcagcggcgcggccggatcgggcgtaaccagaacaaggagggcgaccagtacgtctacatggggcagccgctcaacaatgacgaggaccacgcacactggaccgaggccaagatgctgctcgacaatataaacacgcccgagggcattataccggccttgttcgaaccggaacgagagaaatctgcggctatcgacggtgagtaccgtctgcgcggcgaggcccgaaagacctttgtggagctgatgcgccggggcgaccttcccgtctggctgtcatacaaagtcgcgtcggaggggttccagtacagcgatcgccggtggtgctttgacggtgagcgcaataaccaggtattagaggaaaacatggacgtggaaatctggaccaaggagggagagcggaaaaaactccgcccaaggtggctggacgctcgcacttactccgaccccctggcactgcgggaattcaaggaattcgccgccggccgccggagcgtctcaggcgacctgatactggagatcgggaagctgccgcagcacctcaccctgagggcccagaacgctttggacaatctggtgatgctccataattccgagcaggggggtaaggcgtacagacacgccatggaggagttaccagacaccatcgagaccctgatgttactagccctgatagcagtcctcacaggaggggtcaccctgtttttccttagtggcaaaggcctgggtaagacctccattgggctcctgtgcgtgacagcctccagcgccctgttatggatggcctcagtggagccccactggattgccgcaagcatcatcctggaattcttcctaatggtccttttgatcccagaacccgatcgccagagaaccccccaggacaaccaactggcgtacgtggtaataggactgctgtttatgatcctgaccgttgccgccaacgaaatgggcctcctagagaccacgaagaaggatcttgggatcggccacgtggccgccgagaaccatcagcacgcgactatgctggatgtggatcttaggccggccagcgcctggaccctgtacgcggttgccacgaccgtgatcaccccgatgatgcgacacaccatcgaaaacacgaccgcgaacatttccctcacagccatcgccaaccaggccgcaatcctgatgggcctggacaaggggtggcccatcagcaagatggacatcggcgtccccctgttggcactggggtgctactcgcaagtcaaccccctcacgctgacggccgccgtgctgatgctggtggcacactatgcgatcatcggccctgggttgcaggcaaaggccacgcgcgaagcccagaagcggaccgccgctggaatcatgaagaaccccacggtcgacggcatcgtggccatcgacctggacccggtggtctatgatgcaaagtttgagaaacagctcgggcagattatgctactgatcctctgcacgtcgcaaatcttactgatgcgcaccacctgggcgttgtgcgagtccatcaccctggcgacgggcccgctgaccaccttatgggagggatcccccgggaagttctggaatacaacgattgcggttagtatggccaacattttccgcggcagctacctggctggggccggcctggccttcagtctcatgaaatcactcggtggcgggcggcgcggtacaggcgcgcagggggagacactgggggagaagtggaagcggcagctgaatcagttgtccaagagtgagttcaacacctacaagcgctctggcataatggaggtggaccggtctgaggccaaggagggccttaagcgcggggagacgactaagcacgccgtgagccggggcaccgccaagctcagatggtttgtggagaggaatttggtcaagcccgaggggaaggtaattgacctcggatgtggtcgggggggctggtcctattactgtgctggactgaagaaggtcacggaagtaaagggctacaccaagggcgggcccggccacgaggagcccattcccatggccacgtacgggtggaatctcgtgaagttgcactcaggcaaagacgtgtttttcatgcctcccgagaaatgcgacaccctgctttgcgacattggcgagtccagcccgaaccccacgatcgaggagggtagaaccctgcgcgtccttaagatggttgaaccgtggctccggggcaaccagttttgcatcaagattctgaacccttacatgccgtcagtggtagagacgctggagcagatgcagcgcaagcacgggggcatgctcgtgcgtaaccccctgagtcgaaactccactcatgagatgtactgggtgagctgcgggaccggcaacatcgtatccgccgtcaacatgaccagccgcatgctgctcaatcgcttcaccatggctcaccggaagcccacctacgagcgcgacgtagaccttggcgccggcacccgacatgtggcggtcgaacctgaggtggccaatctggatattatcggccagagaatcgagaacataaaaaacgaacataagtctacctggcactatgacgaggacaacccttacaagacgtgggcctaccacggatcgtacgaggtgaagccctcaggcagcgccagtagcatggtaaacggagtggtgcgcctcctgaccaagccgtgggatgtaataccaatggtgacccagatcgccatgaccgacacgacgccgttcggccagcagcgcgtcttcaaggagaaggttgacacccgcacgccccgggcgaaacgcggcacggcccagatcatggaggtgaccgccaagtggctgtgggggttcctatcacggaacaagaagccccgtatatgcacccgggaggagttcacacgcaaggtacggagcaacgctgcgatcggcgcggtgtttgtggatgagaatcagtggaatagcgccaaggaggctgtggaggacgagcgtttctgggacctggtgcaccgggagcgcgagctgcacaagcaggggaagtgcgccacgtgtgtgtacaatatgatgggcaagcgggagaagaagctcggagagttcggcaaggcaaaaggctcccgcgcaatctggtacatgtggctgggggcccgtttcttagagttcgaggccctaggcttcatgaacgaggaccattggttcagccgcgagaactccttaagcggggtcgagggcgaggggttacacaagctcggctacatcctacgagacatctcgaagatcccgggcgggaacatgtatgccgacgacaccgcgggctgggacacccgcatcactgaagacgacctgcagaacgaggctaagatcacagacatcatggagcccgagcacgccctcttggcaacatccattttcaagttgacctatcaaaacaaagtggtgcgggtccagcgccccgccaagaacggaaccgttatggacgtgatctcccgccgtgaccagcgcggcagtggccaggtcgggacctacggcttaaacaccttcaccaacatggaggtgcagctgatccgtcagatggagtccgaggggatcttcctgccctcggagctcgagaccccgaatttggcggagagggtgctggactggctagagaagcacggcgcagagcgcctgaagcgcatggcgatctctggcgatgactgcgtagtgaagcccattgatgacagattcgccactgccctgatcgcactcaacgacatgggcaaggtgcgcaaggacatcccccagtgggagcccagcaaaggctggaatgactggcagcaggtcccgttctgttcccaccacttccatcagctgataatgaaggacgggcgggaaatagtagtcccatgtcgcaaccaggacgagctggtcggcagagcccgagtaagccagggggctggctggtccctcagagagaccgcttgcctgggcaagagctatgcccagatgtggcagctgatgtactttcaccgccgcgacctccgcctggcggctaatgccatctgctccgctgtgcccgtcgactgggtgcctacgtcccggaccacatggagcatccacgcgcaccaccaatggatgacgacggaagacatgctgtccgtgtggaatcgcgtctggatagaagagaacccgtggatggaggacaaaacccacgtgagctcctgggaagaggtgccctacctcggcaagcgggaagatcagtggtgcgggagcctgatcggcctgaccgcccgcgccacatgggcgaccaacatacaggttgccattaatcaggtgcgtcgcttgattgggaacgagaactacctggactacatgaccagtatgaagcgcttcaagaacgagagtgaccctgagggggctctgtgg

SEQ ID NO: 24775 - RNA, 9876 nt, synthetic construct
  misc_feature 1..9876: note = derived and/or modified CDS sequence (opt11) from DENV-1__KF672762__SS-prME
  source 1..9876: mol_type = other RNA
tccgtgaccatgcttctcatgctgctgccgacggccctcgccttccatctgaccactcgcgggggcgagccgcacatgatcgtatctaagcaagagagaggcaagagcctcctcttcaagaccagcgcaggggtgaacatgtgcacattgatcgccatggatctgggagagctatgcgaggataccatgacctacaagtgcccccggatcaccgaggccgagcccgatgacgtggactgctggtgcaacgcgaccgatacctgggtcacctacggtacctgttctcaaactggcgagcaccggcgcgataagaggtccgtggccctggcgccccacgtgggcctcggtctcgagacgagaaccgagacctggatgagctccgaaggcgcttggaaacagattcaaaaagtcgagacttgggccttacggcaccccgggttcacggtaatagccctgttcctcgcgcatgccatcggcacaagcatcacccagaaggggatcatcttcatcctgctgatgctcgtgaccccttccatggcaatgcgctgcgttgggataggcaacagagacttcgtggagggtctgtcgggtgccacctgggtggacgtcgtgctagagcacgggtcctgcgtaaccaccatggccaagaataagcccaccctcgacatcgagctgctcaaaacggaggtcaccaaccccgcggttctccgcaagctgtgcatcgaggctaagatctccaacaccactacagattctcggtgccctacccaaggcgaggccaccctggtggaagaacaggacgccaacttcgtctgtcgcaggaccttcgtggatagagggtgggggaacggttgcggcttattcggaaaggggagcctgcttacgtgtgccaaatttaaatgcgttaccaagttggagggaaagatcgtccagtacgagaacctgaagtactccgtaatcgtgaccgtacacaccggcgatcagcaccaagtggggaacgagacgaccgagcacgggactattgcgaccatcacgccccaagcccctacgtccgagatacaactgactgactacggggccctcaccctggactgcagtccccggactggcctggatttcaacgagatggtcctcctgactatgaaagagaagtcctggctggtccacaagcagtggttcttggacctgccgttaccctggaccagtggcgccagcacctcccaggagacctggaatcgccaggacctcctggtgacattcaagaccgcccacgcgaagaagcaagaggtagtggtgctgggctcccaagagggcgctatgcacacggcactcacgggggcgacagagatacagaccagcggcactactacgatcttcgccgggcacctgaagtgtcggctaaaaatggacaagcttacactgaagggcacctcctacgtcatgtgtacaggaagcttcaagctggaaaaggaggtggcggagacccagcacggcacagtcctggtccaggtgaagtatgagggcattgatgctccttgcaagatccccttttcgacccaagacgagaaaggagtgactcagaacggccgcctcatcactgcaaatccgatcgtcactgacaaggagaagccggtgaatatcgaaaccgagccgccctttggggagagctacatcgtggtcggcgcaggcgagaaggcgttaaaactgtcctggttcaagaaggggagttccatcggcaagatgttcgaggccaccgcccgcggagcccgccgcatggccatcctcggtgacacggcgtgggatttcgggtctatcgggggggtgttcacaagcgtgggaaagctggtccaccaggttttgggcacagcctacggggttctgttcagcggcgtctcttggaccatgaagatcgggatcggcattctgctgacgtggttgggcctgaacagccgttctacctccctgtccatgacgtgtatcgccgtggggatggtgaccctctatttaggcgtcatggtgcaagccgactcagggtgcgtgatcaattggaagggacgggagttgaagtgtgggtccggaatcttcgtaactaatgaggtgcacacctggaccgaacagtacaagttccaggcagacagcccgaagcggctcagcgctgcgataggcaaggcctgggaggaaggggtgtgcggcatccgctccgctacccgtctggagaacatcatgtggaagcaaatcagcaacgagttgaatcacatcctactggagaatgacatgaagttcaccgttgtagttggggacgccaatggcatcctggcgcaggggaaaaagatgatccgcccacagcccatggaacacaagtactcttggaagtcctggggcaaggccaagattatcggcgccgacatacaaaatacaactttcatcatcgacggccctgacaccccggagtgcccggatgagcagcgagcctggaacatctgggaggtggaggactacgggttcgggattttcacaacgaatatctggctcaaactgcgggacagttacacgcagatgtgcgaccaccggctcatgagcgcagccattaaggacagcaaggccgtgcacgccgacatgggctactggatcgagtcagagaagaacgagacgtggaagctcgcgcgcgcgtcgttcatcgaggtgaagacctgcatatggccgaagagccacacgctgtggtccaatggcgtcctagagagcgagatgatcatccccaagatctacgggggcccgatctcacaacataactacaggcccgggtatttcacccaaactgccggcccctggcacctgggaaagctggagttggacttcgatctctgcgagggaaccacggtggtggtcgacgaacactgtggcaacagagggccgagcttgagaaccaccaccgttacggggaagatcatccacgagtggtgctgtcgctcctgcaccctgcctcccttgcggtttaggggggaggacggttgctggtacgggatggaaatccggccggtcaaagagaaggaagagaacctagtccgtagtatggtgtcggccggaagcggggaggtggactctttctccctgggtatcctctgcgtatctatcatgatagaagaagtgatgcggagccgctggagtcggaagatgctgatgaccggaactctggctgtgtttttactgctgatcatgggacaactcacgtggaacgatctgatccggctgtgcatcatggtaggggcaaacgcttccgacaagatggggatgggcaccacttacctcgccctgatggccacatttaagatgcgcccaatgttcgccgtagggttgctcttccggcgcctgacgagcagagaggtgctgctcctgacgattgggttgtccctagtcgcgtctgtcgaactgcccaactccctggaagagctcggagatggcctggcgatgggcatcatgatgctgaagctcttgaccgagttccagccccaccagctgtggaccacgctgttaagcctgaccttcatcaagactacgctctccctggactacgcctggaagacgaccgccatggttctgagtatcgtgtccctattccctctgtgcttaagcaccacctcgcagaagacgacctggctcccggtcctgcttggcagcttcgggtgcaaacccctaacaatgttcctgataaccgagaataagatctggggaaggaagtcatggcccctgaacgaggggataatggccatcggcatcgtctcaatcctcttatctagcctactcaagaatgacgtgccactggcagggccgctgatcgccggcggcatgctcatcgcctgctacgttatttccggcagcagcgcagacttatccctagagaaggccgcggaggttagctgggaggaggaagccgaacactccggcactagccacaacatcttggtagaagtgcaggacgatgggacgatgaagatcaaggacgaggagcgggatgacaccctgacgatcttactcaaggccaccctgctagccgtttcgggagtgtaccctatgtctattcccgcgacgctcttcgtgtggtacttctggcagaaaaagaagcaacgctccggtgtcctgtgggacacccctagcccacccgaagtggagcgggccgtgttggacgacggcatttaccggatcctgcagcggggtctcttggggcgatcccaggtgggtgtgggcgtgtttcaggacggcgtcttccacaccatgtggcacgtgacgcgcggcgccgtgctaatgtatcagggcaagcgcctcgagcccagctgggcctccgtaaagaaagacctgatctcttacggcgggggctggcggttccaaggctcatggaacacgggcgaggaggtccaggtgatcgccgtcgaacccgggaagaaccccaagaacgtccagaccaccccaggcacatttaagacgcccgagggcgaggtcggggccatagccctagattttaagccaggtacctcagggtcccccatcgtcaatcgcgaaggcaaaatcgtaggcctctacgggaacggagtggtcaccaccagcgggacgtacgtgtccgccatcgcccaggccaaggcctcccaggagggccccctaccagagatcgaggacgaggtgttcaagaagcggaacctgaccatcatggatttacacccgggctcgggtaagacccgccggtacctaccagcaatcgtgcgcgaagccatcaaacgcaaactgcgcaccttgatcctggcccccacccgggtcgtggccagcgagatggctgaggctctgaagggtatgcccatccgctaccagacaaccgccgttaaaagcgagcacaccgggcgcgagattgtggatctcatgtgccacgccacgttcaccatgcggctcctgtccccggttcgcgtcccaaactacaatatgatcatcatggatgaagcccacttcaccgaccccgcaagcatcgccgcccgggggtacatctcaaccagggtgggaatgggcgaggccgctgcgattttcatgacggccacgccgcccgggagcgtggaagccttcccacagtcaaacgccgtcatccaggatgaggagcgggatatccccgagcgcagctggaattcaggctacgactggataaccgatttccccggacggactgtgtggttcgtgcccagcatcaagtccggcaacgacatcgccaactgcctccgcaagaacggtaagcgggtaatacagctgtcacggaaaacgttcgataccgagtaccagaagacaaagaacaatgactgggactacgtggtcaccacggacatctccgagatgggcgcgaactttcgagcagaccgggttatcgacccccgccgctgcctgaagccggtcatcctcaaggatggccccgagcgggtgatactggcggggccaatgccagtgactgtagcgagcgctgcacaacgccggggcagaatcggcaggaaccaaaacaaggagggggaccagtacgtttacatgggtcagcccctgaacaatgacgaggaccacgcccattggaccgaggccaagatgctcctcgataacattaacacccccgaggggatcattccggccctgttcgaaccagagagggaaaaatcggcggcaattgacggagaataccgcctccggggagaggcacgcaaaacgtttgtggagctgatgcggcgaggcgaccttcccgtgtggctctcatacaaggttgcctccgagggtttccagtattccgatcggcgctggtgcttcgacggtgagcggaacaaccaggtgcttgaggagaatatggacgtggagatttggactaaggagggtgagcgcaagaagctccggccccggtggctcgacgcccgcacttactctgatcctctggcgctgcgtgaattcaaagagtttgccgcagggcggcggagcgtcagcggcgacctcatccttgagatcggcaaactgccccagcacctcaccctgcgggcgcagaacgcgctggacaacctggtgatgctgcacaacagtgaacagggcggaaaggcgtaccgccatgctatggaggaactccccgacaccatagaaactctcatgctgctggccctcatcgccgtgttaaccgggggcgttaccctcttcttcctatccgggaagggcttaggcaagacgtcaataggtctgctctgcgtgacggcgagttccgctttgctgtggatggccagcgtcgagccccactggattgccgcctccatcatcctcgagttcttcctgatggtcctgctcatcccggagcccgaccggcagcgtacgccgcaagacaaccagctcgcgtatgtggtgattggcctcctattcatgatcctgaccgtcgcggccaacgagatggggctgttagaaaccaccaaaaaggacttgggcattgggcacgtggccgccgagaaccaccagcacgcgaccatgctggacgtggatttacggccggcctccgcctggacgctgtacgccgtcgccaccacggtgattacgcccatgatgcgtcacacgatcgagaacaccaccgcgaatatcagtctgaccgccattgcaaaccaagccgccattcttatgggcctcgacaagggctggcccatcagcaaaatggacatcggggtgcccctgctcgccctgggatgctacagtcaagtaaaccccctaacgctcaccgccgccgtgctgatgctggtggcccactatgccatcatcggacccggcttacaggccaaagcaacgcgggaggcccagaagcgcacagccgcggggatcatgaagaaccccaccgtcgacggtatcgtggccattgatttggatcccgtggtctatgacgctaagttcgaaaagcaactaggtcagatcatgttgttaatattatgcactagtcagatcctcctgatgcgcacgacctgggccctgtgcgagtccatcaccctcgccaccgggccgctgacgaccctgtgggaaggctcgcccggtaagttctggaacactaccatcgcggtgtccatggcgaatattttccgggggtcatacctggccggcgcggggctggccttcagtttgatgaagtccctcggaggggggagaagagggaccggcgcgcaaggcgagaccctgggggagaagtggaaacgccagctgaaccaactctccaagtccgagttcaacacctataagaggagcggtatcatggaggttgaccgtagtgaggccaaggagggattaaagagaggcgaaaccacgaaacacgcggtcagtcggggaaccgcgaagctgcgatggttcgtggagcgcaatctggtcaagcccgagggcaaggtcatcgacctcgggtgtgggcgaggtgggtggtcctactactgtgctggcctgaaaaaggtgaccgaagttaaggggtacacgaagggtggccctgggcacgaggagccgatccctatggccacctacgggtggaaccttgtaaagctccacagcggcaaagacgtgttcttcatgccgccggaaaagtgtgacacgctgctttgcgacatcggcgagagctcgccgaaccccacgatcgaggaggggcgtacacttcgggtgctgaagatggttgagccctggctgcgcggcaaccagttctgtattaagatcctcaacccatacatgccgtccgtagtggagaccctggaacagatgcagagaaagcatgggggcatgctggtccgcaaccccctcagccggaactccacgcacgagatgtattgggtgagctgcggtacggggaacatcgtgtccgccgtgaacatgacgagccgcatgctcctgaaccggttcaccatggcccaccgcaagcctacttacgaacgcgatgtggacctcggcgccggtacccgccatgttgcggtcgagcccgaagtggccaacctggacattatcgggcagcgcatagagaatatcaaaaacgagcacaaatccacctggcactacgacgaagataacccatacaagacatgggcctaccatggcagctacgaggtgaagccctcggggtccgcctccagcatggtcaacggggtagtccggctgctaacaaagccctgggacgtcatacccatggtgactcaaatcgccatgaccgacaccacgccgttcgggcagcagcgcgtctttaaggagaaggtagatacccggactccccgggccaagcggggaaccgcgcaaatcatggaggtcacggccaagtggctgtggggcttcctgtcccgcaacaagaagccccgaatctgcacccgcgaggaattcaccagaaaggtacgctcgaacgcagccattggcgcagtcttcgtggacgagaaccagtggaacagcgccaaagaggcagtggaggacgaacggttctgggacctcgtgcaccgcgaacgggaactccataagcagggcaaatgcgcgacatgcgtgtacaacatgatggggaaacgcgagaagaaactgggagagttcgggaaggcgaagggctcacgagcaatctggtacatgtggctcggcgcacgcttccttgagttcgaggccctgggttttatgaatgaggaccactggttctcgcgcgagaacagtctcagcggtgtcgagggggaaggactgcacaagctggggtatatactaagggacatctcgaagataccgggcggtaacatgtacgcagacgacacggccgggtgggacacccggatcacagaggacgatctgcagaacgaggccaagattaccgacataatggagcccgagcatgccttactcgcgacgagcatcttcaagctgacctaccaaaataaggtggtgcgagtccagcggcctgccaagaatggcaccgtgatggatgtgatctcacggcgcgaccagcgggggagcggccaggtcggaacgtacggtctgaacacgtttacaaacatggaagtgcagctcattcggcagatggagtcggagggcatcttcctgccctccgagcttgagactccaaacctcgccgagcgggttctggactggttggaaaagcacggggccgagcgcctcaaacgcatggctatctccggcgacgattgcgtagtcaaacctatcgatgaccgctttgccacggctctcatcgctttaaacgacatggggaaagttaggaaggacatcccccaatgggagccctcgaaggggtggaacgactggcagcaggtaccgttttgctcccaccacttccaccagctcattatgaaggacggccgtgagatcgtggtgccctgccgcaaccaggacgagttagtcgggcgggcccgggttagccagggtgccgggtggtccctgcgcgagacggcctgcctcggcaagagctacgctcagatgtggcagctgatgtacttccaccggcgcgaccttcggctcgccgccaatgcaatttgttccgccgtccccatagactgggtacccacttctcgcaccacctggagcatccacgcgcaccaccaatggatgacaacggaggacatgctgtccgtttggaacagagtgtggatcgaggagaacccgtggatggaggataaggctcacgtctccagttgggaggaggtgccatatctggggaagcgcgaggatcagtggtgcggcagcctaatcggcctgaccgcccgcgccacgtgggccaccaacatccaagtagctatcaaccaggtcagaagactcatcgggaacgagaactacctcgattatatgacttccatgaagcggttcaagaacgagtcagaccccgagggcgcgctgtgg

SEQ ID NO: 24776 - RNA, 9879 nt, synthetic construct
  misc_feature 1..9879: note = derived and/or modified CDS sequence (opt11) from DENV-1__JF459993__SS-prME
  source 1..9879: mol_type = other RNA
agcgtgaccatgctgttcatgctcctgcccactagcctggccttccacctcacaacccggggcggcgagccgcatatgatcgtgagtaagcaagagcgaggcaaatccttactcttcaagactagcgccggggtgaacatgtgcaccctaatcgccatggacctgggcgagctgtgcgaggacaccatgacctacaagtgcccgcgcatcacggagaccgagcccgacgacgtggattgttggtgcaatgccacggagacctgggtgacctacggtacctgctcccagacgggcgagcaccgacgcgataaacggagcgtggccctcgcgccccatgtgggcctgggtctggagacccggactgagacgtggatgagtagcgagggcgcctggaagcagatacagaaagtggagacgtgggcgctcgggcaccccggcttcacggttatagccctgttcctggcccatgccatagggacctccatcacgcagaagggcattatcttcatactcctgatgctggtgacccccagcatggcgatgcggtgtgtcggcatcggaaaccgcgacttcgtggaaggcctctccggggccacctgggtggacgtcgtactggagcacggcagctgtgtcactaccatggctaaggacaagcctacgctggatattgaactcctgaagaccgaggtcactaaccccgcaatcctgcgcaagctctgtatcgaggccaagatctccaacaccacaaccgatagccgctgcccgacccagggggaggcgaccctggtggaggagcaggacacgaactttgtgtgccggcgcaccttcgtcgaccgggggtggggcaacgggtgcggcctgttcggaaaggggtccctcatcacgtgtgccaagttcaagtgcgttactaagctggagggcaagatcgtgcagtacgagaacctgaagtacagcgtcatagtgaccgtgcacaccggagaccagcaccaggtcggcaatgagaccaccgagcacgggaccacggccaccatcacgccccaggccccgacatccgagatccagttgacggactacggcgctctcaccctggactgcagcccccgcaccgggctcgacttcaacgagatggtgctgctgacaatgaaggagaagtcctggctcgttcacaagcagtggttcctggatctgcctctcccttggacgagcggggcgagcacctcccaggagacctggaaccggcaggatctgctggtgacctttaagacggcccacgccaagaaacaggaggtggtagttctcggcagccaggagggtgccatgcacaccgccctgaccggcgcgaccgagatccagacatccgggaccacgaccatcttcgccggtcacctgaagtgccgcctcaagatggacaagctaacgctgaagggtgtctcgtacgtcatgtgcaccggctccttcaagctcgagaaggaggttgccgagacccagcatggcaccgtgttggtccaggtgaaatacgaagggacggacgccccttgcaaaatcccattcagctcccaggacgagaagggggtaatccagaacgggcggctgatcacggccaacccgatcgtcacggacaaggagaagcccgtgaacatcgaggcggagccgcccttcggggagagctacattgtagtcggcgccggggagaaggccttgaaactttcctggttcaagaagggttcgtcaatcgggaagatgttcgaggcgaccgcgcggggcgcccgtcgcatggcaatcctgggggatacggcttgggacttcgggagcatcggcggggtttttaccagtgtgggcaaactggtacaccagatcttcgggaccgcctacggcgtactgttctcgggggtgtcctggaccatgaagataggcatcggcatcctgctgacgtggctcgggctcaactctaggtcaaccagcctgtccatgacatgcatcgcggtcggcatggttaccctctacctgggggtgatggtccaagccgacagcggctgtgttatcaactggaaggggcgagagttaaagtgcggctccggcatcttcgtcaccaacgaggtacacacctggaccgagcagtacaagttccaggccgactccccgaaacggctcagcgccgccatcgggaaagcgtgggaggagggagtgtgcggtatcaggtccgccacccgcctagagaacatcatgtggaagcagatctcaaacgagctaaaccacatcctcctggagaacgacatgaagttcaccgtggtcgtgggtgacgtggcagggatcctggcccagggcaagaagatgattcggccccagccaatggagtataaatactcctggaagtcatggggaaaggccaagataatcggggcggacgtccagaacgccacattcatcatcgacggccccaacaccccggagtgccccgacgaccaacgcgcgtggaacatctgggaggtggaggactacgggttcgggatcttcaccaccaacatctggttgaaactgcgggactcctacactcaagtgtgcgaccaccggctgatgtcagccgcgatcaaggattccaaagccgtccacgccgacatgggctattggatcgagagcgagaaaaacgagacctggaagctcgcccgagcttcgttcatcgaggtcaagacctgcgtgtggcctaagagccacaccctctggtccaacggggtcctggagagcgagatgataatacccaagatctatggcggtcccatatcccagcacaaccaccgccccggttacttcacgcagacagcggggccctggcacctcggtaagctggagctggactttgacctctgcgaagggaccaccgtggtcgtcgacgagcactgcgggaaccgaggcccgagcctgagaacaaccaccgttaccgggaagatcatccacgagtggtgctgcaggtcctgcaccttgccgcccctcaggttcagaggggaagacgggtgctggtacggcatggagatccgcccagtgaaggagaaggaggaaaatctggtaaagagcatggtcagcgcgggctccggggaggtggacagcttttccctgggcctcctgtgcatctctatcatgattgaggaggtcatgcggtcccgctggtctcggaaaatgctgatgactgggaccctcgccgtgttcttcctgctgatcatgggtcagctcacttggaacgacctgatccgcctgtgcatcatggtgggggccaacgcctcagatcggatgggcatgggtactacctacctcgcgctcatggccacctttaagatgcgcccgatgtttgccgtcgggctcctgttccggagactaacctctagagaggtgctcctcctgacgatcggcctgtccctggtggcaagcgtggagctgcccaacagtctggaggagctaggggacggcctggccatgggcatcatgatcctaaagctcctgaccgacttccagagccaccaactgtgggcaaccctcctgtccctgacctttatcaaaacaaccttctcgctccactacgcctggaagactatggccatggtgctatcaatcgtcagcctgttccccctctgcctgagcaccacgtcacagaagaccacatggctgcccgtgctcctgggctccttaggctgcaagccgctcaccatgttcctgatcgccgagaataaaatctgggggcgcaagtcttggcccctgaacgagggcatcatggcggtcggtatcgttagcatcctcctgtccagcctcctcaagaacgacgtgccactggccggccccctgatcgccggcgggatgctcatagcgtgttacgtgatctccggctcctctgcggacctgtccctggagaaggcagccgaggtcagttgggaggaggaggccgagcattctggggcatcccacaatattctcgtggaggtacaagacgacggcacaatgaagatcaaggacgaggagcgggacgacaccctgaccattttgctcaaggccaccctgttagccgtcagcggggtgtacccgctctccatccccgcgaccttgttcgtgtggtacttctggcaaaagaagaagcagcggagcggcgtactttgggacacgcccagccctcccgaagtagaacgcgcggtactggacgacggcatctaccggatcatgcagcgcgggctgctgggccggtcccaggtcggcgtgggcgtattccaggagaacgtcttccacaccatgtggcacgtgaccagaggggccgtgctgatgtaccagggcaagagactcgagccatcctgggccagcgtcaagaaggacctgatctcctacggcgggggctggagactgcagggaagctggaacaccggcgaggaggtccaggtgatcgccgtcgagcccggcaagaaccccaaaaatgtgcagacggcccccggaaccttcaagacccccgagggcgaagttggagctatcgccctcgatttcaagcccggaaccagtggcagcccgatcgtcaatcgggagggcaagatcgtgggcttatacgggaacggggtggtcacgaccagcgggacgtatgtgtccgctatcgcgcaggcaaaggcctcgcaagagggcccgctgcccgagatcgaggacgaggtcttccgcaagcggaacctcaccatcatggacctccaccccggatccggcaagacgcgccggtacctgccggccatcgtccgcgaggcgatcaagcggaagctccgcaccctgatcctagcccccaccagggtggtggcgagcgagatggctgaggccctaaagggcatgcccatccgttaccagaccacggcggtcaaatccgagcacaccgggaaggagatcgtggatctgatgtgccacgccacctttaccatgcgcctgctctcgcccgtgcgggtcccgaactacaatatgataatcatggacgaggcccacttcacggacccgtccagcattgccgcgcgcggctacatctccacccgggtggggatgggcgaggcggcggccatcttcatgaccgccacgccgcccgggagcgtggaagcgttcccgcagtccaacgctgtcatccaggacgaggagcgggacatacctgagcggagctggaactccggctacgagtggatcacggactttcccggcaagaccgtctggttcgtgcccagcatcaagtcgggaaacgacatcgccaactgtctgcgcaagaacggcaaaagggtaatacagctgagccgtaagaccttcgacaccgagtaccagaaaacgaagaacaacgactgggactacgtcgtgaccaccgacatctccgagatgggggccaacttccgggccgatcgcgtcatcgacccgcgtcgatgcctcaagcctgtgatcctcaaggacggcccggaacgggtcatcctagcgggacccatgcctgtgaccgtggccagcgccgctcagcgccgcggacgcatcggccggaaccacaataaggagggtgaccaatacatctacatgggccagcccctcaacaacgacgaggatcacgcccactggacggaggcgaagatgctgttagataacatcaatacccccgaggggatcatcccagccctcttcgagccggagcgcgagaagtccgccgccatagacggcgagtaccggctgcgcggggaggccagaaagaccttcgtcgagctgatgcggcgcggcgatcttcccgtgtggctgagttacaaagtggcgagcgaaggcttccagtactctgaccggcgctggtgcttcgacggcgagcggaacaaccaagtcctggaggagaacatggacgtggagatctggaccaaggagggtgagaggaagaagctgcggccccgctggctggacgcccggacttactccgaccccctggctctccgcgagttcaaggagttcgccgccgggcggcgcagtgtctcaggcgacctgatcctggagataggcaagctcccgcagcacctgactcagcgagcccagaacgccctggacaacctcgtcatgctgcacaattccgagcagggcgggcgagcctaccggcacgctctggaggaactccccgacaccatcgagaccctgatgctgctagcgctgatcgccgtgctgaccgggggcgttaccctcttcttcctgagcgggcgcggcctgggtaagacctccattgggttgctttgcgtcatggccagctccgccctgctgtggatggccagcgtcgaaccccactggatcgcggcctccatcatcctggagttcttcctgatggtccttctcatccccgagccggatcggcagcgcactccccaggacaaccagctggcctatgtcgtgatcggtctcctgttcatgatcctgaccgtggccgccaacgaaatgggcttgctggaaaccaccaagaaggacctgggcattgggcacgtcgctgtggaaaaccatcaccacgccagcatgctcgatgtggacttacaccccgcctcggcctggacgctctacgccgtcgctaccacgatcatcaccccgatgatgcggcacaccatagagaacactacggccaacatctccctcaccgcgatcgccaaccaggccgcaatcctgatgggcctggacaagggctggccgatctccaagatggacattggggtgcccctcctggccctgggctgttacagccaggtgaaccccctcaccctcaccgccgccgtcctgatgctagtcgcgcactacgccatcatcgggcccggcctgcaggccaaggcgacgcgggaggcccagaagcggacagcggccgggatcatgaagaaccccacggtcgacggcatagtcgctatcgacctggaccccgtggtgtacgacgccaagttcgagaagcaactcggccagatcatgctgctgatcctatgcacgtcccagatccttctgatgcggacgacatgggccctctgcgagagcataaccctggcaaccgggcccctgacgacgttgtgggaaggctccccggggaagttttggaacaccactatcgccgtctccatggccaacatctttcgcggcagctacctggccggcgccgggttagcgttctccttaatgaaatccctgggcgggggccggcgcgggacgggcgctcagggcgagacgctgggagagaagtggaagcgtcagctgaaccagctgtccaagtcagagttcaatacctataaacgctccggcatcatggaagtggataggagcgaggctaaggaggggctgaagcgcggcgagaccacgaaacacgccgtgtcccgggggaccgcgaaattacgctggttcgtcgaacggaacctggttaagcccgagggcaaggtaatcgacctggggtgcgggcgcggcgggtggagctactactgcgccggcctgaagaaggtcacagaggtcaaggggtacaccaagggcggcccggggcacgaggagcccatccctatggccacgtacggctggaatctcgtgaagctgcactccgggaaggacgtcttctttatcccgcccgagaagtgcgacaccctgctttgcgatatcggcgagagctcccccaatcccaccatagaagaggggcggaccctgcgcgttcttaagatggtggaaccctggctacggggcaaccaattctgcatcaagattctgaacccgtacatgcccagcgtcgtcgaaacgttagagcagatgcagcgcaagcacggcgggatgctcgtgaggaacccactgtcccggaacagcacccacgaaatgtattgggtctcctgcggaaccgggaacatcgtgagcgcggtgaacatgacgtcccggatgctgctcaaccgcttcactatggcccatcggaagcccacatacgagcgcgatgtcgatctgggcgctggaactcgccacgtggccgtggagcccgaggtcgccaacctggacatcatcggtcaacggatcgagaacataaagcacgagcacaagagcacctggcattacgacgaggacaacccgtacaagacatgggcctatcatggctcatacgaagtaaagccgtcggggtccgcatccagcatggttaacggagtggtgaagctcctgacaaagccctgggatgtcatcccgatggtgacccagatcgctatgaccgacaccacgccattcggccagcagcgcgtgttcaaggagaaggtagacacccggaccccgaaggccaagcgcggtaccgcacagatcatggaggtgacggcaagatggctgtggggctttctctcgcgcaataagaagccccggatctgcacccgcgaggagttcacgcggaaggtgcgtagcaacgccgcgataggggccgtcttcgtggacgaaaaccagtggaactccgccaaagaggccgtcgaggacgagcggttctgggacctggtccaccgcgagcgggagctgcacaagcaaggcaagtgcgcgacctgcgtgtacaacatgatggggaaaagagagaagaaactcggcgagttcggcaaggccaagggcagccgcgccatctggtatatgtggctgggcgcacgcttcctggagttcgaggccctcgggttcatgaacgaggaccactggttttcccgggaaaattccttatccggagtggagggtgagggcctgcacaaactcggctacatcttacgggacatctctaaaatccccggcggcaacatgtacgcagacgacacggctgggtgggatacccggatcaccgaggacgacctgcagaacgaggccaagatcaccgacatcatggagccggagcacgccctgctggccaagtccatcttcaagctgacgtaccagaacaaggtcgtacgcgtgcagcggcccgcgaaaaacgggaccgtcatggacgtgatctcccgccgcgaccagcgggggtccggacaggtgggaacctacgggcttaataccttcacgaacatggaggcccaactcatccgtcagatggaaagtgaggagatcttctcccccagcgagctggagacccccaacctcgctgaacgcgtcctggactggctggagaaatacggcgttgaacgcctcaagcggatggccatctcaggggacgactgcgtggtaaagccgatcgatgaccgattcgccaccgcgctgaccgccctgaacgacatgggcaaagtcaggaaggacatcccccagtgggagcccagcaaggggtggaacgactggcagcaggtccctttttgcagccaccacttccatcagctcatcatgaaggacggccgcgaggtcgtggtgccctgcagaaaccaagacgaactggtcggccgcgcccgtgtgtcccagggggccggctggagcctgcgcgagacggcctgcctcggaaaatcgtacgctcagatgtggcagttgatgtacttccatcggcgcgacctaaggctcgcagcaaacgccatttgtagcgcggtgcccgtggactgggtgcccacctcccgtaccacctggagcattcacgcgcatcaccagtggatgacgaccgaggacatgctgtccgtgtggaaccgggtatggatcgaggagaacccctggatggaggacaagactcatgttagctcctgggaggacgtgccgtacctgggcaagcgcgaggaccaatggtgcggtagcctcatcggcctgaccgcccgggccacgtgggccaccaacatccaagtcgctattaaccaagtgaggcgcctcatcgggaacgagaactacctcgactacatgacctccatgaagcggttcaagaacgagagtgaccccgaaggggcactgtggtga

SEQ ID NO: 24777 - RNA, 9876 nt, synthetic construct
  misc_feature 1..9876: note = derived and/or modified CDS sequence (opt11) from DENV-1__KF672763__SS-prME
  source 1..9876: mol_type = other RNA
agcgtcaccatgctgctcatgttgctgcccactgccctcgccttccacctgaccacccggggcggggaaccgcacatgatcgtttctaagcaggagcggggcaagagcttgctgttcaagacatctgcgggggtgaacatgtgcaccctgatcgccatggacttgggcgagctttgcgaggataccatgacctacaagtgcccccggatcaccgaggccgagcccgacgatgtggattgctggtgcaacgccaccgacacttgggtgacctatggaacatgtagccagaccggcgagcaccggcgggacaagcgttccgttgctctcgcgcctcacgtgggtctggggttagagacgcggaccgagacctggatgagttccgagggcgcctggaagcaaattcagaaggtcgagacctgggccttacggcaccccgggttcaccgtgatagcactgttcctcgcgcacgccatcgggacgagcatcacgcagaaggggatcatctttatcctacttatgcttgtgactccctccatggcgatgcggtgcgtgggcatcggaaaccgggacttcgtggaggggctgagcggcgccacgtgggtggacgtcgtgctggagcacggttcctgcgtgaccactatggccaagaacaagccgaccctcgatatcgagctgctgaagacggaggtcactaaccccgctgtgctccgcaagttgtgcattgaggcgaaaatctcgaacaccactacggactcccggtgcccgacccagggcgaagccaccctggtggaggagcaggatgccaacttcgtctgccgccggaccttcgtggaccgcggctgggggaacggctgcggtctcttcggtaaaggaagcctgctgacgtgtgctaagttcaagtgtgtgaccaagctcgagggcaagatcgtccagtacgaaaacctgaagtattccgtaatcgtgaccgtgcacaccggcgaccagcaccaggtggggaatgagacaaccgagcacggcaccatcgcaaccatcacgccccaagccccgaccagcgagatccaactcaccgattacggggcgctcacactggattgcagcccccggaccggcctggacttcaacgagatggtgctcttgacgatgaaagagaagtcctggctggtgcacaagcagtggttcctcgacctgccgctgccctggacctccggggcctcgaccagccaggagacctggaaccgccaggacctcctggtgacgttcaaaaccgcccacgctaagaagcaggaggtcgtggtgctgggctcccaggaaggcgccatgcacaccgccttgaccggggccacggagatccagaccagcggaaccaccacgattttcgccggacaccttaagtgccggctgaagatggacaagctcactctgaagggtacctcctacgtaatgtgcaccgggtcttttaagctggagaaggaggtggcggagacccagcacggcaccgtgctggttcaggtgaagtacgagggcaccgacgctccgtgcaaaatccccttctccacccaggacgagaagggggtgacgcagaatgggcggctgatcaccgccaacccgatcgtaactgacaaagagaagcccgtgaacatcgagaccgagcctccatttggggagagctacatcgtggtcggcgtgggcgagaaggccctgaagctctcctggttcaagaaaggtagctccatcggcaagatgtttgaagcgacggcccgcggggcccgccggatggctatcctcggtgacaccgcctgggacttcgggagcataggcggtgtgttcacctccgtgggtaaactggttcaccaggtgttcggaaccgcgtacggggtgctgttcagcggcgtgtcctggacgatgaagatcgggatcggcatcctcctgacctggctgggactcaacagccgctcgacctcgctctccatgacctgcatcgccgtggggatggtcacgctgtacctcggcgtgatggtgcaggcggacagcgggtgcgtcatcaactggaagggccgcgaactcaagtgcggttccggcatctttgtcaccaacgaggtgcacacctggacagagcagtataagttccaggcagacagcccgaagcggctgagcgctgcgatcggccgcgcctgggaggagggggtctgcggaatccggtccgccacccgcctcgagaacataatgtggaagcagatctcaaatgaactgaaccatatcctgttggaaaatgacatcaagtttaccgtggtggtcgggaatgccgacggcatcctggcccaggggaagaagatgatccggcctcaacccatggagcacaagtactcctggaaaagctggggcaaggcgaagatcattggggccgacatccagaacaccactttcatcattgacggacccgataccccggagtgccccgacgagcagcgcgcctggaacatatgggaggtggaggattacggctttgggatcttcacgaccaacatctggctgaagctcagagactcatacacccaaatgtgcgaccatcgcttgatgagcgctgcgatcaaggactccaaggccgtgcatgccgacatgggctactggatcgagagcgagaaaaacgagacctggaagctggctcgggcctccttcatcgaggtcaagacgtgcatctggcccaagtcccacaccctatggtccaacggcgtgcttgagagcgagatgatcatccccaagatgtacgggggcccgatctcccagcacaactaccgacccgggtactttacccagaccgcgggtccctggcacctggggaagttggagctggacttcgatctttgcgagggaaccaccgtagtcgtggatgaacactgcggctcccgggggccatccctgaggactaccacggtgacgggcaagatcatccacgagtggtgctgccggagctgcaccctgccgcccctgcgcttccgcggggaggacggctgttggtatgggatggagatccgccccgtcaaagagaaggaggagaacttggtgcggtcaatggtgagcgccggcagcggcgaggtggactccttcagcctggggattctatgcgtatccataatgatcgaggaggtgatgcgcagccgttggtcaagaaagatgctcatgaccggcaccctggcggtcttcctgctcctgatcatggggcaactaacctggaacgaccttattcgcctttgcatcatggtcggcgccaacgccagcgacaagatgggaatgggcacaacctacctggcgctcatggccacgtttaagatgcggccgatgttcgccgtggggctgctgttccgcaggctgacctcccgcgaggtgctgctgctcaccatcggactgtctctgatggcctccgtggagctccccaacagcctggaagaactgggcgacggccttgccatgggcataatgatgctcaaactgctcaccgaatttcagccccaccaactgtggacgacactgctctccctgacattcatcaagaccacgctgagcctcgactatgcttggaagaccaccgccatggtgctgtccatcgtgagcctgttccccctctgcctgtcgaccacctcccagaagacgacctggctgccagtcctcctgggctccttcgggtgcaagcccctgaccatgttcctcatcactgagaacgagatctggggccgaaagagctggcccctcaacgagggcataatggctatcggcatcgtctccatcctgctcagcagcttactgaagaacgatgtgcccctcgccggcccactgatcgcaggcggcatgcttatagcctgctatgtgattagcgggagctccgcagacctcagcctggagaaagccgccgaagtcagttgggaggaggaggcagagcactccggcacgtcccacaacatcctggtggaagtgcaggacgacgggaccatgaaaattaaggacgaagaaagggacgacaccctcaccatcctgctgaaggcaacgctactcgctgtcagcggcgtctacccgatgtccatccccgccaccctgttcgtgtggtacttctggcagaagaagaagcagcggagcggggtcctatgggataccccctccccgccagaggtggagcgcgccgtgctagacgacggcatttaccggatactgcagcgcggcctgctcgggaggagccaggtcggcgtgggggtgtttcaggacggggtcttccacacaatgtggcacgtgacgagaggggcggtgctgatgtaccagggcaagcgtttggaaccttcctgggcctccgtcaagaaggacctcatatcctacggcgggggctggcgcttccaggggagctggaacaccggcgaggaggtacaggtgattgccgtcgagcccgggaagaatccgaagaacgttcagacgacccccggcacttttaaaaccccagagggcgaggtgggggccatcgccctggactttaagcccggcaccagtgggagcccgatcgtcaacagagaaggcaagatcgtgggtctgtatgggaacggcgttgtcaccacgtccgggacctacgtgtccgcaatcgcccaggcaaaagccagccaggagggcccccttcccgagatcgaggacgaggtgtttaagaagcgcaacctgaccatcatggacctgcatccgggatccggcaagacccggcgctatttacccgccatcgtcagagaggcgatcaagcgaaagctccggacgctgatactcgcccccacccgagtggtggcgagcgagatggcagaggcgctaaagggcatgcccatccgataccagaccaccgccgtaaagtctgagcacacggggcgggagatagtggacctgatgtgccacgccaccttcaccatgcgcctcctgagcccggtccgggtccccaactacaacatgattatcatggatgaggcccacttcacagatcccgcctccatcgcggcccgcgggtacatcagcacccgggtggggatgggcgaagccgccgcgatcttcatgaccgcgactccgcccggatccgtggaggccttcccccagagcaacgccgtcatccaagatgaggagcgcgacatccccgagcggtcctggaacagcggttacgactggatcaccgatttccccggcaagacggtgtggttcgtgccctccattaagagcgggaacgacattgcaaactgcctgcgcaaaaatggtaaaagagtcatccagctttcccgcaagacctttgacaccgaataccagaagacgaagaacaacgactgggactacgtggtgacgaccgacatcagtgagatgggcgctaactttcgggcggaccgcgtcatcgacccccgacgctgcctgaagcccgtgatccttaaggacggccccgagcgggtgatcctcgccgggccgatgcccgtcaccgtggcttccgccgcgcagcgccggggacgcatcggacggaaccagaacaaggagggcgatcagtacgtctacatgggccagcccttgaacaacgacgaggaccacgctcactggaccgaggccaaaatgctgctggacaacataaacacgcccgaagggattatcccggccctgttcgagcccgagcgcgagaagtccgccgcgatcgacggcgagtaccgcttgcgcggggaggcccgtaagaccttcgtggagctgatgcggcgaggtgatttacccgtgtggctgtcctacaaggttgcaagcgagggcttccagtactccgacagacgctggtgtttcgacggtgagcggaacaaccaggtgctcgaggagaacatggatgtggagatatggaccaaggaaggtgaacgcaagaagctgcggccccggtggctcgacgcccggacctacagcgatccactcgccctgcgagagttcaaggaatttgcggcagggcgccgcagcgtctccggcgacctgatattggagatcggcaagctgccccagcacctgaccctccgggcgcagaacgccctggacaacctggtgatgctccacaacagcgaacagggcgggaaggcatataggcacgcgatggaggagctgccagacacgattgagaccctgatgctcctagcgctgatagccgtgctcaccgggggcgtcaccctgtttttcctgtcagggaagggtctcggtaagactagcatcgggctgctgtgtgtgacggcctccagcgctctcctgtggatggcctccgtggagcctcactggatagccgccagtatcatcctggagttcttcctgatggtcctgctgatcccggagcccgacagacagcgcacgccccaggataaccagctcgcatatgtggtgattggcctgttattcatgatcctcaccgttgcggcgaacgagatgggtctgctggagacgaccaaaaaggacctcgggatagggcacgtggccgccgagaaccaccaacacgccaccatgctggacgtagacctgcaccctgcatccgcctggacactctacgccgttgccacgaccgtgatcacccccatgatgcggcacaccatagagaacacgaccgccaacatcagcctgaccgctatcgccaatcaggccgccatcctgatgggcctggacaaaggctggcctatctccaagatggacctgggagtgccactgcttgcactgggatgctacagccaggtcaacccgctaaccctcacggcagccgtcctgatgctggtagcccattacgccatcatcgggcccggcctccaggcgaaggccacccgcgaggcccagaagcggaccgctgcaggtatcatgaagaaccccaccatcgacggcatcgtcgcaatagatctggaccccgtggtgtacgacgccaagttcgagaaacagctgggccagatcatgctcctgatcctgtgcacttcccagatcttactgatgcgcaccacatgggccctgtgcgagagtatcacactcgccacgggaccactaaccacactgtgggagggctcccccgggaagttttggaataccacgatcgccgtcagcatggccaacatattccgcggctcctacctcgccggcgccgggcttgcattcagcctgatgaaatccctcggcggagggcggcgcgggacgggtgcccaaggcgagactctgggggagaagtggaagcggcaactcaatcagctcagcaagagcgagttcaacacgtacaagagaagcggcataatggaggtagaccggtcagaggcgaaggaagggctcaagcgaggcgagacgacgaagcacgccgtgtcgcgggggaccgccaagctgcgctggttcgtcgagcggaacctggtgaagcccgaaggcaaggtgatcgacctcggctgcgggcgcggcgggtggagctactactgcgccggtctgaagaaagtcaccgaggtgaaggggtataccaagggcggcccggggcacgaggagcccattcccatggcgacctacggctggaacctggtgaagctccactcagggaaggacgtcttcttcatgcccccggagaagtgcgacaccctgttgtgcgacataggcgagagctctcccaacccaaccatcgaagaggggcgtaccctccgcgtgctgaagatggtggagccctggctgcggggcaaccagttttgcatcaagattctcaatccctacatgccgagcgtcgtagaaacgctggagcagatgcagcgtaaacacggcgggatgctcgtacgaaatcccctctcccgcaacagcacccatgagatgtactgggtcagttgcggcaccgggaatatcgtgagcgccgtgaacatgacctcccggatgctgcttaaccgattcaccatggcccaccggaagcccacctacgagcgcgacgtcgacctcggcgccggcaccagacatgtggccgtggagcccgaagtcgcgaacctggacatcattggacagcggattgaaaacatcaaaaacgagcacaagagcacctggcactacgatgaggataacccctacaaaacgtgggcgtaccacggcagctacgaggtgaaacccagcggatccgccagctctatggtgaacggcgtagtgcgcctgcttaccaagccttgggacgtcattcctatggtaacccagatagcgatgaccgacactaccccgttcggccagcagcgggtgttcaaggagaaggtagacactaggacgcctcgagcaaagaggggtacggcgcagatcatggaggtgaccgccaaatggctgtgggggttcctcagtcggaacaaaaagccccgcatctgcacccgggaggagttcaccaggaaggtgcggagcaacgctgccatcggggcggtcttcgtggacgagaaccagtggaactccgcgaaggaggccgtggaggacgagcgcttctgggacctagtgcaccgtgagcgcgagctgcacaagcaaggcaagtgcgccacatgcgtgtataacatgatggggaagcgggagaagaagctgggggagtttgggaaggccaagggcagccgcgcaatctggtacatgtggcttggcgccagattcctggagttcgaggccctggggttcatgaacgaggaccactggttctcccgcgaaaacagcctctccggcgtggagggggagggcttgcacaagctggggtatatcctccgggacatctctaaaataccgggcggcaacatgtacgccgacgacacggccgggtgggacacccgcatcactgaggacgacctacgtaacgaggcgaagataactgacatcatggagcccgaacacgctctgctcgccacgtccatattcaaactgacctaccagaacaaagtcgtgcgtgtgcagcgccccgcaaagaacgggaccgtcatggacgtgatcagtaggcgcgaccaacgggggtccggccaggtgggaacatacggtttgaatactttcaccaacatggaggtccagctcatccgccagatggagtccgagggaatcttctttccctcagagctggaaagcccgaatcttgcggagcgcgtgctcgattggctggagaagcacggggcggagcgcctgaagcggatggccatttccggcgacgactgcgtggtcaagcccatagacgaccgcttcgccaccgccctcatcgcactgaacgacatggggaaagtgcggaaggacattccccagtgggagccctctaagggctggaacgactggcagcaggtaccgttttgctcccatcatttccatcagctgatcatgaaggacggacgggagatagtcgtgccctgccggaaccaagacgagctcgtggggcgcgctcgggtctcacagggcgccgggtggtctctgcgggagactgcctgccttggcaagtcctacgcccagatgtggcagctgatgtacttccaccgacgcgatctgcgtctcgccgccaacgccatttgctcggcagtgccagtggactgggtccccaccagccgcaccacctggagcatacacgcccaccaccagtggatgacgacggaggacatgctctccgtgtggaaccgggtctggatcgaggagaacccgtggatggaggacaagacccacgtcagctcttgggaagaggtgccctatctggggaagcgcgaggaccaatggtgtggcagcctgattggcctcaccgcgcgcgccacctgggcgaccaacatccaggtcgccatcaatcaggttcgccgcctgatcgggaacgagaactacctggactacatgacctctatgaagcggttcaagaacgagagcgatcccgagggcgccctttgg

SEQ ID NO: 24778 - RNA, 9876 nt, synthetic construct
  misc_feature 1..9876: note = derived and/or modified CDS sequence (opt11) from DENV-1__KF672764__SS-prME
  source 1..9876: mol_type = other RNA
agcgtgaccatgctactcatgctgctgcccaccgccctcgcgtttcatttaacaacccggggcggggagcctcatatgatcgtatccaagcaggaaaggggcaagagcctactgttcaaaaccagtgcgggggtgaacatgtgtactctaatcgccatggacctgggcgagctctgcgaggataccatgacctacaagtgcccccggatcacagaggcggagcccgatgacgtggattgctggtgcaacgccaccgacacctgggtcacctacgggacctgcagccagaccggcgagcaccggcgtgataagcgatcggtcgcgctggcgccccacgtgggcttggggctcgagaccaggaccgagacctggatgagctccgagggcgcctggaagcagattcagaaggtcgagacgtgggccctgcggcaccccgggttcacagtgattgccttatttttggctcacgccatcggaaccagcattacccaaaagggaatcatcttcatcttgctgatgctcgtgaccccctccatggccatgcgctgtgtcgggatcggcaaccgggacttcgtggagggactgagcggcgccacatgggtggacgtcgtgcttgagcacgggtcctgcgtgaccaccatggccaagaacaagcccaccctcgacatagaactgttgaaaacggaggtcacaaaccccgccgtactcagaaagctgtgcatcgaggctaagatcagcaacaccaccacggactcacgttgcccgacacagggagaggccacgttagtggaggagcaggatgccaatttcgtctgccgccggaccttcgtggatcgcggctgggggaacggctgcggcctgtttgggaaggggtccctcctcacgtgcgccaagttcaagtgcgtgactaaacttgagggcaagatcgtccagtacgagaacctaaagtacagcgtcatcgtgaccgtccataccggcgaccagcaccaagtcgggaacgaaacgacagagcacggcaccatcgccaccatcacgccccaggcccccacgagcgagatacagctgacggactacggggccttaaccctggactgctctccccggaccggcctggacttcaacgaaatggtcctcctgacgatgaaggagaagtcctggctggtgcacaaacagtggtttttagatctgccgctgccttggaccagtggggccagtaccagccaggagacctggaatcgtcaggacctcttagtgactttcaagacggcccacgccaagaagcaggaggttgtggttctgggctcccaagagggtgccatgcacacggccctcactggtgcaactgagatccagaccagcggtacgaccacgatcttcgccgggcacctgaagtgccggctgaagatggataagctcacactgaagggcacctcctacgtcatgtgtaccgggtcgttcaagctggagaaggaggtggctgagacacagcacggcaccgtacttgtccaggtgaagtacgagggcaccgacgcaccgtgcaagatccctttctccacacaggacgaaaagggggtgacccagaacggccgcctcataaccgcaaacccgatagtaaccgacaaggagaaacccgtgaacattgagaccgagccacccttcggggagtcctatatcgtggtaggcgccggcgagaaggccctcaaactatcctggtttaagaaggggagctccatcgggaagatgttcgaggctacggcaaggggggcacgccggatggccatactcggcgacaccgcttgggacttcgggtctatcggcggcgtgtttacttccgtggggaagctcgtccaccaagtattcggcactgcctacggggtgctgttcagcggcgtctcctggaccatgaagatcgggatcggcatccttctgacatggctgggcctgaacagccgctccacctctctgagcatgacctgcatcgccgtgggtatggtgacgctatacctcggcgttatggtgcaggccgactctggttgcgtgatcaactggaagggtcgggagctgaaatgcgggtcaggcatttttgtcaccaacgaagtgcatacctggacggagcagtacaagttccaagccgattccccgaagcggctgtctgcggccatcggccgcgcgtgggaggagggggtatgtggaatccggtcagccacccgcctcgaaaacatcatgtggaagcagatcagcaacgagctgaatcacatcctcctcgagaatgacatcaagttcacggtcgtggtggggaacgccaacggaatcctgacccagggcaagaagatgataagaccccagcccatggagcacaagtactcctggaaatcctggggtaaggcgaagataatcggcgccgatatccaaaacaccaccttcatcatcgacgggcccgataccccggaatgccccgacgagcagcgcgcctggaacatctgggaggtcgaggactacggattcggtatcttcacaacgaacatctggctaaagctccgggactcctacacccagatgtgtgaccaccgcctaatgagcgcagcgatcaaggactccaaggcagtgcacgccgacatggggtattggatcgagtctgaaaagaacgagacatggaagctggcccgggccagcttcatcgaggtaaagacatgcatatggccgaagtcccacaccctctggtcgaacggagtcttagagtcagagatgataatccccaaaatgtacggcgggccgatctcccagcacaactaccgcccaggctacttcacccaaacggcgggcccctggcacctggggaagcttgagctggacttcgacctttgtgagggcaccactgtggtggtcgacgagcactgtggtagccgggggccatccctccgcacaacaaccgtgaccggcaagataatccatgaatggtgctgcaggagctgcaccctccctcccttgcgctttcgcggtgaggatggctgctggtatgggatggagattcgccctgtgaaggagaaggaagagaaccttgtcaaatccatggtgagtgccggcagcggcgaagtagactccttcagcctggggatcctgtgcgtcagcatcatgatcgaggaggtgatgcggagccgttggagtcgcaagatgctcatgacgggcaccctggccgtgttcctgctattaatcatggggcagctaacctggaacgatttaatccgcttatgtatcatggtcggcgccaacgccagcgacaagatggggatgggtaccacctacctggcgctcatggctaccttcaaaatgcgaccgatgtttgctgtggggctgttattccggcgcctcacctcccgggaggtgctgctgcttaccatcggcctgtccctggtcgcctccgtagagttacccaactcgctcgaggagctgggagacgggctcgccatgggaatcatgatgctgaagctgctcaccgagttccagccgcaccaattatggaccactttactctctctaaccttcatcaagacgaccctttccctcgactacgcgtggaagaccaccgccatggtcctctctatagtcagcctgttcccactttgcctgtccacgacctctcagaagaccacctggctgccggtactactgggcagtttcgggtgcaagcccctaacaatgttcctcatcacggagaacaaaatctgggggcgcaagtcatggccactaaacgaggggatcatggccatcggcatcgtctccatccttctaagcagcctgctgaagaatgatgtccccttagcagggccgctgatcgcgggaggcatgctgatcgcctgttacgtgatttccgggagttccgccgatttgtcgttggagaaagccgctgaggtctcctgggaggaggaagcagagcatagcggtaccagtcataatatattagtggaggtgcaggacgacgggaccatgaagatcaaggacgaggagagggacgacaccctcacgatcctgctgaaagccactcttctggccgtaagcggcgtgtaccccatgtccatccctgccaccttattcgtgtggtatttctggcagaagaagaagcagcgcagcggtgtcctctgggacaccccctctcctcctgaggttgagcgtgccgtgcttgacgacggtatctatcgaatcctgcagcggggcctcttggggcgcagccaagtgggcgtgggtgtgttccaagacggcgtgttccacactatgtggcatgtgacccgcggggccgtgctgatgtaccagggcaaacgcctggagccatcctgggccagcgtcaagaaggacctcatctcctacggcggaggctggcggtttcagggtagctggaatacgggcgaggaggtacaggtgatcgccgtcgaacccggcaagaatccgaagaacgtgcagaccacacccggcaccttcaagaccccagagggcgaggtgggggcgatcgccttggacttcaagcccggcacgtcggggagcccgatcgtcaaccgcgagggtaagatcgtgggcctgtatggtaacggcgtggtcacgacttccgggacctatgtcagcgcgattgcccaggccaaggccagtcaagagggccccctccccgagatagaagacgaggtgttcaagaagcggaatttaactatcatggacctgcacccgggttccggcaagacgcgccggtacctccccgcgattgtccgcgaagcgatcaaaaggaagctgcgcacattaatccttgcccccactcgggttgtggccagcgagatggccgaggcgctgaaaggaatgcccatccgataccagaccacggccgtcaaatccgagcatactggccgcgaaatcgtagacctgatgtgccacgcaacgttcactatgagattgctgagcccggtgcgcgtgcccaattacaacatgatcataatggacgaggcccacttcacggaccccgcatcgatcgccgctcggggctatatcagcacgagagtggggatgggtgaggccgccgctatattcatgaccgcgacaccgccggggtccgttgaggccttcccccagagcaacgcagtcatccaggacgaggagcgagacatccccgagcgctcctggaattcaggctacgactggattacggacttccccggcaagaccgtgtggttcgtgccaagcatcaagagcgggaacgacatcgccaactgcctgcggaaaaacggcaagcgcgttatccagctctcccggaagaccttcgacaccgagtatcagaaaacgaagaacaacgactgggactatgtggtgactaccgacatctcagagatgggagcaaacttccgggcagaccgggtgatcgacccacgccggtgcttaaagcccgtgatcctgaaagacggacccgaacgcgtgatcctcgccgggccgatgcccgtaaccgtagcctccgccgcgcaacggcgcggccggataggcagaaaccagaataaggaaggggaccagtacgtctatatgggccagcccctaaacaatgacgaggaccacgctcattggacggaggccaaaatgctgctcgacaatataaacacccccgagggtatcatcccggcactgttcgagcccgagcgggaaaagtccgccgcgatcgacggcgagtaccgcctgcgcggggaagccaggaagactttcgtggagctcatgcgcaggggggacctgcccgtgtggctgtcctacaaggtggccagcgaaggctttcagtactccgaccgccggtggtgctttgacggggagcgtaacaatcaggtgctcgaagagaatatggacgtggagatctggaccaaagagggcgagcggaagaagctgcgccctcggtggctggacgcccgcacttacagcgacccgctcgccctgagggaattcaaggagttcgcagccgggcgccggagtgtctcgggcgacctgattctcgagattggcaagctgcctcagcacctgacgctgcgcgcccagaacgccctggacaacctggtgatgctccacaacagcgaacaagggggaaaggcctaccggcacgcaatggaggagctgccagacaccatcgagaccttgatgcttctcgccctgatcgccgtgctcaccgggggggtaacgctgtttttcctgtccgggaagggtctcgggaaaacatctatcggtctgctgtgcgtcacggcgtccagcgccctcctgtggatggcctccgttgagccccactggatcgcagccagcatcatcctggagttcttcctcatggtcctgctgatcccggaaccagaccgccagcgtacacctcaggacaaccagttagcctacgtggtgatcggcctgttattcatgatcctgactgtcgctgccaacgagatggggctgttagagaccaccaagaaggacctcggcatagggcacgtggccgccgagaaccatcagcacgcgaccatgctggacgtggacctgcacccggcgtccgcttggacgctatacgccgtcgccaccaccgtgatcacccccatgatgcgccacacgatcgagaacaccactgccaacatcagcctgaccgcgatcgccaaccaggccgcaatattgatgggcctcgacaagggctggcccatctccaagatggacctgggggtgcccctgctcgccttagggtgctatagccaggtcaacccgctgacgctgacagcagccgtgctgatgctagtggcacattacgccattatcgggcctggcctccaggcaaaggcgacgcgggaggcccagaagcgtactgccgccggtatcatgaagaaccccacggtcgacggcatcgtggcgatagacctggaccccgtggtctatgatgccaaattcgagaaacaactgggccaaatcatgctcctcatcctgtgcacctcccagatcctcctgatgcggaccacgtgggccctgtgcgagagcatcacactcgccaccgggcctctgaccacgctgtgggaaggctctcccgggaagttctggaacacaaccatcgccgtgagcatggcgaacatattccgcggctcctacctcgcaggcgccgggctggcgttctctctgatgaagtccctcggaggggggcgccgggggactggcgcccagggagagacgctgggggagaagtggaagaggcagctgaaccaactcagcaaaagcgagttcaatacctacaagaggagcggaatcatggaggtcgaccgcacggaggcgaaggaggggctcaagcggggcgaaaccaccaagcacgccgtctcgagagggaccgccaagctacggtggttcgtggagagaaacctggtgaagcccgaaggtaaggttatcgacctcggttgcgggcggggcggatggtcctactactgcgctgggctcaagaaggtgaccgaggtcaaggggtacaccaagggtgggcccggtcacgaagagccgatccccatggcgacctacggctggaatctagtcaaactccattccgggaaggatgtgttcttcatgccacccgagaagtgcgataccctcctgtgcgacatcggagagtccagcccgaatccaacaatagaggaggggcgaaccctgcgtgtactcaagatggtcgagccatggctaagaggcaaccagttctgcatcaaaatcttgaacccctacatgccgtccgtggtggagactctggagcagatgcagcggaagcacggcgggatgttagtgcggaaccccttgagccggaactccacccatgagatgtactgggtaagttgtggcacgggtaatatcgtgtccgcagtcaacatgaccagccgcatgctcctaaatcggttcactatggcccaccgaaagcccacatatgagcgggatgtggatctcggagccggcacgcgccacgtggccgtcgaaccggaggtggcgaacctggacatcatcgggcaacgcatagagaatatcaagaacgagcacaagtccacctggcactatgacgaggataacccatataagacctgggcctaccacggcagctatgaggtgaagccttccgggagcgcctcgtcaatggtcaacggcgtggtccgcctgctcactaagccctgggacgtgatacccatggttacccagattgccatgaccgacaccaccccgttcgggcagcagcgcgtcttcaaggaaaaggtggatactcgaactcctcgggccaagcgcggcaccgcgcagatcatggaggtgaccgccaagtggctttggggcttcttatcccgcaacaaaaagccccggatctgcacgcgtgaggagttcactcggaaggtccggagcaatgctgccattggggccgtgttcgtggacgagaaccaatggaatagcgccaaggaggccgtcgaagacgagcgtttctgggacctcgtgcaccgggaaagagaactccacaagcagggcaaatgcgcgacatgcgtgtacaacatgatggggaagagagagaaaaagctgggggagttcgggaaggccaaaggctcccgcgctatctggtacatgtggctaggcgcccgattcctggagtttgaggccctggggttcatgaacgaagatcactggttctctagagagaactccctcagcggcgtcgaaggggagggcctgcacaaactaggttacattctccgcgacatctcaaagatcccaggtggcaacatgtacgccgatgacaccgccgggtgggacacgcggatcaccgaggacgacctgcaaaacgaagcgaagatcaccgacatcatggagcccgaacatgcgctactcgccaccagcatcttcaagctgacgtaccagaacaaggtcgtacgcgtccagcgtcccgccaagaacggcaccgtaatggatgtcatctcccgccgcgatcagcgggggagtggacaagtgggcacctacggcctgaacaccttcacgaacatggaggtacagctcatccgacagatggagagtgagggcatcttcttcccgtccgagctggagtccccgaacctagccgagcgcgtgctcgactggctggagaagcatggggcggagcgcctgaagcggatggcgatcagcggcgatgactgcgtcgtgaagcccattgacgacaggttcgccacggccctcatcgctctgaacgacatggggaaagtgcggaaggatatcccccaatgggagccgagcaagggctggaacgactggcaacaggtcccgttctgcagccaccactttcaccaactaatcatgaaagacggccgcgagatcgtggtgccatgcaggaaccaggacgagctcgttgggagggcgcgagtatcccagggcgctgggtggtccctgcgcgagaccgcctgcctgggcaagtcgtatgctcaaatgtggcagctaatgtacttccaccggcgagacctgcggctggcagctaacgccatctgcagcgccgtgcccgttgactgggttcccaccagtcgcaccacttggtccatccacgcacaccatcagtggatgaccactgaggatatgttgagcgtgtggaacagggtttggatcgaggagaacccgtggatggaggataagacccacgtctccagctgggaggaggtcccctacctggggaaaagagaggaccagtggtgcgggagcctgatcggcctcacggcgcgggcgacctgggccaccaacatccaggtcgccattaaccaggtgcgccgtttgatcgggaacgagaattaccttgactacatgaccagcatgaagcggttcaagaacgagtccgaccctgagggcgccctctgg

SEQ ID NO: 24779 - RNA, 9879 nt, synthetic construct
  misc_feature 1..9879: note = derived and/or modified CDS sequence (opt11) from DENV-1__EU863650__SS-prME
  source 1..9879: mol_type = other RNA
agcgtgaccatgctgctcatgctgctgcccacagtgctcaccttccacttaaccacccgcggcggtgagccccatatgatcgtgagcaagcaggagcggggcaagagcttgctgttcaaaacctccgccggggtgaacatgtgcacgctcatcgccatggacttaggcgagctctgcgacgacaccatgacctacaagtgcccccgcatcaccgagacggagcccgacgacgtggactgctggtgcaacgccaccgagacgtgggtgacctacgggacttgcagccagacgggtgagcaccggagggacaagcggtccgtggccctagccccccacgtcggcctagggctcgagacccgaaccgagacgtggatgagctccgagggagcctggcggcagatccaaaaggtggagacctgggccctgcgccaccccggcttcaccgtgatcgctctgttcctcgcccatgccatcggcacctcgatcacgcagaaggggatcatattcatcctgctgatgctcgtcaccccctcaatggccatgagatgcgtgggcatcggtaacagggacttcgtggaggggctgagcggagcgacatgggtggacgtggtcctggagcacgggtcctgtgtcaccacgatggccaaggacaaaccgaccctcgacatcgagctgctgaagactgaagtgaccaacccagctgtgcttcggaagctgtgcatcgaggccaagatttccaacacgaccaccgattcccgctgcccaacccagggagaggcaacattggtcgaagagcaggataccaatttcgtgtgccggcgcaccttcgtggatcggggctgggggaacgggtgcggcctgttcggcaaagggtctctgatcacatgcgcgaagttcaagtgcgtgaccaagctggagggcaagatcgtgcagtacgagaatctcaagtactccgtgattgtcaccgtgcacactggcgatcaacatcaggtcggtaacgagaccaccgagcacggcacgatcgctaccatcactccacaggcacccacttccgagatacaactgacggactacggagcattgaccctcgactgcagcccccggacaggtctggatttcaacgagatggtgctgctcacgatgaaggagaagagttggcttgtccacaagcagtggttcctggacctacccctgccctggacgtcaggggccagcacgagccaggagacctggaaccgtcaagacctcctcgttactttcaagacggcgcacgccaagaagcaggaggtggtggtcttgggctcccaggagggcgccatgcatacggcactgaccggggcaaccgagatccagacgagcggcacgaccaccatcttcgccgggcacctcaagtgccgcctgaagatggacaaactgacgctaaaaggcatctcctacgtgatgtgcaccgggctgtttaagctggagaaggaagtggccgagacccaacacggcaccgtcctggtccaggtcaagtacgagggcactgacgccccatgtaagatccccttctcttcccaggatgagaagggagccacccagaatggccggctcgtcaccgccaacccgatcgttaccgacaaggagaagccagtgaatatcgaggcagagccgcccttcggagagtcgtatatcgtcgtgggcgccggtgagaaggccctgaagctgtcgtggttcaaaaaagggagctccatcggcaagatgttcgaggccacggcgcgaggggctcggcgcatggccatcctcggagacaccgcctgggatttcgggagcattggcggcgtgttcaccagcgtggggaagctggtgcaccagattttcgggaccgcctacggggtgctgttcagcggcgtgtcctggaccatgaaaatcgggatcggaattctcttgacttggctgggactcaactcccgctccaccagcttatccatgacctgtatcgcggtggggatggtgacgctttacctcggcgtaatggtgcaggccgacagtgggtgcgttattaattggaagggccgggagctgaagtgcgggtccggtatcttcgtcaccaatgaagtgcacacctggacggagcagtacaaattccaggcggactcgccgaagcgcctgagcgccgccatcggcaaggcgtgggaggagggggtgtgcggaatcaggtccgccaccaggctcgagaacataatgtggaagcagatcagcaacgagctgaaccacatcctgctcgagaacgacatgaagttcacggtcgtggtgggggacgtctccggcatactggcccagggaaagaagaccatccgtccccagcccatggagcacaagtactcctggaagtcctgggggaaagccaagattatcggcgccgatgtgcagaacactacgttcatcatcgacgggcccaacacgccggaatgtccggacgaccagcgcgcgtggaacatatgggaggtggaggactacggcttcgggatcttcaccaccaacatctggctcaagctcagggatagctacacgcaggtctgcgaccacaggctgatgtccgccgccatcaaggactctaaggcagtgcacgcggacatgggctactggatcgagagcgagaagaatgagacgtggaagctggcccgggccagcttcatcgaggtgaagacctgcgtctggcccaagtcccacaccctgtggagccacggcgtcctggagtccgagatgatcatccccaagatttacgggggcccgatcagccaacacaactaccgccccggctacttcacgcagaccgccggcccctggcacctggggaagctcgagctggactttgatctgtgcgaaggcacaaccgtggtagtggacgagcactgcggcaaccgtgggccgtccctccgcaccacgaccgttacgggcaaaatcatccacgagtggtgctgtagatcctgcaccctgccgcccctgcgtttcaagggggaggacgggtgctggtacgggatggagatccgtcccgttaaggagaaggaggagaacctcgtgaagtccatggtgagcgctggcagcggcgaggtcgactccttcagcctggggctgctttgcatctccatcatgatagaagaagttatgcgcagccggtggtcccgcaagatgctgatgacgggcactctggtggtgttcctcctgcttactctcgggcagctgacctggaacgacctgatccggctctgcataatggtgggcgcgaacgccagcgacaacatggggatgggcacgacctacttggccctaatggcgacattccgcatgcgccctatgttcgccgtcgggctcttgttccgccgactgacctcccgtgaggtgctcttactgacggtggggctcagcctagtcgcctccgtagagctgcccaactctctcgacgaactgggcgatgggttggccatgggaatcatgatcctcaagctgctgaccgacttccagtcccaccagctgtgggcgaccctgctgagcctcaccttcgtgaagacaacgctgtccctgcactacgcctggaagaccatggccatgatcctcagcatcgtctccctcttgcccctctgcctgtcaaccacgtctcagaagaccacgtggctgcccgtgctcctcggctccctggggtgcaagcctctcacgatgttcctgatcaccgagaacaagatctggggccgcaagtcctggcccctcaatgaggggatcatggcggtgggcattgtcagcatactcctgagctccttgctcaagaacgacgttcccctggccggacccctgatcgccggcggcatgctcatcgcctgctacgtgatcagcgggagtagtgcggacctttccctggagaaggccgccaaagtgagctgggaagaggaggccgagcactccggcgccagccataacatccttgttgagatccaagatgacgggacgatgaagatcaaggacgaggagcgggacgacaccatcaccatactgctgaaggcaaccctcctcgccatttcaggggtgtacccgatgagcatccccgccacgctgttcgtctggcacttctggcagaagaaaaagcagcgctccggggtgctgtgggacacccccagcccgcccgaggtggagaaggccgtgctagacgacggcatctatcggattttgcagcgcggcctgctcggccggtcccaggtgggcgtaggggtcttccaggagggcgtgttccacacgatgtggcacgtgaccagaggtgctgtcctgatgtaccagggcaagcggctggagcccagctgggcgagcgtgaagaaggatctcatcagctacggggggggctggcgcttccaggggtcctggaacacgggcgaggaggtgcaagtcatcgccgtggagcccggaaagaatccaaagaacgttcagactgcccccggcaccttcaagaccagcgaaggagaagtcggggccatcgccctggatttcaagcccggaacctccggaagccccatcgtgaatcgggaaggaaagattgtcggcctgtacgggaacggcgtcgtgaccaccagcggcacctatgtgtcagcgatcgcccaggcaaaggccagccaagaaggtccgctccccgagattgaggacgaggtctttcgcaagcggaaccttacaatcatggacctgcaccccgggtccggcaaaacccgccggtacctccccgcgatcgtgcgcgaggcgatcaagcggaagctgcgcaccctggtgctcgccccgacccgggtcgtggccagcgaaatggcagaggcgctgaaaggcatgcccatccgctaccagacgacagcggtgaagtcggaacacaccgggaaggaaatcgtcgacctgatgtgccacgccacctttacgatgcgcctcctgagccctgtgcgggtgcccaactacaacatgattatcatggacgaggcacacttcaccgaccctgcttcgatcgcggcgcgcggctacatctcaactcgcgtcggtatgggtgaggccgccgccatcttcatgaccgcgacgccgcccgggtccgtggaggccttcccccagagcaacgccgtaatccaggacgaggagaaggatatccccgaacgctcatggaatagcggctacgactggattaccgactttcccggcaagacggtctggttcgtgccttccatcaagagcgggaacgacatcgccaactgcctccgcaagaacggtaaacgcgtgatccagctctcccggaagacattcgacacggagtaccagaagacgaagaacaacgactgggactacgtcgtgaccaccgatatttcggaaatgggcgccaactttcgcgcggatcgcgtcatcgacccccgccggtgcctgaagccggtgatcctgaaggacggacccgagcgcgtgatcctcgccgggcccatgcccgtaacggtggcctccgctgcgcagcggcgcggcaggatcgggcgcaaccagaacaaggaaggggaccagtacatctatatggggcagccgctgaacaacgacgaggaccacgcccactggaccgaggccaagatgctcctcgacaacatcaacacccccgaggggattatcccggccctgttcgagcccgagcgggagaagtcggccgccatcgacggcgagtaccgcctgcgcggggaagcccgcaagaccttcgtagagctgatgcgccggggtgacctgcccgtgtggctgtcctacaaagtggctagcgaggggttccaatactcggaccgccggtggtgcttcgacggggagcgcaacaaccaggtgctcgaggagaatatggacgtcgagatatggacgaaagagggtgagcggaagaagcttcgcccccggtggctggacgccagaacctatagcgaccctctcgccctccgggagttcaaggagttcgcggcggggcggcggagcgtgagcggggacctgatcctcgagatcggcaagcttccccagcacctgacgcagcgcgcccagaaggccctcgataacctggtgatgctacacaacagtgagcagggcgggaaggcgtaccggcacgcgatggaagaactcccggacaccatcgagaccatcatgttactggccctcatcgctgtcctgaccggcggggtgaccctgttctttctttccgggcgcgggctgggcaagacctccatcgggctgttgtgcgtcacctcaagctccgctctgctgtggatggcatcagtcgagccccactggatcgccgccagcatcatcctcgagttcttcctgatggtacttctcatccccgaacccgaccggcagaggacgccgcaagacaaccagctcgcgtacgtggtcatcggcctcctcttcatgattctgaccgtcgccgcgaccgagatggggctgctcgagaccacgaagaaagatctgggcatcgggcacgctgccgccgagaaccatcaccacgccgcgatgttggatgtggacctccaccccgccagcgcctggaccctgtacgccgtcgccaccaccattatcacgccgatgatgcggcacaccattgagaacaccaccgcgaacatctccctgacggccatcgctaatcaggccgccatcctcatgggcctggacaagggctggccgatcagcaaaatggacatcggggtgcctctcctcgccctgggctgctactcccaggtcaaccccttaacactcacggcagccgtgctgatgctcgtggcccactacgcgattatcgggcccggcctccaggccaaggccacgcgcgaagcacagaagcgtacggccgcgggcattatgaagaacccgaccgtggacggaatcgtcgccatcgacttggaccccgtggtgtacgacgccaaattcgaaaagcagctaggccagatcatgctcctgatcttgtgcaccagccaaatccttctgatgagaaccacgtgggccctttgtgaatccatcaccctcgccaccggtcccctgaccacgctgtgggagggctcgcccgggaagttctggaacactaccatcgcggtttccatggccaacatcttccgcggcagctacctcgcaggtgccgggctggccttcagcctgatgaaatcactcggcgggggccgccgcgggaccggcgcgcagggcgagacgctgggggagaaatggaagcggcagctgaaccagctcagcaaatcagaattcaaaacgtacaaacgcagcggcatcatcgaagtggaccgctccgaggccaaggaggggctgaagcgtggcgagaccaccaagcacgcggtgagccggggaacggcaaagctgcgctggttcgtcgagcggaacctggtgaagccggaaggcaaggtgatagacctcggatgtggccgcggcggctggtcctactactgcgcaggccttaagaaagtcacagaggtcaaggggagcacgaaagggggccccgggcacgaggaacccattccaatggccacctacggctggaacctcgttaaactgcactccgggaaagacgtattcttcatcccgccggagaagtgcgacaccctgctgtgcgacatcggcgagagctccccgaaccccacgatcgaggaggggcggaccttacgcgtgctgaagatggtggagccgtggcttcggggcaaccagttctgtataaagatcttaaacccctacatgcccagcgtcgtggagaccctggagcagatgcagaggaagcacggagggatgctggtgcggaatccactctcccgcaatagcacccacgagatgtactgggtctcttgcggcacggggaacatcgtgagcgccgtgaacatgacctctcggatgctgctcaaccgcttcaccatggcccaccggaagccgacctacgaacgcgacgtcgacctcggcgccggcacccggcatgtagcggtggagccagaggtcgccaacctggacatcatcgggcagcgaatcgagaacatcaagaacgagcacaagtctacctggcactacgacgaggacaacccctacaagacctgggcataccacggctcctacgaggttaagcccagcggtagtgcctccagcatggtcaacggcgtggtacgccttttgaccaaaccgtgggacgtcatcccaatggttacgcagatcgccatgaccgacaccacccccttcgggcagcaacgtgtgtttaaggagaaggttgacacccgcacccctaaggcgaagcgcggcaccgcccagatcatggaggtgacagcaaagtggctatggggctttctgtcccgcaacaagaagccgcgtatttgcacacgcgaggagttcacacggaaggtgcggtcaaacgccgccataggggcggtcttcgtggacgaaaatcagtggaactccccgaaggaggccgtggaggacgagcgattctgggaccttgtgcaccgcgagcgggagctgcacaaacagggaaaatgcgcgacctgcgtgtacaatatgatgggtaagcgcgagaagaaactgggcgagttcgggaaggccaaaggctcccgcgctatttggtacatgtggctcggcgcccgcttcttagagttcgaagccctggggttcatgaatgaggaccactggttctcccgggagaactccctctcaggcgttgagggggaaggcctccacaagttggggtacatcctccgcgacatcagcaagatcccaggcggcaacatgtacgccgacgacacagccgggtgggacacgcggatcacagaagatgacctccagaacgaggcaaaaatcaccgatatcatggaaccggagcacgccctgctcgctacctcgatcttcaagctgacgtaccagaacaaagttgtgcgagtgcagaggcccgccaagaacgggaccgtgatggacgtgatcagccgccgggaccagcgcgggtctggccaggtgggcacttatggcctgaacaccttcacgaatatggaggcacaattgatccgccagatggagagcgaggggatctttctgccctccgagctggaaccccccaacctcgcggggcgggtccccgactggctggaaaaacacggcaccgagcgcctgcggcgcatggccatctctggtgacgactgtgtggttaagccaatcgacgatcggttcgccaccgcccttaccgccctgaacgacatgggcaaggtccgcaaggacatcccccagtgggagccttccaagggttggaacgactggcagcaggtccccttctgctcccaccacttccaccagctgatcatgaaggacgggcgtgaaatcgtggtcccctgccgcaaccaggacgagttggtgggccgtgcgcgcgtgtctcagggggccggctggtctctgcgggagacggcttgccttggcaagagctacgcccagatgtggcagctcatgtactttcaccgccgggacctgcgcctggcggcgaatgccatctgctcggccgtccctgtggactgggtgccgaccagccggaccacctggtctatccatgcccaccaccagtggatgaccacggaggacatgctcagcgtgtggaaccgcgtatggatagaggagaatccctggatggaggacaagacccacgtgtcctcatgggaagatgttccctatctgggcaagcgggaggaccagtggtgtggatccttgattgggctaaccgcgcgcgccacctgggcaacgaacatccaggtggctattaaccaagtgcggcgcctgatcgggaacgaaaactacttggactacatgaccagcatgaagcgcttcaagaacgagtccgaccccgagggcgccctctggtga

SEQ ID NO: 24780 - RNA, 9879 nt, synthetic construct
  misc_feature 1..9879: note = derived and/or modified CDS sequence (opt11) from DENV-1__KU365900__SS-prME
  source 1..9879: mol_type = other RNA
tccgtgactatgcttctgatgttgatgcccaccgccctggccttccacctcaccacccggggcggggaaccccacatgatagtcagcaaacaggaacggggcaagagcctgctgttcaagacctccgccggggtgaatatgtgcactctcatcgccatggacctgggcgagctgtgtgaggacacgatgacctacaagtgcccccgtatcaccgaggccgagccggacgacgtggattgctggtgcaacgccaccgacacctgggtcacctacgggacttgctcccagaccggcgagcaccggcgggacaagcggagcgtggcattggcccctcacgtgggcctggggctggagacgagaactgagacgtggatgagctccgagggcgcctggaagcagatccagcgggtcgagacctgggccctccgtcaccccgggttcacggtgatcgccctgttccttgcgcacgctataggcaccagcatcacgcagaaggggatcattttcatactcctgatgctggtgacgccctccatggccatgcggtgcgtcggcatcggctcacgcgacttcgttgagggattgtctggcgccacgtgggtggacgtcgtgctggagcacggttcctgcgtgaccaccatggccaaggacaagcccaccctggacatcgagctcctgaagacggaggtcaccaaccccgcagtgctgcggaagctctgcatcgaggccaagatctccaacaccaccacggacagccgctgcccgacccagggtgaggccaccctggtggaggaacaagacgccaacttcgtctgccggcgaacctttgtggaccgaggatggggaaacggctgcgggttgttcggcaaaggctccctaatcacgtgcgccaaattcaagtgcgtgacaaagctcgagggcaaaattgtccagtacgagaatctgaaatacagcgtgatcgtgaccgtccacaccggcgaccaacaccaggtggggaacgagtccacggagcacggtaccacagcgaccatcactccccaggcccctacgaccgagatccagctcaccgattacggggccctgaccctggactgcagcccccgcacaggcctagacttcaatgagatggtcctgctgaccatgaaggaaaagagttggctcgtgcacaagcagtggttcctggacctgcccctcccctggaccagcggggccagcacctcccaagagacgtggaaccggcaagacctgctggtgacctttaagaccgcccacgcgaagaagcaggaggtcgtggtgctcggcagccaggagggcgccatgcacaccgcccttacaggggccacagagatccaaacctccggcaccacgaccatcttcgccgggcacctgaagtgcaggttgaagatggacaagctgaccctgaagggtatgagctacgtcatgtgcacggggtccttcaagctcgagaaagaggtagcggagacgcagcacggcaccgtgctggtgcagattaagtacgagggcactgacgccccctgcaagatccccttcagcacccaggacgagaagggggtgactcagaacggccggctgatcaccgccaacccgatcgtaaccgacaaggagaagcccgtcaatatcgaggcagagccgccctttggggagtcctacatcgtgatcggcgcgggcgagaaggccctgaagctcagctggttcaagaaggggtctagcatcggcaagatgttcgaggccaccgcacgcggggcgcggcgcatggcaatcctgggcgacacggcctgggacttcgggtctattggcggggtgttcaccagcgtcgggaaactggtgcaccagatcttcggcaccgcctacggggtactcttctccggcgtcagctggaccatgaagatcgggatcggcgtgctgctgacgtggctcggcctgaactcccgctcaacctcactgagcatgacctgcattgcagtgggactcgtcaccctgtatctgggggtgatggtgcaagctgactccggctgcgtcatcaactggaagggccgggagctgaagtgcgggagcggcatattcgtgacgaatgaggtgcacacctggacagagcagtacaagttccaagcggatagcccgaagcgcctgtccgccgccatcggcaaggcctgggaagagggggtctgcggcatccggagcgccacccgcctggagaacattatgtggaagcagatctccaacgaactcaaccacatcctgctggagaatgacatgaagttcacagtagtggtcggggacgtggccggcatcctcgcccaggggaagaaaatgattcggccccagcccatggagcacaagtacagctggaaatcctggggcaaggccaagatcatcggggccgacgtgcagaacaccaccttcatcatcgacgggcctaacaccccggagtgtcccgacgaccagcgcgcgtggaacatctgggaggtcgaggattatggcttcgggatcttcaccacgaacatctggctgaagctgcgggattcatacacacaggtgtgcgaccaccgcctcatgagtgccgctataaaagacagcaaggccgtgcacgcagacatgggctactggatcgagtccgagaaaaatgagacctggaaactggcgcgggcctcattcatcgaggtgaagacctgcatctggcccaagtcccacacgctgtggagcaacggcgttctcgagtccgagatgatcatacccaagatctacggtggcccgatcagccagcacaactaccgtcccgggtactttacgcagaccgccggaccctggcacctggggaagctggagctcgacttcgatctgtgcgagggcaccacggtggtcgtggacgagcattgcggcaatcgggggccgtccctgcgcactaccaccgtgacgggcaaaatcatccacgagtggtgctgccggagctgcaccctgccgcctctcagattccgcggggaggatggctgctggtacgggatggaaatccgccccgtcaaggagaaggaggagaacctcgtgaagtccatggtgagcgccggcccaggcgaggtcgacagcttctccctcggactgctctgcatcagcataatgatcgaagaggtgatgcggtctcggtggagccggaagatgctcatgaccggcaccctggccgtgttcttcctgctcatcatggggcagctgacgtggaacgacctgatccgcctctgcatcatggtcggtgcgaacgcctccgaccgcatggggatgggcacgacctacctggccctaatggccaccttcaagatgcgtcccatgttcgccgtcggcctccttctgcgaagactcacgagccgcgaagtgctcctgctcaccatcgggctgtccctggttgcgagcgtggagctccccaactccctggaggagttgggcgacgggctggccatgggcatcatgatcctgaaattactcactgacttccagagccaccagctgtgggccaccctgctctccctgacgtttatcaaaactaccttcagcctgcactacgcctggaaaaccatggcgatggtcctctccatcgtgagcctgttccccctgtgcctctccacgacgagccagaaaaccacctggctgccggtgctgctcggctcgctggggtgcaagcccctgacgatgttcctcatcgcagagaacaagatctggggccgaaagagctggcccctgaacgaggggatcatggccgtcggcatcgtgtctatcctgctctccagcctgctgaagaacgacgtgcctctcgccgggccgctgatagcaggcggcatgctgatcgcgtgctacgtgatctccgggagctccgccgacctcagcctggagaaagccgccgaggtgtcctgggaggaggaggccgagcacagcggcgcatcccacaacatactggtggaggtccaggacgacgggaccatgaagattaaggacgaggagcgcgatgacaccctcaccatcctgctgaaggccaccctgctggccgtgtccggtgtttaccccctgtccatccctgccacccttttcgtctggtacttctggcagaagaagaaacagcgtagcggggtgctatgggacaccccctcgccacccgaagtcgagagagccgtcctggacgacggcatctaccggatcatgcagcgcggactgctcgggcggagccaggtgggcgtgggggtcttccaggagaacgtgttccacactatgtggcatgtgacccgcggtgcggtgctgatgtaccaggggaagcggctggagccctcctgggccagtgtgaaaaaggacctcatctcctacggcggcgggtggcgccttcagggcagctggaacacgggggaggaggtgcaggtcattgccgtggagcccggcaagaacccgaagaatgtgcaaaccgcccccgggaccttcaagacccccgagggcgaagtcggcgccatagcgctggacttcaagcccggcacgtccggaagcccgatcgtgaaccgggaggggaagatcgtgggcctctacggcaatggcgtagtgacgacctccggcacctacgtaagcgccatcgcccaggcaaaggcgagccaggaggggccgctgcccgagatcgaggacgaggtcttccgcaagcggaacctgacaatcatggacctccacccgggctccggcaagactcgccgatacctgcccgccatcgtgcgcgaggccatcaagcggaagctacgcaccctcatcctggcacccacccgcgtggtcgccagcgagatggcggaggctctgaagggcatgccaatccggtaccaaacgacagctgttaagtcagagcacaccggtaaggagatcgtggatctcatgtgccacgccacctttacgatgcgcctgctgagcccggtgcgggtgcccaactacaatatgatcataatggacgaggcccattttaccgacccctctagcatcgcggcccgcgggtacatttccacccgggtgggcatgggggaggccgccgccatctttatgaccgcgacgcccccagggagcgtcgaggccttcccacaatccaacgccgtcatccaggacgaggagcgggatattcccgagcggagctggaactccgggtacgagtggattacagacttccctggcaagaccgtgtggttcgtcccgagcatcaaatccggaaacgacatcgctaactgcctccgcaagaacgggaagcgggtgatacaactgagccgcaagaccttcgacacggagtaccaaaagaccaagaacaacgactgggactatgtggtcaccaccgacatctccgagatgggcgcgaacttccgggccgaccgcgtgatcgacccccggcgctgcctcaagcccgtgatactaaaggacgggcccgagagagtcattctggccggcccgatgcccgttacggtcgctagcgccgcgcagagacgcgggcgcatcggccggaaccacaacaaggagggcgaccagtacatatacatggggcagcccctgaacaacgacgaggatcacgcccactggaccgaggcgaaaatgttactggacaacataaacacccccgagggcatcatcccggccctgttcgagcccgagcgcgagaagtccgccgcgatcgacggggagtaccgcctccggggcgaggcccgcaagaccttcgtggagctgatgcggcgcggggacctgcccgtgtggctctcttacaaggtcgccagtgagggcttccagtacagcgaccggaagtggtgcttcgacggcgagcgcaacaaccaggtgctggaggagaacatggacgtggagatctggacgaaggagggggagcggaaaaagctgcgccctcggtggctcgacgcccgcacctacagcgacccgctggccctgagggagttcaaggagttcgcggccggccgcagatccgtcagcggggacctcattctggagattggcaagctcccccagcacctcacccagcgcgcccagaacgctctggacaacctcgtgatgctccacaattccgagcagggcgggcgagcgtaccgccacgccatggaagagttaccagataccatcgagacgctgatgctcctggccctgatcgccgtgctcaccggcggggtcaccttatttttccttagcgggcgggggctcggcaagacttccatcggcttactgtgcgtgatggcctccagtgtgctcctgtggatggcgagcgtcgagccccactggatcgccgcttcaatcatcctcgagttcttcctcatggtgttgttaatcccggagccagaccggcagaggacgccccaggacaaccagctcgcctacgtggtcatcgggttactattcatgatcttaacggtggccgccaacgagatgggcctgttagagaccaccaagaaggacctcggtatcggccacgtggccgtcgagaatcaccaccacgcgaccatgctggatgtggatttgcaccccgccagcgcctggacgctctatgcggtggccactaccatcatcacgccgatgatgcgccacaccatcgagaacaccacagccaatatctctctgaccgccattgccaaccaggcggccatcttgatggggctcgacaagggctggcccataagcaagatggacatcggcgtccccctgctggcgctcgggtgctactcccaggtgaatccgctcactctgaccgccgcggtgctcatgctggtggcccattacgccatcatcggccccgggctgcaggccaaggccacccgggaggcgcagaagcgcactgccgctggcatcatgaagaaccccactgtggatgggatcgtggctatagacctcgaccctgtcgtctacgacgccaagttcgagaagcagttgggccagatcatgctgctcatcctgtgtacctcgcaaatactgctcatgcgcacaacatgggcgctgtgcgagtccatcacgttagccaccggtccgctcaccaccctgtgggaagggagcccaggtaagttctggaacacgacaatcgcagtgtcgatggccaacatcttccgggggagctacctggccggcgcgggcctcgccttctccctcatgaagtccctagggggcgggcgccgggggaccggggcccagggcgaaaccctcggcgagaagtggaagcgccagctgaaccagctgagcaagtccgagttcaacacgtataagcggagtgggatcatggaggtcgaccgatccgaggccaaggagggcctcaagcgcggggagaccaccaagcatgcggtgagccgcggcaccgcgaagctgcggtggttcgtagagcgcaacctagtcaagcccgaggggaaggtgatcgacctgggctgtggccgcgggggctggtcctactactgcgccgggctcaagaaggtgacggaggtcaagggctacacgaagggcggccccggccacgaggagccgattcccatggccacctacgggtggaacttagtgaagctgtacagcgggaaggatgtgtttttcatcccgccggagaagtgcgacaccctcctgtgcgacatcggggagtccagcccgaaccccacgatcgaggaggggcgcaccctgcgggtactcaagatggtggagccctggctgcgcgggaaccaattctgcatcaaaattctgaacccctacatgccgtccgtggtcgagactctcgagcagatgcaacggaaacatggcggcatgctggtgaggaaccccctgagccgaaacagcacgcacgagatgtactgggtgagctgcgggaccggcaacatcgtctccgctgtcaacatgacgagccgcatgctcttgaacagatttaccatggcccaccgcaagcccacctacgagaaggacgtggacctgggggccggcaccaggcacgtcgccgtggagcccgaggtagccaacctcgatatcattggccagcggatagagaatatcaagcacgagcacaagtccacgtggcattacgacgaagacaacccgtacaagacctgggcctatcacgggtcgtacgaggttaagccatccggctcggcgtccagcatggtgaacggggtcgtcaagctgctgaccaaaccctgggacgtcatccccatggtgacccagatcgccatgacggacaccaccccgttcggccagcagcgcgtcttcaaggaaaaggtggacacccggacgcccaaggccaagcgcggaaccgcccaaatcatggaggtcaccgcccggtggctctggggcttcttgagtcgcaacaagaagccccggatctgcacccgcgaggagttcacgcggaaggtgcgctcgaacgctgccatcggagccgtattcatcgacgagaaccagtggaacagcgccaaggaggcggtcgaagacgagcggttttgggaccttgtgcaccgcgagagagagctccataagcaggggaagtgtgcgacctgtgtgtacaacatgatgggcaagcgcgagaagaagctgggggagttcggcaaggccaaggggtcccgggctatctggtacatgtggctgggcgcccgcttcctcgagttcgaagcgctgggcttcatgaatgaagaccactggttcagcagggagaactccttaagcggggtcgagggcgaggggctccacaagctgggctacatcctacgcgacatttccaagatcagcggagggaacatgtacgcggacgacaccgccggctgggatacccggatcacggaggacgatctccagaacgaggccaaaataaccgacatcatggagccggagcacgccctgctggcgaaggccatattcaagctcacctatcaaaacaaggtggtgcgcgtccagcggcctgccaagaacgggaccgtgatggacgtgatctcccgccgagaccagcggggcagcgggcaggtcggtacgtatggcctgaataccttcaccaacatggaggcacagctgatccgccagatggaaagcgaagggatctttagccccagcgagctcgaaacccccaacctggccgaacgggtgctggactggctcggcaaatacggagtggagcgcctgaagcggatggcgatcagcggcgacgactgcgtcgtgaagcctattgacgaccgcttcgcaacggccttgacggccttgaacgacatggggaaggtgcggaaggacataccccagtgggagccttccaagggctggaacgactggcagcaggtccccttctgcagccaccacttccaccagctgatcatgaaagacgggcgcgaaatcgtggtgccgtgccggaaccaggatgagctggtcgggcgcgcccgggtgtcccagggcgcggggtggagcctccgcgagaccgcctgcctgggcaagagctacgcccagatgtggcagctgatgtacttccacagacgcgacctccggctggccgcgaacgctatctgttccgcggtgcccgtcgattgggtgcccacctcccgcacgacctggtccatccacgcccaccaccagtggatgaccaccgaagacatgctgagcgtatggaaccgggtatggatcgaggaaaacccctggatggaggacaagacgcatatctccagctgggaggacgttccgtacctcgggaagcgggaggaccagtggtgcggctccctgattggcctgaccgcccgggcaacctgggccaccaacatccaagttgccatcaaccaggtccgtagacttatcgggaacgagaactacctggactacatgacatctatgaagcggttcaagaacgagagtgatcccgagggcgctctctggtag

SEQ ID NO: 24781 - RNA, 9879 nt, synthetic construct
  misc_feature 1..9879: note = derived and/or modified CDS sequence (opt11) from DENV-1__FJ176779__SS-prME
  source 1..9879: mol_type = other RNA
tccgtgaccatgctgctcatgctcatgcccaccgcgctggccttccatttaaccacccggggcggggagccccacatgatcgtatctaaacaggaacggggtaagagcctgctattcaagacctccgcgggggtgaatatgtgcacccttgtggccatggacctgggcgagctctgcgaggacacgatgacatacaagtgccccagaatcacggaagccgaacccgacgacgtggactgctggtgcaacgccaccgacacctgggtcacgtacgggacctgcagccagaccggtgagcaccggagagacaaacggtctgtcgccctcgccccccatgtcggcctgggactggagacgcggaccgagacctggatgtcttccgagggcgcatggaaacaaatccagcgggtggagacctgggccctccgccatcccggcttcacggtgatagccctgtttctagcgcacgccataggcactagtattacccagaaggggatcattttcatcttgttaatgctggtcaccccctccatggctatgcggtgcgtaggtatcggctcacgagatttcgtcgaagggttatccggtgccacgtgggtcgacgtggtgctggaacacgggagctgcgttaccaccatggccaaggacaagccaacactggacatcgagctcctgaagacggaggtgacaaatcctgcagtgctgcggaagctctgcatagaggcgaagatctccaacacgaccacggactcgcgatgccccacccagggcgaggccacactggtcgaggagcaggacgccaacttcgtgtgccgtcgcaccttcgtggaccggggctgggggaatggctgtgggctgttcggcaaggggtccttgctgacgtgcgccaagttcaagtgtgtcaccaagctggagggtaagatcgtgcagtacgagaatctcaagtatagcgtgatcgtcaccgtccacaccggagatcagcaccaggtcggcaatgagtccacggagcacggcaccaccgcgacgatcacgccccaggcaccgacaaccgagatccagctgaccgactacggggccctgacacttgactgcagcccgcgcacgggcctggatttcaacgagatggtgttactcacgatgaaggagaagtcctggctggtgcacaaacagtggttcctggacctcccgctgccgtggaccagcggagctagcacctcccaggagacgtggaaccggcaagatctgttggtcacctttaagaccgcccacgcaaagaaacaggaggtggtggttctgggcagccaggagggcgccatgcacaccgccctgacaggggccaccgaaatccagacgtccggcaccacgaccattttcgccgggcacctcaagtgccgcctgaaaatggataagctcacactcaagggcatgagttacgtgatgtgtaccgggtcctttaaactggagaaggaggtggcggaaacacagcacggtaccgtactggtgcagatcaagtacgagggcaccgacgctccttgcaagatcccattcagcacccaggacgagaagggggttacgcagaacggccggctgataaccgcgaatccgatagtcactgataaagagaaacccgtgaacatcgaggccgaaccgccctttggggagtcctacatcgtgatcggcgtcggcgagaaggcgcttaagctgagctggttcaaaaaagggtccagcatcggcaagatgttcgaagccaccgcccgcggtgcccggcgcatggccatcctgggggacacggcgtgggacttcgggtccatcggcggcgtcttcacctccgtggggaagctagtccaccagatcttcggcaccgcctacggcgtgctgttctccggcgtaagctggaccatgaagatcgggatcggcgtgctgctcacttggctgggcctcaactccagaagcacctccctcagcatgacctgcatagccgttgggttggtgaccctctatctcggcgtcatggtgcaggccgattccgggtgtgtgatcaactggaagggccgtgaactgaagtgcggtagcggcatcttcgtcacgaatgaggtgcatacctggaccgagcagtacaagttccaagccgacagcccgaaaaggctgagtgcggcaatcggtaaagcctgggaagaaggggtctgcggcatcaggagcgctaccagactagagaacattatgtggaagcaaatctctaatgagctgaaccacatcttactcgagaatgacatgaaattcaccgtcgtcgtgggtgacgtcgccggcatcctggcgcagggcaagaagatgatacggccccagcccatggagcataaatatagctggaagaactggggcaaggcgaagatcataggggccgacgtgcagaactccacgttcatcattgacgggcccaatactcctgagtgcagtgacgaccagcgcgcctggaacatatgggaggtggaagactacggttttgggatcttcaccaccaacatatggctgaagctccgcgactcctacacgcaggtctgcgatcaccgcctgatgagtgcggccattaaggactccaaggcggtgcatgccgacatgggctactggatcgagagcgagaaaaacgagacctggaaactagcccgggcgtccttcatcgaggttaaaacctgtatctggcccaagagccacactctctggtccaacggcgtcctggaaagcgaaatgatcatccctaagatctacggcggccccatcagccagcataactaccgcccagggtacttcacgcagaccgccggcccgtggcacttagggaagctggagctggacttcgacttatgtgagggcaccaccgtggtagtcgatgagcactgcggcaaccgggggcccagcctccgcacgaccactgttaccggtaagataatccatgagtggtgttgccggtcatgcacgctgccgcccctccgcttccggggggaggatggctgctggtatggcatggagatccgccccgtgaaggagaaggaggagaacctcgtcaagagcatggtgagcgccggatccggggaggtggatagtttctccttgggtttgttgtgcatcagcatcatgatagaggaggtgatgcggtcgcgctggagcaggaagatgctgatgacgggaactctagccgtgttcttccttctgatcatggggcagctgacgtggaacgacctcatccgcttatgcataatggtgggcgccaacgcatccgaccgcatgggaatgggcacgacgtacctggctctaatggcaaccttcaaaatgcggccaatgttcgcagtcggcctcctgtttcgccggctcacttcgcgcgaggtgctcctgctcacgattgggctgagcctggtcgccagcgtggaactccctaactccctggaggagctgggcgacggccttgcgatgggcatcatgatcctgaaactgctcaccgacttccagagccatcagctgtgggccaccctgctcagtatgacattcatcaagacgaccttcagcttacactatgcctggaagactatggcgatggtgctgtccatcgtcagcctcttccccctgtgcttatccaccacgagtcagaagacgacctggttgcccgtgctgctgggctccctggggtgcaaacccctcaccatgttcctgattgccgagaataaaatctggggccgcaaaagctggccgctcaacgagggtatcatggccgtgggcatcgtcagcatcctcctgtccagcctcctgaagaacgacgtgcccctggcggggcccctcatcgccggaggtatgctgatcgcctgctatgtgatctcagggtcatcggcagacctgtcgctggaaaaggccgcagaggtctcctgggaggaggaggccgagcatagcggggcctcccataacatcttggtagaggtgcaggacgacgggacgatgaagataaaggatgaggaacgagacgacaccctgaccatcctccttaaggcgaccctgttagccgtcagcggtgtgtaccccctatctatcccggcaaccctcttcgtgtggtacttctggcagaagaaaaagcaaagaagcggggtcctctgggacacccccagtccgcccaaggtggagcgcgcggtgctggacgacggcatctaccggataatgcagcgcgggctgcttgggcgtagccaggtcggcgtcggggtgttccaggaaaatgtcttccacacgatgtggcacgtcacccgcggcgctgtcctcatgtaccagggaaagcggctggaaccgagctgggccagcgttaagaaggacctgatctcctacggaggggggtggagactacaaggctcatggaacaccggggaagaggtccaggtgatcgccgtcgagcccggcaagaatccgaagaacgtgcagacggcccccggaactttcaagaccccggagggcgaggtcggcgctatcgccctggactttaagcccgggacctccgggtcccccatcgtcaaccgggaggggaagatagtgggcctgtacggcaacggcgtggtcacgacctccggcacttacgtgtccgcgatcgcccaggccaaagccagccaggagggccccctccctgaaatcgaggacgaggtgtttcgcaagcggaacctgaccatcatggacctgcaccccggctccgggaagacgagacgttatcttccagccatcgtacgcgaagcaattaagcggaaaatgcgcaccctgatcctggccccgacccgcgtggtggccagcgagatggccgaggcgttaaagggcatgcccatcagatatcagaccacggccgtcaagagtgaacacaccggcaaggaaatcgtggacctgatgtgtcacgcaaccttcaccatgcgactgctcagcccagtacgggtacccaactacaacatgatcataatggacgaggcccatttcacggacccctccagcatcgccgcgcgcgggtacatctccacccgggtgggtatgggggaggccgccgccattttcatgaccgccacgccacccggctccgtggaggcattcccccagtccaatgcagtcatacaagatgaggagagagatatcccggagcggagctggaactccgggtacgagtggattacggagttcccaggtaaaactgtgtggttcgtgccttccatcaaggcaggcaatgacatcgccaactgcctgcggaagaacggaaagcgggtcatccagctgtcccgtaagacgttcgacactgagtaccagaagacgaagaacaacgactgggattacgtggtgactaccgacatcagcgagatgggcgcgaatttcagagctgatcgcgtcatcgacccccgacgttgccttaagccggtgatacttaaagacgggccagagcgggtcatactcgccggccccatgccggtgaccgtggcctccgcagcgcagcgtcggggtcgtatcggccggaaccacaacaaagagggcgaccagtacatctacatgggtcagccgctaaacaacgacgaggaccatgcgcactggaccgaggccaagatgctgctggacaacatcaacacgcccgagggcattatcccagccttattcgagcccgaacgcgagaaatccgccgccatcgatggtgagtatcgcttacggggagaggcccggaagacctttgtcgaactgatgcggcgcggggatctccctgtttggctgtcctacaaggtggcctcggagggcttccagtactcagaccggcgctggtgcttcgacggcgagcggaacaaccaggtcctggaagagaacatggacgtggagatctggacaaaggagggggagaggaagaagctcagaccccgctggctggatgcccggacgtactccgaccccctggccctccgcgagttcaaggagtttgcggccggacggcgctcggtctccggggacctgattctggagattgggaagctcccccagcacctgactcaacgggcccagaatgctctggacaacctcgtcatgctgcacaacagcgagcaaggcgggcgcgcgtaccggcatgccatggaggagctgcctgacacaatcgaaacgctcatgctgctggcgctcatcgccgtgctgacgggcggggtcaccttattcttcttgtccggcaagggactcggcaagacctccatcggactgctctgcgtcatggcctctagcgtactgttatggatggcgtctgtggaaccccactggatagccgcgagcatcattctcgagttcttcctgatggtcctactcatccccgagcccgatcgccaacggaccccgcaggacaaccaattagcttacgtggttatcgggctcctgttcatgatactgaccgtagccgcgaacgagatgggcctgctcgagacgaccaaaaaggaccttgggatcggccacgtggcggtggaaaatcatcaccatgctgcaatgctggacgtcgaccttcacccagcctccgcttggacgctgtatgccgtggccaccacgataatcacccctatgatgcgccatactatcgagaacaccacggccaacatcagcctgaccgccatcgcgaaccaggcagccatactcatggggcttgacaagggctggcccatcagcaagatggacataggcgtgcccctgctcgccctgggttgctacagccaagtcaaccccctaacactcacggctgccgtgctgatgctggtggcccattacgccatcatcggtcccgggcttcaagccaaggcgacgcgggaggcccagaagcgaaccgccgcgggcatcatgaagaacccgactatagacggaatcgtagccatcgacttagatcctgttgtttacgacgcgaagttcgagaagcagctgggccagatcatgctcctcatcctgtgtacctcccagatactcctgatgagaaccacctgggcactatgcgagtctatcaccctcgccaccggacccctgactacactgtgggagggctcccccggtaagttctggaacaccaccattgctgtttcaatggcgaacatcttccgggggtcctacctcgcgggcgccggtcttgcgttcagcctgatgaagtccctcgggggcgggcgacggggcacgggggctcaaggagagaccctgggagagaaatggaagcgccagctgaaccagctcagtaagagcgaattcaacacctacaagaggtccgggatcatggaagtcgaccgcagcgaagccaaagaaggcctgaaacgcggcgagacaacaaagcacgccgtgagtcgcggcaccgccaaactgcgttggtttgtggagaggaatttggtgaagccggaggggaaggtgatagatctgggctgcggccgcggcgggtggagctactactgcgccggactgaagaaggtcactgaagtgaagggatacacaaagggcggccccggccatgaggagcccatcccgatggccacgtacggctggaacttagtgaagctgcactccggcaaagacgtcttcttcataccccccgaaaagtgtgacacattactatgcgacattggtgagtcgtccccgaaccccacgatcgaggaggggaggacattgcgtgtgctgaagatggtagagccctggctgcgcgggaatcaattctgcatcaagattctaaacccttacatgccatccgtagtggaaacgctggagcagatgcaacggaaacacggcggcatgctggtgaggaaccctctatcccggaatagtacgcatgagatgtactgggtctcctgcggcactggcaacatcgtgtcagctgtgaacatgacatcccgcatgctgctaaaccggtttaccatggcccacaggaagcccacgtacgagagggacgtcgatctcggggccggaaccaggcacgtggccgttgagcccgaagtcaccaacctggacattatcggtcaacggatcgagaacatcaagtacgagcacaagagcacctggcactacgatgaggacaacccgtacaaaacgtgggcctaccatgggtcctacgaggttaagcccagcggctccgcgtccagcatggtcaacggagtcgttaaactgctcacgaaaccgtgggacgtcatacccatggtgacccagatcgctatgactgacacgacccccttcgggcagcagagggtgttcaaagagaaagtcgacacacgtacgcccaaggccaagcgaggaacggcgcagattatggaggtgacggcacgctggctgtggtcctttttaagccggaacaagaagccgcgcatctgcaccagggaggagttcacccgaaaggtgcgatccaacgcggccatcggcgccgtcttcgtggacgagaaccagtggaacagtgccaaggaggcggtggaggacgacagattctgggacctcgtccaccgggagcgtgaactgcacaagcagggaaagtgcgcaacgtgcgtgtacaacatgatggggaagcgggagaagaaactgggcgagttcggtaaggccaagggctcgcgggcgatttggtatatgtggctaggggcccggttcttggagtttgaagcactgggcttcatgaacgaggaccactggttctcccgcgagaacagtctctccggcgtcgagggggagggcctccacaaattaggatacatacttcgtgacatctccaagataccgggcgggaacatgtacgccgacgacaccgccggctgggacacccgcatcacggaagacgatctgcaaaatgaagccaagatcacggacatcatggaacccgagcacgccctgctcgccaagagcattttcaagctgacctaccagaacaaagtagtgcgggtgcagcgcccggcaaagaacggcactgtcatggacgtaatctcccgacgggaccagcgcggttctggccaggtgggtacctatggcctgaacacgtttacgaacatggaggcccaactcatccggcaaatggagtccgaaggcatattcagccccaacgagctggaaaccccaaacttagcagaaagggtgttggactggctggaaaagtacggcgtggaacgtttaaagcgcatggccatctcgggcgacgattgcgtggttaagcccatcgatgaccggttcgcgaccgcccttacggccctgaacgatatggggaaggtgcgcaaggacatcccgcaatgggaacccagcaaaggttggaacgactggcagcaggtcccattctgcagtcaccacttccaccagcttatcatgaaggacgggcgggagatcgtcgtgccctgccgcaatcaggacgagcttgtgggccgggcgcgcgtcagccagggcgccggttggagcctgcgggaaacagcgtgcctgggcaagtcctacgcccagatgtggcagctcatgtactttcaccgccgcgacctgcggctggctgccaatgctatctgtagcgccgtgccggtcgactgggtgcccacgtcccggacaacgtggagcatccatgcccatcaccagtggatgaccaccgaggacatgctctccgtttggaaccgggtgtggatcgaggagaatccctggatggaagacaagacccggatcagctcctgggaggacgtgccctacctcgggaagagggaggaccagtggtgtggcagcctgatcgggctcactgctcgcgccacgtgggcgaccaatatccaggtagccatcaaccaagtgcggcgcttaatcggcaacgagaactattccgactatatgaccagcatgaagcggttcaaaaatgagtccgagcctgagggcgcgctgtggtag

SEQ ID NO: 24782 - RNA, 9879 nt, synthetic construct
  misc_feature 1..9879: note = derived and/or modified CDS sequence (opt11) from DENV-1__FJ176780__SS-prME
  source 1..9879: mol_type = other RNA
tccgtgaccatgctgctcatgctgatgccgaccgccctggcctttcacctcaccacccggggcggagagccccacatgatcgtaagcaagcaagagcggggcaagtctctcctgttcaagaccagcgccggggtgaacatgtgcactctcatcgccatggacctgggagagttatgcgaggacacgatgacctataagtgccccagaatcacggaagccgagcccgacgacgtggactgctggtgcaacgccaccgacacatgggtgacctacgggacctgtagccagacgggggaacaccgacgggacaagagatccgtagccctcgctccccacgtgggcctggggctagaaacgcgaactgaaacctggatgagctccgaaggcgcctggaagcagatccaacgggtcgagacatgggccctccggcaccccgggttcactgtgatcgccttatttctggctcacgccatcggtaccagcatcacccagaaggggattatcttcattctcctgatgctagtgactcccagcatggctatgcggtgcgtgggcataggcagccgcgatttcgtggaggggctttccggcgccacgtgggtggacgtcgtactggagcacgggtcctgtgtgaccaccatggccaaggacaagcccaccctggacatcgaactcctcaagacggaagtcaccaaccccgcggtactgaggaagttatgcatagaggccaagatctccaacaccaccacggacagccgctgccctacccaaggcgaagctacgctggtcgaagaacaggacgccaacttcgtctgtcggcgcaccttcgtggaccggggttgggggaacggatgtgggcttttcgggaaggggtcactcataacctgcgccaagttcaagtgcgtgaccaagctggagggcaagatcgtccagtatgagaatctgaagtacagcgtgatcgttacagtccacactggcgaccagcatcaggtggggaatgagagtacggagcacggcaccaccgcgaccatcacgccccaggcaccaacgaccgagatccagctcaccgactacggggccctgaccctggactgcagcccccgaacgggcctcgacttcaacgagatggtactgctgaccatgaaagagaagtcctggctcgtgcacaagcaatggttcctggacctgcccctcccctggacgagtggggcctcgacctcccaagagacatggaaccgccaggacctgctggtcacctttaagaccgcccacgcgaagaagcaggaggtagtggtgctcggctctcaggaaggcgccatgcacaccgccctgacgggggccaccgagattcaaacctccggcacgaccaccatcttcgccggacacctaaagtgccgcctcaaaatggacaagttaaccctgaagggcatgtcttacgtcatgtgtacagggtccttcaagctcgagaaggaggtggcggagacgcaacacggcacggtgttggttcagatcaagtatgaggggacagacgccccctgcaagatccccttcagcacacaggatgagaagggggtgacgcagaatggtcggctgatcaccgccaatccgatcgtgaccgacaaagagaagccagtcaatatcgaggccgagccgcccttcggcgagtcctacatcgtgatcggcgcgggcgagaaggccctgaagctctcttggttcaagaaggggtccagcatcggcaagatgttcgaggcaaccgcccgcggggcccgccgaatggcgatcctgggcgataccgcttgggacttcgggagcatcggcggcgtcttcacctcggtcgggaaactggttcaccagatcttcggcaccgcctacggggtgctgttctccggagtcagctggacgatgaagatcgggatcggcgtgctgttaacatggctcggcctgaactcacgcagcacctctctaagtatgacctgtatcgcagtggggctcgtcaccctatacctaggcgtgatggttcaggccgactccgggtgcgttatcaattggaagggcagggaactcaagtgcggtagcggcatattcgtgacgaacgaggtacacacctggacggaacaatacaagtttcaggccgactcgccaaagcgcctgagtgccgcaatcggcaaggcctgggaggaaggggtgtgcggcatccggagcgccacccgcctggaaaatatcatgtggaagcagatctccaacgaactcaaccacatcctactggagaacgacatgaaattcaccgtggtggtgggggacgtggcgggtatactcgcccaagggaagaagatgatccggccccagcccatggagtacaagtactcctggaaaagctgggggaaggccaagatcatcggggccgacgtgcagaatacgaccttcatcattgacggtcccaacaccccggagtgtccggacgaccagcgcgcgtggaacatctgggaggtcgaggactatggcttcgggatcttcaccacgaacatctggctgaagctacgggacagctacacccaggtgtgcgaccatcgcctcatgtccgctgccatcaaggacagcaaggccgtgcacgccgacatggggtactggatcgagtccgagaagaacgagacgtggaagctggcgcgggcgagctttatagaggtgaagacctgcatctggcccaaatcccacacgctgtggtccaacggggttctagagtcagaaatgatcatccccaagatttacgggggcccgattagccaacacaactaccgccccgggtacttcacccaaaccgccggcccttggcacctggggaagctagagctcgacttcgacctgtgcgagggcacaacggtcgtggtggacgagcattgcggcaaccgggggccctccctgcgcacgaccacagtcacgggaaaaatcatacacgagtggtgttgccgttcatgcacactgcctcctctccgcttccgtggggaggacggctgttggtacgggatggagatccgccccgtcaaggagaaggaagaaaacctggtgaagtccatggtgagtgccggctcgggcgaggtcgactcctttagccttgggctgctatgcatctccataatgatcgaggaggtaatgagaagccgctggtcccgtaagatgctcatgaccggcactctggccgtgttcttcctgctcatcatggggcagctgacgtggaacgatctgatccgcctctgcatcatggttggcgcgaacgccagcgatcgcatggggatgggcaccacataccttgcccttatggccacctttaagatgcggccgatgttcgccgtaggtctcctgttcaggcggctgacgagccgggaggttctactgctgaccatcgggctcagcctggtcgcctccgtggagctgcccacaagcctcgaggaactcggcgacggactggccatgggtatcatgatcctcaaactgttgacggacttccagtcccaccaactctgggctacgctgctgtcgctcacgttcgtcaaaaccaccttcagtctgcactacgcctggaagacgatggcgatggtactgagcatcgtgtccctcttccccctgtgtctttcgactacctcccagaagaccacttggctccccgtcctgctgggcagcctcgggtgcaagccgctgaccatgtttctgatcgccgagaacaagatatggggacgaaggtcctggcccctaaacgaggggatcatggccgtgggtattgtatcgatcctgctgagctccctactgaagaacgacgtcccactggccgggcccctcatcgcgggcggcatgctaatcgcgtgctatgtaatcagcggatccagcgcagatctgtccctcgagaaggcggccgaggtgagttgggaggaggaggctgagcactccggcgcgagccacaatatcctggtggaggtgcaggacgacgggaccatgaagatcaaggacgaggagcgggacgacactttgactatcctcctgaaggcgacgcttctagccgtgtccggcgtctatcctttaagcatccccgccaccctgttcgtgtggtacttctggcaaaagaagaagcaacgctcaggtgtcctctgggacactccatcgccgccagaggtcgagcgggccgtgctggacgacggcatttaccgcatcatgcagcgcggcttgctggggcgctcccaggtgggcgtcggagtgttccaggagaacgtgttccataccatgtggcacgtcacgcggggcgcggtgctaatgtaccaggggaagagactggaacccagctgggcctccgtgaagaaagacctgatcagctatggcggcgggtggcgtctccagggttcctggaacaccggggaggaggtccaggtgatcgccgtagagcccggcaagaaccccaaaaatgtccagaccgcccccgggaccttcaagacgcccgaaggcgaggtcggggccatcgcgctggatttcaagcccgggacaagcggctcccccatagtgaacagagagggcaagatcgtcggtctgtacggcaacggggtggtgactacctcaggcacgtacgtaagcgcgatagcccaggccaaggcgtctcaggaggggccgctccccgagattgaggacgaggtgttccggaagcgcaacttgacgatcatggacctgcaccccggcagcgggaagacccggcgctacctcccggccatcgtgagagaggccatcaagcgtaagctgcgcaccttgattctcgcccccacgcgggtcgtggccagtgagatggcggaggccctgaagggaatgcccatccgctaccagaccaccgccgtcaagagtgagcatacaggcaaggagatcgttgacctgatgtgccacgccacgttcaccatgcggctcctatcccctgtgcgcgtgccgaactacaacatgatcatcatggacgaggcccacttcaccgaccccagctccatcgcggcccggggctacatcagcacccgcgtcggcatgggcgaggcggccgccatctttatgacggcgacgccgcccggttccgttgaggcattcccgcagagcaacgcggttatccaggacgaggaacgggacatccccgagcgctcctggaactccgggtatgagtggatcaccgacttccccggcaagacagtctggttcgtgcccagcatcaagagcggcaatgacatcgccaactgcctgcggaaaaacgggaagcgcgtcatccagctctcccgtaagacgttcgacaccgagtaccagaagaccaagaacaatgactgggattacgtcgtcaccacggacatctccgaaatgggcgcgaacttccgcgccgaccgggtgatcgaccctcgccggtgcctgaagcccgtcatcctgaaggacgggcccgagagagtaatcctcgccgggcccatgccggtcaccgtagcctcggccgcgcagcggcgcgggcggatcggccgcaatcacaacaaggaaggcgaccagtatatctacatgggacaacccctgaacaatgacgaggaccacgcccactggaccgaggcgaagatgttgctcgacaacattaacacccccgagggcataattcccgccctgttcgagcccgagcgcgagaagtcggccgcgatcgacggggagtatcggctgaggggcgaagctcggaagacgttcgtggaactcatgagaagaggagacctgcccgtctggctgtcctacaaggtggcttcagagggttaccagtactccgaccggcggtggtgcttcgacggcgagcgaaacaaccaggtgctcgaggagaacatggacgtcgagatttggaccaaagaaggggaacgcaagaaactgcgcccccggtggctggacgcccgcacctacagcgaccccctcgccctgcgggagttcaaggaatttgcggcaggccgtcgtagcgtgtcgggggatcttatactcgagatcggcaaacttccgcaacatttaacccagcgcgcccagaacgccttggacaacctggtgatgctgcacaattcagagcagggaggccgggcgtaccgccatgccatggaggagctccccgacacgatcgagacccttatgctgctcgctctgatcgccgttctgaccggcggggtgactctcttctttctgtccggccgagggctgggcaaaacctctattggcctactgtgcgtgatggcctccagcgtcctgctctggatggcgtccgtagagccccactggatcgccgccagcataatactggaatttttcctgatggttctcctgatccccgagccggaccgccagcggactccccaagacaaccagcttgcctacgtcgtgatcgggctcttgttcatgattttgaccgtggccgctaacgagatggggctcctggagaccacgaagaaggacctagggatcggacacgtcgcagtggagaaccaccatcacgccgctatgctcgacgtagatctgcacccggcttccgcgtggacgctgtacgccgtggccacgaccatcatcaccccgatgatgcgccatacaatcgagaacaccaccgccaacatcagcttaaccgccatcgcgaatcaggcagccatcctgatggggctggataagggttggccgatctccaagatggacatcggggtgccactactggccttggggtgctatagccaggtgaaccccctcacgctgaccgcggccgtcctgatgctcgttgcccactacgccatcattggaccgggcctgcaggctaaggcgacccgcgaggcccaaaagcggaccgccgccggcatcatgaagaaccccacggtggatggaatcgtcgccatcgacctggacccggtggtgtacgacgcgaagttcgagaagcagctcggtcagatcatgctgctgatcttgtgcacctcccagatcctgcttatgcggaccacatgggccctctgcgaaagcatcacgctcgccaccggccctctgaccaccctctgggaggggtccccgggcaagttttggaacactaccatagccgttagcatggcaaacatctttcgggggtcctacctggcgggcgctggcttagccttcagcctcatgaagtctctcgggggcgggcgcagagggaccggcgcccagggcgagaccctgggcgaaaagtggaagcgccagctcaaccagttatccaagagcgagtttaacacctacaagcggtccgggatcatggaggtggaccgcagcgaggcaaaagagggcttaaagcgaggggagaccaccaaacacgcagtgtcccgcggcaccgccaagttacggtggttcgtcgagcgcaacctcgtgaagcccgaggggaaggtgatagacttgggctgcggccgcgggggctggagctattactgtgccgggctcaagaaggtcacggaggtgaagggctacaccaaagggggccccggccacgaggaacccattccgatggcgacttacgggtggaacttagtgaagctgcacagtggtaaggacgtcttcttcatcccgcccgagaagtgtgacaccttactctgcgacatcggggagtcttcccccaaccccacgattgaggagggccgcaccctgcgggtgctgaagatggtggagccctggctccgcggtaaccagttctgcatcaaaatcctgaacccctacatgcctagcgtcgtggaaacactggagcagatgcagcggaagcacggcggaatgttagtgcgcaacccgctatcccggaacagcacccacgagatgtactgggtctcctgtgggactggcaacatcgtgtccgcggtgaacatgacgagccgcatgctgctcaaccgttttaccatggctcaccggaagcctacctatgagcgggacgtagatctgggggccggcacccggcacgtggcggtggagcccgaggtcacgaacctagacatcatcggacagcgcatcgagaacatcaagcacgaacacaagagcacctggcactacgacgaagataacccctataaaacctgggcctaccacgggtcctacgaggtgaagccaagcggatccgcgagcagcatggtcaacggggtggtgaagctcctgaccaagccctgggacgtcatccccatggtgacgcagatcgcaatgacggacactacacccttcggacagcagcgagtgttcaaagagaaagtcgacacaagaaccccgaaggccaagcgaggtaccgcccagatcatggaggtgaccgcgaaatggctgtggggcttcctctcaagaaataagaagccccggatatgcacgcgcgaggagttcacccggaaggtgcgcagcaacgcggccatcggagcggtcttcgtggacgagaatcagtggaactccgccaaggaggcggtggaagacgaacggttctgggacctggttcaccgtgaacgggagctccacaagcaggggaagtgcgcgacctgcgtttacaacatgatggggaagcgcgagaagaagctcggtgagtttggcaaggccaaggggagccgggccatctggtacatgtggctgggcgctcgctttcttgagttcgaggctctcggcttcatgaacgaggaccactggttctcgcgggagaacagcctatccggggtcgagggcgaaggcctgcacaagctcggttacatcctgcgggacattagcaagatacccggaggcaacatgtacgccgacgacaccgcaggctgggacaccaggattactgaggacgatctgcagaacgaggcccgcatcaccgatatcatggagccggagcacgcattactggcgaagtccatcttcaagctgacgtaccagaacaaggtcgtgcgcgtgcagcggcccgccaagaatgggacggtcatggacgtgatcagccgccgggaccagcgcggctccggccaggtggggacctacggcctgaacaccttcaccaacatggaggcacagctgatacggcagatggagagcgaggggatattttccccctcggagctggagacgcccaatttagccgagcgcgtcctggactggctcgagaagtacggcgtggagaggctcaagcgcatggccatatccggggacgactgcgtggtaaagcccatcgatgaccggttcgcgaccgctctgaccgctctgaacgacatgggcaaggtgcgtaaggacatcccccagtgggagccctccaaggggtggaatgactggcagcaggttccgttctgctcccaccacttccaccagctcataatgaaggacggccgggagatcgtcgtgccctgccgcaaccaggatgagctggtggggcgggcccgagtcagccaaggggccgggtggagcctgagggagaccgcgtgcctcgggaagtcctacgcgcaaatgtggcagcttatgtacttccaccgccgtgacctgcgcctcgccgccaacgcgatctgcagcgcggtgcccgttgactggattcccacctcccggaccacctggagcatccacgcccaccaccagtggatgaccactgaggacatgctgtccgtctggaaccgcgtgtggatcgaggagaacccctggatggaggacaagactcacattagctcctggggtgacgtaccgtacctaggaaagcgcgaggatcagtggtgcggaagcctcatcggcctgaccgcccgggccacctgggccaccaacatacaggtcgcaatctaccaggtcaggaggctgatcgggaacgaaaactaccttgactacatgacgtcgatgaagcgcttcaagaacgaaagcgaccccgagggtgccttatggtaa

SEQ ID NO: 24783 - RNA, 9879 nt, synthetic construct
  misc_feature 1..9879: note = derived and/or modified CDS sequence (opt11) from DENV-1__JN205310__SS-prME
  source 1..9879: mol_type = other RNA
agcgtgacagtgctgttcatgttactacccaccgccctggccttccaccttaccaccctgggcggggaaccccatatgatcgtgagcaagcaagaacgcggcaagagcctcctgttcaaaacatccgcgggggtgaacatgtgcaccctgattgccatggacctgggcgaactctgcgaagacaccatgacctacaaatgcccccggatcacagaaaccgaacccgacgacgttgactgctggtgcaacgccaccgagacctgggtgacctacgggacttgcagccagaccggcgagcaccgcagggacaaacgctccgtggccctggcgccccacgtcggcctggggctcgaaacccggaccgagacctggatgtcctccgagggagcctggaagcagatccagaaggtggagacgtgggccctgcgccaccctgggttcaccgtgatagcgctgtttctcgctcacgcgatcgggacaagcataacccagaagggcatcatctttatactattaatgctcgttacgccctccatggccatgcggtgcgtgggcattggcaaccgcgacttcgtggaggggcccagcggtgccacatgggttgacgtggtgctggagcacggatcctgcgtcactacaatggccaagaataagccgacactggacatcgaactccttaagaccgaggtgaccaacccggccattttacggaaactttgcatagaggcgaagatatccaacactacgaccgactcgcggtgccccacccagggcgaggccaccctggtggaggaacaggacacgaacttcgtatgtcgccggactttcgtcgaccggggctgggggaacgggtgcgggctgttcggcaaggggtcactcatcacgtgcgccaagtttaaatgcgtgaccaagctggagggcaagatcgtccagtacgagaatttgaaatactcggtgatcgtgactgtccacaccggcgaccagcaccaggttgggaatgagaccaccgagcacggcaccacggccatcataacgccccaggctccgacaagcgagatccagctcaccgattacggggcgctgacaccggactgtagcccccgcaccgggctcgatttcaacgagatggttcttctgacaatgaaggagaagagttggttagtgcacaagcagtggttcttagatctgcccctaccgtggacctccggcgccagcacgagccaggaaacctggaaccggcaggacctgctggtgaccttcaaaaccgcccacgccaaaaagcaggaggtcgtggtgctgggatcgcaggaaggtgccatgcacaccgcgctcaccggggccaccgagatccagactagcgggacgacaaccatattcgccgggcacttaaagtgccgcctgaagatggacaaactcaccctgaagggcgtctcatacgtgatgtgcacagggagcttcaaactggaaaaggaggtggccgagacccagcacggcaccgtgctcgtccaggtgaagtacgagggcaccgacgccccatgcaagatccccagtagttcgcaggatgagaagggagttatccagaacggccgattaatcacggcaaacccaattgtgaccgacaaggagaagcctgtgaacatcgaggccgagccgcccttcggggagagctacatcgtcgtgggcgccggcgaaaaggccctgaagctgtcatggtttaagaaggggagctccatcggcaagatgtttgaggcgaccgccagaggggcccggcgcatggctatactcggcgacaccgcctgggatttcggctcgatcggcggcgtgttcacgtccgtcgggaagctggtgcaccagatcttcggcaccgcgtacggggttctgttcagcggcgtctcctggaccatgaagatcgggatcggtatcctcctgacatggctagggctcaacagccggtccacgagcctgtccatgacctgcattgcggtcgggatggtgaccctttatctcggcgttatggtgcaggccgatagtgggtgcgtgatcaactggaagggaagggagctgaagtgcggaagcggcattttcgtcacgaacgaagtgcatacgtggaccgagcagtacaagttccaggcagactcccctaagcgcctaagcgccgcgatcggtaaggcatgggaggaaggggtgtgtggcatcaggtccgccacccgtctcgagaacatcatgtggaagcagattagcaacgagctgaatcacatcctgctcgagaatgacatgaagttcacggtggttgtgggggatgtctccggcatcctggcccaggggaagaagatgattcggccccagccgatggagcataagtacagctggaagtcttggggcaaggccaagataatcggcgcggacgtgcagaacaccacgttcataatcgacggtcccaacacgcctgagtgccccgataaccagcgcgcttggaacatttgggaggtggaagactacggcttcggaatattcaccaccaacatatggctgaaactccgggattcgttcacgcaggtctgtgatcatcgcctgatgtctgccgccatcaaggacagcaaggcggtgcacgccgatatgggctactggatcgagtccgagaagaaggagacctggaagctggcccgggcctcattcatcgaggtgaagacctgcatctggccaaagagccacaccctctggtctaatggcgttctagagagcgagatgattattcctaagatctacgggggtcccgttagccaacacaactacaggccggggtacttcacacaaacagccggaccctggcacctcgggaaactagagctagacttcgacctgtgcgaaggtaccaccgtggtcgtggacgaaaactgcggaaaccggggtccctcgctcaggacgaccaccgttaccggtaagacgacccacgagcgctgctgccgcagctgcaccctgccccctctgcggtttaagcgcgaggatgggtgctggtacggcatggagatccggcccgttaaggagaaggaggagaacctcgttaagtcgatggtgtcagcgggaagcggcgaagtcgactccttcagcctaggcctactctgtatcagtataatgatcgaggaggtgatgcgaagccgatggtcgcgcaagatgctgatgaccgggacgctggccgtgttcctcctgctgaccatgggccagagcacctggaacgaccttatccggctgtgcacaatggtcggggcgaacgccagtgacatgatgggaatgggcacgacgtacctggccttaatggcgacattccgcatgcggcccatgtttgccgttggtctgctgttccggcgcctgacgagcagagagatcttgctgctcacggtcggcctgtccctcgtggcatccgttgagctccccaactccctggaggaactcggcgacggcctcgccatgggaattatgatgctgaaacttctcaccgacttccagccgcaccagctgtgggccaccctcctctctctgaccttcgtcaagacaacgctgtccctccattatgcgtggaagaccatggccatgatcttatctatagtgtccctgttgcccctgtgtctcagcaccacctcccagaagaccacctggctcccggtgctcctgggtagcttaggctgcaagccccttaccatgttcctgatcacagagaacaagatctgggggcgccggagctggccgctcaacgagggcatcatggccatcgggatcgtcagtatcctgctgagcagccccctgaagaacgatgtgcccctggcaggccccctcatcgcaggagggatgctcatcgcatgctacgtgatcagtgggtcctcggccgacttgtccctggagaaagccgccgaggtcagctgggaggacgaggcggaacactccggggcaagccataacatcttggtggaggtgcaggacgacggcactatgaagattaaggacgaggaacgcgatgacaccctgaccatcctgctcaaggccactctgctggtcatctccggtgtgtacccgatgagcattcccgccaccctcttcgtgtggtacttctggcagaagaagaaacagagatccggcgtcctgtgggacaccccctccccgcccgaggtagagcgcgccgtgctggacaacggtatctaccggatcctccagcgcggcctgcttggcagatcccaggtcggggtaggcgtgtttcaggaaggggttttccacaccatgtggcatgtgacccgcggcgcggtactcatgtatcaggggaagcggttggagccctcgtgggcatccgtaaagaaggacctgatctcatatggcggcgggtggagattccagggctcctggaatacgggggaggaggtccaggtgatagccgtcgagcccggtaagaaccccaaaaacgtacagaccacccccgggaccttcaagacgcccgagggcgaggtgggggccatcgctctggatttcaagcccgggacctcgggctcaaccatcgtcaaccgggaagggaagatcgtagggctctacggcaacggggtggtcaccacgtccggtacctacgtgagcgcgatagctcaggccaaagcctcccaggagggaccactgcccgagatagaggacgaggttttccgcaaacgtaacctgaccattatggatctccaccccgggagcggtaagaccagacggtacctgcctgccatagtccgtgaggcgataaagcggaagctgcgcacgctcgtgctggccccgacccgcgtggtcgcctccgagatggccgaggctctcaagggcatgccaatccggtaccagaccaccgccgtgaagtcagagcatacgggcaaagagatcgtggaccttatgtgccacgcaacgtttacgatgcgcctgctctcgcccgtccgggtgccgaactacaatatgatcataatggacgaggcccactttaccgacccggccagcatcgcggcccgcgggtatatcagcacgcgggtgggcatgggggaggccgcagctatcttcatgaccgcgacgcccccaggcagcgtcgaggccttcccacaatccaacgccgtgatccaggacgaggaaagagatattccggaacggagctggaactctggatacgagtggattacagatttccccggcaaaacggtgtggttcgtcccctccatcaagtccggcaacgacatcgccaactgtctccgcaagaacgggaagagggtggttcagctgagccgcaaaaccttcgacaccgagtaccaaaagaccaagaacaacgactgggattacgtcgtgacgaccgacatctctgaaatgggcgccaatttccgagcggacagggtcatcgatccccggcgctgtttaaagccggtgatcctcaaagacgggcccgagcgagtcatcctggccggccccatgcccgtcacggttgccagcgccgcgcagagacggggtcgcataggtcggaatcctaataaggagggcgaccagtacgtgtatatgggacaacccctaaacaacgacgaagaccacgcgcattggaccgaggccaagatgctcttggataacatcaacacgcctgaggggatcatccctgccctgtttgagcccgagagggagaagagtgccgcgatcgacggggagtatcgcctgcggggcgaggcccgcaaaactttcgtggagttgatgcggagaggggatttacccgtctggctaagctacaaggtggctagcgagggcttccaatactccgaccgaagatggtgtttcgacggagagagaaacaaccaggtgcttgaggagaatatggatgtcgaaatttggaccaaggagggggaacgcaagaagctgcgacccaggtggctcgacgcacggacttactcggacccactggctctacgcgaatttaaggagttcgcggccggccggagatccgtcagcggtgatctcatcctggaaatcgggaagctgccgcagcatctcaccctgaaagcccagaacgccctggacaacttggtcatgctgcacaactccgagcagggcggtaaagcctaccggcacgcgatggaggagctgcctgacacgatcgagaccctcatgctgttggccctcattgccgtgctgaccggcggagtgaccctgtttttcctcagcggccgcggcctaggtaagacgtccatcggcctgctttgtgtcatggcctcctccgttctgctgtggatggcgagcgtggaaccccactggatagccgcctccattatcctcgagttcttcctgatggtcctgctcatcccggagcccgaccgccagcgcacgccccaggataaccagctagcctacgtggtcatagggctcctgttcatgatcttgaccgtggccgcgaacgaaatgggcctgctagagacgacgaagaaggacttggggatcggccacgcagccgccgagaaccatcatcacgccgcgatgctggatgtggacctccaccccgccagcgcgtggaccctgtacgcagttgctaccaccattatcacgccgatgatgcggcataccatcgaaaacaccactgcgaacatctccctgacagccatcgctaaccatgccgccatcttaatgggtttagacaaggggtggccgatcagcaaaatggacatcggagtccccctgctcgcgttggggtgctactcccaggtaaaccccctgaccctcaccgccgcggtgctgatgctagtggctcattacgcgatcatcggcccgggattgcaggcaaaggccacccgcgaggcccaaaagcggacggcggcgggcatcatgaagaaccccaccgtggacgggatagtggcgatcgacctggaccccgtcgtctacgacgctaagatagagaagcagctgggccagattatgctactgatcctctgcaccagccagatcttgctaatgaggaccacatgggccctgtgcgagtcaatcaccctcgccaccggcccgctgaccacgctttgggaggggagcccgggcaagttttggaatactaccatcgcggtgtccatggcgaacatattccgtggcagctacctcgccggagccggtctggcattcagcctgatgaagtccctcggaggtgggcgtcgcgggacaggcgcgcagggagaaacgctgggcgagaagtggaagcggcagctgaaccagctctcgaagtccgagttcaacatctacaagcgctctgggattatcgaggtcgaccggtccgaggccaaggagggcctaaagagaggggaaacgaccaagcacgccgtgtctcggggcaccgccaaacttcgctggttcgtcgagcggaacctcgtcaagcctgaggggaaggtgatcgacctgggctgtggccgcgggggctggtcctattattgcgcagggctgaagaaggtgacggaggttaagggctacaccaagggcgggcctgggcacgaggaaccgatcccgatggccacctacggttggaaccttgtaaagctgcacagcggtaaagacgtattctttacgccgccggaaaaatgcgacacccttctgtgtgacatcggagagagtagccccaacccgaccatcgaggagggcaggaccctccgcgtactgaagatggtggagccatggctgcgtgggaaccaattctgcataaagatcctcaacccttacatgccctccgtggtggagacgctggagcagatgcagcgtaagcacggcggcatgctcgtgcgtaatccgttaagccgaaactccactcatgagatgtactgggtaagctgcgggacgggcaacatcgtctccgccgtgaacatgaccagccgtatgttattgaatcgcttcaccatggctcaccgtaagcccacctacgagcgcgacgtcgacctgggggccgggacccggcacgtcgcggtggagcccgaggtcgcaaacttggacatcattggccagcggattgagaatataaagaatgagcataagtccacttggcactacgatgaggacaatccctacaagacgtgggcctaccacgggagctacgaggtgaagccctccggctccgccagctctatggtgaacggggtggtgcgcctactcaccaagccctgggatgttatccccatggtcacccagatcgccatgaccgataccaccccgttcgggcagcagcgggtattcaaggaaaaggtagacacgcgcactccgaaggcgaagcgggggaccgcccaaataatggaggtcaccgcccgttggttgtggggctttctgagccggaacaagaagccccgcatctgcacgcgggaggagttcacaaggaaggtccgttccaacgccgcgatcggtgcggtattcgtcgacgagaaccagtggaacagcgccaaggaggctgtggaggacgagcgcttttgggaccttgtgcatagagagcgcgagctgcacaagcaagggaagtgcgcaacctgcgtttacaacatgatgggccggcgcgagaagaagctgggggagttcggaaaagctaaagggtcacgggccatctggtacatgtggctcggcgcccgcttcctcgagttcgaggccctggggttcatgaatgaggaccactggttcagccgggagaactcactcagcggcgtggagggcgagggacatcacaaactgggctacatcttacgcgacatcagtaagatccccggtggcaatatgtatgccgacgacaccgccggctgggacacgcggatcaccgaagacgacctccaaaatgaagcaaagattaccgacatcatggagcccgagcacgccctgctggccacaagcatcttcaaacttacctatcagaacaaggtggtcagagtgcagcgccccgcgaagaacgggaccgtgatggacgtcatctccaggcgcgaccagcgggggagcggccaagtgggcacctacggcctgaacaccttcactaacatggaggcgcaactgattagacaaatggagagcgagggaatcttcagcccatccgagttggaaacacccaacctggccgagcgggttttcgattggctggagaagcacggcatcgagcgcctcaagcggatggccatcagcggggacgattgtgtcgtgaagcccatcgacgaccgcttcgccactgccttaaccgcgcttaacgacatgggcaaggtgcggaaggacatcccacagtgggagccgcccaaagggtggaacgactggcagcaggtcccgttttgctcccaccactttcaccagctcattatgaaagacggtcgagagatagtggtgccctgccggaatcaggacgagctggtcggccgcgcccgggtctcgcagggggccggttggagtctgcgcgaaacggcatgcttgggcaagtcctacgcccagatgtggcagcttatgtatttccaccggcgcgacctgcggctcgcggccaacgccatctgcagcgccgtacctgtcgactgggtgcccacctctcgtaccacttggtccatccacgcgcaccaccaatggatgaccacggaggacatgctgtccgtgtggaaccgcgtctggatagaggagaacccgtggatggaagacaagacgcacgtgagctcctgggaggacgtgccttacctgggcaagcgcgaagaccagtggtgcggctcactcatcgggctgaccgcccgcgccacctgggccacgaacattcaagtggcaatcaaccaagttcggcgccttatcggcaacgagaattacctagactacatgacctccatgaagagatttaaaaatgaaagcgaccccgaaggggcgctgtggtag

SEQ ID NO: 24784 - RNA, 9879 nt, synthetic construct
  misc_feature 1..9879: note = derived and/or modified CDS sequence (opt11) from DENV-1__HQ332182__SS-prME
  source 1..9879: mol_type = other RNA
tccgtcacgatgctgctcatgctgctgcccaccgctctagccttccacctgaccaccagaggcggggaaccgcatatgatagtgtcaaagcaggagcgaggcaagagcctgttattcaagaccagcgccggtgtgaatatgtgtactctgatagccatggatctgggcgagctctgtgaggacaccatgacctacaaatgtcctcgcatcactgaggcggagcccgacgacgtggactgctggtgtaacgcaaccgacacctgggtgacttacgggacatgcagccagaccggcgaacaccggcgcgacaagcggtccgtggcccttgcgccccatgtggggctcgggctcgagacgaggactgagacctggatgagctccgagggcgcctggaagcagatccagcgggtcgagacgtgggccctgcgccaccccggttttactgtgatcgctttgttcctcgcccacgccataggcaccagcatcacccaaaagggaatcatctttatcctgctgatgcttgtgaccccctccatggccatgcggtgcgttggcatcgggaaccgcgattttgtggaagggctttcaggcgccacgtgggttgacgtggtcctggaacatgggtcatgcgtgacgaccatggctaagaacaagcctaccctggacattgagctgctgaaaacggaagtcaccaaccctgcagtactgcggaagctatgcattgaggcgaaaatcagcaataccactacggactcccgctgcccgacccagggcgaggccaccctggtggaggaacaagacgcaaacttcgtctgccggagaaccttcgtggaccggggctgggggaacggttgtggcctcttcgggaaagggagcctcctgacgtgcgccaagtttaaatgcgtgaccaagctcgagggcaagatcgtccagtacgagaaccttaagtattccgttatcgttacggtccacaccggggatcagcaccaggtggggaacgagacaacggagcatggcactatagcgacgatcacgccccaggccccaacgagcgagatccagctgaccgactacggtgctctcacccttgactgctctcctagaaccggcctggactttaacgagatggtcttactgacgatgaaggaaaagtcctggctggtgcataagcagtggttcctcgacctgcctctgccctggacctcaggggctagcaccagccaggaaacctggaaccggcaggatttactcgtgacgttcaaaaccgctcacgcgaagaagcaggaggtcgtggtgctgggttcccaggagggcgccatgcatacagcccttactggggcaacggagattcagaccagcggcaccaccacgatctttgccgggcacctaaagtgcaggctcaagatggacaaactcacgttgaagggcacctcctacgtcatgtgcaccgggtcgttcaagctggagaaggaggtggccgagacgcagcatggcaccgtgctggtccaggtgaagtacgaaggcaccgacgccccctgcaagatccccttctccacgcaggatgaaaagggcgtgacgcaaaacggccgtctcatcaccgccaatccgatcgtcacggacaaggagaagcccgttaacatcgagaccgagccgccctttggtgagagctacatcgttgtcggagcgggcgagaaggccctgaagttatcctggttcaaaaaggggagctccatcggcaagatgttcgaggccacggcccgcggtgcccggcgcatggccatcctcggggataccgcgtgggacttcggaagcatcggcggcgttttcacgtccgtggggaagctcgtacaccaggtgttcggcaccgcctacggggtgttgtttagtggagtcagttggacgatgaagatcgggatcggcatcctcctgacctggctaggcctcaacagcagaagcaccagcctgtcaatgacatgcatcgcggtagggatggttacgctgtacctcggcgtcatggtgcaggcagacagcgggtgtgtgatcaactggaagggcagagagttaaagtgcgggagcggcatcttcgtcactaacgaggtgcatacctggacggagcaatacaaattccaggcggactccccgaagcgcctgagcgcggccatcggcaaggcgtgggaggaaggggtgtgcggcatccggtccgcaacccgcctggagaacattatgtggaagcagatttcgaacgagctgaaccacattctgctagagaacgatatgaaattcacggtcgtggttggggacgccaacggcatcctggcgcagggtaagaagatgatccggccccagcccatggagcacaagtacagctggaaatcctggggtaaggcgaagatcatcggcgccgacatccagaatacaacgttcataatcgacgggcccgacaccccagagtgccccgatgaccagcgcgcctggaacatctgggaggtcgaggactatggctttgggatctttacgactaacatatggctgaagctccgcgactcctacacccaaatgtgcgaccaccgcctgatgagcgcagccattaaggactccaaggccgtgcatgccgacatgggctactggatcgagagcgagaagaatgagacctggaagctggccagggcgtccttcatcgaagtgaaaacgtgcacatggcccaagagccacactctatggtccaacggcgtcctggagagcgagatgattatccccaagatctacgggggcccgatctcccaacacaattaccgccccgggtatttcacccagacagccgggccctggcacctggggaagctcgagctggacttcgacctatgcgagggcaccaccgtggtggtcgacgagcactgcggcaatcgggggcctagcctccgcactacgaccgtgacggggaagatcatccatgagtggtgctgccggtcctgcaccctaccgcccctgcgctttcgcggggaggatggctgctggtatgggatggagattcgccccgtgaaggagaaggaggagaatctcgtccggagcatggtgtcggccggcagcggcgaggtggattcattctccctggggatcctgtgcgtcagcatcatgattgaggaggtgatgcgcagccggtggagccgcaaaatgcttatgacgggaaccttggcagtgttcctcctactgatcatggggcagctgacctggaacgatctcatccgactgtgcataatggtcggcgccaatgcgtccgaccggatggggatgggtacgacgtacctggccctcatggccactttcaagatgcgcccgatgttcgccgtgggccttcttttccggcgcctcacctcacgggaggtgctactcctaaccatcgggctgagtctggtagccagcgtggagctgcccaattcgctcgaggagctgggtgacgggctcgcgatgggcatcatgatgctgaagttgctaacggagttccaaccccaccagctgtggaccaccctgctctcgctgacctttatcaaaacgaccctgagtctagactacgcctggaagacgaccgccatggcgctgagcatcgtctccttattccccttatgcctgagcacgacttcccagaagaccacctggctgccggtgctactgggcagctttggttgcaagcccctgaccatgttcctcatcacggaaaataagatctggggccggaagtcctggcccatcaacgaggggataatggcgatcgggatcgtgagcatattactgagtagcctcctgaagaacgacgtaccacttgccgggccgcttatcgccggcggaatgctgattgcttgctacgtgatcagcgggtcctcagccgacctgtcactcgagaaggcggccgaggtgtcgtgggagcaggaggccgaacatagcggtaccagccataacatcctggtcgaggttcaggacgatggaaccatgcgcattaaggacgaggagaaggatgatacgctgacgatactcctgaaagccactctgctcgctgtctccggagtgtaccccatgagcatacccgcgacactgttcgtttggtacttttggcagaagaagaagcaacgctccggagtgctgtgggacactcccagcccccccgaggtcgagcgcgcggtgctcgacgatggcatctacagaatacttcagcggggcctgctgggaaggtcccaagtgggcgtcggggtgtttcaggacggcgtgttccacacgatgtggcacgtgacccgcggggcggtgcttatgtaccaaggcaagcgcctggagcccagctgggcctccgtgaagaaggacctgatcagctacggcgggggttggcggttccagggatcctggaataccggcgaagaggttcaggtgatcgccgtcgagccagggaagaatccgaagaacgtccaaaccacgcccggcaccttcaaaacacccgagggcgaggtgggagcgatcgctctggacttcaaaccgggcaccagcgggagcccgatcgtgaacagggagggcaagatagtcggcctgtatgggaacggcgtggtgacgacatccgggacctacgtgtccgccatcgcccaggccaaggccagccaggagggacccctgcctgagatcgaggatgaggtgttcaagaagcgtaacctcacgataatggacctgcacccggggtcaggtaagacacgccggtacctgcccgccatcgtgagagaagccataaagcggaagttacgcaccctaatcttagccccaacccgtgtcgtggcgtctgagatggccgaggcgctcaaggggatgcccattaggtaccaaaccaccgccgtaaagagcgagcacaccgggcgcgaaatcgtagatctgatgtgccacgccaccttcaccatgcggctactctccccggtgcgcgtccccaactacaatatgatcatcatggacgaggcgcacttcacggacccggcctccatcgctgcccggggctacatctccacccgcgttggaatgggcgaagccgcggccatcttcatgaccgccaccccgcccggctccgtagaggcctttccgcagtccaacgccgtgatccaggacgaagagagggatatccccgagcgcagctggaactccggctatgactggataacggatttcccaggcaagacagtatggttcgtaccctcgatcaagtccgggaacgacatcgccaactgtctgcggaagaacggcaaacgggtgattcaattatctcgaaagactttcgacaccgagtatcagaaaacgaagaacaacgactgggattacgtagtgaccaccgacatatccgagatgggggctaacttccgcgccgaccgggtaatcgatccccgtcggtgccttaagccggtgattctgaaggacggccccgagagggtaatcctggccgggcctatgcccgtgaccgtcgcgagcgccgcacagcggcggggtcggattggccgcaaccaaaacaaggaaggagaccagtacgtatacatggggcagcccttaaacaatgacgaagaccacgcccactggacagaggccaagatgctgttggacaacatcaacacccccgaagggatcatcccggccttattcgagcccgagcgcgagaagtcggcggccatcgacggcgagtatcgtctgcgcggggaagcgcgcaagaccttcgttgagttgatgcgacggggcgatctccccgtgtggctgagctacaaggtggcttctgagggcttccagtacagcgaccgccgttggtgcttcgacggggagcgcaacaaccaggtcctagaggagaacatggacgtggagatctggaccaaggagggtgaacggaagaaacttcggccccggtggttggatgcgcgaacctattccgatcctctggcgctccgggaattcaaggaattcgccgccgggcgccggagcgtgagcggcgacctgattctggaaatcgggaagctcccacagcacctgacgctgcgcgcacagaatgcgctcgacaatctggtgatgctccataacagcgaacaaggcgggaaggcctaccggcacgccatggaggagcttccggacaccatcgagaccctgatgttgctcgccctgattgcggtgcttaccggcggcgtgacactcttcttcctgagcgggaaaggcctgggcaagacctccatcgggctcctgtgtgtgacagccagctctgtgctactttggatggcctcagtggagccacactggatcgccgcctccatcattctggagttcttcctcatggtcctcctgatccctgaacccgaccgccagcggaccccacaggacaaccagctggcctacgtggtgatcggcttactgttcatgatcctgacggtggctgccaacgagatgggcctcctggaaaccactaagagagacctgggtatcgggcacgtggcagccgagaatcatcaacacgcgaccatgctcgacgtggatctgcggccggccagcgcctggacgctgtatgctgtcgccacgactgtgatcacgcccatgatgcgccacactatcgagaacaccaccgcgaatatctccctcaccgcaatcgccaaccaagccgccatcctgatgggcctcgacaaaggttggcccatctcgaaaatggacatcggggtgcccttactggcactagggtgctattcccaggtaaatccgctcactttaaccgccgccgtgttgatgctcgtggcccactacgcaatcatcggccccggtttgcaggccaaggccaccagagaggcgcagaagaggaccgccgccggaatcatgaagaaccccacagtggacggcatcgtggccatcgacctggaccccgtagtctacgacgccaagttcgagaagcagctcggccaaattatgcttctaatcctctgtgcctctcaggtgctgctgatgcgcaccacctgggccctctgcgagtccatcaccctcgcgacgggtccgctgaccaccctctgggagggctcgcccggaaagttctggaacaccacgatcgcagtctctatggcaaacatattccggggcagctacctagccggcgccggcctggcgttcagcctcatgaagtcactgggcgggggcagaagagggaccggagcccagggcgagaccctgggggagaaatggaaacgccagctcaaccagctgtccaaaagcgagttcaacacttacaagaggagcggtattatggaggtcgacagatccgaggccaaggaggggctgaaaagaggggagacgaccaagcacgcagtgagccgcgggacagcgaagctacggtggttcgtggaacgcaacctagtcaagccagaggggaaggtgatcgacctgggctgcgggcggggtggttggtcctactactgtgccggcctgaagaaggtgactgaggtcaagggctataccaaggggggccccgggcatgaggagcctattcccatggcgacttacgggtggaacctcgtgaagctgcacagcgggaaggacgtgttcttcatgccgcctgagaagtgcgacaccttactctgcgacataggggaatcaagtccgaatcccacaatcgaggaggggcgaaccttacgggtcctgaagatggtggagccctggctacgcggtaaccagttttgcatcaagatccttaacccctatatgccgtccgtggtagagacattagagcagatgcagcggaagcacggcgggatgctcgtgcgcaaccccctaagccggaactcaacgcacgagatgtactgggtaagctgcggtaccgggaacatcgtgtccgcggtcaacatgactagccgcatgcttctcaaccgcttcacgatggcccaccggaagccaacctacgagagagacgtggacctgggcgcgggcacacggcacgtcgcggtggagcccgaagtggccaacctggacatcatcgggcagcgcattgagaatataaagaacgagcacaaatccacctggcactacgacgaggacaacccgtataagacgtgggcctaccacggcagctatgaggtcaagccgtctgggagcgcctcaagcatggtaaacggcgtcgtgcgtctcctgaccaagccttgggatgtgatccccatggtcacccaaatagcgatgaccgacacgactccgttcgggcaacagcgcgtgttcaaggagaaagtcgacacccgtacaccccgggccaagagaggcacgacccagataatggaggtcaccgctaagtggctgtgggggttcctgtcccgcaacaagaagccccggatctgcacgagagaggagttcacgcgtaaagtgcgcagcaacgccgcagtgggggcggtcttcgtggacgaaaaccagtggaacagcgctaaggaggcagtggaggacgagcggttctgggacctggtccaccgagagcgggagctgcacaagcaaggcaagtgcgcgacctgtgtgtacaacatgatggggaagcgcgagaagaaactcggtgagttcgggaaggcgaagggctcccgggcaatctggtacatgtggctaggtgcccgcttcttggagttcgaggcactagggttcatgaatgaggatcactggttctcccgggagaactccttgtcaggcgtggagggggagggccttcacaagctcgggtacatcctacgcgacatctccaagatccccggcggaaacatgtacgccgacgatactgccggctgggacacacgaattacggaggatgatctgcagaacgaggccaagatcacggacataatggagcccgaacacgctcttctggcgacctccatctttaagcttacctaccaaaacaaagttgttcgggtgcagcgacccgcgaagaacggcacagtcatggacgtgatctcccggagggaccagagagggagcgggcaggtgggaacctacgggttaaataccttcaccaacatggaggtacagctgatccgtcagatggagtccgagggcatcttcctgcctagcgagttggagacaccgaacctggccgagcgggtgctggactggttagagaagcacggggccgaacgcctgaagcggatggccatctccggcgacgactgcgtggttaagcccatcgacgatcgcttcgccaccgccctgaccgcgctcaacgacatgggtaaggtcaggaaagacataccccagtgggagccgagcaaaggttggaacgactggcagcaggtcccgttctgctcgcaccacttccaccagctgataatgaaggacggccgcgaaatcgtcgttccctgccggaatcaagacgaactagtggggcgcgcccgggtctctcagggcgccgggtggtctctccgcgagaccgcctgcctggggaagagctacgcccagatgtggcagctgatgtacttccatcggcgcgacttacggcttgcggctaacgccatctgctccgccgtgcccgtggactgggtcccgactagccgcacgacctggagcatccacgcgcaccatcagtggatgaccaccgaggatatgctgtccgtgtggaaccgagtgtggatcgaagagaacccgtggatggaggataaaacgcacgtttcgtcctgggaggaggtaccctacctcgggaagcgggaggaccagtggtgcggcagcctgatcggcctgaccgcccgcgccacctgggcaacaaacatacaggtggccatcaaccaggtccggcgactcatcggaaacgagaactacctggattatatgacttccatgaaacggttcaagaacgagagcgacccagagggtgcgctgtggtga

SEQ ID NO: 24785 - RNA, 9879 nt, synthetic construct
  misc_feature 1..9879: note = derived and/or modified CDS sequence (opt11) from DENV-1__HQ332181__SS-prME
  source 1..9879: mol_type = other RNA
agtgtaaccatgttgctaatgctgctgcccactgccctagcctttcatctgaccacccggggcggggaacctcacatgatcgtgagcaaacaagaacggggcaagagcctcctgtttaagaccagcgctggggttaatatgtgcaccctgattgccatggacctgggcgaactctgcgaggacaccatgacctacaagtgcccccgcatcaccgaggccgaaccggacgacgttgattgctggtgcaatgctaccgacacctgggtgacctacgggacttgctcccaaaccggcgaacaccggagggagaaacggtccgtggccctggcgccgcacgtgggactggggctcgaaacccgcactgagacatggatgtcgtcggagggcgcctggaagcaaatccaacgagtcgagacctgggcgctgcgccaccccgggttcactgtgatagcctttttcctagctcacgccatcggcacctccattacccagaaggggataatcttcatcctcctgatgctggtgacgccgagcatggccatgcgatgcgtcggcatcggcaatagggacttcgtagaggggctctcaggcgccacatgggtggacgttgtcctggagcacgggagttgtgtcaccaccatggccaagaacaagcccaccctggacatagagctgctgaagaccgaggtcaccaaccctgcggttcttaggaagctctgcatcgaggccaaaattagtaacaccaccacagactctcgctgcccaacccagggggaagcaaccctggtggaggagcaggacgccaacttcgtgtgtcggcgcacctttgttgacaggggctgggggaacgggtgcgggctgtttgggaaggggagtctcctgacgtgtgcgaagttcaaatgcgtgaccaaactggagggaaagatcgtccagtacgagaacctcaagtactccgttattgtgaccgttcacacaggcgatcagcaccaggtaggaaatgagacgaccgagcacggcacgatcgcgactatcacaccccaggcccccacctctgagatccaactgaccgactacggggcactaaccctggactgctctccccggaccggtctggatttcaacgagatggtccttctcacgatgaaggagaaaagctggctggtccacaaacagtggttcctggacctaccattgccctggacgagtggggctagtaccagccaagaaacttggaatagacaggacctgctcgtgacatttaagaccgcccatgcgaagaagcaggaggtcgtggtgctgggctcgcaagagggcgccatgcacaccgcgctgaccggcgctacggaaatccaaaccagcggcaccactacgatcttcgccgggcacctgaaatgtcgcctcaagatggacaagctgaccttaaaaggaatgtcctacgtcatgtgcaccgggtcattcaagttggagaaagaggttgcggaaacccagcacgggacggtgctggtacaggtaaagtacgaagggaccgacgccccatgcaagatccctttctccacacaggacgagaaaggcgtgacccagaacggccgattgattacggccaaccctatcgtcacggacaaagaaaagcccgtgaacatcgagacggagccgcccttcggcgagagctatatagtcgttggcgcgggcgagaaagcgctcaagctgtcgtggttcaagcgcgggtctagcataggcaagatgttcgaggccacagctagaggggccaggcgcatggccatcctgggcgacacggcgtgggacttcgggagtattggaggcgtattcacttccgtgggtaagctagttcaccaggttttcggaactgcatacggggtgctgttcagcggtgtcagttggaccatgaagatcgggattggcatactgctcacgtggctcgggctgaactcgcgctcgacaagtctcagtatgacgtgtattgccgtggggatggttaccctctatcttggcgtcatggtccaggccgacagcgggtgcgtgattaattggaaaggtcgcgagctcaaatgcgggtccggcatcttcgtcacgaacgaggtgcatacatggaccgagcagtacaagttccaggcggacagcccgaagcggttatcagcggccatcggcaaagcctgggaggagggtgtatgtggaatcaggagcgccacgcggcttgagaatattatgtggaagcagatcagcaacgagctcaatcacatacttctcgagaacgacatgaagttcaccgtcgtggtgggggatgccaacgggatcctcgtccaggggaaaaagatgatccgaccccagcctatggagcacaagtacagttggaagtcatggggtaaggcgaagatcataggcgccgatatacagaacacgaccttcatcattgatgggcccgatacgccggagtgccccgatggtcaacgcgcctggaatatctgggaggtggaagattacgggtttggagtgttcaccacgaacatctggctgaagctgcgcgattcctacacacaaatgtgcgaccaccggctcatgagcgcggccataaaggactccaaggcggtccacgccgacatgggttactggatcgaaagcgagaagaacgagacctggaaactcgcccgtgcatccttcatcgaggtgaagacctgcacgtggcccaagtctcataccctgtggagcaacggggtgttagagtctgagatgatcatccctaagatctacggcgggccgatcagtcagcataattaccgtcctggctacttcacacagaccgcggggccttggcacctgggcaagctggaactcgacttcgacctgtgcgagggcacgactgtggtggttgacgagcattgtgggaaccgtggccctagcctgcggaccaccacggttaccgggaagataatccatgagtggtgctgccgctcctgcactctaccgcctctgcggtttcgcggcgaggacgggtgctggtatggcatggagattcggcccgtgaaggaaaaggaggagaatctggtgcgcagcatggtcagcgccggcactggggaggtcgacagcttcagcctgggcatcctctgcgtcagcattatgatcgaggaagtaatgcgttcgcgctggtcccgcaagatgttaatgacggggacgctcgccgtattcctactgctcatcatgggtcagcttacttggaacgatctgatcaggttatgtatcatggtgggggccaatgcaagcgaccgcatggggatgggcacgacttacctcgctctgatggcaactttcaaaatgcggccgatgttcgcagtcgggctcctcttccgccggctgacctccagagaggttctccttctgactatcggcctctctctagtcgcctccgtggaacttccaaacagcctcgaggaactgggggacggcttggccatgggcatcatgatgcttaagctgctgacggagttccaacctcatcagctctggaccaccctgctttccctgaccttcgtgaagacggcgttgtccctggactatgcgtggaaaaccaccgccatggtcctctccatcgtgagcctgttccccctgtgcttgtccaccacgtcgcagaagaccacctggttacccgtgctgttagggtccttcggctgcaaacccctgacaatgttcctaatcacagagaacaaaatctgggggcgcaagagctggcccctcaacgaaggcataatggccatcgggatcgtttccatcctgctcagctccttactgaaaaacgacgtaccactggcgggcccgctcatagcgggcggtatgctgatcgcctgttacgttattagcggtagctccgccgacttaagcctcgagaaggccgcggaggtctcatgggagcaagaggccgagcacagcggcgcttcccacaacatcctggtggaggtacaggatgacggcaccatgaagatcaaagacgaggaacgcgacgataccctgaccattctcctgaaggctacacttctggccgtcagcggggtgtacccgatgtccattcccgcaaccttattcgtatggtatttctggcagaaaaagaaacagcggagcggggtgttatgggacaccccctctccgcccgaggtggagcgcgccgtattggacaatggcatctatcggatcctgcagcgcgggcttctagggcggagccaggtcggggtaggtgtgttccaggacggggtcttccacaccatgtggcacgtcactcgaggagccgttctcatgtaccagggcaaacgactggaaccctcctgggcctctgtcaagaaggacctgatctcatacggaggcgggtggcggtttcagggcagctggaacacgggggaagaggtccaggtgatcgcggtcgagcccgggaaaaacccgaagaacgtgcagaccactcccggcaccttcaagacgcccgagggcgaggtgggcgcgatcgccttagacttcaagcccgggacgtctggctcaccgatcgtcaaccgggagggcaaaatcgtggggctgtacggcaacggggttgtcacaacctccgggacgtacgtctcagcaatcgcgcaagctaaggcgtcccaggaaggacccctgcccgagatcgaggatgaggtgttcaagaagcgcaacttaaccattatggacctgcatccgggttcgggtaagacccggcgctacttacccgccatcgtccgggaggccatcaaacgcaagctccgcaccctcatcctggcccccacgcgggtggtggcgtccgagatggcagaggccctcaaggggatgcccatccgctaccagaccacggccgtcaagagcgagcacaccggccgggagattgtggacctgatgtgccacgccacgtttaccatgcgtctgctcagcccggtgcgggttcccaactacaacatgatcatcatggacgaggcgcacttcaccgaccccgccagtatcgcggccagggggtatatttcgaccagggtgggcatgggggaggcagctgctatcttcatgacggccacgccgcccggctccgtcgaggcattcccccagagcaacgccgtcatccaggacgaggagagagatatccccgaacggtcctggaactcgggctacgactggatcaccgacttcccagggaaaaccgtttggttcgtgccctccatcaagagcggcaacgatatagcaaattgcctgaggaagaacggcaagcgggtcatccagctgagccgcaagacgttcgacaccgagtaccagaagacgaagaacaacgactgggactacgtggtgacgacggacatttccgagatgggcgcaaattttcgggccgaccgggtcattgacccccggaggtgtctaaaacccgtgatcctgaaggacgggcccgagcgtgtcattctggccggcccgatgcccgtgaccgtggcaagtgccgcccaaaggcgcgggagaatcggtcgcaatcagaacaaagagggcgaccaatacgtctacatgggacagcccctcaacaacgacgaggaccatgcccactggaccgaagccaagatgctgctggacaatatcaacacccccgaggggatcataccggcgctgttcgaacctgagcgggaaaaatcagccgccatcgacggggagtaccgcctacggggcgaagcccgcaagacatttgtggagttgatgcggaggggagatctccccgtgtggctgtcctacaaagtcgctagcgaggggttccagtattccgaccggcgctggtgctttgatggcgagcggaacaaccaggtgcttgaggagaacatggacgtggagatctggacaaaggagggagagcgaaagaagctccgcccccggtggctggacgctcggacttacagcgacccgctagcgctccgcgagttcaaagagttcgccgcaggacgccgctccgtcagcggcgacctgattttagagatcggaaagctaccccagcatctgactctgcgtgcacagaatgccttggacaacctggttatgctgcacaacagcgagcagggcgggaaggcatatcggcacgctatggaggagctccccgacactatcgaaacgctgatgctgctcgcactgatcgccgtgctgacaggcggagtcaccctctttttcctgagtggcaagggcctggggaagaccagcataggcctcctgtgtgtgacggcctcctcagccctgctctggatggcctccgtcgagccccactggatagccgcgtctatcatccttgagttctttctgatggtactcctgatcccggagccagaccggcagcggacgccccaggacaaccagctggcgtacgtcgtgatcgggctcctgtttatgatccttaccgtcgcagcaaatgagatgggcctactggagacaacgaagaaagatctggggatcggctatgtggcagcggagaaccaccaacacgccaccatgctcgacgtagatctgcaccccgcctccgcgtggaccttatacgcggtagcgaccacggtgatcacccccatgatgcgccacacaatcgagaacaccacggccaatatcagcctcaccgcgatcgcgaaccaggcggcgatcctgatgggccttgacaagggttggcccatctccaagatggacattggcgtgcccctcctggctttaggctgctacagccaggtcaatccgctcaccctgacggcagcggtgctgatgctcgtcgcgcactacgcaatcatcggcccgggcctgcaggccaaggcgacgcgcgaggctcaaaaacgcacagcggcagggatcatgaaaaatcccaccgtagacggcatcgtggctatcgatctagaccccgtggtctacgacgcgaagttcgagaaacagctcggccagataatgttactcatcctctgcactagccagatcctgctgatgcggactacctgggccctctgcgagagcatcaccctggccaccggcccgcttacgaccctctgggaggggtcccctggcaagttttggaacaccaccatcgccgtgagcatggccaacatatttcgcggctcctacctggccggggccggcctggcgttctcgctcatgaagtccttaggaggcggacggcgcggcacgggcgcccagggggagaccctgggcgagaagtggaagagacaactgaatcagctgagcaagagtgagtttaacacctacaaacgcagcggcatcatggaggtcgaccggtctgaagccaaagaggggctgaagcgcggagagaccaccaagcacgctgtttcgcggggcaccgcgaaattacgttggttcgtggagcggaacttagtcaagcccgagggcaaggtcatcgatctgggatgcgggcgcgggggctggagctactactgtgccgggctcaaaaaggtaaccgaggtgaagggctacaccaaaggcgggcccggccacgaggagcccatcccgatggccacatacgggtggaacctcgtcaagttgcactcagggaaggatgtgttcttcatgccacccgagaagtgcgatacgctgctctgcgatatcggggaatcatcccctaaccccactatcgaagagggacgaaccctgcgcgtgctgaaaatggtagagccctggctacggggcaatcagttctgtatcaagatcctaaacccctatatgccgtcggtagtggagacgctggagcagatgcagcgtaagcacggtggcatgctcgtcaggaatcccctgtcacgcaacagcacgcacgaaatgtactgggtgtcctgcgggacaggcaatattgtgagcgcagtgaacatgacctcccgtatgttacttaaccgcttcactatggcccaccgcaagcccacgtacgagcgggacgttgacttgggcgcggggacccgtcatgttgccgtggagcccgaagtggccaaccttgacatcatcggacagcgcatcgagaacatcaagaatgagcacaagagcacctggcactacgacgaggacaacccgtacaaaacctgggcctaccacggctcctacgaggtcaaaccctctgggagtgccagctccatggtgaacggggtggtcaggttgctgacgaagccctgggacgttatccccatggtaactcagatcgccatgaccgatacaactccgttcggccagcagagggtattcaaggagaaggtcgataccagaacgcccagggccaagagaggcaccacgcagatcatggaggtgaccgccaagtggctgtggggtttcctcagccgaaacaagaagccccgcatttgcacgagggaggagtttacccgcaaggttcgctccaatgctgcgatcggagcggtgttcgtggacgaaaaccaatggaactcggctaaggaggccgtagaagacgagcgcttctgggacctggtgcaccgggagcgggagcttcacaagcaggggaagtgcgccacgtgcgtttacaacatgatgggcaaacgtgagaaaaagctcggggagttcgggaaagcaaagggaagtagggccatctggtacatgtggctgggggcccgatttctggaatttgaggccctcggcttcatgaatgaagaccactggttctcgcgcgagaactcattatccggcgtcgaaggcgagggcctgcacaaactcggctacatactgcgagacattagtaagataccaggcgggaacatgtatgccgacgatactgcgggatgggacaccagaatcaccgaggacgacctgcagaacgaagccaagatcacagacatcatggagcccgagcacgccctcttggccacctcgatcttcaagctgacgtaccagaacaaggtcgtgagggttcagcggccggcgaagaacggaaccgtgatggacgtcatcagccgccgggaccagcgaggctccggccaagtcgggacgtacgggctaaacaccttcaccaacatggaggtgcaattaatcagacaaatggagagcgaggggattttcctgccatccgagctcgagaccccgaacctcgcggaacgcgcactggactggctcgagaaacacggcgccgaaagactcaagagaatggcaataagcggagacgactgcgtggtcaagccgattgacgaccggttcgccacggcgctgacagccttgaacgacatgggaaaggttcgcaaggatatcccccagtgggagccctcgaaaggatggaacgactggcagcaagtcccgttctgctcacaccacttccaccagctgatcatgaaggacggtcgggaaatcgtcgttccctgccgtaaccaggacgaactggtgggccgggcacgcgtttcccagggggccggctggtcgctccgcgagaccgcgtgcctggggaagtcctacgcgcagatgtggcagctcatgtacttccatagaagggacctcaggcttgctgccaacgccatatgttcagccgtcccagtcgattgggtccctacctcccggacgacgtggagcatccacgcccatcaccaatggatgaccacggaggacatgctgagcgtatggaatcgggtctggatcgaggagaatccgtggatggaggataaaacccacgtctcgagctgggaggaagtgccctacctcggaaagcgcgaagaccagtggtgcgggtccctgataggtctcactgcgcgggcaacctgggctaccaacatccaggtggcaatcaatcaggtgcggaggcttatcggcaatgagaattatttagactacatgacctcgatgaagcgtttcaagaatgagtccgacagcgaaggcgctctgtggtag

SEQ ID NO: 24786 - RNA, 9879 nt, synthetic construct
  misc_feature 1..9879: note = derived and/or modified CDS sequence (opt11) from DENV-1__HQ332180__SS-prME
  source 1..9879: mol_type = other RNA
agcgtgaccatgctcttgatgctcctgcccaccgctctcgccttccatctgaccacccgcggaggggagccccacatgataatctcaaagcaggagcggggcaagagcctgctgttcaaaactagcgcgggggtgaacatgtgcacccttatcgccatggacttaggcgagctctgcgaggacaccatgacctacaagtgccctcgcataaccgaggcggagcccgatgatgtggactgctggtgcaacgccaccgacacatgggtgacctacgggacctgtagtcagaccggcgagcaccggcgcgataagcgatccgtcgccctggcgccccacgtgggcttagggctcgagacccgaaccgagacctggatgagctccgagggcgcgtggaagcaaatacagcgggttgagacctgggccctgcgacatccggggttcacggtgatcgccctcttcttggcgcacgccatcggcaccagcataacccagaagggtatcatcttcattctgctgatgctcgtgactccttccatggccatgcggtgcgtgggcatcggcaaccgagacttcgtagaggggttatcgggggccacgtgggttgacgtggttctcgagcacgggtcctgcgtgaccaccatggctaagaacaagccgaccctcgacatcgagttactgaagacggaggtgaccaaccccgcggtcctgcggaagttatgcatcgaggccaagatcagcaacacaaccacggactcccgctgcccgacccagggcgaggccaccttagtggaggagcaggatgccaacttcgtgtgccggagaacctttgtcgatagaggctgggggaacggctgtggcttatttggcaaggggtcactgctgacgtgcgctaagttcaagtgtgtgaccaagctcgagggcaaaatagtgcagtacgagaacctgaagtactcggtcatcgtgacagtgcacactggagaccagcatcaagtcgggaacgaaacgaccgagcacggcaccatcgcgaccatcacgccccaggccccaacgtccgagatccagctgaccgactatggggcattaacgctagactgtagcccccgcacgggcctggatttcaacgagatggtgctcctgacaatgaaggagaagtcctggctggtgcacaaacaatggttcctcgacctgccactgccgtggacctcaggggcgagcaccagccaggagacatggaatcggcaggaccttctggtgacgttcaaaaccgcccacgctaagaagcaggaggtggtcgtgctgggcagtcaggagggcgctatgcacactgccctcaccggggccacggagatccagacctcgggcaccaccacgatcttcgcgggtcaccttaagtgccgccttaagatggacaagctgaccttaaaggggatgtcctacgtgatgtgcaccgggtcgttcaagctggagaaggaggtcgcagagacgcagcacggaacagttctggtgcaggtcaagtatgagggcaccgacgccccttgcaagatccccttctccacccaggacgagaagggggtcacccaaaacggccggctcatcacggccaacccgatagtgaccgacaaggagaagcccgtgaacatcgaaaccgagccgcccttcggggaatcctatatcgtggtgggtgccggcgagaaggcgctgaagctgtcctggttcaagaaagggtctagcatcggaaaaatgttcgaggccacagcacgcggggctaggcgcatggccatcttgggcgacaccgcgtgggacttcgggtctatcggtggcgtcttcacctccgtggggaagctggtgcaccaagtcttcgggaccgcctatggggtgctgttttcgggcgtgtcttggaccatgaagatcgggatcggcatcctcctgacgtggctgggcctcaattctagaagcaccagcctgtcaatgacctgtatcgccgtcggtatggtgaccctgtacctcggcgccatggtgcaggccgacagcggttgcgtcatcaactggaagggccgggagctgaagtgtgggtccggcatcttcgttacgaatgaggtgcacacttggaccgagcagtacaagttccaggcggacagccccaagcgcctgtctgccgccatcggcaaagcctgggaggagggggtctgtggcatccggtccgccacccgcctcgaaaatatcatgtggaagcagattagcaacgaactgaatcacattctgctcgagaacgacatgaagttcaccgtcgtggtcggggacgcgaacggcatcttggcccaggggaagaagatgattcggcctcagcccatggagcacaagtactcctggaagtcttggggaaaggccaagataatcggcgcagacatccagaacacgacctttattatagacggtcctgacaccccggaatgccccgacggccagcgcgcgtggaacatttgggaggtcgaggactacgggttcggaatcttcaccacgaacatttggctgaaacttcgggactcctatacccagatgtgcgaccaccgtcttatgagcgccgcgatcaaggactcgaaggccgtgcacgctgacatgggctattggatcgagagcgagaagaacgagacctggaagctggcgcgggctagtttcatagaggtcaagacctgcacgtggccaaagtcgcacaccctctggtccaacggggtgctggaaagcgagatgatcatacccaaaatctatggcgggccgatttcccagcacaactaccgccccggatacttcacccagaccgccggcccctggcacctcggaaagctcgagttggatttcgacctgtgcgagggcacgaccgtggtcgtggacgagcactgcggtaaccgcggaccgagcctccgcaccaccacggtaaccgggaagattatccacgagtggtgctgccgctcctgcaccctgccgccactgaggttccggggcgaggatgggtgctggtacggcatggagattcgccccgtcaaggagaaggaggagaacctcgtgaggagcatggtgtccgcgggcagcggagaggtcgacagcttctccctgggcattctgtgcgtatcaatcatgatcgaggaggtgatgaggtcccggtggagccgcaagatgctcatgaccgggacgttagccgtcttcctgctcctgataatgggccaactgacctggaacgacctcatccgcctgtgcatcatggttggggcgaacgcttctgaccggatggggatgggcaccacgcacctggccctcatggccactttcaagatgcgcccgatgtttgcggtggggcttcttttcaggcgcctcaccagccgggaggtactgctgctcaccatcgggctgtccctgatggcgagtatggagctccccaatagtctagaggaactgggcgacggcctagccatgggtattatgatgctgaagctactcactgagttccagcctcaccagctgtggaccaccctgctcagcctgaccttcgtcaagacgacgctgtccctcgactacgcctggaaaaccaccgccatgattctgagcattgtgtccctgttccccctttgcttgtccaccacgtcccagaagaccacctggttaccggtcctcctggggagcttcggatgcaagccccttaccatgttccttatcaccgagaacaaaatatgggggcggaagtcctggcccctgaacgaaggcatcatggcgatcggaatcgtcagcattctgctcagcagcctgctgaagaacgacgtccccctcgccggacctctgatcgctggagggatgctgatcgcctgttacgttatctctggctccagcgctgacctctccctggagaaggccgccgaggtgagctgggagcaagaggccgagcactccggggcgagccacaacatcctggtcgaggtgcaggacgacggcacgatgaaaatcaaggacgaggaacgggacgacaccctcaccatcctgctgaaagctaccctcctggcggtgtccggggtctaccccatgagcatccccgctacgctgttcgtctggtacttctggcaaaagaaaaagcagcgctcaggtgtgctgtgggacacccccagcccgcccgaagtcgagcgggcggtcctcgacgacggcatctataggattctgcagcgggggctgttaggccgctcccaggtgggggtcggcgtgttccaggatggggtctttcacaccatgtggcacgtcacccggggagccgtgctgatgtaccagggcaagagactggagccgagctgggcctccgtaaagaaggacctcatcagctacgggggcgggtggcggtttcagggctcctggaacacaggggaggaggtccaggtgatcgcggtggaacctgggaagaacccgaagaacgtccaaaccaccccggggacgttcaagacccccgagggggaggtgggcgccatagccctggacttcaaaccggggaccagcggctcaccgatcgtgaaccgcgagggcaagatcgtcgggttatacggcaacggggtggtgaccacctctggcacgtacgtctcagctatcgcccaggcgaaggcaagccaggaagggcccctccccgagatcgaggacgaggtgttcaagaagcggaatttaaccatcatggatttgcacccggggagcggaaagacccgccggtacctgcccgccatcgtgcgcgaagccatcaagcggaagctacgcaccctgattctcgcccccacgcgcgtcgtggcctctgagatggccgaggctctgaaggggatgccaatccggtatcagaccaccgcggtcaaaagcgaacacactggccgcgagatagtagacctgatgtgccacgcgacgttcaccatgcggctcctgtccccagtgcgcgtgcccaactacaacatgatcatcatggacgaggcccacttcacagaccccgccagcatcgccgccagagggtatatctccacccgcgtcggcatgggggaggcggctgccatcttcatgacggccacgccgcccggcagcgtggaggccttcccacagtccaatgcggtgatccaggatgaggagcgggacatccccgagcggtcatggaactccggctatgactggattaccgatttccccgggaagaccgtctggttcgttcctagcatcaaatctggaaacgatatcgcgaactgcctgcggaagaatgggaagcgcgtcatccagctgtcccggaagacgttcgacaccgagtatcagaagaccaagaacaacgactgggactacgtagtgaccacggacatatccgagatgggcgccaactttcgtgcggacagagtgatcgacccgcgccggtgcttgaagccggtcatcctgaaggacggacccgagcgcgtaatcctcgcgggaccaatgcccgtgaccgtcgccagcgccgcgcagcggcgcggccggatcggccgcaatcagaacaaggagggcgaccaatacgtgtacatggggcagccactgaacaacgacgaggaccacgcccactggaccgaggcgaagatgctgcttgacaatataaacactcccgaaggcattatcccggctctctttgagcccgagcgcgaaaagagcgccgctatcgacggggagtaccgtctgagaggcgaggccaggaagacgttcgtggaactcatgcgccggggcgaccttcccgtctggctgagctacaaggttgcgtccgaagggttccagtactcagaccgcagatggtgctttgatggcgaacgcaacaatcaggtcctcgaggagaacatggacgtggagatctggacaaaagagggggaacggaagaaactccgcccacggtggctggacgcccgcacctactccgacccgcttgcccttcgggagttcaaagagttcgccgccggtcgccggtctgtgagcggcgacctgatcctcgagatcggaaagctgccccagcacttgaccttgcgcgcgcaaaacgccctggacaacttagtaatgctccacaactctgagcagggcgggaaggcctatcggcacgccatggaggagttacccgacaccatcgagacactgatgctcctggccctgatcgccgtgctcacaggcggggtcaccctgttctttttaagcggcaagggccttgggaagacctccatcggcctgctctgcgtcacggccagttccgccctcttgtggatggccagcgtggagccccactggatcgcggcatccattatcctggagttcttcttgatggtactgctgatccctgaacccgaccgccagaggactccccaggacaaccaactcgcctatgtcgttatcgggctgctattcatgatcctcaccgtggccgccaacgaaatgggcttactggagacaacgaagaaggacctcgggatcggctacgtcgcggccgagaaccatcagcatgccaccatgctggacgtggacttacgcccggccagcgcctggaccttatacgcggttgccactaccgtcattacgcccatgatgcggcacaccatcgagaacacaactgcgaacatctccctgaccgccattgccaatcaagcggccatcctgatggggctcgacaagggttggccgattagtaagatggacataggggtgccattactggctctcgggtgctattctcaggtgaacccgctgaccttaaccgccgctgtgctgatgctggtcgcccattacgcaattatcggtcccgggctgcaagccaaggctacgcgcgaggcgcagaagcgcaccgccgcaggcatcatgaagaacccaaccgtggacggtatcgtagccatcgacttagatccagtcgtttacgacgccaagttcgagaaacagctggggcagatcatgctgctcatcctgtgtaccagccaaatcctgttaatgcgtacgacctgggcgctgtgcgagtccatcaccctggccaccgggccgttaacgaccctatgggaggggagccccggcaagttctggaacacaacgatcgccgtctccatggccaacatcttccgcggcagctacctggccggggcgggcctcgccttctccttaatgaagtccctcggtggcgggcggcgggggacgggagcgcagggggaaaccctcggcgagaagtggaagcggcaattaaaccaactaagcaagagcgagttcaacacctacaagcgttcagggataatggaggtggaccggtccgaggccaaagaaggcctgaagcgtggggagactacaaagcatgcggtgagccggggcacggccaagctgcgatggtttgttgagcggaacctggtgaagcccgagggtaaggtcatcgacttgggctgtggccgcgggggctggtcctactactgtgccgggctcaagaaggttaccgaggtaaagggctacaccaagggcgggcccggccacgaggaaccgattcccatggccacctacgggtggaacctggtgaagctgcacagcggcaaggacgtgtttttcatgccgcctgagaagtgcgacacgctcttgtgcgacatcggggagtccagccccaaccccaccatcgaggagggacgcaccctgcgcgtgctcaagatggtcgagccctggttaaagggcaatcagttttgcatcaagatcctgaacccatacatgccctccgtcgtggagaccctcgagcaaatgcagcgtaagcacgggggcatgcttgtaaggaaccccctgagccgcaattccacgcacgagatgtactgggtctcgtgcgggactggcaacatcgtgagtgccgtgaacatgacctcacgcatgcttctgaaccggttcaccatggcgcaccgcaagcccacttacgagcgcgacgtcgacctgggcgccgggacccggcacgtggccgtggagcccgaggtagcgaacctcgacatcatcggccaacgcatcgagaacatcaagaatgagcacaaatccacctggcattatgatgaggacaacccgtacaaaacctgggcctatcacgggtcttacgaggtgaagccctccggcagcgcgtccagcatggtgaacggggtcgtgcggttgctgacgaagccgtgggacgtaatcccgatggtcacacagatagcgatgaccgataccacgccgtttggccagcaacgcgtcttcaaggaaaaagtcgacacccggactccccgcgccaaacggggcaccacgcaaatcatggaagtgaccgccaagtggctctgggggttcctgtcacgcaacaagaagccgcggatctgtactcgcgaggagttcacccgcaaagtgcgcagcaacgccgcaatcggtgccgtgttcgtggacgagaaccaatggaacagcgccaaggaggccgtagaggacgagcggttttgggacctggtccaccgcgagagggaacttcacaagcaggggaagtgcgctacatgcgtgtacaatatgatgggcaagcgcgagaagaagctgggagagttcggcaaggccaaaggctcccgagccatctggtacatgtggctgggggccagattccttgagtttgaggccctggggttcatgaacgaggaccactggtttagccgggaaaattcactgagcggggtggagggcgaggggctccacaagctagggtacatcctgagagacatctctaagatcccgggcggaaacatgtacgcggacgacaccgcaggctgggacacccgtatcaccgaggacgacctccagaatgaggccaagatcacggatatcatggagccagagcacgccctgctggccacgtccatcttcaagctaacctaccagaacaaggtcgtgcgcgtgcagcgccccgctaagaatgggaccgtcatggacgtgatctcccggcgagatcagcggggctcaggccaagtggggacgtatggcctaaacaccttcactaacatggaggtccaactgatacgccagatggagagcgaggggatcttcctaccaagcgaacttgagacaccgaacctggccgagagagtcctcgattggttagagaagcatggcgctgaacgactgaagcggatggctatctcgggtgacgactgcgtggtgaagccgattgacgaccgcttcgccacagcgttgaccgccctgaacgacatgggcaaggtgcggaaagacatcccccaatgggagcccagcaagggctggaacgactggcagcaggttccgttctgttcccatcatttccaccagctgatcatgaaggacggacgcgaaatcgtcgtgccctgtcggaaccaagatgagttagtgggccgagcccgggtctcccaaggggctggctggtctctgcgcgagacagcctgcctaggcaaaagctacgctcagatgtggcagctcatgtacttccaccggcgcgacttgcgactggccgccaacgccatttgctccgcggtgcccgtggactgggtccccaccagccgcaccacgtggagcatccacgcccaccaccaatggatgactactgaggacatgctgagcgtctggaaccgggtgtggattgaagagaacccgtggatggaggacaagacccacgttagctcgtgggaggaggtgccatacctgggcaaacgcgaggaccagtggtgcggcagccttatcggtcttacggcccgcgccacctgggccaccaacatccaggtggcaataaaccaggtccggcgcctgatcggcaacgagaactacctggactacatgacctccatgaagcggttcaagaatgaaagcgacccagagggggccctctggtga

SEQ ID NO: 24787 - RNA, 9879 nt, synthetic construct
  misc_feature 1..9879: note = derived and/or modified CDS sequence (opt11) from DENV-1__HQ332179__SS-prME
  source 1..9879: mol_type = other RNA
tccgtgaccatgctcctcatgctgctgcccaccgccctcgccttccacctgaccacgcgcggcggcgagccccacatgatcgtgagcaagcaggagcggggcaagagcctcctcttcaagaccagcgcgggggtgaatatgtgcaccctgattgccatggacctgggggaactatgcgaggacacgatgacctacaagtgcccacgcatcactgaggccgagcccgacgacgtggactgctggtgcaacgccaccgacacctgggtcacctatggcacttgcagccagaccggggagcaccggcgcgacaagcggtccgttgccctggcgccccacgtgggcctgggtctcgagacacgcaccgagacttggatgtcaagtgagggcgcctggaagcagatccagcgggtagagacctgggccctgcgccaccccgggttcacggtgatcgccctattcctcgcgcacgccattggcacaagtatcacccaaaaggggattatcttcatcctgctgatgctcgtgaccccatccatggccatgcggtgcgtcggcatcggcaaccgcgacttcgtggaggggctgagcggcgccacgtgggtggacgtcgtgctggagcacgggagttgcgtgaccactatggccaagaacaaacccaccctcgacatcgagctgctgaagacggaggtaaccaacccagcggttctccggaagctgtgcatcgaagctaagatcagcaacaccaccacagactccaggtgccccacccagggcgaggcgaccctggtggaggagcaggacgccaactttgtctgccggcgcaccttcgtggacaggggctggggaaacggctgcggcctattcggcaaggggagcctgctgacgtgcgccaagttcaagtgtgtgaccaagctcgaaggtaagatcgtccagtacgagaacctgaagtactcagtgatcgtgaccgtccacaccggcgaccagcaccaggtcggaaatgagacgacagagcacggcaccatcgcgaccatcaccccacaggcccccacgagcgaaatccagctgactgactacggggccctcaccctggattgcagtccccgcaccggcctggacttcaacgagatggtcctcctgacaatgaaggagaagtcctggctggtgcacaaacagtggttccttgacctgcctctgccatggacctccggggccagcaccagccaggagacctggaaccggcaggacctcctggtgacgttcaaaaccgcgcacgcgaaaaagcaggaggttgtagtgctgggctctcaggagggcgccatgcacaccgccctgaccggagccacggaaatccagaccagcgggaccaccacgatcttcgccgggcacctgaaatgccgcctgaagatggacaaactcaccctgaagggcatgtcctacgttatgtgcaccgggagctttaagctggagaaggaggtggcggagacccagcacggcacggtgttggtccaggtaaagtatgagggaaccgacgccccctgcaagatccccttctccacccaggacgaaaagggagtgacccagaatggcaggctcatcacggccaaccctatcgtgaccgacaaggaaaagcccgtgaacatcgagaccgagccgccattcggggagagctacatcgttgtcggcgccggcgagaaggcgctgaaactgtcctggttcaagaaggggtcttccattggcaagatgttcgaggccaccgccagaggggcccgtaggatggccatactaggagacacggcgtgggacttcgggagcatcggcggcgtgttcacctccgtgggcaaacttgtccaccaggtgttcggcaccgcctacggggtgctgttcagcggcgtctcctggaccatgaagatcgggatagggattttgctgacatggctgggcctcaactcccgctccacctcactgtccatgacctgcatcgccgtggggatggttaccctgtacctcggagtcatggtgcaggccgacagcgggtgcgtgattaactggaagggccgggagctgaagtgcggctcgggcatctttgtcacgaacgaggtgcacacctggacagaacagtacaagtttcaggccgacagtccgaagcgcctctcagcggccatcggcaaggcctgggaggagggggtttgcggcatccggtccgcaacacgcctcgaaaacatcatgtggaagcagatcagcaacgagctgaaccacatcttgctcgagaacgacatgaagttcaccgtcgttgttggagatgctaacggtattctggcgcaggggaagaaaatgatccggccgcagcccatggagcacaagtactcctggaagtcctggggcaaggccaagatcataggcgccgatatccagaacacgaccttcatcatcgacgggcctgataccccggagtgtcccgatggccagcgcgcctggaacatctgggaggtcgaagactacggtttcggcatcttcaccacgaacatctggctgaagctcagggactcctacacccaaatgtgcgaccaccggctgatgagcgcggctatcaaggactccaaggccgtgcacgccgacatgggctactggatcgagagcgagaagaacgagacctggaagctggcccgtgcgtccttcatcgaggtgaaaacctgcacgtggccaaagagccacactctctggagcaacggggtcctggagagtgagatgatcatccccaaaatctacggcgggccgatctcgcagcacaactaccgccccggctactttacacagaccgccgggccctggcaccttggcaagctcgagttggacttcgacctgtgcgagggcacgaccgtggtggtcgatgaacactgcgggaaccgggggccgagcctgcgcactacaacggtgaccgggaagatcatccacgagtggtgttgccggtcctgcaccctgccgcccctgcgcttccggggcgaggacgggtgctggtatggcatggagatcaggccagttaaagagaaggaggagaacctcgtccggagcatggtatccgccggaagcggggaggtggacagcttctcactgggaatcctgtgcgccagcatcatgattgaggaggtcatgcgctcgcggtggagccgcaagatgctcatgaccggtacgctggccgtcttcctgctcctgattatgggccagctgacatggaacgacctcatccgcctgtgcatcatggtgggggcaaacgcctccgacaggatgggcatgggcaccacctatctggccttgatggccacgtttaagatgcgcccgatgtttgccgtagggttactgttccggcggttaaccagtcgagaggtgctgctgctcacaatcggcttgtccctggtcgcatcagtcgagctccccaattccctggaggagctgggggacggcctcgccatgggcattatgatgctaaagttactcaccgagtttcagccccatcagctgtggacaacgctgctctcgctgaccttcgtgaagaccacgctgtccttggactacgcctggaagaccaccgcaatggtcttaagcatcgtgagcctgtttccactctgcctgagcaccacgtcccaaaagaccacctggctgccggtgctcctcgggagctttgggtgtaaacccctgaccatgttcctcatcacggagaacaaaatctgggggcgcaagtcctggcccctcaatgagggcatcatggcgatcgggatcgtcagcatcctgctctccagcctgctgaagaacgacgtgcccctcgccggcccgttgatcgctggcgggatgctaatcgcctgctacgtcatcagcggctccagcgccgacctcctgctggagaaagcggccgaagtctcctgggagcaggaggccgaacactcgggggcctcccacaacatcctcgtggaggtgcaggatgacggcacgatgaagatcaaggacgaggagcgggacgacaccctgaccatcctgctcaaggccacccttctggcggtcagcggagtgtatcccatgtcaatccccgccacactgttcgtgtggtacttttggcagaaaaagaaacagcgcagcggcgtcctgtgggacacccccagcccacccgaagtggagcgggccgtgctggacgacggcatctacaggatcctgcagcgggggctcctgggtcgcagccaggtcggggtgggggtgttccaagacggggtcttccataccatgtggcatgtgacccgtggcgccgtgctgatgtaccagggaaagcgcctcgagccctcctgggctagcgttaagaaagacctgatctcctacgggggcgggtggcggttccaggggagctggaacactggggaggaggtccaagtgatcgcggtcgagcccggcaagaacccgaaaaacgttcagaccactcccggcaccttcaagacgcccgagggggaggttggtgccatcgccctggacttcaagccagggacctccggcagtccgatcgtcaaccgcgagggcaagatcgtggggctctacggcaatggggtggtcaccacctccggcacgtacgtgtcagccatcgcccaagcgaaggcctcccaggaggggcccttgcccgagatcgaggacgaggtgttcaagaagcggaatctgaccatcatggatctccacccgggcagcggcaagacccgccggtacctgcccgccatcgtccgcgaggccataaagcggaaactgcgcaccttaatcctggcacccacacgcgtggtggccagcgaaatggccgaagccctgaaggggatgcccatccggtaccagaccactgccgtcaagtcagagcacaccggacgcgagatcgtggacctcatgtgccacgctacgttcaccatgcggttgctgtcgccggtacgcgtccccaactacaacatgatcataatggacgaggcccacttcaccgatcccgcctccatcgccgcccgggggtacatcagcacccgcgtgggcatgggggaggccgccgcaatcttcatgaccgcaacgccgcccggctccgtggaggcctttccccagtcgaacgccgttattcaggacgaagaacgggacatccccgaacgttcctggaacagcggctacgactggatcaccgacttcccggggaaaaccgtgtggttcgtaccctcgatcaagtctgggaacgacatcgctaattgcctccggaaaaacgggaagcgcgtcatccagctgtcgcggaagacgttcgacaccgagtatcagaaaacaaagaacaatgactgggactacgtggtgaccacggacatctcggagatgggtgccaactttcgcgccgaccgggtaatcgaccccagaaggtgcctgaagcccgtgatcctcaaggacgggcccgagcgcgtgatcctggcgggcccgatgccggttaccgtggcgtccgccgcgcagcggcgcggccggatcggtcgcaaccagaataaggaaggcgaccagtacgtctacatggggcagcccctgaacaacgacgaggaccacgcgcactggaccgaggcgaagatgctcctggacaacatcaacacaccagaggggatcataccggccctgttcgagcccgagcgcgagaagtccgccgccatcgacggggaatataggctccgcggcgaggcccggaagaccttcgtggagctgatgagacggggcgacctgcccgtttggttatcctacaaggtcgcgtctgaggggttccagtactccgaccggcggtggtgcttcgacggcgagcgcaacaaccaggtgctggaagagaacatggacgtggaaatctggactaaggagggggagcggaagaaacttcgcccccggtggctggacgccagaacctacagcgacccgctggccctgagagagttcaaggagttcgccgccgggcgacggtccgtcagcggcgacctcatcctggagatcgggaagctgccccagcacctcaccttacgcgcgcagaacgccctggacaacctcgtgatgctgcacaacagcgagcagggagggaaggcctaccggcacgccatggaggagttacccgacaccatcgagaccttaatgctgcttgcgctcatcgccgtgctgaccggaggggtcaccctgttcttcctctccggcaagggattggggaagacgagcatcggcctgctctgcgtgacggcgtccagcgccctgctgtggatggcctgcgtggagccccactggatcgcggcctccatcatcctcgagttcttcctgatggtcctgctaatcccggagccggaccgccagcggactccacaggacaaccagttggcctacgtggtgatcgggctcctcttcatgatcctgacggtcgccgctaacgaaatgggcctgctagagaccacaaagaaagatcttggtatcggctacgtggccgccgagaaccaccagcacgcgaccatgctggacgtcgacctccgcccggccagcgcctggaccctttacgcggtcgccaccaccgtgatcacccccatgatgcggcacaccatcgagaacaccacagctaacatctccttaaccgccatcgccaatcaggcggccatccttatgggcctggacaaggggtggcccatcagcaagatggacatcggcgtgcccctgctcgccctggggtgctactcccaagtcaacccgctgacgctcactgccgcggtactgatgctggtggcccattacgctatcatcggccccggactccaggcaaaggccacgcgcgaggcgcagaagcgcaccgccgccggcataatgaagaaccccaccgtcgacggcatcgtggcaatcgacctggatcccgtggtctatgacgccaagttcgagaagcagctggggcagatcatgctactgatactgtgcaccagccagatcctcctgatgcggacgacctgggcgctgtgtgagtccatcaccctcgcgaccggcccgctgaccaccttgtgggagggcagccccggcaagttctggaataccacaatcgccgtgtccatggccaacatcttccgcggcagctacctcgcgggggcgggcctcgcattctccctgatgaaaagcctcgggggcgggcgcagaggcacgggcgcccagggggagaccttaggggagaagtggaagcggcagctgaaccagctctccaagagcgagttcaacacatacaagcgctccgggatcatggaggtggaccggagcgaggccaaggagggcctgaagcgcggggagaccacgaagcacgcggtcagccggggcaccgccaagctgcgctggtttgtggagcggaacctggtgaagcccgaggggaaggtaatcgacctcgggtgcggcagagggggctggtcctattattgcgccgggctgaagaaggtgaccgaggtgaagggttacaccaagggcgggcccggccacgaggaaccgatccccatggccacctacgggtggaatctcgtcaagctccacagcggcaaggacgtattcttcatgccgccggagaaatgcgacacgctgctgtgcgacatcggggagtccagcccgaaccccaccatcgaggagggccggaccctccgcgtgctgaagatggtcgagccctggctgaagggcaaccagttctgcatcaagatcctcaacccctacatgccgtccgtggtggagacactggaacagatgcagagaaagcacgggggtatgctggtccgcaaccccctcagtcggaactccacgcatgagatgtactgggtgagctgtgggaccggcaacatcgtctccgcagtcaacatgaccagccgcatgctcttaaaccggttcaccatggcgcaccgcaagcccacgtacgagcgtgacgtggacctcggcgcagggacccgtcacgtggccgttgaacccgaggtggctaacctggacatcatcggtcagcgcatcgagaacattaaaaacgagcacaagtccacctggcactacgacgaagacaacccgtacaaaacatgggcataccacgggagctacgaagtgaagcccagcgggagcgcgtccagcatggtcaacggggtggtccggctgctgactaaaccgtgggatgtgatccctatggtgacccagatcgccatgaccgacaccactcccttcggccagcagcgcgttttcaaggagaaagtagacaccaggacgccccgcgccaagcggggcaccacgcagatcatggaggtgaccgccaagtggctgtgggggttcctgtcccgcaacaagaagccccgcatctgcacccgcgaggagttcacccggaaggtccgcagcaacgccgcgattggcgccgtgttcgtagacgagaaccagtggaactccgccaaggaggccgtcgaggacgagcggttctgggacctcgtgcaccgcgagcgagagctgcacaagcaggggaaatgcgcgacgtgcgtgtacaacatgatgggcaagcgcgagaagaagctgggggagttcggcaaggccaagggcagtcgggccatctggtacatgtggctcggagcccgcttcctggagttcgaggcgctgggcttcatgaacgaggaccactggttcagcagggagaactccttgtcgggtgtcgagggcgaagggctgcacaagctgggctatatcctccgcgacattagtaaaatcccgggcgggaacatgtatgcggacgacaccgccggctgggatacccggatcaccgaggacgacctgcagaacgaggccaagatcaccgacatcatggagcccgagcacgcactgctagccactagcatcttcaagttaacttaccagaacaaggtggtgcgtgtacagcgccccgcgaaaaacgggaccgtgatggacgtgatctcccggcgcgaccaacggggcagcggccaggtcggaacgtacggcctgaatacgttcacaaacatggaggtgcagctcatcaggcagatggagtccgaggggatcttcctgcccagcgagctggagaccccgaacctcgccgagcgggtgcttgactggctggagaagcacggcgccgagcgcctcaagcgcatggccatctccggggacgactgcgtcgtgaagcccattgatgaccgcttcgcgacggcgctgaccgccctgaacgacatgggcaaggtgcggaaagacatcccccagtgggagccctccaagggctggaacgactggcagcaggtcccgttctgctcccaccacttccatcagctcatcatgaaagacggacgggagatcgtggtgccgtgccggaaccaggacgagctggtgggcagggccagagttagccagggggccggttggtccttgcgcgagaccgcctgccttggcaagagctacgcgcagatgtggcagcttatgtacttccaccggcgcgacttgcggttagcggcgaacgccatctgctccgccgtgccggtcgactgggtcccaaccagccgcaccacgtggtccatccacgcacaccatcagtggatgacgaccgaggacatgctgagcgtgtggaaccgggtctggatcgaggagaacccgtggatggaggacaagacccacgtgagctcctgggaggaggtgccgtacctgggaaagcgcgaggatcagtggtgcggctcactcatcggattaaccgcccgcgcgacctgggccaccaacatccaagtcgcgatcaaccaggttaggcgcctgatcggcaacgaaaactacctcgattatatgacctccatgaagcgtttcaagaacgagagcgaccccgagggggcattgtggtga

SEQ ID NO: 24788 - RNA, 9879 nt, synthetic construct
  misc_feature 1..9879: note = derived and/or modified CDS sequence (opt11) from DENV-1__KR919820__SS-prME
  source 1..9879: mol_type = other RNA
accgtagtggccctgctcatgctcctgcctatggtgttctcctttcacctcaccacccgaggcggggagccgcacatgatagtgaacaagcaggagagaggtaagagcctcttatttaagacatccgggggcataaacatgtgcacccttatcgccatggacctgggggacctgtgtgaggacactatgacgtataagtgtccccggataacagaggctgagcccgacgacgtggattgctggtgtaacgcaaccgacacctgggtgacttatggcatctgcagtcccaccggcgaacatcggcgcgagaaacggagcgtggccctcgctccacacgtcgggctgggactggagacccgggccgaaacctggatgagcagcgaaggcgcatggaagcaaatccagcgcgtggagacgtgggcactcaggcaccccggctttacggtcatcgctctgtttctggcccacatcatcgggacctccattacccagaagggcgtcatcttcattctcctgatgctggttacgccaagcatggcgatgaggtgcgtcggcgtggggaacagagacttcgtggagggactctcaggagccacatgggtggacgtggtgttggagcacggtagttgcgtgaccaccatggccaagaacaagcccacactcgacatcgaactcctaaagacggaggtctccaaccccgccgtcttaaggaagctctgcatcgaggcccgtatctcaaacaccacaacagacagtcggtgccctacgcagggagaggcgagcctgagtgaggagcaggataccaatttcgtgtgtagaagaacactggtcgaccgcgggtggggcaacgggtgcggcctcttcgggaagggcagcctgatcacgtgcgctaagttcgagtgcctcaccaagatggagggcaagatcgtgcagtacgagaacctcaagtactcggtgatcgtcaccgtccacaccggggaccagcaccaggttggcaacgagaccaccggtcacggcacaacagccaccatcaccccacaagcccccacgagcgaaatccagctcaccgactacggggcccttaccctcgactgctctccgcggacaggccttgatttcaacgagatggtactgcttaccatgaaggagaaaagctggctggtccacaaacagtggtttctggacttacccctgccatgggcgtctggcgcctccagcccgcaggaaacatggaatagacaggacctgctcgtaactttcaaaaccgcccacgccaaaaagcaggaagtggtggtcctgggctcccaggagggcgccatgcacactgcgctgactggagcaacggaaattcaaactagcggcaccacaaccatttttgccggccacttaaaatgccggctgaaaatggacaagctgacccttaagggcatgtcctacgtgatgtgcaccggcagcttcaagctaaagaaggaagtggccgagacccaacacggcactgtcttagtccaagtggaatacgaaggcacggacgcgccgtgtaaaatccccttcaccacccaggacgagaaaggggtaatccagaacggtcgcctgatcacggcgaatcccattgttacagacaaagagaagccggtaaacatcgaggccgagccccccttcggcgagtcctacatggttatcggcgtgggcgacaaggccctcaagctgtcatggttcaagaagggatccagcctgggcaagatgtttgaggcgacggcgcgcggggcgcgccggatggccattctcggcgacacagcctgggacttcgggtccgtcggcggggtcttcacctccatggggaagctggtgcaccagatatttgggacggcctacggggtactgttctccggagtgtcctggacgatgaagatcggcatcgggctccttctgacctggctcggcctcaattcccggagtacgtctctgagcatgacgtgtatcgccgttggtatcataaccctctacctgggggtgatggtgcaggccgataccgggtgcgtggttaattggaagggcagggagctaaagtgtgggtccgggatcttcgtcaccaatgaggtgcatacgtggacagaacagtacaagttccaagcggatagccccaaaagactcagcgctgccatcggcaaggcttgggaggacggcgtatgcggcatccgctccgctacacggttggagaacattatgtggaagcagatagccaatgagctgaactatattctcctcgagaacgatatgaagttcaccgtcgtggtaggggacgtcaagggtatactcactcaaggcaagaaggggattcgcccccagcccatggagcataagtactcttggaagtcctggggcaaagccaagatcatcggcgcggacgtgcagaacaccaccttcataatcgacggcccggacacccccgagtgccccgacagccagcgggcgtggaacatctgggaggtggaggactatggattcggaatcttcaccacgaatatctggttaaagctgcgcgattcctacacccaagtttgcgaccaccggttaatgagcgcagcgataaaggactcccgggccgtgcacgccgacatgggctactggattgagtcagaaaaaaacgaaacttggaaactttccagagcaagcttcattgaggtaaaaacatgcacgtggccgaagtcccacaccctgtggagcaacggggtcctggagtccgaaatgatcatccccaagatctacggcgggcccatatctcaacataactaccgcccaggttactttacacaaaccgctgggccgtggcacctcgggaagctggagttggatttcgacctgtgtgaggggacaaccgtggtggtcgatgagcaatgcgggaaccgggggccatctctgaggaccaccacagtgacgggtaagatcattcacgagtggtgctgtagaagctgcactctgcccccgctccgattcaaaggcgaggacggctgctggtatgggatggagatccggcccgtaaaggagaaagaagagaacctggtcaagtcaatggtgtccgccggcagtgggaaagtggataacttctcgctggggctcctctgcattagcatcatggtagaggaggtgatgcgctcccgctggagtgggaaaatgctgatgaccggcacgatggcggtgttcttgctgctggtcatgggtcagctcacctggaatgacttaatccgcgtctgcatcatggtcggggcgcatgctctggatagcatgggcatggggacgacatatctcgccttgatggcaaccttcaagattcgccctatgctggccgtgggactgctgttccggaaactgaccagccgcgagatcctcttgctgaccatcggcctttcactgatcacccccgtggagctgccgaacagcatcgaggagcttggggacggactggcgatggggattatgatgctgaagctcctgacagacttccagccctaccaactttgggccaccctcttatctctcaccttcgtcaaaaccaccttgagcctgcactacgcctggaagactgccgcgatggtgctgtcgatcgtgagcctcctgccattatgcttgtccacaacttcccaaaagactacgtggctgcccatcctgttaggctccctggggtgcaaaccgctgacgatgttcctcataagcgagaacaaaatttggggccggaggtcttggccgataaatgagggcatcatggcggtcggtatcgtgagcatcctgatgtccagcctgctcaaaaacgatgtgccccttgcggggcccctgatcgccgggggcatgctcgtcgcctgctatgtaatcagcgggtcctctgcggacctgaccctcgaaaagacggccgaggtgtcgtgggaggaagaagccgaacactcaggcacggcccacaatatattagtcgaggtccaggatgacggaaccatgaagatcaaagacgaggaacgggaggataccctgacaatcttactcaaggccgccctgttggcactctccggagtataccccatgagcataccggccaccctgttcgtctggtatttctggcaaaaaaagaagcagcgctccggcgtgctttgggacatccccagcccacccgaggtggagaaggccgtccttgacgacgggatataccggatattacagcgaggtgtttttgggcggtcccaggtgggcgtaggcgtgttccaggagggggtgttccacaccatgtggcacgtcacgcgcggcgctgtcctgacctaccaggggaaacggctggagccaagctgggccagtgtgaagaaagatctcattagttacggcggggggtggaggctgcagggctcctggaacgtcggggaggaagtccaggtgatcgcggtcgaaccaggcaaaaaccccaagaacgtgcagacggtaccggggacctttaagacccacgagggcgaggtcggcgccatcgccctggatttcaagcctgggaccagcggctctcccatcgtcaaccgggacgggaaagtggtaggtctttacggtaacggcgtagtaacgactagcgggacttacgtgtccgccatcgcacagtccaaggtgtcccaggagggaccgctgcctgaaatcgaggacgaggtcttcaaaaagaaaaatctgaccattatggacctgcacccgggcagcggaaagacgcgccggtaccttccggcaatagtccgcgaaagcatcaaacggcgcctgcggacactcatccttgcaccgactcgcgtggtggcatccgaaatggccgaggcgctcaagggcctccccatccggtaccaaaccaccgccgtccgcaacgagcataccgggcgcgagatcgtggacctgatgtgtcacgccaccttcacaatgcgtctgctttcgccagtacgcgtccctaactacaacatgatcatcatggatgaggcccatttcacggatccggcatctatagccgcccgcgggtatataagtacccgcgttggaatgggggaggccgcggcaatcttcatgacggccaccccgcccgggagcgccgaagcgttcccccaatcgaacagcgttatctacgatgaagagaaggatatcccagagcggagctggaactccggctatgactggataaccgacttccagggaaaaaccgtctggttcgttcctagtatcaagaccggtaacgacattgcgaattgcctgcgcaagaacggcaagcgggtgatccagctgtcccggaagacttttgatacggagtaccaaaagaccaagaattcggactgggacttcgttgttaccactgacatttccgagatgggagcgaattttcgggctgaccgcgtcatagatccgcgtcgctgccttaaacccgtgattctaagagatgggccggagagggtcatcctggccggccccatgcccgtcacggtagccagcgcggcacaacgacgcgggcgtatcggaaggaaccagtccaaagagggagatcaatacatctatatgggccagccgcttaataatgacgaagaccacgcccactggactgaggcgaagatgttgctggataacatcaacaccccggaaggcattatccccgcgttgttcgagccggaacgggagaaatccgccgccattgacggggagtacaggttacgcggagaggccaggaagaccttcgtagaactgatgcgacgcggggatctcccggtctggctgtcctacaaagtggcaagcgagggcatccagtacgccgaccgcaagtggtgcttcgacggcgagagaaacaaccagatcctggaggaaaatatggacgtggagatctggacgaaggaaggggagcgcaagaagctccggcctcgctggttggacgcccgcacctactcagatcccctggccctacgcgaattcaaagagttcgccgcgggccggcgttctgtctcgggtgaccttatactggagataggcaagctccctcaccacttgacccagcgggcccagaatgctctcgacaacctcgtcatgctacataatagtgaacagggcggtcgcgcctaccgacacgccatggaggaactacccgacaccatcgagaccttaatgctgctggccatgatcgccactctcaccggaggcgtcgcgctatttttcctaagcggcaaaggactcggcaagacctccatcgggctcctatgtgtcatggccagctccactttgctgtggatggccagcgtggagccacattggattgccgcgtcaatcgtgctcgaattcttcctaatggtcctgcttatccccgagccggatcgtcaacggacgccacaagacaaccagttagcctacgtggtgatcggcctattagtcctaatcctgaccgtcgccgccaacgagatgggcttgctcgagacgaccaaaaaggatctggggataggcagcgctgcggctgaaatccaacaccatacgaccattctggacgtggaccttcacccggccagtgcctggacgctgtacgcggtcgccacgacggttattactcccatgctgcgtcacacgatagaaaacaccacggctaacatgagcctcaccgctatcgcgaaccaggctgcgatcctgatggggcttgacaaagggtggcccatcagcaaaatggatataggtgtgccattgctggccctgggttgctacagccaggtcaaccccatgaccctcaccgccgccgttctgatgttggtggcccactacgcgatcataggcccagggttgcaagcaaaagccaccagggacgcacagaagaggacggccgcggggatcatgaagaaccccaccgtcgacggcatagtggccatagatctggacccggtagtctacgacaccaaattcgaaaaacagctgggtcagattatgttactaatcctgtgcacgtcccagatcctcctgatgcggaccacgtgggccttttgcgaaagcattacccttgcgacaggccctctcacgaccctgtgggaggggtcccccggcaagttctggaataccacaatcgcggtttccatggccaatatttttcgaggctcgtacttggccggcgccgggctcgcctttagcctgatgaagtccctgggcggtaatcgccgggggacgggcgcgcagggggagactctcggcgagaaatggaaacgccaactgaaccaactgtcaaagctagaattcaacacctataaacggtctgggataatggaggtcgatcgcacggaggcgaaggaaggtctgaagcggggcgagaccacccgccacgccgtctcgagagggaccgccaagctgcgctggttcgtggagcgcaacctagtgaagcccgagggaaaggtcatagacctcgggtgcggtcgcgggggatggagctactactgcgccggcttgaagaaagtaacggaggtgaaggggtacactaagggcgggccgggccacgaagagccaatacccatggcgacatacgggtggaacttagtgaagttgcactccggcaaggatgtgttcttcataccgcccgagaaatgtgacactctgttgtgtgatatcggcgagagctcacccaatcccaccatcgaggagggacggacactccgagtgttaaagatggtcgagccttggctacggggcaatcaattttgcatcaaggtactcaatccgtacatgccaagcgtggtagagaccctagagcgaatgcaacggaagcatggggggatgctcgtcagaaaccccctctctcggaacagcacccatgagatgtactgggtttcttgcggcaccgggaacattgtcagcgccgtgaatatgacgtcacgcatgctgctaaaccgcttcacgatgacccatcgcaagcccacctacgaaaaggacgtcgacctcggcgccgggacgcgccacgttgccgtggagcccgaggtagcgaacttagacattatcggccagagaatagaaaatatcaaaaatgagcacaagtcgacctggcattacgacgaggacaacccctacaagacctgggcctaccacgggtcctacgaggtgaagcccagcggatccgcatcttcaatggtgaacggcgtcgtgcgcctgctcaccaagccttgggacgtgataccgatggtcacgcaaattgcaatgacggacaccacgcccttcggtcagcagcgagtgttcaaggagaaggtggacacgcgcacccccaaggccaagaggggcaccgcgcaggttatggaaataaccgcggggtggttgtggaaatttctgtcccgcaagaagaagccgcggatctgcactcgggaggagttcacacgaaaggtgcgctccaacgccgccattggtgccgtgtttgtcgacgagaatcagtggaacagcgcgaaggaggccgtcgacgacgagcggttctgggacctcgtgaaccgcgagcgtgagctgcacaagcagggcaagtgcgctacctgtgtctacaatatgatgggcaagcgcgagaagaaactaggagaattcgggaaggcaaagggtagccgggcgatctggtacatgtggctcggggcgcgttttctagagtttgaggctctgggcttcatgaacgaagatcactggttttcccgggacaatagcctttccggggtagaaggcgagggcctgcacaagctggggtacatcctccgcgacatcgctcggatcccgggcggcaacatgtatgctgacgacacagcgggctgggacacgcgcatcaccgaggaggacctgcagaacgaggcccgagttaccgagctgatggagcccgatcacgcacagctcgctaccagcatcttcagactgacttatcagaataaggtcgtacgcgtccagcgcccaggtaagaacggaacggtcatggacgttatctcccgccgggaccagaggggctctggccaggtgggcacttacgggctgaacaccttcactaatatggaagcccagcttatccgccaaatggagtccgagggcgtgtttagcccgagcgagctggagacgcctaacctggcgaaccgggtgctagactggctggagaagtatggcgtggagaggctaaagcgcatggccatctcgggggacgactgcgtagtgaagcccatcgacgatcgtttcgccaccgccttgactgcacttaacgacatgggcaaggtgcgcaaagacattccccagtgggagccgtcccgtggatggaacgactggcagcaggtacctttttgttctcaccacttccaccagctgatcatgaaggacggtagggagatagtggttccttgccggaaccaagacgaactcgtcgggcgtgcgcgggtgtcccaaggggcaggctggtccttgcgcgagacagcctgcctagggaagtcctatgcccagatgtggcagctgatgtacttccaccggcgagacctgcggctggccgcgaacgccatctgcagcgctgtgcccgtcgattgggtaccaacttcccggaccacctggagcatacatgcccatcaccaatggatgaccacggaggacatgctgagcgtctggaaccgcgtctggatagaggagaacccttggatggaagacaagactcatgtgacctcctgggaggacgtgccctatctgggtaagagagaggaccaatggtgcggaagcttaatcggattaagcgcccgcgcgacatgggccatcaacatccaagtggcgataaaccaggtgcggaagttgatcgggaacgaacattaccaggactacatgacgagcatgcgccggtttaagaacgagagtgaaccggagggcgccctgtggtga

SEQ ID NO: 24789 - RNA, 9879 nt, synthetic construct
  misc_feature 1..9879: note = derived and/or modified CDS sequence (opt11) from DENV-1__DQ285561__SS-prME
  source 1..9879: mol_type = other RNA
tctgtgaccatgctgttaatgctgcttccgaccgctctcaccttccaccttaccaccaggggaggtgaaccccacatgatcgtgggtaagcaggagcggggcaagtctttgttatttaaaacgagcgccggggtaaacatgtgcacactcattgcgatggatttaggagagctctgtgacgacaccatgacctataagtgtccccgcattactgagaccgagcccgacgatgtagactgctggtgtaacgcaacagagacgtgggtgacttacggaacctgctctcagaccggggagcacagacgcgacaaaagatcggtggcgctggcgccccacgtcgggctgggcttagagacccggaccgagacgtggatgtcctctgagggggcgtggaggcagatccaaaaggtggagacttgggcgctgcgacacccaggctttaccgtgatcgccctatttcttgcgcacgccatagggacctcaatcacgcaaaagggcattattttcatcctgcttatgctcgtgacccccagcatggcaatgaggtgcgtgggcatcggtaatcgagacttcgtggagggcctgtccggggcaacgtgggttgacgtcgtgctggagcacggcagctgcgtaaccactatggcgaaggataagccaaccctcgacatcgagctgttaaagactgaagttaccaaccccgccgtgttaagaaagctgtgcatcgaggccaagatctccaacactaccaccgactctcgctgccctacccaaggtgaggcgaccctggtggaggagcaagacaccaactttgtatgccgacgcacctttgtggatcgggggtggggtaacgggtgcggcctcttcgggaagggctcactgataacatgcgctaagttcaaatgcgtgacgaagctggagggcaagatcgttcagtacgaaaacctcaagtacagcgtgatcgtcaccgtccatacaggggatcaacaccaggtggggaacgagaccaccgagcacgggacgatcgcgacaatcacgcctcaagcgcccacctccgagattcaactgaccgattacggcgcgttaacactcgactgcagtccccgcaccgggctagattttaacgagatggtgctactcaccatgaaggaaaagtcctggctggtgcacaagcagtggtttctggatcttccgctcccctggacgagcggcgcatccactagccaagagatctggaacaggcaagatctgttggtgacattcaagactgcgcacgcaaagaaacaggaggtcgtggttttaggcagccaggaaggggctatgcacacggccctgacaggcgcaaccgagatccagacctccgggacgactaccatattcgcgggccatctcaagtgcagactgaagatggacaagctgaccttgaagggaatcagctacgtcatgtgcacgggcagctttaagttggagaaggaagttgccgagacgcaacacggcaccgttttggtccaggtcaagtacgaggggaccgatgccccctgcaagatcccattctcttcacaggatgagaagggcgtcacacagaacggccggttggttactgcaaacccgatagtgaccgacaaagagaaaccggtgaacatagaagcggagccacccttcggggagagctacatagtggtcggtgccggggagaaagcgctgaagttatcctggtttaagaagggctcatcaatcgggaaaatgttcgaagcaaccgccaggggcgctagacgcatggctatattaggtgacacagcttgggatttcggcagcatcggcggggtgttcacttccgtcggtaaactcgtgcaccagatctttgggaccgcatacggcgtcttattttccggtgtctcctggacgatgaagatcggcatcggcattctgctaacatggttagggctgaacagccgctccaccagcctatccatgacgtgcatagcggttggtatgatcaccctgtacttgggggttatggtccaggccgactctggctgcgtcatcaactggaaggggagagagctcaagtgcgggtccggcatcttcgtgactaacgaggtccacacctggaccgaacagtacaaatttcaggccgacagcccgaagcgccttagcgccgccataggtaaggcgtgggaggagggcgtatgtggcatccggtccgcaactcgcctggaaaacataatgtggaaacagatctccaacgaattaaaccacatactgctggagaatgatatgaaattcaccgtggtcgttggggacgtgagcggcatcttagcccaaggcaagaagtccatccgcccccagccgatggagcataagtactcctggaaatcctgggggaaggccaagatcattggggccgacgttcaaaacacgactttcattatcgacgggcccaataccccggagtgccccgacgaccagcgcgcgtggaacatatgggaggtcgaggactacggcttcggcatctttaccacaaatatttggctgaagctgagagacagttacacacaggtgtgcgaccacagactgatgagcgccgccatcaaggactccaaagccgtacacgcggacatgggttattggattgagagcgagaaaaacgagacctggaagctggcccgggcctccttcatcgaggtcaagacatgcatctggcccaagagccacacgctgtggtccaacggtgtcctcgagagcgagatgatcatccctaaaatttatggagggccaatctcccaacacaactaccgccccggctatttcacgcagaccgccggaccctggcatttaggcaagttagagctcgacttcgatctgtgcgaaggcactacggtggtggtggacgaacactgtgggaaccgggggcccagcctgagaaccacgactgtcacggggaaaatcattcacgaatggtgttgccggtcctgcaccctgccacccctaaggttcaaaggcgaggacggttgctggtacggaatggagatacggccagtgaaggagaaggaggagaacctggtcaagagcatggtcagcgccggaagtggggaagtggacagcttctccctcggcctcctgtgcatcagcatcatgatcgaggaagtgatgaggagtcggtggtcccgaaaaatgctcatgactggaacattggccgttttcctgctcctgaccatgggacagcttacctggaatgacctcatccgactgtgcataatggtcggcgccaacgcatctgacaacatgggcatgggcactacctacttggctctcatggccacctttcgcatgcgtccgatgttcgcggtagggctgctgttccggagactcacctctcgggaggtcttgctgctcaccgtcggattgtcactggtcgcgagcgtggagctccctaattccctggaggagctgggagatggcctagccatgggcattatgatcttgaaactgctcacggatttccagagccaccagctctgggctacattattgtctctgaccttcgtgaaaactaccttcagcctgcactacgcctggaagacgatggcgatgattttgtccattgtgagcctgttccccttatgtctctccaccacgagccagaagacaacgtggctgcccgtactgttggggagtctgggctgcaagcccttgaccatgttcctcattaccgagaataaaatatggggacggaagagctggcccctaaatgagggcattatggcagtggggatcgtgagcatcctgttgtccagcttgttaaaaaatgacgtgcctcttgccggccccctgatcgccgggggaatgctgatagcgtgctacgtgatctccggttcgtccgccgatctcagcctggagaaagccgccgaggtctcctgggaggaggaagccgagcacagcggcgcgtcgcacaacatcctggtggagatacaagacgatggcactatgaaaataaaggatgaagagcgggatgacactatcacgatattactgaaagccaccttactagcgatctcaggggtataccctatgtccatccccgcaaccctgtttgtctggtacttttggcagaagaagaaacaacgctcgggcgtactctgggacacccccagcccgcccgaagtcgagcgggccgtcctcgacgacggcatctaccgcattctgcagcgtggcctgctgggccgcagccaggtaggggtcggcgttttccaggagggggtgtttcacaccatgtggcatgtgaccagaggcgcggtcttgatgtaccagggaaagcgactggagccttcatgggcctcagtaaagaaggacctgatatcatacgggggcggttggcggttccagggtagctggaacacaggggaggaagtgcaagttatcgccgtggaaccagggaagaaccccaagaacgtgcagacggcccccggaacattcaaaacctccgaaggcgaggttggtgccatagcgctcgactttaagcccggcacaagcggcagccccatagtcaacagggagggcaagatagtggggctgtacggcaatggggtagtgacgacgtcagggacctacgtgagcgccatagcccaagctaaggcctcccaagaagggcctctgccggaaatagaagatgaggtgttccgtaaacgtaacctcaccattatggacctgcaccctggctccggcaagacccgccgctacctgcccgcgatcgtacgggaggctatcaagcgcaagctccggacgctcgtcttagccccaacgcgtgtcgtggcctccgagatggccgaggcactaaaagggatgccaatccgataccagaccacagccgtcaagtcagagcacacgggccgggagatcgtagacctgatgtgccacgccacctttactatgaggctgctctcccccgtcagagttcccaactacaacatgattattatggacgaggcccacttcaccgatccggcaagcatcgccgcccgcgggtacatatccacgcgggtcggcatgggtgaggcggcggcgatcttcatgaccgccacgccgcccggcagcgttgaggccttcccccaatctaatgccgtgatccaggatgaggagaaagacatcccggagcgaagctggaatagcggctacgattggatcactggctttcccggcaagactgtctggtttgtgcccagcatcaagtctggtaatgacatcgccaactgccttaggaagaatggcaagcgtgtgatccagttaagccgtaagacattcgacaccgagtatcaaaagaccaagaacaacgattgggactacgtcgtgaccaccgacatctccgaaatgggggcgaacttccgcgccgacagagtgatcgatccccgccggtgcctcaaacccgtgatcttgaaggacggccctgaacgcgtcatcttagcgggtcctatgcccgtcaccgtggcaagcgcagcgcagcgacgtgggcgtatcggaagaaatcaaaacaaggaaggggaccaatacatctacatgggccagcccctcaacaatgatgaagatcacgcgcattggaccgaggcaaagatgttattagacaacataaacacgccagaggggatcatccccgccctcttcgagccggaacgggagaagtccgctgcaatagacggcgagtacagattgcgaggtgaggcccggaagactttcgtagagctgatgaggcgaggggacctccctgtgtggcttagctataaggtggcgagtgagggctttcagtactccgaccgccgttggtgctttgacggggagcgcaacaaccaggtgctggaagagaatatggatgttgaaatttggaccaaagagggcgagcggaagaaactacgcccccggtggctggacgcccgaacatatagcgatcccctcgccctccgggagttcaaagagttcgccgccggccgtcggtccgtttccggcgacctgatactggagatcggcaagttgccccagcacctgacacaacgtgcccagaacgccctcgacaatctcgtcatgttgcacaactccgaacagggtgggaaagcctatcggcacgccatggaggagctgccggacaccatcgagaccttgatgcttctggccctcatcgcagttctgaccgggggggtgaccctgtttttcctgtcaggacgcgggctggggaagacatcaatcgggttactctgcgtgatgagctccagtgcgcttctgtggatggcctccgtcgagccccactggatcgcagcttcaatcatactagagttcttcctgatggtgctactcatccccgaaccggaccggcaacgcaccccgcaggacaaccaactcgcctacgtggtcatcggactcttgtttatgatcctgacagtggcagccaacgagatggggctcttagagaccacaaagaaagacttgggcatcggccacgccgccgcggagaaccaccatcatgctgctatgctggatgtggacctccatcccgcttccgcctggaccctgtacgccgtggcgacaaccatcataaccccgatgatgcggcataccatagaaaacaccaccgccaacatctcactgactgcgatagccaatcaggccgccatcctcatgggcttagataagggatggccgatcagcaagatggatatcggtgttccactgctcgccctgggttgctatagccaggtgaaccccttgacactcactgcagccgtcctgatgctggtagcgcattacgccatcatagggcccggtctccaggcaaaggctacccgcgaggcccagaagaggacggcggccggcatcatgaagaacccaacggtggatgggatcgtcgccattgacctcgatcccgtcgtatacgatgccaagttcgagaagcagcttggccagatcatgctcctgatactgtgtacctcccagatcctcctaatgcgcactacgtgggcgctgtgcgaaagcatcacgcttgccactggaccactgaccacgctatgggagggctcccccggaaagttttggaacaccacgatcgcagtcagcatggcaaacatcttccgcggtagctacctagcgggcgccgggctggctttctcattaatgaagagcctcgggggtgggcggcgcggaaccggcgcccagggcgagacgctaggggagaaatggaaacgccagctgaaccagctgagtaagagtgaattcaacatatacaagaggtccggcatagtggaagttgaccgatctgaagccaaagaggggctgaagaggggcgagaccattaaacatgcggtatctcgcggaaccgcgaaactgcggtggtttgtggagcggaacctcgtgaagccagaagggaaggtaattgacctaggttgtgggcgcggagggtggagctattactgcgcaggattgaagaaagtcaccgaggtgaagggctacacgaagggtgggccaggtcatgaggagcccatccccatggccacttacggttggaacctagttaagctgtactcagggaaggatgtgttctttatccctcctgaaaagtgtgataccctgttgtgcgatatcggtgagagctcccccaatccgaccatagaggagggacgtactctccgcgtgttaaagatggtggagccgtggctgagagggaaccagttctgcataaaaattttgaatccctatatgccatcagtggtggagaccctagagcagatgcaaaggaaacacggtgggatgctggttcgcaacccactctcacgcaactctacacacgagatgtattgggtatcctgcggcaccggcaacatcgtgagcgccgtcaacatgacctcccgaatgctgcttaacaggttcacgatggcgcaccggaagcccacctacgagcgcgacgtcgacctcggggcgggaacccgccacgtagctgtcgagccagaagtggctaacctggacatcatagggcagcgcatcgaaaacataaagaatgaacataagagcacctggcattacgacgaagacaacccttacaaaacatgggcctaccatggctcctacgaagtgaaacccagcgggagcgcctccagcatggtcaacggcgttgtgcgcctgctcacgaagccttgggacgtgattcccatggtgacccagattgccatgacagacacgacgcccttcggtcagcagcgagtcttcaaagagaaggtggacacccgcacccccaaggctaaacgggggacggcccagatcatggaagtgaccgcgaagtggttatggggattcttatctcgaaacaaaaagccccggatttgtacccgggaggagttcacgcgtaaagtccgcagcaacgcagccataggtgccgtgttcgtggacgagaatcagtggaactccgcaaaggaggcagtcgaggacgagaggttttgggacctcgttcgcagagagcgtgaactgcacaagcagggcaagtgcgcgacctgtgtgtataacatgatgggcaagcgggagaagaagttaggcgaattcggcaaggccaagggaagtagagcaatatggtatatgtggttaggggcacggttcttagagttcgaggcattaggattcatgaacgaagatcactggttctcacgcgagaacagcctatctggtgtagagggggaaggcctccacaagcttggttacatccttcgtgacatcagcaagattcccggaggcaatatgtatgcggatgacaccgccgggtgggacacgaggatcaccgaggacgacctgcagaacgaggccaaaatcacggacatcatggaacccgagcacgctctcctagctactagcatttttaaacttacttatcaaaacaaagtcgtacgggtccagcgcccagcgaaaaacgggaccgtgatggatgttatctcgcgccgggaccagcgcggctcgggacaggtcggaacctatggcctgaatacctttacgaatatgggcgcccagctcatccgccagatggagagcgaagggatcttctcaccaagcgaactggagacgccaaacttagctggccgcgttctcgactggctggaaaagcacggcatagaacgtctccgccgcatggcaatctccggcgacgactgcgtggtcaaacccattgacgatcgtttcgccactgcgctcaccgcgctgaacgacatgggcaaagtgcggaaggacatcccacagtgggaacccagcaaaggctggaacgattggcaacaggttcccttttgctcccaccacttccaccagttaattatgaaggatggccgcgagatcgtcgtcccctgccggaaccaggacgagcttgtagggagggcccgagtgtctcaaggcgcgggctggtcactgcgcgagacggcctgccttgggaaatcctacgcgcaaatgtggcagctcatgtacttccatagaagggatcttcggcttgctgccaacgccatctgcagtgcggtccccgtcgactgggtccccacctccaggacgacttggtcaattcacgcacatcatcagtggatgacaaccgaagatatgctctcggtttggaacagggtttggatcgaagagaatccctggatggaagacaaaacgcacgtcagctcatgggaggacgtgccctacctgggcaagcgcgaggaccagtggtgtggcagtctgatcggcctcaccgccagggcgacatgggccacaaacattcaagtggcgatcaaccaggtaagacgcctgatcgggaatgaaaactaccttgattacatgacctccatgaaacggtttaagaacgagagcgacccggagggcgcactctggtga

SEQ ID NO: 24790 - RNA, 9879 nt, synthetic construct
  misc_feature 1..9879: note = derived and/or modified CDS sequence (opt11) from DENV-1__DQ285562__SS-prME
  source 1..9879: mol_type = other RNA
agcgtaaccatgttgctcatgcttctgccgaccgccttggccttccacctgacaacgcgcggtggtgagccccacatgatcgtgagcaagcaagagcggggcaagtcgcttctattcaagacttccgcgggggtgaacatgtgcacactgatcgccatggacttaggcgagctctgcgaggataccatgacctacaaatgcccccgtatcactgaggcggaacccgacgacgtggactgctggtgtaacgctaccgacacgtgggtgacatacgggacctgcagccaaacgggcgagcatcgtcgcgacaagcggtccgtggccctcgcgccccacgtaggcctaggactcgagacgcgaaccgaaacgtggatgagcagtgaaggtgcctggcggcagatccaaaaggtcgagacctgggccctgcggcaccctgggttcacggtgattgcccttttcctcgcgcacaccatcggtacaagcataacccagaaggggatcatcttcatcttgctgatgcttgtgacgccgagtatggccatgcggtgcgtgggcattggaaatcgggacttcgtggaggggctgagcggggccacgtgggtggacgtcgtgctggagcacgggtcctgtgtaacgaccatggccaagaataagcccacgctcgacatcgagctgctgaagaccgaggtaaccaaccccgctgtgctccggaagctgtgcatcgaagcgaaaatcagcaacaccacgaccgactcccgctgtcccacacagggcgaggccaccctggtagaagagcaggacgccaacttcgtctgccggcgaacgttcgtggatcgcggttgggggaacggctgcggcctcttcgggaaggggagccttctgacctgcgccaagttcaagtgcgtgaccaagctcgaaggcaagatcgtccagtacgagaaccttaaatactccgtgatcgtaacagttcacacgggcgaccagcaccaggtcgggaatgaaaccacggaacacggcaccatcgccaccatcacccctcaagcgcccaccagcgagatccagcttacagactacggggccctcaccctcgactgcagcccaagaacgggcctggactttaacgagatggtcctcctgacgatgaaggaaaagtcctggctggttcacaagcagtggttcctcgatctgccgttaccctggacctccggggcgagcaccagccaagagacgtggaaccggcaagacctcctggtaaccttcaagacagcacatgccaagaaacaggaggtagtggtgctgggctcccaagagggcgcgatgcacaccgccctcacgggggccactgaaatacagacctctggcaccacgacaatatttgccgggcacctgaagtgccgcctgaagatggacaagctaaccctgaagggcgtcagttatgtaatgtgcaccgggagcttcaagctggagaaggaggtcgctgagactcagcacggaaccgtactagtccaggtgaagtatgaaggcacggacgcgccttgcaagatccccttcagtacccaggacgagaagggggtcactcagaacggccggctcatcaccgccaacccgatcgtgaccgacaaggaaaagcccgtgaacatagagaccgagccgccattcggggaaagttatatcgtcataggcgccggcgagaaggccctgaaacttagttggttcaagaagggcagctccatcggcaagatgttcgaggcgacggcccgcggggcacggcggatggccatcctcggcgacaccgcatgggacttcgggagtatcggcggcgttttcacctccgttgggaagctggtccatcaagtgttcggcacggcgtatggggtgttgttcagtggcgtctcctggacgatgaagatcgggatcggaattctcctgacgtggttaggcctcaacagccgctccacctctctgtccatgacctgcatcgtggtggggatggtcaccttatacctcggagttatggtgcaagctgactcagggtgcgtcatcaactggaagggccgggagctgaagtgcggctccggcatctttgtgaccaatgaggttcacacctggaccgagcagtacaagttccaggcagattcgccgaaacgcttaagcgccgcaatcggcaaagcgtgggaggagggggtctgtggtatccggtccgccacccgcttggagaacatcatgtggaaacaaatcagcaacgagctaaaccatatcctgctcgagaacgacatgaagttcaccgtggtcgtcggggacgccaacggcatcctgacccagggaaaaaagatgatccggccccaaccgatggagcacaagtattcctggaagtcctggggcaaagctaagatcatcggcgccgacattcagaacaccacattcatcatcgacggtccagacactccggagtgtcccgatgaccagagggcgtggaacatttgggaagttgaggactacggctttgggatattcacaaccaacatctggttgaagctccgggatagctacacacagatgtgcgaccaccgcctgatgagcgcagccatcaaagattccaaggccgttcacgcggacatgggctactggatcgagagcgagaagaacgagacgtggaagttagcccgggcctccttcatcgaggtgaagacgtgcatctggccccgcagccacaccttatggtcgaatggtgtgctggagagcgagatgatcatccccaagatctatgggggcccgatctcccagcacaactaccggcccgggtacttcacgcagacggccggcccctggcacctggggaagttagagctggacttcgatctgtgcgaaggaaccaccgtagtcgttgatgagcattgcggcaaccgcgggccgagcctccggactactaccgtcacgggcaagatcatccacgagtggtgctgtcgttcttgcaccctaccgcctttgcggttcaagggtgaagacggctgctggtacggcatggaaatccgtcccgtcaaggaaaaggaggagaacctcgtgcggagcatggtgtccgccggcagtggcgaggtcgactccttctccctggggctgctctgcgtatctatcatggttgaggaggtcatgcgctcacgatggagccgcaagatgttgatgacgggcaccttggccgtgttcttcttgttaatcatggggcagctgacctggaacgacctcatccgcctctgcatcatggtcggcgccaatgtatccgaccggatgggcatgggtaccacgtatctggcactcatggccaccttcaagatgcgcccgatgttcgcggtggggctgctgttccggcgcctgacgagccgggaggtcctgctgttgacgattgggctgtccctggtcgcaagcgtggaactccccaactccctggaggaactgggcgacggactcgccatgggcatcatgatgctgaagctgctcacggatttccagagccaccagctgtggaccaccctgctgtccctgactttcattaagacgaccctgtctctcgattacgcctggaaaacgatcgccatggtactttccatagtgtcgctcttccccctctgcctgtccactacgagtcagaagacgacctggctacccgtgcttctgggctccttcggatgcaaaccgctgacaatgttcctcatcaccgagaacaagatatggggccgaaaatcttggcccctgaacgagggtatcatggcagtcggcatcgtatccatcctactcagcagcctgctgaagaatgacgtgcccctcgcgggccccctgatcgccggcggcatgcttatcacctgctacgtcatctctggcagctccgccgaccttagtctggagaaggccgcggaggtctcttgggaggaggaggccgagcacagcggcgcctcccacaacatcttagtggaggtccaggacgatgggaccatgaagatcaaggacgaggagcgggacgacacactcacaatactattaaaagccacgttactggccgtgagcggagtgtatccgatgtccatcccggcgaccctgttcgtctggtacttctggcagaagaaaaagcaacgctcaggggtgctgtgggacacccccagcccgcccgaggtggagcgcgccgtgctggacgacggtatatataggattttgcagcgaggcctgctcgggcgcagccaggtcggggtgggggtcttccaggacggcgtgttccacaccatgtggcacgtgacgagaggggcagtcctgatgtaccagggcaagcgcctggaaccctcctgggccagcgtcaaaaaggacctcatctcctacggcggaggctggagattccaggggagctggaacaccggagaggaggtgcaggtaattgccgtcgagcccgggaaaaatcccaagaacgtgcagaccaccccaggcactttcaagacccccgagggcgaagtcggggcgatcgccctggacttcaagcccggaacgagcggtagcccaatcgtgaaccgcgagggcaagatcgtaggcctttacgggaacggagtcgtgactacgtccgggacttacgtgagcgctatcgcccaggcaaaggcgagccaagagggcccactccccgagatcgaagacgaggtcttcaagaagcggaacctgaccataatggacctgcaccccgggagcggcaagacccgccggtacctcccggccatcgtgcgggaggccatcaagcggaaattgcgcacgctgatcctcgcccccacccgagtggtggccagcgagatggcggaggcgttaaaggggatgccaattcgttaccaaacaaccgccgtgaagtccgaacacacgggtcgtgagatcgtagacctcatgtgtcacgccaccttcaccatgcggctcctgagccccgtccgcgtaccgaactacaacatgattatcatggacgaggcccacttcaccgacccggcctccatagccgcccggggatatatcagcacccgcgtggggatgggcgaggccgcggccatcttcatgacagctacgccgcccggatctgtggaggcctttccgcagagcaacgccgtcatccaggacgaagagagggacatcccggagaggtcctggaacagcggctacgactggatcacagactttcccggcaaaacggtctggttcgtcccctccatcaaaagcgggaacgacatcgcgaactgtctgcggaagaacggcaagcgcgtgatccagctctccagaaagaccttcgacaccgagtatcaaaagaccaagaacaatgactgggattatgtggtcacgaccgacatcagcgagatgggggccaacttccgtgccgaccgggtcatagacccgaggcggtgcctgaagcccgttatactaaaggacggccccgagagggtgattctcgccgggcccatgccggtgacggtcgcctccgcagcccagcgccggggccggatcggccgcaaccaaaacaaagagggggaccagtacatctacatgggacagccactaaacaacgatgaggaccacgcccactggaccgaggctaagatgctccttgataacatcaatacacccgaggggattattccagcattattcgagccagagcgcgagaagtccgccgcaatcgacggagagtacaggctacgcggggaggctcgaaagacatttgtggaactcatgcgccggggcgacctgcccgtgtggctttcctacaaggtagctagcgagggtttccagtacagcgataggcggtggtgcttcgacggggagcgaaataatcaggtgttagaggaaaacatggacgtggagatctggaccaaggagggcgagcggaagaagctgcgcccccgttggctggatgcccgaacctacagcgatcctcttgcgctacgggagttcaaggagttcgccgccgggagaagaagcgtctccggggacctgatactcgagatcggaaagcttccgcaacacctcacactccgggcccagaatgcgctcgacaacctcgttatgttacacaatagcgagcagggcgggaaggcctaccgacacgctatggaggagctgcccgacacgatcgagaccttaatgctcttagccctgattgctgtgctcactgggggcgtcactctcttctttctgagtgggaaggggctcggcaagacgagcattgggctactgtgcgtgatggcctccagcgtgctcctgtggatggcctccgtcgagcctcactggattgcagccagcatcatccttgagttcttcctcatggtattgctgattccggagccggacaggcagcggacgccacaggacaaccagctggcgtacgtggtaattggtcttctttttatgattctcaccgtggccgcaaacgagatggggctcctggaaaccacgaaaaaggatctcggtatagggcatgccgtggcggaaaaccaccatcacgcgaccatgttagacatcgacctgcaccccgcgagtgcctggaccctctacgccgtagcgaccacgatcatcaccccgatgatgagacacaccatcgagaacaccacggcaaacataagcctgaccgccatcgccaatcaggccgcaatcttgatgggtctcgacaagggctggcccatcagcaagatggacatcggcgtgcccctgctggcgctgggatgctactctcaagtgaaccccctaaccctgaccgccgccgtcctcatgctggtggcccattacgccatcataggccctggcctgcaagcgaaggccacgcgggaagcccagaagaggactgcggcgggtatcatgaagaaccccaccgtggacggcattgtggccatcgacctcgatcccgtggtgtacgatgccaagtttgaaaaacagctgggacagatcatgctgctcatcttgtgcaccagtcaaatcttactcatgcgtacgacgtgggccctttgtgagagcataaccctggccacggggccactcacgaccctgtgggagggctctccaggcaagttctggaacaccaccatcgcggtcagcatggccaacatattccggggatcatacctggcaggcgccggactcgcgttcagcctgatgaagtctctgggaggtggcaggcggggcacgggcgcgcagggggagacactcggggagaagtggaagcgccagttgaaccagctgagcaaatcggaatttaacacctacaagcggagtggcatcatggaggtcgaccgcagcgaggccaaggaggggttaaaacggggcgagaccacgaagcacgccgtgtcccgaggtaccgccaaactgcggtggttcgttgagagaaacctggtgaaacccgagggaaaagtgatcgacctgggctgcggtcggggcgggtggagctactactgcgctggtctcaaaaaggtcaccgaggtgaaggggtacaccaaaggtggacccgggcacgaggaacccatcccaatggcgacatacggctggaacttggtgaaactgcactcgggaaaagacgtcttcttcacgcctccagagaagtgcgacaccctgctttgtgacattggcgagagctcccccaacccaaccatagaggaggggcgcaccctgagagtgctcaagatggtagaaccctggctgcgcggtaaccagttctgcataaagatcctgaacccgtacatgcccagcgtcgtggaaacgctcgaacagatgcagaggaagcatggcgggatgctggtgcgaaaccccctgtcccggaactctacccacgagatgtactgggtgtcctgcggtaccgggaacatcgtgtccgccgttaacatgacctcccgcatgctcttgaaccggttcaccatggcccaccgaaagccgacctatgaacgcgacgtcgacttaggtgccggcacccgtcacgtggcagtggagccggaaatagccaacctcgacatcatagggcagcgcatcgagaatatcaagaacgagcacaaaagcacctggcactatgacgaggataacccttataaaacgtgggcctaccatggctcctacgaggtgaagccgagcggatccgccagctccatggtcaacggcgtcgtgcggctactgaccaagccctgggacgtgatccccatggtcacccagatcgccatgaccgacacgacccccttcggccaacagcgcgtgttcaaagaaaaggttgacaccagaacaccgcgtcccaagcggggcacggcgcagataatggaggtcaccgcaaagtggctctgggggttcctgagccgtaacaagaagccccggatatgcacccgcgaggagtttacaagaaaggtacgatccaacgccgctataggggcggtattcgtggacgagaaccagtggaactccgccaaagaagccgtggaagacgaaaggttttgggacctggtgcatcgcgagcgggagctccacaagcaaggtaagtgcgccacgtgcgtatacaatatgatggggaaacgcgagaagaagctgggcgagttcgggaaggccaagggctctcgggccatatggtatatgtggctgggagcgcgtttcctcgagttcgaggccctggggttcatgaacgaggaccactggttctccagagagaacagtctgtccggcgtggagggtgaggggctccacaaattagggtacatcctccgcgacataagcaaaattccgggcggcaacgtgtatgccgacgataccgccgggtgggacaccaggattaccgaggacgacttacagaacgaggctaagatcactgacatcatggagcccgagcacgccctgctggctaccagcatcttcaagctaacctaccaaaacaaagtcgtgcgagttcagagacccgccaagagcgggaccgtgatggatatcatttcccggcgcgaccagcggggctcaggccaggtgggcacgtatggcctgaacaccttcacgaacatggaggtgcagctgatccgccagatggaatccgagggcatttttagtccctcagagctcgagaacagcaacctggccgagagagtcctggactggttggagaagcacggggtggaacgcctgaaaagaatggcgatcagcggcgacgactgtgtggtcaaaccgaccgacgaccgcttcgcaacggcgctgaccgctctgaacgacatgggcaaggttcggaaggacatcccccagtgggagcctagtaagggctggaacgactggcagcaggtgcccttctgctcgcaccactttcaccagctgatcatgaaggacggcagagagatcgtcgttccttgtcggaatcaagacgagttggtggggcgcgcccgggtctcgcagggcgcgggttggagccttcgggagaccgcctgcctggggaagagttacgcccaaatgtggcagttgatgtacttccaccggcgcgacctccgtctggccgccaatgcgatctgcagcgctgtgcccgtggactgggtccccaccagccgcaccacatggagcatccacgcccaccatcagtggatgaccactgaggacatgctgtccgtttggaatcgtgtgtggatcgaggaaaatccctggatggaggacaaaacccatgtgagctcctgggaggacgtgccgtacttaggcaagcgtgaggaccagtggtgtggaagcctgatcggcctgacggcccgcgccacctgggcgacaaacatccaggtggccatcaagcaggtacggcgcctcatcggaaacgagaactacctcgactacatgacctccatgaagcgcttcaaaaacgagagcgaccccgagggagctctgtggtaa

SEQ ID NO: 24791 - RNA, 9879 nt, synthetic construct
  misc_feature 1..9879: note = derived and/or modified CDS sequence (opt11) from DENV-1__DQ285558__SS-prME
  source 1..9879: mol_type = other RNA
agcgtgaccatgctgctcatgctgctgcccaccgccctcacctttcatcttaccacccgcggcggtgagccccatatgatcgtgggcaagcaagagcggggcaagagcctgctgttcaagaccagcgccggggtgaacatgtgtaccctgatcgcgatggacctgggagagctgtgcgacgacaccatgacctacaagtgcccccgaatcaccgagacggagcccgatgacgtggactgttggtgtaacgccaccgagacttgggtgacatacggcacgtgctcgcagaccggcgaacaccgccgcgacaagcggtctgtcgccctcgcaccacacgtagggctgggcttggagacgcgcactgagacatggatgtccagcgagggggcctggagacagatccagaaggtcgagacctgggccctgcgccaccccggattcacagtgatcgccctgttcctcgcccacgcgatcgggacctccatcactcagaaaggcatcatcttcatcctgctgatgttagttacccccagcatggcgatgcgttgcgtcgggatcgggaaccgcgacttcgttgaagggctgtccggggctacctgggtggacgtcgtgctggagcacggcagctgcgtgaccacgatggccaaggacaagcccaccctcgacatcgagctgctgaagaccgaggtcaccaacccggccgtgctccggaagctgtgcatcgaggccaagatctccaacacaaccaccgactcacgctgcccgactcagggcgaggctacactggtggaagagcaagacaccaacttcgtctgccggcgaacctttgtcgaccgagggtggggcaacgggtgcggtctcttcgggaagggctccctgatcacatgcgccaagtttaagtgcgtgaccaaactggagggcaagatagtccagtacgagaatctcaagtacagcgttatcgtaactgtccacacgggggaccagcaccaggtcggcaatgagaccaccgagcacgggacgatcgccaccatcacgccacaggcccccacctccgagatccagctgacagactacggcgcgctcacccttgactgcagcccacgcacagggctggactttaacgagatggtcctgctcaccatgaaggagaagtcctggctagtgcacaagcaatggttcctggatctcccgctgccctggacttccggagcgtccacttcccaagagacttggaacaggcaggacctgctcgtgaccttcaagaccgcgcacgccaaaaagcaggaggtagtggtgctgggcagccaggaaggggccatgcacaccgccctgaccggcgcgacggagatccagacttccggcaccaccactatcttcgccggccatctcaagtgccgcctgaagatggataaactaacgctcaaagggatatcgtatgtcatgtgcaccggcagcttcaagctcgaaaaggaggtggccgagacccagcacggcaccgtgctggtccaagtgaagtacgaaggaacggacgccccctgtaaaatcccgttcagttcccaggacgaaaagggagtgacccaaaacggtcggctggtcaccgccaatcctattgtaaccgacaaggagaagcccgtgaacatcgaggcggagccgcccttcggtgagtcctacattgtcgtgggcgccggggagaaggccctcaagctgtcttggttcaagaagggcagctccatcggcaagatgttcgaggccacggctcgcggcgcccgacgaatggccatcctgggggacacagcctgggacttcggcagcatcggtggggttttcacctcagtcggcaagctcgtgcaccagatcttcgggaccgcctacggcgtattattcagcggggtcagttggacgatgaagatcggtatcggcatcctgctcacctggctgggtttgaacagccgctcaaccagcctgagtatgacttgcatcgcggtgggtctgatcacgttatacctcggagtgatggtccaggccgatagcggctgcgtgatcaactggaaggggagggagctgaaatgtggatccggaattttcgtgaccaatgaggtacacacctggaccgagcagtacaagttccaggccgactcccctaaacgcctgagcgcagccattggtaaagcgtgggaggagggcgtgtgcgggatccggtcagccactcgcctcgagaacatcatgtggaagcagatcagcaacgagctgaaccacatcctgttggagaacgacatgaaatttacggtggtcgtgggtgacgtgtccgggatcctggcgcagggtaagaagtcaatccggccccagcccatggagcacaagtactcctggaagtcctggggcaaggccaagatcattggggcagacgtccagaacaccaccttcattatcgacggtccgaacaccccagagtgccccgacgaccagcgggcgtggaacatatgggaggtggaggactacggctttgggatctttacgaccaacatctggctgaagctgcgggactcctacacccaggtatgcgaccatcgcctgatgagcgcagcaatcaaggattccaaggccgtccacgcggacatgggctactggatcgagagcgagaaaaacgagacctggaagctggcgcgggcctccttcatcgaggttaagacgtgcatctggcctaagagccacaccttgtggtcaaacggggtgctcgaaagcgagatgatcatccccaagatctatggcgggccgatctcccagcacaactatcgccccggctacttcacccagaccgccgggccctggcacctgggcaaactcgagctggacttcgatctgtgcgagggtacgaccgtcgtggtggacgagcactgcgggaaccggggcccgtcactccgaaccaccacggtgaccgggaaaatcatccacgagtggtgctgccggtcctgcacgctacctccgttacgcttcaagggcgaggacgggtgctggtacggcatggagattcggcccgtgaaggagaaggaggaaaacctcgttaaatctatggtcagcgccggctccggcgaggtggacagcttctccctgggtctgctctgtatctctatcatgatcgaggaggtcatgcgatctcggtggagccgcaagatgctgatgaccgggacactggcggttttcttactgctgaccatgggccagctcacatggaacgaccttatccggctgtgtatcatggtgggcgccaacgcctccgacaacatgggcatggggaccacgtacctcgcgctgatggccacctttcgcatgaggccaatgttcgcggtagggctcctgttccggcgcctgacctcacgggaggtcctactcctgacggtgggcctgtcgctcgtagccagcgtggagctgcccaactccctggaggagctcggcgatggcctggccatgggaatcatgatcctgaaactcctgacggacttccagagccaccaactgtgggcgaccttattatccctgacattcgtgaaaaccacattcagcctccactatgcctggaagaccatggcgatgatactgtcgatcgtaagcctgtttcccctctgcttatcaaccaccagccagaagacgacctggctgcccgtgctcctggggtccctgggctgcaagccgctcaccatgttcctgatcaccgagaacaagatctgggggcgcaaaagctggcccctgaacgagggcatcatggccgtggggatagtcagcatccttttgtccagcctgctcaagaacgacgtgcccctggccggccccctgatcgccggcgggatgctcatcgcgtgctacgtgatctcaggctcgtccgccgacctgagccttgagaaggccgccgaggtctcctgggaggaggaggcggagcacagcggggcgtcccataatatcctcgtggagatccaggacgacggcaccatgaagatcaaggatgaggagcgggacgatacgatcacgattctgctgaaagcgacactcctggccatcagcggcgtttacccaatgtccataccggccaccctgtttgtctggtacttctggcagaagaagaagcagaggtctggcgtactgtgggacacgcccagcccgcctgaggtggagcgggcagtcctggacgacggaatctaccgcattctgcagcgggggctgttaggccgcagccaggtgggggtgggcgtgttccaggagggcgtattccataccatgtggcacgtcacccggggcgcggtcctgatgtaccagggcaagcgccttgagccctcctgggcaagcgtgaagaaggacctcatctcctacgggggtgggtggcggttccaaggctcgtggaataccggggaggaagtgcaggtcatcgccgtggagccgggcaagaaccccaagaatgtgcagacggcccccggaacgttcaagacgtccgagggggaggtcggcgccatagccctggacttcaagcccggaaccagcggcagccccatagttaaccgcgaaggaaagatcgtggggctctacggcaacggggtcgtgactacctccggaacctacgtttccgccatcgcccaggctaaggcctcccaggaggggcccctcccggagatcgaggacgaggtcttccggaagcgcaatctgaccatcatggatctgcatcccgggagcggcaaaacgcggcgctacctccctgcgatcgtacgggaggccatcaagcgcaaactgcggaccctggtgctcgccccgacccgcgtcgtggcttccgagatggcagaggcgctgaaggggatgccgatccgctaccagactacggccgtcaagagcgagcacaccggccgtgagatagtcgacctgatgtgccatgccaccttcaccatgcgcttgctgtcacctgtgcgggtgcccaactacaacatgatcatcatggatgaggcccacttcacggatccggcgagcatagcagcgcgcgggtacatctccacccgggtcgggatgggagaagccgctgcgatcttcatgaccgccacgccgccaggtagtgtggaggccttcccccagtccaacgccgtgatccaggacgaggagaaggacatcccggaacgcagctggaactccggttacgactggatcacggactttccggggaagaccgtctggttcgtgccctctataaagtcgggcaacgatatcgccaattgtctacggaagaatgggaagcgcgtgatccagctcagccggaagaccttcgacaccgagtaccagaagacgaagaataatgactgggactacgtcgtaaccactgatatttccgagatgggcgcgaacttccgcgcagatcgagtcatagatccccgcagatgcctgaagccggtcatcctaaaagacggccccgaacgcgtgatccttgccggccccatgcccgtcaccgtggccagcgcggcgcagcggcggggccggatcgggcgaaaccaaaacaaggaaggagatcagtatatctatatggggcaaccgctgaacaacgacgaggaccacgctcactggacggaggctaagatgctgttagacaacataaacaccccagagggcatcatccccgccctgttcgagcccgaacgggagaagtccgcggccatcgacggggagtatcgcttgcgcggtgaagcccggaagaccttcgtggagctcatgcgccggggcgacctgccggtatggctgagctacaaggtggccagcgaggggttccaatattcggaccgccgctggtgcttcgacggcgagaggaataaccaggtgctcgaggaaaatatggacgtcgagatctggaccaaggaaggggagagaaagaagttgcgcccccgttggctggacgcccgcacgtatagcgaccccctcgcgctgcgggagtttaaggagttcgccgccggtcgccggtccgtgtccggcgacctgatcctcgagatcgggaagctgccccagcacctgacacagcgcgcccagaacgccttagacaacctggtgatgctgcataactccgagcaaggcgggaaggcgtaccgacacgccatggaggagctcccagataccatcgagaccctgatgctgctcgccctgatagccgtactgactggaggggtgaccctcttcttcctgagcggccgcggcctggggaagacctctatagggttactgtgcgtgatgagttccagcgcgctgttatggatggccagcgtcgagccacactggatagctgccagcatcatcctcgagttcttcctgatggttcttctgatccccgagcccgaccgccagcgcaccccgcaggacaatcaattagcctacgtggtcatcgggctactgtttatgatcctgaccgtggcggccaacgagatgggcctcctggagacgaccaagaaggacctggggatcggccacgcggccgcagagaatcatcaccacgcagccatgctcgatgtggatctgcaccccgccagtgcatggaccttgtacgcagtcgcgaccacgataatcacccccatgatgcggcacacgatcgagaacacaacggccaacatttccctcaccgccatcgcgaatcaagccgcgatcctgatgggcctggacaaggggtggccgatctccaagatggacatcggcgtacccctcctcgccctgggttgctacagccaggtgaaccccctcaccctgactgcagccgtcttaatgctcgtggcgcactacgccataataggccccgggctgcaagcgaaggccacgcgcgaggcccaaaagagaaccgcagcaggaatcatgaagaacccgaccgtggacggcatcgtagcgatagacctggaccccgtggtgtacgatgcaaaattcgagaagcagctcgggcaaatcatgctgctgatcctctgcacctcccagatactgctgatgcgcactacctgggctctctgcgagtcaatcacccttgctacgggacccctgacgaccctctgggaggggtcccccggcaagttctggaacacaaccattgccgtaagcatggccaacatcttccgcggctcatatctggcgggggcggggctggcgttctccctgatgaagtccctcgggggcgggcgtcgcggcacgggcgcccagggggaaaccctgggcgagaaatggaaacggcagctgaaccagttgtccaaatcagagttcaacatctacaagcgatccgggatcgtcgaagtagaccggagcgaggccaaggagggcctgaaacgcggggagaccatcaagcatgcggtctcccggggcaccgcgaagctccgctggttcgtggagagaaacctggtcaaaccggaaggcaaggtgatagacctggggtgcggacgcgggggatggagctactactgcgctggactgaaaaaggtgactgaagtgaagggctacaccaaaggcgggcccggccacgaggaacccatccccatggctacctacggttggaacctcgtcaagctgtactccggcaaggatgtgttcttcatcccgcccgagaaatgcgatacgctgctctgcgatatcggtgagagtagtcccaaccccacgattgaggagggccggaccctacgcgttctgaagatggtcgagccctggctccggggcaaccaattctgtattaagatcctgaacccatacatgcccagcgttgttgaaacgttagagcagatgcagcgcaaacacgggggtatgttggtccggaaccctctgtcacgtaacagcacccacgagatgtactgggtgtcctgcgggaccggtaacatcgtcagcgccgtcaacatgacgtcccggatgctgctcaaccgcttcacgatggcccaccggaagcctacctacgagagagacgtggacctgggcgcggggacccggcacgtggcagtcgaaccagaggtggccaatctggacatcatcggccagcggatcgagaacatcaagaacgagcacaagagcacgtggcactacgacgaggacaacccctacaagacttgggcctaccatgggtcctacgaggtaaagcccagcggaagcgcctccagcatggtgaacggggtggtccgcctcctgacgaagccgtgggacgtgatccccatggtaacacaaatcgcgatgacggacaccaccccattcggccagcagcgggtcttcaaggagaaagttgatacccgcacgcccaaggccaagcgaggcaccgcccagatcatggaggtgaccgcaaagtggctgtgggggttcctctcccgcaacaagaagccgcggatctgtacccgagaggagttcacgcggaaggtccgcagcaacgccgcgatcggcgccgtattcgtggacgagaaccagtggaactccgccaaggaggccgtcgaggacgagcgcttctgggacctggtgcgccgggaacgcgaactgcacaagcagggaaagtgcgcaacctgcgtgtacaatatgatgggcaagcgggagaagaagctcggagaattcgggaaggccaaaggcagccgcgctatctggtacatgtggctgggcgcccgcttcttggagttcgaggcactcggtttcatgaatgaggaccactggttctcccgcgaaaactctctgagcggggtcgagggcgaggggctgcacaaactcgggtacatcctgcgggacataagcaagatcccaggcgggaacatgtacgcggacgacaccgccggctgggacacgcggatcacggaggatgacctgcagaacgaggccaagataacggatatcatggagcccgagcacgccctccttgccacttccatcttcaagctgacctaccagaacaaggtggtgcgggtgcagcgcccggcaaagaacgggacggtgatggacgttataagccgccgggaccagcgcggctccggccaggtgggcacctacggcctcaacaccttcaccaacatgggggcccagctcatccggcagatggagagcgagggcatcttctcccccagcgagctggagactcccaacctcgccgggcgcgtgctggattggctggagaaacacggcattgagcgtctccgccggatggccatcagcggcgacgactgcgtggtcaagcccatcgacgaccggtttgccactgcgcttaccgccctgaacgacatggggaaggtgcggaaggacattccgcagtgggaaccgagcaagggatggaatgactggcaacaggtccccttttgctcacaccacttccaccagctcatcatgaaggacgggcgtgaaatcgtggtgccttgtcgaaaccaggacgagctcgtgggcagagctagagtcagccagggcgccggctggtcgttacgcgagaccgcttgcctcggcaagtcctatgcgcagatgtggcagctgatgtacttccaccggcgggacctgcggctcgccgcgaacgcaatctgcagcgcggtaccggtggactgggtccccacgagtcgcacgacgtggagcatccacgcccatcaccaatggatgaccacggaggacatgctgtccgtctggaaccgggtgtggatcgaggagaacccttggatggaggacaagacacacgtcagcagttgggaagacgtgccctatctcgggaagagagaggaccagtggtgcggtagcctaatcgggctgaccgcccgcgctacgtgggccacaaacatccaggtggcgatcaaccaggttcggcgactgatcggcaacgagaactacctcgactacatgacgtccatgaaacggttcaagaacgagagcgaccccgagggggccctgtggtaa

SEQ ID NO: 24792 - RNA, 9879 nt, synthetic construct
  misc_feature 1..9879: note = derived and/or modified CDS sequence (opt11) from DENV-1__DQ285559__SS-prME
  source 1..9879: mol_type = other RNA
tctgtgaccatgttgctaatgctactgcctaccgccctgaccttccacctgaccacccgcggcggggaaccgcatatgatcgtaagcaagcaggagcggggcaagtcacttctgttcaagaccagcgtgggggtgaacatgtgcaccctgatcgccatggacctgggcgagctctgcgaagacacaatgacctacaagtgcccccgcattaccgaggccgaacccgacgatgtggactgctggtgcaacgcgacggatacttgggttacctacgggacctgcagccaaacgggcgagcaccggcgcgacaagcggtccgtggccctggcgccgcacgtaggcttggggctagagacgcgcaccgagacatggatgagctccgaaggcgcctggaagcaaattcaaaaagtcgagacttgggcgctgcggcacccagggttcaccgtgattgccctgttcctcgcacacgccatcggcaccagcatcacccagaaggggatcatattcatcctgctgatgctcgtgactccctccatggccatgcgttgtgtgggcatcggtaaccgcgacttcgtggagggactgagcggcgccacctgggtcgacgtggtgctcgagcacgggagttgcgtcacaaccatggccaaaaacaagccgaccctcgacatcgagcttctgaagacggaagtgaccaacccagcagtgctccgcaagctgtgtatcgaggccaaaatcagcaacaccacgacggactcccgatgccctacccagggcgaggctaccctggtcgaggagcaggacgccaacttcgtgtgccgccggacgtttgtggaccgcggctgggggaacggctgtggcttattcggcaaggggagcctactcacttgcgccaagttcaagtgcgtaactaagctcgaaggcaagatagttcagtacgagaacttaaaatattcagtcatcgtcaccgtgcacacgggcgaccagcaccaggttgggaatgagaccaccgagcatggcaccatcgcgactatcacaccgcaggccccgactagcgagatccagctcattgattatggagcgctcaccctggactgctctccccggacaggcctcgacttcaacgagatggtcctcctgacgatgaaaggcaagagctggcttgtgcacaagcagtggttcctggatctgccgctgccctggacctccggcgccagcacgagccaggagacctggaaccgccaggacctcctggtcacgttcaagaccgcgcacgccaagaagcaggaggtggtggtcttgggctcccaagagggggcgatgcacaccgcgttaaccggcgcgacggagatccaaacctcagggaccacgacgatcttcgctggccacctgaagtgtcgactgaagatggacaaactcaccctcaaggggatgtcctacgttatgtgcacagggagcttcaagttagagaaggaagtggcggagacccagcacggcacggtcctcgtccaggtgaaatacgaggggactgacgccccatgcaaaatccccttctcaacgcaggacgagaagggcgttacccagaatgggaggttaattacggcgaatccgatcgtgaccgacaaagaaaagccagtgaatatcgagaccgagccgcccttcggcgagtcgtacatcgtcgtgggcgccggggaaaaggccctgaagctgtcctggtttaagaagggctcatccattgggaagatgttcgaggccaccgcgcggggcgcccgccggatggctatcctcggggacacggcctgggacttcggcagcatcggcggggtgttcacttcagtcggcaagctgacccaccaggtgtttgggaccgcctacggcgtgctgttctcgggggtctcctggactatgaagatcggaatcgggatcctcttaacttggctgggactcaacagcagatcgactagcctgtccatgacgtgtatagcggtgggcatggtgacactgtacctcggggtcatggttcaggccgatagcggctgcgtgatcaactggaagggccgtgaactaaagtgcggctccggcatcttcgtcacaaacgaagtgcacacctggaccgagcaatacaaattccaggctgacagccctaagaaacttagcgccgccattggaaaggcctgggaggagggggtgtgcgggatccggtccgcgacccgcctcgagaacatcatgtggaaacagatcagcaacgaactgaactacatcctgctcgagaacgacatgaagttcacggtcgtggtgggcgacgccaacgggatcctggcccagggcaagaagatgatacggccccagcccatggaacacaagtactcctggaaatcctggggcaaggctaagatcatcggcgcggacatccaaaacacgaccttcatcatcgatggccccgatacccctgaatgccctgatgaccagagggcatggaacatctgggaggtagaggactacgggttcggcatcttcacgaccaatatctggctgaagctacgggactcctacacccaaatgtgcgaccaccgcctaatgagcgctgcaatcaaggactccaaggcggtgcacgccgacatgggctattggatcgaatcagagaaaaacgaaacctggaagctggcacgggcctcctttatcgaggtgaagacgtgcatctggcctaagagccacacgctctggtccaacggggtcctcgagagcgagatgatcatcccgaaaatctacggcggtccaatctcccagcataactaccgccccggctacttcacccagaccgctgggccatggcacctgggcaaacttgaactggacttcgacctatgtgagggcacaaccgtggtggtcgacgagcattgtgggaacagaggcccgagcctccgcaccaccacagtgacagggaagatcatccatgagtggtgctgccggtcctgcaccctcccgcccctacgctttcggggcgaggacgggtgctggtatggcatggagatccgccccgttaaagagaaagaggaaaacctcgtccggagcatggtgagcgctggcagcggggaggtggacagcttctccctcggaatactatgtgtctctatcctcatcgaggaggtgatgcgctccaagtggtcccggaagatgctgatgaccgggacattggccgtgttcctcctgctgatcatgggccagttaacctggaacgacctgacccgactgtgcatcatggtcggggccaacgcttccgatcgtatgggcatgggaaccacgtacctcgccttgatggccaccttcaagatgcgcccgatgttcgccgttgggctgctattcaggcgcctgacctcccgcgaagtgctgctcctcaccatcggactgtccctcgtcgcaagcgtggagcttcctaattcactggaggaactcggggacggcctggcgatgggcatcatgattctaaagctcctgacggacttccaaccccatcagctctggacaacactcttgagcctcaccttcataaagacgactctctcactggactacgcctggaagaccatggcgatgaccctgagcatcgtctccctcttccccctgtgcctcagcacgacctcccagaagactacttggctcccggtgctgcttgggagcttcgggtgtaagcccctcaccatgttcctgattacggagaacaagatctgggggcggaagtcctggcccattaatgaggggattatggccgtagggattgtgagcattctgctctccagtctgctgaaaaacgacgtgcccctagccgggccgctgatcgcgggagggatgctgatagcgtgctatgtgatcagcggcagtagcgccgacttatccctggagaaagctgccgaggtaagctgggaggaagaggccgaacattccggaaccagccacaacatcctggtggaggtgcaggacgacggcacaatgaagatcaaggacgaggagcgcgacgatacgctcacgattctgctcaaggcgaccctcctggccgtctcgggggtataccccatgtctataccagccaccctattcgtttggtacttctggcagaagaagaaacagcggtctggcgtcctctgggacacccctagcccgccagaggtcgagcgcgccgtgttggacgatggcatctatcggatcctgcaacgcgggctgctcggccggagccaggtcggggtgggcgtgttccaggacggcgtcttccacacgatgtggcacgttacccggggcgctgtgctgatgtaccaaggcaaacggctggagccctcgtgggcttccgtcaagaaggatctcatcagctatggaggcgggtggcgcttccagggtagctggaacaccggggaggaggtccaggtgatcgccgtagagcccggcaagaatccgaaaaatgttcagacaacgccgggcaccttcaagacccccgagggggaggtgggggctatcgctctggacttcaagcccgggaccagcggctctccgatcgtcaaccgggagggcaagatcgtggggctctacggcaacggcgtggtaacgacctctggcacctacgtgtccgccatcgcgcaggcaaaggccagccaggaggggcccctccctgagatcgaggatgaggtgtttaagaagcgaaacctcaccatcatggacctgcacccgggcagcggaaagactcggagatacctccctgccatcgttcgggaagccatcaagcggaaactgcggacccttatcctcgcccccacccgcgtcgtggcctccgaaatggccgaagccttgaaggggatgcccatccgctaccagaccacggcggtcaagtctgagcacaccgggcgtgagatcgtggacctgatgtgccatgcgaccttcacgatgcgcctcctgtccccggtgcgggtcccaaactacaacatgatcatcatggacgaggcacacttcacggatcccgccagcatcgccgcgcgcggttacatctccacccgggtgggcatgggagaggccgcagcgatattcatgaccgccacgcctccaggctcggtggaggcattcccccagtccaacgctgttatacaggacgaggagaaggatatccctgagcgctcttggaactccggatacgactggataacggactttcctggtaagaccgtgtggttcgtgccctcgatcaagtcgggtaatgacatagccaactgtctgcgtaaaaatggcaagcgcgttatccaactcagccggaagaccttcgacaccgagtaccagaagacgaagaacaatgactgggactacgttgtgacgactgacatatccgagatgggcgcaaactttcgcgcagaccgggtcatcgacccccgcagatgcctgaagcccgtgatactgaaggacggtcccgagagagtgatcctcgcgggcccgatgcccgtcaccgtggcgtcagccgcccagcggagaggtcggatagggcgcaaccaaaacaaggagggagatcagtacgtctacatggggcaacccctgaataacgatgaagaccacgcgcactggacggaggccaagatgctgctcgacaatatcaacacccccgagggcatcatcccggccctgttcgagccagaaagagaaaagtccgcggccatagacggggaatacagactgcgtggcgaggcgcgcaagacgttcgtggagctcatgcgcagaggggacttgcccgtgtggctcagctacaaggtggcgtcggagggtttccagtacagcgaccgccggtggtgcttcgacggcgagcgcaacaaccaggtgctcgaagagaacatggacgtggaaatatggaccaaagagggggagcggaaaaagctgcggccccggtggctggatgccagaacctactccgacccattagcgctgcgggagtttaaggagttcgctgcgggccgccggagcgtcagcggcgacctgattctcgagatcgggaagctgccccagcacctgacgctgcgcgcccagaacgcccttgacaacctagttatgctccacaactccgaacagggcgggaaggcttaccgtcacgccatggaggagctgcctgataccattgagaccctgatgctactggcactgattgccgtgctcaccggcggggtcacgcttttcttcctcagcggtaagggcttagggaagacttccattggcttgctgtgcgtgatggcctcctccgccctcctgtggatggcgtcggtggagcctcactggatcgcagcctctatcatcttggagttcttcttgatggttctcttgatcccggagcccgaccgccagcggacgccccaggacaaccagctcgcctacgtggtgatagggctcttgttcatgatcctcaccgtagctgccaatgagatgggccttctcgagacgaccaagaaggacctcgggatcggtcacgtagccgcggaaaatcaccaccacgccaccatgctggacgtggatctgcgcccggctagcgcgtggaccctctacgccgtcgccacgaccgtaataactccgatgatgcgtcacaccatagagaacacgaccgccaacatctccctgaccgcaatcgcaaaccaggccgccatcctgatgggcctggacaagggatggcccatatctaagatggacataggcgtccccctgctggctctcgggtgctactcccaggtgaaccctctgacgctgacagcagcggtactgatgctggtggcccactacgccataatcggtcccgggctgcaggccaaggccacgcgtgaggcccagaaacgaacagccgccggtatcatgaagaatcccaccgtcgacggtatcgtcgccatcgatctcgaccccgtggtctacgacgcgaaattcgagaagcagctcggacagatcatgctgctcatcctgtgcacaagccagatcctgctcatgcgtaccacgtgggccctgtgcgagtccatcacactggctacgggcccgctcaccaccctgtgggaaggtagccccggcaagttctggaacaccacgatcgccgtttccatggcaaacatcttccggggcagctatctagctggggccggtttggccttttccctcatgaagtccctcggcggagggcgccgcgggaccggagctcagggggagaccctcggcgagaaatggaagcggcagctgaaccagctctccaagtcggagttcaacacttacaagcgaagcgggatcatggaggtggaccggagtgaggctaaggagggcttaaagcgcggggaaactaccaaacacgcggtcagccggggcacggccaaactgcgctggtttgtggaacggaacttagtgaagcccgagggaaaggtcatcgacctggggtgcggcagagggggctggtcctattactgcgcaggattaaagaaggtaaccgaggtgaagggctataccaagggtggtccaggccacgaggagcctatcccaatggccacttacggatggaacctggtcaagctgcactccggcaaggatgtatttttcatccctccagagaaatgcgacaccctcctgtgcgacatcggggagtccagcccaaatcctaccatcgaggaaggtcggacattaagggtgctaaagatggtcgagccctggctcaagggcaaccagttctgcataaagatcctaaacccctacatgccgagtgtagtggagacgctcgagcagatgcagcggaagcacgggggcatgttggtacgaaatccattaagcagaaactcgacccacgagatgtactgggtcagctgcgggaccggcaatatcgtgtccgcggtcaacatgaccagccgcatgctcctaaaccggttcacgatggcccaccgcaagcccacctacgagcgggacgttgacctgggcgcaggaacccgccacgtggcagtcgagcccgaggttgccaacctcgacatcattggccaacggatagagaacatcaagaacgagcacaagtccacctggcactacgacgaggataacccgtacaagacctgggcgtaccacgggagctacgaggtgaagcccagcggcagcgcctccagcatggtaaatggggtggtccgcctgctgaccaagccgtgggacgtgatccccatggtaacacaaatcgctatgaccgacacgacaccattcgggcagcaacgcgtcttcaaggagaaggtggacacacggacgccccgcgccaagcgaggaacggcccaaatcatggaagtgaccgcgaagtggctctgggggttcctgagccgcaacaagaagccccggatctgcacccgcgaggagttcacccggaaggtccgcagcaacgccgctatcggagccgtgttcgtcgacgagaaccagtggaatagcgcaaaggaggcggtcgaagacgagcggttttgggacctggtgcaccgggagcgggaactccacaagcaagggaagtgcgccacgtgcgtttataatatgatgggcaaacgcgagaagaagctgggggaatttggcaaggccaagggctctagggccatctggtatatgtggctgggggcgaggttcctcgagttcgaggccctgggcttcatgaatgaggaccattggttcagccgggaaaactcccttagcggggtcgaaggcgaaggcctccataaacttggctacatacttcgcgatatctccaagatcccgggcgggaatatgtacgccgacgacacggccggctgggacacccggatcacagaggacgatctacaaaacgaagccaagataacagatatcatggagccagagcacgcgctgctggccaccgccatcttcaagctcacctaccagaacaaggtggtgcgagtccagaggcccgccaagagcgggacggtaatggacgtgatctcccgccgcgaccagcgaggaagcggccaggtcgggacatacggcctgaacaccttcaccaacatggaggcccagctgatccgccagatggaatccgaagggatcttcctcccctccgaacttgagactccgaacctggcgaagagggtactcgattggctggagaaatacggcgccgagcggctgaagcggatggccatctccggagacgactgtgtggtcaaacccatcgacgaccgcttcgctaaggccctcacggcgttaaacgatatgggcaaggtgcggaaggacatcccccagtgggaaccctcgaaaggatggaacgactggcagcaggtaccgttctgctctcaccatttccaccagctgatcatgaaggacggccgggagatcgtagttccctgcagaaaccaggacgagctcgtgggccgtgcccgggtatcccaaggagccggctggtccctgcgtgagaccgcatgcctgggcaaaagctacgcccaaatgtggcagctcatgtatttccaccggcgcgacctccgtctagcggcaaatgccatctgctccgccgtacccgtcgactgggtccccaccagccgaaccacctggagcatccacgctcatcaccagtggatgactaccgaggacatgctctccgtgtggaaccgggtgtggatcgaagagaacccgtggatggaggacaagacccatgtcagctcatgggaggaggtcccatatctgggcaaacgcgaggaccaatggtgcggcagccttatcgggttaaccgccagagctacatgggccaccaacattcaggtggcaattaaccaggtccgccggctgattggcaatgagaactatctggactacatggcgagcatgaagcgcttcaagaacgagagcgaccccgagggggccctctggtga

SEQ ID NO: 24793 - RNA, 9879 nt, synthetic construct
  misc_feature 1..9879: note = derived and/or modified CDS sequence (opt11) from DENV-1__AF311956__SS-prME
  source 1..9879: mol_type = other RNA
agcgtgaccatgctgctcatgctgctgcccaccgccttagcctttcacctgacaacgcggggcggggagccccacatgatcgtaagcaaacaggagcggggcaagagcctcctgtttaagaccagcgcgggggtgaacatgtgcaccctgatcgccatggacctgggggagttatgcgaggatactatgacctacaagtgcccccggatcactgaggccgaacccgacgacgttgattgctggtgcaacgcgaccgacacctgggtaacctacgggacctgcagccagaccggcgagcacagacgggacaagcggtccgtggccctggctccccatgtgggcctggggctcgagacccgtaccgaaacctggatgagctcggaaggtgcctggaaacagattcagaaggtcgagacttgggccctccggcaccctggctttacggtgatcgccctgtttctcgcgcacgccatcggcaccagcatcacccaaaaaggtatcatttttattctgctcatgctggttaccccctcgatggccatgcgatgcgtaggcataggcaaccgggatttcgtggaggggctcagcggcgccacgtgggtggacgtcgtgctggagcacgggtcttgcgtgaccaccatggccaagaataagccaaccctcgacatcgagcttctgaaaacagaggtcacgaatcccgccgtgctgcgcaagttgtgcatagaagccaaaatttcgaacaccactacggacagtcggtgcccgacccagggcgaggccaccctggtggaggagcaggacgccaacttcgtctgccgccggacctttgtggaccgcggctggggtaacggttgcggactcttcggcaaggggtcactgcttacgtgcgcgaagttcaagtgcgttaccaagctcgaggggaaaatcgtccagtatgagaacctgaagtactctgttattgtaaccgtccacaccggcgatcaacatcaggtgggcaacgagacaaccgagcacggcaccatcgcgaccattacgcctcaggctccaacgagcgagatccagctcaccgattacggtgccctcacccttgactgcagccctagaaccgggctggacttcaatgagatggtcctcctgacgatgaaggagaagtcctggctggtgcacaagcagtggttccttgatttacccctgccctggacgtccggggccagcaccagccaggagacctggaaccgccaggaccttctggtgacattcaaaaccgcccacgccaagaagcaggaggtcgtagtgttaggctctcaagagggcgccatgcacacggccctcaccggggccaccgagatccagacctcagggaccaccacgatcttcgccggccaccttaagtgccggctgaagatggacaagctcaccctgaagggtaccagctacgtcatgtgcaccggcagtttcaagttggagaaggaggtggcggaaacgcaacacgggaccgtgctggtccaggtgaaatacgagggcaccgatgccccctgcaagattcccttctccacccaggacgagaagggagtgacgcaaaatggccgtctcatcaccgccaacccgatcgtcaccgacaaggaaaagcctgtgaacatcgagacagagccacccttcggggagagctacatcgtggtcggggccggcgagaaggcactgaagctgtcctggttcaagaaggggagctccatcggtaagatgtttgaggccacggcccgcggggctcgccggatggccatcctcggcgatactgcgtgggacttcggaagcatcgggggggtgtttacctccgtaggaaagctggtccaccaggtgtttggcacagcctacggtgtgctgttcagtggagtcagttggacgatgaaaattgggatcggtatcctcctcacgtggctgggccttaacagccgcagcaccagcttatccatgacatgcatcgcagtggggatggttacgctgtacctcggcgtcatggtgcaggcagacagcgggtgcgtgataaactggaagggccgcgaactaaagtgcggctccggcatcttcgtcaccaacgaggtgcacacctggaccgagcagtataaattccaggcagacagcccgaagcggctaagtgcggccattggccgagcctgggaggagggggtgtgcggtatacgatccgccacccgcctcgagaacatcatgtggaagcagatcagcaacgagctgaatcacatcctcctcgagaacgacatcaagttcacggtcgtggttggcaacgccaatggcatactggcgcaggggaagaagatgatcagaccccagcccatggagcacaagtactcctggaagtcttggggcaaggctaagatcattggcgccgacatccagaacaccactttcatcatagatgggccagataccccggagtgtcccgacgagcagcgggcgtggaacatctgggaggtcgaggactatggcttcgggatcttcacgaccaacatctggctgaagctcagagacagctacactcagatgtgcgaccaccgcctcatgagcgcggctattaaggactccaaggccgtgcacgccgacatgggctactggatcgagagcgagaaaaacgagacctggaagctggcccgggcgtccttcatcgaggtgaagacctgcatctggcccaagtctcatactctctggtccaacggcgtcctagagtccgagatgatcatccccaagatgtacgggggcccgatctcccagcacaactaccgccccggatacttcacccagacggccggcccctggcacctcgggaagctcgaactagacttcgacctgtgtgagggaacaacagtggtggtcgacgaacactgcggtagccgggggccgtcactccgcaccacgacggtgacgggcaagatcatccatgagtggtgctgccggagctgcacactgccccccctgcgcttccgtggggaggatggatgctggtacgggatggaaatccgacccgtgaaagaaaaagaggaaaacctagtccggtccatggtaagcgccggaagcggcgaggtggattctttttctctcggaatcctttgcgtctccatcatgatcgaggaagtgatgaggagccggtggtccagaaaaatgctcatgaccggcacgttagccgtgttcctgcttctgatcatggggcagctgacctggaacgatctcatccgcctctgcatcatggttggcgccaacgcgagcgacaagatgggaatgggaaccacctacctggccctaatggccactttcaagatgcggccgatgttcgccgtggggctacttttccgccggctcacctcgcgcgaggtgctcctgctcacgatcgggctgagtttagtcgcctcagtggagctccccaacagcctggaggagctgggtgacgggctcgctatgggcatcatgatgctgaagctgctcaccgagttccagccccaccagttatggacgaccctgttatccctgacctttatcaagaccacgttgagcctcgactacgcctggaagaccaccgcgatggtcctgtccattgtgagcctgttccccctctgtctgtccactacgtcacaaaaaaccacatggttgccggtgctcctgggttccttcggctgcaaacccctgactatgtttctcattaccgagaacgagatctggggccgcaagagctggcccttgaacgagggcatcatggccattggcatcgtatccatcctgctctccagcctcctgaagaacgatgtgcccttagcgggtccgctgatcgccggcggtatgctaatcgcctgctatgtgatctccggcagctccgccgaccttagcctagagaaggccgcggaggtctcctgggaggaagaggccgaacactcgggcacgtcccacaatatcctggtggaggtgcaggacgatggaaccatgaagatcaaggacgaagaacgtgacgacaccctgaccatcctgctgaaggccactttgctcgccgtctccggcgtgtaccccatgtcaatccccgccacgttgtttgtgtggtacttctggcagaagaagaagcagcggagtggtgttctttgggacaccccctccccgcccgaggtggagcgcgcggtgctcgacgacggaatctatcggatccttcagcgcggcctgctcggtcggagccaggtcggcgtgggagtgttccaggacggcgtgttccacaccatgtggcacgtgacgcgtggggccgtactgatgtaccaaggcaagcggttagagccctcctgggccagcgtaaagaaggacctcatctcctacggcgggggatggcgcttccaggggagctggaacacaggcgaagaggtccaggtgatagccgtcgagccggggaagaaccctaagaacgtgcagaccacccccggcacttttaagacccccgagggcgaggtgggggccatagcgctggactttaagcccggcacttccgggagcccgatagtcaatcgagagggcaagattgtcggcttatacgggaacggggtggtcaccacgtccgggacatacgtgagcgccatagcccaggcgaaggccagccaggagggccccctcccggagatcgaggacgaggtatttaagaagcgcaacctgaccataatggacctacacccagggtccggcaagacccggcgctacctccccgcgatcgtgcgggaagccatcaagcggaagctgcggacactcatcctggcccccacccgtgtggtggccagcgaaatggcggaggcgctgaaaggcatgcccatacggtatcaaaccactgccgtcaaatcggagcacacggggcgcgagattgtcgatctgatgtgccacgccaccttcacaatgaggctactgagcccggtgcgggtccccaattacaatatgatcatcatggatgaggcccatttcaccgacccggcgagtatcgccgcccgcgggtacattagcacgcgggtgggaatgggcgaagctgccgcgatcttcatgactgccacgccgcccgggtccgtcgaagcctttccgcagagcaatgccgtcatccaggacgaggagcgtgacatacctgaacgctcctggaacagcgggtacgattggatcaccgatttccccggcaagacggtctggttcgtgccctccataaagagcggtaacgacatcgccaactgccttcgcaagaatggaaagcgggtcattcagctcagtcgcaagacattcgataccgagtaccagaagaccaagaataacgactgggactatgtagtgacgaccgatatcagcgagatgggggcgaacttccgcgccgatcgcgtcatcgacccacggcgctgcctgaagcccgtgatactgaaggacggccccgagagagttatcctcgccgggcctatgcctgtgaccgtggcttccgcggcccagagacggggccgcatcggacggaatcagaataaggagggggaccagtacgtctatatgggccagcccctaaacaacgacgaggaccacgcccactggaccgaagcgaagatgctcctcgacaacatcaacacgcccgaggggatcatccccgcactatttgaaccggagcgcgagaagtccgccgctatcgatggcgagtacaggctgcgcggggaggcgcgcaagacgttcgtggagcttatgcggcgcggcgacctgcccgtgtggctgtcctacaaggtggccagtgaagggttccagtattccgaccggcgatggtgtttcgacggggagagaaacaaccaggtattagaggagaacatggacgtggagatctggacgaaggagggagagcgcaagaaactgagaccacgatggctggatgcaaggacgtacagcgacccgctggcgctgagggagttcaaggagttcgccgccgggcggcgctctgtctcgggcgacctgatcctcgagatcggcaagctgccgcaacacttaaccctccgggctcaaaacgctctggacaacctggtgatgttgcataacagcgagcagggagggaaggcttaccgccacgcgatggaggagctgccagatacgatcgagacactgatgcttctcgccttgatcgccgttctcaccgggggcgtcactctgttctttctgtcaggcaagggcctcggcaaaacgtctatcgggttgctctgcgtgactgcgtcctcggccctcctgtggatggcatcagtggagccccactggattgccgccagcatcatactggagttcttcctcatggtgctgttaatcccggagcccgatcggcagcgcactccacaggacaaccagttagcatatgtggtgatcggcctgctgtttatgatcctcaccgtcgccgctaacgaaatgggtttactggagactaccaagaaggacctcggaatcgggcacgtggccgccgagaaccaccagcacgcgactatcctggacgtggacctgcacccggcctccgcctggacactctacgccgtcgccacgactgtgatcacccctatgatgcgacacaccatcgaaaacacgaccgcgaacatcagcctgactgcgattgccaaccaggccgccattctgatgggtctcgacaagggctggcccattagcaaaatggacctgggggtgccacttctcgcgctgggatgctactctcaagtcaaccccttaaccttaacggctgccgtactgatgctggttgcccactacgcaatcatcgggcccggcctccaggccaaggccacacgcgaggcccagaagcggaccgccgcaggaatcatgaaaaaccccaccgtcgacggcattgtggcgatcgatctggaccccgtggtctatgatgcgaagttcgagaaacaactgggacagatcatgctcctgatcctctgcacgagccagatcttgctgatgcgcaccacctgggccctctgtgagagcatcactctcgccacggggcctctgaccaccctatgggagggctcccccgggaagttctggaacacaacgatcgcggtgagcatggcgaacatcttccgcggatcctacctcgccggtgccgggctggccttcagcctcatgaagagcctcggcgggggccggagaggtaccggcgcgcaaggcgagaccctgggggagaagtggaaacggcaactgaaccaactcagcaagagcgagttcaacacgtacaagaggtcgggcatcatggaggtggaccggtcagaggccaaggaagggctgaagcggggcgagacgaccaagcacgccgtcagccgggggacagcaaagctgcgctggttcgtggagcggaacctggttaagcccgaaggcaaggtaatcgacctcggctgcgggcgcggcggttggtcatactactgcgcgggccttaagaaggtgaccgaagtgaaggggtacactaagggcggaccggggcacgaggagccgatccccatggccacttacggctggaacctggtcaagctccactccgggaaggacgtgttcttcatgcctcccgaaaaatgcgacaccctgctgtgcgacatcggcgaatcttccccgaacccaaccatcgaggaagggcggaccctcagggtactgaagatggtcgagccctggctgcggggcaaccagttttgcatcaagatccttaacccctacatgcccagcgtggtggagacgcttgaacagatgcagcgcaagcacggcgggatgttggtcaggaatcccctctcccgcaatagcacccacgagatgtactgggtatcctgcggtaccgggaacatcgtgagcgccgttaatatgacttcgcggatgctactgaaccgcttcaccatggcccaccgcaagcctacctatgagcgcgacgtcgacctcggcgccggcacccgccacgtggctgtcgagcccgaggtagccaacctggacattatagggcagcggatcgagaacatcaagaacgaacacaagagcacctggcattatgacgaggacaatccctacaagacctgggcctaccacggctcctacgaggtgaagccgtcggggtccgccagctccatggttaacggcgtggtccgactgctcaccaaaccgtgggacgtgataccaatggtgacccagatcgccatgactgacacgacgccgttcgggcagcaacgggttttcaaggaaaaggtagacacccgcacgccccgggctaagcgcggcacggcccagatcatggaggtgaccgccaagtggttgtggggcttcctgagccggaataaaaagccccgcatctgcacccgggaggagttcacccgcaaagtccgcagcaacgccgcgataggggcggtattcgtggacgagaaccagtggaactcggcgaaggaggccgtggaggacgagcgcttctgggatctcgtgcaccgagagcgcgaactgcacaagcagggcaagtgcgctacgtgcgtgtacaacatgatgggaaagcgggagaagaagctgggcgagttcggaaaggcgaagggcagccgggccatctggtacatgtggctcggtgcccggttcctggagttcgaggctctggggttcatgaacgaggaccactggttttcccgcgagaacagcctctccggtgtcgagggagagggtctgcacaagcttgggtacatcctcagggacattagcaagatcccgggcggcaatatgtacgccgatgacaccgcggggtgggatacccgcataaccgaggacgacctgcagaacgaggccaagatcactgacataatggagcccgaacacgcccttctggccacctccatcttcaagctgacttaccagaacaaggtagtgcgggttcaacgccccgcgaagaatggcaccgtgatggacgtaatcagcagacgggaccagcgcgggtccgggcaggtcggcacgtacggcctgaacacctttactaacatggaggtgcagctcatccggcagatggagagcgagggcattttcttcccttccgaactggagagcccgaacctggcggagcgcgtgctcgactggctggagaagcacggagccgagaggctgaagcgcatggccatctctggtgatgactgcgtcgtgaagcccatcgacgatcggttcgccacagccctcatcgcactgaatgacatgggcaaggtacgcaaggacattccccagtgggagcccagcaaggggtggaacgactggcagcaggtcccgttttgctcccaccacttccatcaactgattatgaaagacggccgggaaatcgtcgtgccgtgccgtaaccaggacgagctcgtcgggcgggcgcgagtgtcacagggtgcggggtggtcactgcgggagaccgcatgcctcggaaagagctacgcccaaatgtggcagctcatgtacttccaccgccgggacctgcgactggctgccaacgccatctgcagcgccgtgcccgtcgactgggtgcccacctcgcgaaccacctggtcaatccatgcgcaccaccagtggatgaccacggaggacatgctctccgtatggaaccgagtctggatcgaggagaacccgtggatggaagacaagacccacgtgagcagttgggaggaggtgccatacctgggaaaacgggaggaccagtggtgcgggagtctgataggcctgactgcccgcgccacctgggccacgaacatccaggtcgctatcaaccaggtacggcggttaatcgggaacgagaattacctggattacatgacatccatgaagaggttcaagaatgagagcgatcccgagggcgcgctatggtga

SEQ ID NO: 24794 - RNA, 9879 nt, synthetic construct
  misc_feature 1..9879: note = derived and/or modified CDS sequence (opt11) from DENV-1__AF311958__SS-prME
  source 1..9879: mol_type = other RNA
tctgtcacaatgctgctcatgttactgcctaccgccctggccttccacctcaccacgcgaggcggtgaaccccacatgatcgtgagcaaacaggagcggggcaagagcctcctgttcaaaaccagcgcaggcgtaaacatgtgtactcttatcgctatggatctgggcgaactctgcgaggacactatgacgtacaagtgcccccggatcaccgaggcagagcccgacgacgtggactgctggtgcaacgccaccgatacatgggttacctatgggacctgcagccaaaccggcgagcaccgtcgggacaagcggtccgtggccctggcgccccacgttggcctgggactcgagacccgcaccgaaacgtggatgagctccgagggcgcctggaaacagatccagaaggtggaaacttgggccctgcggcacccgggcttcacggtgattgccttattcctcgcacacgccataggtaccagcatcacccagaaagggatcatattcatcctattgatgctagtaaccccgtccatggccatgcgatgtgtcggcatcggcaatcgggacttcgtggaggggctgagcggcgccacgtgggtggacgtggtgctggagcacgggtcctgcgtcaccaccatggccaagaacaagccaacactcgatattgaactgttgaaaacggaggtcaccaatcccgcggtgctccgcaagctctgcatcgaggccaagatcagcaacaccaccacggactcccggtgcccaacacaaggcgaggccacgctggtggaggagcaggacgccaacttcgtctgccgcagaaccttcgtggaccgcggatggggtaatggctgtggcctcttcggaaaggggagcctgttaacgtgcgctaagttcaagtgcgtaactaagcttgaagggaagattgtacagtatgagaacctgaagtactccgtgatcgtgaccgtccacactggcgaccagcaccaggtgggcaatgagacaacggaacacggcaccatcgctacgatcacgccccaggcccccacgagcgagatccagctgaccgactatggtacgctcaccctggattgcagccccaggacgggcctggacttcaacgaaatggtcctcctgaccatgaaggaaaagagctggttggtgcacaagcagtggttcctagacttgcctctgccctggacctccggggctagcaccagtcaggagacgtggaaccggcaggatctcctggtgaccttcaagaccgcccacgcaaagaagcaggaggtggtggtactaggctctcaggagggcgcaatgcacaccgctctcacgggggccaccgaaatccagaccagcggcaccacgacgatattcgcagggcacctgaagtgccggctgaagatggacaagctaaccctgaaaggcacaagttacgtcatgtgcacggggagcttcaagctggagaaggaggtggccgagacccagcacggcaccgtgctagtccaggtgaaatacgagggcaccgacgcgccctgcaagatcccattctccacgcaggacgagaagggagtcacacaaaacggcaggctcattaccgccaacccgatcgtaaccgacaaggagaagcccgtgaacattgagacggagccaccttttggagagagctacattgtggtcggcgcaggcgaaaaggccctgaagttgtcctggttcaagaaggggagctccatcggaaagatgttcgaggctacagcccgcggggcccgccggatggccatcctcggcgacacagcctgggacttcgggagcatcggcggagtgttcaccagcgtggggaagctggtccaccaggtgttcggcactgcgtacggggttctgttcagcggtgtctcctggaccatgaagatcgggatcggcatcctcttgacgtggctgggactcaatagccgctccaccagcctttcaatgacgtgcatcgcagtggggatggtcaccctgtacttgggcgtcatggtgcaggcagacagcggatgcgtgatcaactggaagggtcgcgaactgaagtgcggctccggcatcttcgttaccaacgaggtccacacctggaccgagcaatacaagttccaggcggatagtccgaagcggctgagcgcggcgatcggcagggcctgggaggagggagtttgcggcatacgctccgccacacgcctcgagaacatcatgtggaaacagatatctaacgagcttaatcacatcctgttggagaacgacataaagttcacagtcgtggtggggaacgccaatggcattctggcacaggggaaaaagatgattcgcccccaacccatggaacacaaatactcctggaaatcctggggcaaggcaaagatcatcggcgctgacatccagaatactaccttcatcatcgacggccccgatacgccggaatgtcccgacgagcagcgcgcctggaacatctgggaggtcgaggactacggctttggtatctttaccaccaacatctggctgaaattacgggactcctacacacagatgtgcgatcaccgcctgatgagcgccgcgatcaaggacagcaaggcagtacatgccgatatgggctactggatagagagcgagaagaatgaaacgtggaagctggcccgggcctccttcattgaagtgaaaacctgcatctggcctaagagccacaccctctggtccaacggagtcctggagtctgagatgatcatcccgaaaatgtacgggggccctatctcccagcacaattatcgccccgggtacttcacgcagaccgcgggcccttggcatctcggaaagctggagttagactttgacctgtgtgagggcaccaccgtggtcgtcgatgagcactgcggctctcggggcccgtccctccgcaccacaaccgtgaccggcaagatcatccacgagtggtgctgccgcagctgtactctcccgcccctcaggtttcgtggggaggatggctgctggtacggaatggagatccgccccgtgaaggagaaggaggaaaatttggtccggtcaatggtgagcgcgggcagcggcgaggtagactctttttccctggggattctgtgcgtctccatcatgatcgaggaagtgatgcgcagccggtggtcccgcaagatgttaatgaccggcacgttagcggtgttcctgctccttatcatgggccagctaacgtggaacgatctcatccgcctgtgcatcatggtcggcgccaacgcctcagacaagatgggaatggggaccacgtacctggcgctcatggccaccttcaagatgcggccgatgttcgcggtcgggctccttttccgccggctcacgtcccgcgaggtactgctgctcactatcgggctgagtctggtcgcctccgtggagttacccaacagcctggaggaattaggggacgggctcgccatgggcatcatgatgctgaagctgctaacggagttccaaccccatcagttgtggaccaccctgctttccctgactttcatcaagactaccctgagcttagactatgcgtggaagaccacagctatggtactgtccatcgtgtcactcttccccctctgcctgtctacgaccagccagaagaccacctggctgccggtgctactgggcagtttcgggtgtaaacccctgaccatgttcctcatcacggagtacgagatctggggacgcaagtcatggcccctgaacgagggaatcatggccatcggcatcgtgagtatcctgctgtcgagcctgctgaagaatgatgtgcccctcgccggaccgctgatagcaggaggcatgctgatagcctgctacgtgatctctgggagctccgcagacctctctctggagaaggccgctgaggtcagttgggaggaggaggcggagcacagcggcacctcccacaacatcctggtggaggtgcaggacgatgggactatgaaaatcaaagacgaggagcgcgacgacaccttgacgatcctgctcaaagccaccctcctggcggtcagcggcgtttaccctatgtccatccccgccaccctgttcgtgtggtacttctggcagaagaaaaagcagcgttcgggggtactctgggatacccccagtccgcctgaggttgagcgggccgtgctggacgacggcatctaccgcatcctacagcgcggcctgctcggacgcagccaggtcggcgtcggagttttccaggacggagtctttcacacgatgtggcacgttactcgaggggcggtgctgatgtaccagggcaagcggctggagccctcgtgggctagcgtcaaaaaggacctaatatcctacggagggggctggcgctttcagggcagctggaacaccggcgaagaggtacaggtgatcgccgtcgagcccgggaagaaccctaagaatgtgcagaccacgcctggcacgttcaagaccccagagggcgaggtgggggccatagcactcgacttcaagcccgggacatctggaagcccgatcgtcaaccgggaaggcaaaatcgtggggctctacgggaacggagtggttacgacgtccgggacctatgtttctgcgatcgcccaagccaaggctagccaggaggaacccctccccgagatcgaagatgaggtattcaaaaagcgcaacctgacgatcatggacctgcatccgggatcagggaagacgcgccgctacctccccgccatcgtcagagaggcgatcaagcgcaagctacggaccctgatcctagcgcccacccgggtggtagcttcggaaatggctgaggccctcaagggcatgcccattaggtaccagaccacggcggtgaagtccgagcacaccgggcgggagatcgtggacctgatgtgtcacgcgaccttcaccatgcgcctcctgagcccggtgcgggtcccaaactataacatgatcatcatggatgaggcccactttacggaccctgcttccatcgcggcccgcgggtacatttcaacccgggtgggcatgggtgaagccgccgccatcttcatgaccgcgacgcccccgggctcggtggaggccttcccgcagagcaacgcagtcatacaggatgaggagcgcgacatccccgagcggtcttggaatagtgggtacgactggataacggactttcccggcaagaccgtgtggtttgtgccctcaatcaaaagcggaaacgacatcgccaactgcctacgcaagaacgggaagcgcgttatccaattatctcggaagaccttcgacacggagtaccagaagacgaaaaacaacgactgggactacgtggtgaccaccgatatcagtgagatgggcgccaacttccgggcggaccgcgttatcgaccctcggcgctgcctgaagcccgtgatcctgaaggacgggccggagcgggtcatattggccggcccgatgcccgttactgttgcctccgcggcgcagcgccggggtcgcatcggccggaatcagaacaaggagggtgaccagtacgtatacatggggcagcccctgaacaacgacgaggaccacgcccactggacggaggccaagatgctattagacaacatcaatacgcccgagggcataatcccggccttattcgagcccgagcgcgagaagagtgccgcgatcgacggggagtaccggctgcggggagaggccagaaaaacattcgtggagcttatgcggcgcggggacttacccgtttggctgagctacaaggtagcgagcgagggcttccagtactccgaccggcgctggtgtttcgacggcgagcgaaacaaccaggtgctcgaagagaacatggacgtggagatctggaccaaagagggggagcgaaagaagctgcggccacgctggctggacgcccgaacttacagcgaccccctcgcgctgagggagttcaaagagttcgcggcagggcggcgcagcgtctccggggacctgatattggagatcggaaagctgccccagcacctgacgctccgggcccagaacgccctggacaacctggtgatgctacacaacagcgagcagggcgggaaggcctaccgccatgctatggaagagctgccggacaccatcgagaccttaatgctcctagccctgatcgccgtgctcaccggcggcgttactctcttcttcctctccggtaaagggctcggcaaaacgagcatcggcctgctgtgcgtgaccgcttcctccgcactcttgtggatggcttccgtggagccacactggattgccgccagcattatcctggagttcttcctcatggtcctgctgatcccggagcctgaccggcagcgcacaccccaagacaaccagctcgcctacgtggtgatcggactgctgttcatgatcctcacagtcgcggccaacgaaatgggcctgctggagaccaccaagaaggacctcgggatcggccacgtagccgccgaaaatcaccaacacgccacaatgttggacgtggacctgcacccggcctccgcctggacgttatacgccgtcgccaccaccgtcattaccccaatgatgcggcatacgattgagaataccaccgccaacatctcactgaccgcgatcgccaaccaggccgcgatcctgatggggctcgataagggatggcctatctcgaagatggacctgggagtcccactcctcgctctagggtgttatagccaagtgaacccactaacgctcaccgcggccgtgctgatgctggtcgcccactacgctatcatcggccccgggcttcaggcgaaggccaccagggaagcccaaaagcgaacggccgccggcataatgaagaatcccacggtcgatggaatcgtagcgatcgacctggacccggtggtctacgatgccaagttcgaaaagcaactgggccagatcatgctcctgatcctgtgtacctcccagattctccttatgcgcaccacctgggccctgtgcgagtcgatcacgctcgccactggcccgctgaccacactgtgggaagggtcccccggtaagttctggaacacgaccatcgcggtcagcatggcgaacatcttccgcgggtcctacctagccggcgccgggcttgcctttagcctgatgaagtcactcgggggcgggcggcgcggcaccggggcccaaggcgagaccttaggcgagaagtggaagcgccagctgaatcaattatctaagagcgagttcaacacgtataagcgctccgggattatggaggtcgacagatcagaggcgaaggaaggcctgaagcgcggggagaccaccaagcacgccgtcagtcgcggcgccgccaagctgcgctggttcgtagaacggaacctggtaaagcccgaggggaaagtaattgacctaggctgtggccgggggggctggagctactactgcgcggggctgaagaaggtgaccgaggtgaaaggctacaccaagggcggacccggccacgaggagccgatcccaatggccacttacgggtggaacctggttaagctccactccggcaaggacgtattcttcatgccgcccgagaaatgcgataccctgctgtgcgacatcggggagagctccccgaaccccaccatcgaagaaggccggaccctccgcgtcctcaagatggtcgagccctggctgcggggtaaccagttctgcatcaagatcctaaacccctacatgcctagcgtggtggagacgctggagcagatgcagcgtaagcatggggggatgctggtgcgcaacccactctctcgcaatagcacccacgagatgtactgggtatcttgcggtaccggcaacatcgttagcgctgtcaacatgacctcccggatgctgctgaacagattcacgatggcacatcggaagcccacatacgaacgcgacgtggacttgggggccggcacacggcacgttgcggtcgagcccgaggtggccaatctggacatcatcggccaaaggatcgagaacataaaaaatgagcacaagagcacctggcactacgacgaggacaacccgtacaaaacgtgggcctaccacgggtcctacgaggtgaagccctctggctccgccagctccatggtcaacggggtagtccgtctgttgaccaagccttgggacgtcatacccatggtgacccagatcgccatgaccgacacgaccccctttggccaacagcgggtcttcaaagagaaggtcgacacccgtacgcccagagcgaaacgcgggacagctcaaatcatggaggtaacagccaaatggctgtggggcttcttatcccgtaacaaaaagccacgtatctgcacccgggaagagttcacccgcaaggtccggagcaacgccgccatcggcgcggtgttcgtggacgagaaccagtggaactccgccaaggaggcggtggaggacgagcgcttttgggatctcgtgcatcgggagcgcgagctgcataaacaggggaagtgcgccacgtgcgtgtacaacatgatggggaagcgggagaaaaagctgggggagtttggcaaggcgaaggggagccgcgccatctggtacatgtggctcggcgcccggttcctggagttcgaggccctgggttttatgaacgaggaccactggttttctagagagaacagcctctccggggtggagggcgaagggctgcataagctgggctacatcctccgggacatcagcaagatccctggcgggaatatgtacgcggacgacaccgcgggatgggatacccgcatcacggaggacgatctccagaacgaggccaagatcacggacatcatggagccagagcacgccctgctcgccacctccatcttcaagctgacctaccagaacaaggtggtgcgggtccagagacccgctaagaacgggaccgtgatggacgtgatctctcgccgtgaccagcgcggcagtgggcaggttggaacctacgggctgaacactttcaccaacatggaggttcagctcatccggcagatggagagcgaggggatctttttcccctcggagttagagagccctaacctggccgagcgtgtgttagactggttagagaaacatggcgccgagcggctgaagcgcatggccatctccggggacgactgtgtggtgaagcccatcgatgaccggttcgccaccgccctcatagcgctgaacgacatggggaaggttcgcaaggacataccccagtgggagcctagcaaggggtggaacgactggcagcaggtcccgttctgctcccatcactttcaccagctgattatgaaggacggccgggaaatcgtggtgccatgccgcaatcaggacgagctcgtcggaagggcccgtgtgtcccagggggccggctggtccctgcgggagacggcctgcctgggcaagagctacgcacagatgtggcagctcatgtacttccacagacgggacttgcgtctcgcggccaacgctatctgttccgccgtgcctgtcgactgggtgcccacctcgagaaccacctggagtatccacgcccaccaccagtggatgaccaccgaggatatgctaagcgtgtggaaccgcgtctggatagaagagaacccgtggatggaggacaaaacacatgtgagctcctgggaagaggtgccctacctgggcaagcgggaggaccagtggtgcgggagcctgatcgggttaaccgcccgcgcgacctgggccacgaacatccaggttgccatcaaccaagtgagacggctgatcgggaacgagaattacttggactatatgacctccatgaaacgcttcaagaatgagagcgaccccgagggagcgctctggtga

SEQ ID NO: 24795 - RNA, 9879 nt, synthetic construct
  misc_feature 1..9879: note = derived and/or modified CDS sequence (opt11) from DENV-1__AF311957__SS-prME
  source 1..9879: mol_type = other RNA
tccgtgaccatgctgctcatgctgctgcccacagcactcgccttccacctaaccacccggggtggggaaccccacatgatagtgagcaaacaggagcggggcaagagcctcctgtttaagaccagcgcaggggtgaacatgtgcaccctgatcgccatggacctgggggaactctgcgaagacacaatgacgtataagtgccccaggatcaccgaagcggagcccgatgacgttgattgctggtgcaacgccaccgacacctgggtcacctacgggacatgcagccaaaccggtgagcacaggcgggataagcggtccgtggccttggcgccccacgtcggcctggggctcgagacccggaccgagacttggatgagtagcgagggcgcatggaagcagatccagaaagtcgagacctgggccctgcggcaccccggtttcacggtgatcgccctgttccttgcgcatgccattgggactagcatcacccagaaggggataatattcatcctgctgatgcttgtgacgccctccatggccatgcgctgcgtcggcattggcaaccgggacttcgtggagggattatcaggcgccacgtgggtggacgttgtgctggagcacggttcctgcgtgaccacaatggccaagaacaagcccacactcgacatcgaactgctgaagaccgaagttacgaaccccgcggtgctccgcaagctgtgcatcgaagccaagatcagcaataccaccacggacagccggtgcccgacccagggcgaggcgaccctggtggaggagcaggacgccaacttcgtctgccgccggaccttcgtagaccgaggctgggggaacgggtgcggactcttcggaaaagggtctctgctgacgtgtgccaagtttaagtgcgtgactaaactcgagggtaaaatcgtccagtacgagaacctgaagtactccgtgatcgtgactgtccacaccggcgatcagcaccaggttggtaacgagactaccgagcacggcacaatcgccaccatcacaccccaggcccccacgagcgagatccagctgacggattacggggccctgaccctggactgcagcccccgaaccggcctggatttcaacgagatggtcctcctgacgatgaaggagaagagttggttggtgcacaagcagtggttcctcgacctgccgctgccctggacctccggggccagcacaagccaagaaacctggaatcgccaggacctgttggtgacgttcaagacagcccacgcgaagaagcaagaggtcgtggtgctaggcagccaggagggcgccatgcacaccgcactcacgggagcaacggagatccaaaccagcggcaccaccactatcttcgccggccacctgaagtgcagactgaagatggataagctcaccctgaagggcacctcctacgtcatgtgcaccggttcattcaagctggagaaggaggtggcggagacgcagcacggcacggtactggtccaggtcaagtacgagggcaccgatgccccttgcaagatccccttctccacccaggacgaaaagggggtgactcagaacggacgcctcatcacggccaatccgatcgttaccgacaaagaaaaacccgtgaacatcgagaccgaaccgcccttcggcgagagctacatcgtggtcggtgccggcgagaaggcactgaagctgagttggtttaagaaggggagctccatcggcaagatgttcgaggctacggcccgcggggcccgccggatggccatcctcggcgacaccgcgtgggacttcgggtctattggcggcgtgtttacctccgtggggaaactggtccaccaggtgttcggcacggcttatggggtgttgttcagcggcgtgtcctggacgatgaagatcgggatcggcatcttactcacctggctgggcctcaatagccgctctacttccctatccatgacctgtatcgccgtcggcatggtgacgctgtacctcggcgtcatggtgcaggccgacagcggctgcgtgatcaactggaagggacgagagctgaagtgcgggtccggcatcttcgttaccaacgaggtgcatacctggactgagcagtacaagtttcaagccgacagcccgaagcgcctgagcgcggccatcggccgagcctgggaggagggagtgtgcggcatccggtccgccacccgcttggagaacatcatgtggaaacagatctcaaacgaactgaaccacatcctgctagagaatgacatcaaattcacggtggtggtggggaacgccaacggtatcctggcgcagggaaagaaaatgatccggccccagcctatggagcataagtactcttggaaatcctggggaaaagcaaagatcatcggcgccgacatccagaacaccaccttcatcattgacggccccgacacaccggagtgccccgacgagcagcgcgcatggaacatctgggaggtcgaggactacggctttggtatcttcactaccaacatctggctgaagctacgggactcctacacccaaatgtgcgaccaccgcctgatgagcgcagccatcaaggacagcaaggccgtgcacgccgacatgggttattggattgaatctgagaagaacgagacctggaagctggcgcgggcgtcctttatcgaggtgaagacatgcatctggccgaaaagccacactctctggtccaacggcgtcctggagtccgagatgatcatccccaagatgtacgggggcccgatcagtcaacataactaccgacccggttacttcacccagactgccggcccctggcacctagggaaactcgagctcgacttcgatctgtgcgaaggcacgaccgtggtggtcgatgagcactgcggctcccgggggccgtccctccgcactaccactgtgaccggcaagatcatccacgaatggtgctgccggtcctgcaccctgccgccactgaggtttcggggagaggatggctgctggtatgggatggagatcagacccgtgaaggagaaggaagaaaacctcgtccggtccatggtgagcgccggcagcggcgaggtggacagcttcagcctggggatattgtgcgtctccattatgatcgaggaggtgatgcgcagccggtggtcccggaagatgctcatgaccggcacgctggccgtgttcctgctcctgatcatggggcagctgacttggaatgacctcatccgcctgtgcatcatggtcggtgccaacgcgagcgataaaatggggatgggcaccacctacctggccctaatggccacgttcaagatgcggccgatgttcgccgtggggctcctcttcaggcggttaactagccgcgaggtgctgttgctcacgatcggtctgtcactggtcgcctccgtggagcttcccaactcgctggaggagctgggcgatgggctcgcgatgggaatcatgatgctgaagctgctgactgagttccagccccaccagctgtggacgaccctgctgtccctgacgtttatcaagaccacgctgagcctcgactacgcctggaaaaccaccgccactgtcctgtccatcgtgtcactgttccccctctgcttatcgacaactagccagaagaccacctggctgcccgtgctactgggctccttcgggtgcaaacccctgaccatgttcctcatcacggagaacgaaatctgggggcgcaagtcatggcctttaaacgaggggatcatggcgatcggcatcgtttccatcctgctcagcagcctgctgaagaacgatgtgcccctcgcggggccgctgatcgccggcggtatgttgatcgcctgctacgtgatctccgggagctccgccgacctcagtctggaaaaggccgcggaggtctcctgggaggaggaggctgagcacagcggaacgtcccacaacatcctggtggaggtgcaggatgacgggaccatgaagatcaaggacgaggagcgcgacgacaccctcacgatcctactgaaggcaaccctcctggccgtcagcggggtgtaccccatgtccatccccgcgaccctattcgtgtggtacttttggcagaagaagaagcagaggagcggggtcctctgggataccccaagcccacccgaggtagagcgcgccgtcctggacgacggcatctaccggatcctgcagcggggcctgcttgggcggagccaggtcggggtaggggtgttccaggatggtgtgttccacacgatgtggcacgttactcgcggagcagtgctaatgtaccaaggcaagcggctggagccctcctgggcctcggttaaaaaggacctcatctcctacggagggggctggagattccaggggtcctggaacaccggcgaggaggtccaggtgatcgccgtcgagcccgggaagaacccgaagaacgtgcagacaacgcccggcaccttcaagacccccgaaggcgaggtgggggccatcgcgctggacttcaagcccggcacctccgggagcccgattgttaaccgtgagggcaagatcgtgggcttatacgggaacggagttgtcaccacctccgggacctacgtcagcgccatcgcgcaagcaaaggccagccaggagggcccgttgcccgagatcgaggacgaagtgttcaagaaacgcaatcttaccatcatggacctgcacccggggtccggcaagacgcggcgctacttacccgcaatagtccgggaggcaataaagcgcaagctgcgtaccctgatcctcgcccccacccgtgttgtggccagcgagatggccgaggcgctgaaaggcatgccgatccgctatcaaaccacggctgtcaagtctgagcacaccggtcgggagatcgtggacctgatgtgccacgccacctttacaatgcgtctcctgagcccggtgcgtgtccccaactataatatgatcatcatggacgaggcacacttcacagaccccgcgtccatcgccgcccgcggctacatcagcacgcgggtggggatgggggaggccgccgcgatctttatgaccgccacgcctccaggatccgtggaggccttcccccagtctaacgccgttatccaggatgaagaacgcgacatccccgagcggtcctggaacagcggctacgattggatcacggacttcccaggtaagaccgtgtggtttgttccctccatcaagagcgggaacgacatagccaactgcctgcgcaagaatgggaaacgggtcatccagctctccaggaagaccttcgacacagagtaccagaagacgaagaacaacgactgggactatgtggtgactaccgacatcagcgagatgggggcgaacttccgggccgatcgcgtcatagacccccggcgctgcctgaagcctgttatcctgaaggacggccccgagcgggtaatacttgccggaccgatgcccgtcacagtggcctccgcggcccagcgacgaggccgcatcggccggaaccagaacaaggagggggaccagtacgtttacatgggccagcccctcaacaacgacgaggaccacgcccactggacagaggccaagatgctgctcgacaacatcaacacccccgaagggatcatcccggcactgtttgaacccgagcgcgagaagtcagcggccatcgacggcgaataccgcctgcgcggggaggcccgcaagaccttcgtagaactcatgcgtagaggcgacctgcccgtatggctgtcctacaaggtcgccagcgagggtttccagtactcagaccggcgctggtgcttcgacggggagcgtaacaaccaggtgctcgaggaaaacatggacgtggaaatctggactaaggagggcgagcgcaagaaactgcggccccgctggctggacgcccggacctacagcgatccgcttgcgctgcgcgagttcaaggagtttgccgcagggcggcgtagcgtctccagcgacctgatcctcgagattggcaagctaccccagcatctgacgctccgggcccagaacgcccttgataaccttgtgatgctccataactccgagcaaggcgggaaggcgtaccgccacgcaatggaggagctacccgatacgatcgagaccctgatgctcctggccctgatcgccgtgctgaccggcggggtcacgctgttctttctgagcggaaaggggctcgggaagacctccatcggcttgctgtgtgtcacagcaagctccgccctcctatggatggccagcgtcgagccgcactggatagccgcctccatcatcctggagttcttcctcatggtcttactgataccggagcccgatcgtcagcgcacgccccaggacaatcagctcgcgtacgtggtgatcgggctgcttttcatgatcctcacggtcgcagccaatgagatgggcctgctggaaaccacaaagaaggacctcgggatcggccacgtggcagccgaaaatcaccagcacgcgaccatgctggacgtggatctacacccggccagtgcctggacgctgtacgccgtggccaccaccgtcatcaccccaatgatgcggcacacaattgagaataccaccgcgaacatctccctgacggccattgccaaccaggccgccatcctgatggggttagacaagggttggcccataagcaagatggaccttggcgtgcccctgctagcgctagggtgctactcccaggtcaatccgctgacattgaccgccgccgtgctgatgctggtggcccactatgcgatcattggcccgggtctccaggcgaaggccacccgcgaggcccagaagcggaccgcagcgggcatcatgaagaaccccacagtcgacgggatcgtggccatcgatctggaccccgttgtttacgacgccaagtttgagaagcagctgggccagattatgctcctgatcctatgcaccagccagatcctactaatgcgcaccacatgggccctgtgcgagtccatcacactcgccaccggaccgttaaccaccctttgggaggggagccccggcaagttctggaacacgaccatcgcggtgtccatggctaacattttccgcgggagttatctcgcgggggccggcctagccttctccctgatgaaatctctcgggggcgggaggcgcggcaccggggcgcagggcgagacgctgggcgagaaatggaagcggcagctgaaccagttgagcaagagtgagttcaacacctacaagcggagcggaatcatggaggtggaccggtcggaggccaaggagggcctcaagcgcggggagaccaccaaacacgccgtcagccggggcaccgccaagctgcgctggttcgtggaacgaaacttagtaaagcccgaaggtaaagtgatcgatttgggctgcggccgcggtggctggtcatactattgcgcggggctgaagaaagtgaccgaagtgaaaggctacaccaagggcgggcccggacacgaggagcctatccccatggctacctacgggtggaacctggtcaaactccactctggcaaggacgtgttctttatcccgcccgagaagtgcgacacactgttgtgtgacatcggcgagtccagccctaaccccaccatcgaggagggccggaccttgcgcgttctgaagatggttgaaccctggctgcggggaaatcagttctgcatcaagatcctcaacccctacatgccgagcgtggttgagaccctggagcagatgcaacgcaagcacggaggaatgctggtccggaaccccctcagccgcaactccactcacgagatgtactgggtgagttgcgggaccggcaacattgtgagcgcggtcaacatgacgagccggatgttgctcaaccgcttcaccatggcccaccggaagcccacttacgagcgcgatgtagacttaggggccggaacccgacacgttgcggttgagcctgaggtggcaaacctggacatcatcggccagcggattgagaacatcaagaacgagcacaagtccacgtggcactacgacgaggacaatccctacaagacctgggcctatcacgggagctacgaggtgaagccctccggcagcgcctcaagcatggtcaacggagtggtgcgcctgctcacaaagccctgggacgtgatccccatggtgacccagattgccatgacggacaccaccccgttcggacagcagcgggtcttcaaggaaaaagtggacacccgcacgcctagagcgaagcgagggaccgcccagatcatggaagtgaccgcaaagtggctttgggggttcctgtctagaaataagaagccccgcatatgcacccgggaggagttcacgcgcaaagtacggtccaacgccgccatcggcgctgtgttcgtggacgagaaccagtggaacagcgccaaggaggccgtcgaggacgagcgcttttgggatctcgtgcaccgggagcgcgagctccacaagcaagggaagtgtgcgacctgcgtgtacaacatgatgggcaaacgcgagaagaagctgggggagttcggcaaggcgaaagggtcccgggccatctggtacatgtggctaggagctcggttcctggagttcgaggcactgggcttcatgaacgaagaccactggttctctcgcgagaactccctcagcggcgttgagggcgagggactgcacaagctgggctacatcctccgggatatctccaagatcccgggtgggaacatgtacgccgacgacaccgcggggtgggacactcgcatcacggaggacgacctgcagaacgaggctaagattacggacatcatggagcccgagcacgccctgttggccacgagtatcttcaagctgacctaccagaacaaggtggtgcgggtccagcgccccgcaaagaacggcacggtgatggacgtgatctcccgccgggaccaacgcggtagcggacaggtgggcacctacggcctgaacaccttcaccaacatggaggtccagctcatccggcaaatggagtccgaggggatcttcttccccagcgagctggagtccccaaacctggcggagcgagtcctcgactggctggaaaagcacggcgccgagcggctgaagcgcatggccatcagcggggatgactgcgtcgtgaaacccatcgacgaccggttcgccacggccctcatcgcgctgaacgacatgggcaaggtgcggaaggacatcccccagtgggagcctagcaagggctggaacgactggcagcaggtcccgttttgcagccaccacttccatcagctgatcatgaaggacggcagagagatcgtggtgccgtgccgcaaccaggacgagcttgtcgggcgggccagagtgtcgcaaggggccggctggagcctgcgggagacagcctgccttggcaagtcgtacgcccagatgtggcagttaatgtacttccaccgcagggacctgcgcctggcggccaacgccatctgcagcgccgtgcccgtcgactgggtccccacctctaggaccacctggtccatccacgcacatcatcaatggatgacgaccgaggacatgctcagcgtgtggaacagggtgtggatcgaagagaatccgtggatggaagacaaaacacacgtgtccagctgggaggaggtaccctacctgggtaagcgtgaggatcagtggtgcgggagcctgattggcctcaccgcgcgcgcaacatgggccaccaacattcaggtcgcgatcaaccaagtgcgccggctgatcggcaacgagaactacctggactacatgacctcaatgaagaggtttaaaaacgagtccgaccccgagggagcgctctggtga

SEQ ID NO: 24796 - RNA, 9879 nt, synthetic construct
  misc_feature 1..9879: note = derived and/or modified CDS sequence (opt11) from DENV-1__EU280167__SS-prME
  source 1..9879: mol_type = other RNA
agcgtgactatgctgctaaccctgatgcccacggccctggccttccacctcaccacgagaggcggggaaccccatatgatcgtgagcaagcaagagcgcggcaagtcactcctgttcaagacctccgcgggggtgaacatgtgcaccctcatcgccatggacctgggcgaactgtgcgaggacaccgtgacctacaaatgcccaaggatcacagaggctgagccggatgatgtcgactgctggtgcaacgccaccgacacctgggtgacttacgggacctgtagccagacgggcgaacaccggcgggatatccggtccgtggccctcgcgccccacgttggcttggggctggagacccggacagagacatggatgagctccgagggcgcgtggaagcagatccagcgggttgacacgtgcgtcctccgccaccctggtttcaccgtcatcgccttattcctggcccacgcgatcggaaccagcatctcccaaaaggggatcatattcattctcttgatgctagtgacccctagtatgaccatgcgttgcgtgggcatagggtcccgcgacttcgtggaggggcttagcggcgcaacctgggtggacgtagtcctggagcacgggagttgcgtaacatccatggccaaggataagccaaccctggacatcgagttgctgaagacggaggtgcccaatcccgccgtcctgaggaaactctgtatcgaggcaaagatctccaacaccaccacagacagccgctgccctacgcaaggcgaggcaaccctggttgaggagcaggacgccaacttcgtgtgccggagaaccttcgttgaccggggatgggggaatggctgcggcctgtttggcaagggctccctcctgacctgcgacaagttcaagtgcgtgacgaagctggagggcaagatcatccagtacgagaatttcaagtatagcgtgatagtcacggtgcacaccggcgaccagcaccaagtcggaaacgagtccaccgagcacggcacaacagccaccatcactcctcaggctcccaccacggaaatccagctcacggactatggggcactgacgctggactgctcaccgcgcacaggcctcgatttcaacgagatggtgctgctgacaatgaaagaaaagtcctggctcgtgcataagcagtggttcctggacctgcccctcccctggacctccggggcgagcacatcccgggagacttggaaccgtcaggacttactggtcacgttcaagaccgcccacgccaagaagcaagaggtggtggtcttgggcagccaggagggcgccatgcacacggccctgaccggggcgacggagattcagacctcgggcaccaccactatcttcgccggccacctgaagtgccgcctcaagatggacaagctaaccctgaagggcatgagctacgtgatgtgcaccggatcctttaagctcgagaaggaggtcgccgaaacccagcacggtaccgttctggtccagattaaatacgagggcaccgatgccccctgcaagattccattcagcacccaagacgagaagggggtaacacagaacggacgcttgatcacggccaaccccatcgtcacggacaaggaaaagccggtgaacattgaggcggaacctccgtttggggagtcctacattgtgataggcgtaggcgagaaggctctcaagctaagctggttcaagaagggatccagcatcggcaagatgttcgaggccaccgcgcgcggcgcgcgccgcatggccatcctgggcgacaccgcctgggacttcgggtccatcggcggcgtgttcacttctgtagggaaacttgtccatcagatcttcggcaccgcctacggtgtgctgttctctggggtgagctggactatgaagatagggataggcgtcctgctaacctggctcggcctgaattcccggtccacctccctctctatgacatgtattgccgtgggcctcgtgacgctgtatttaggagtcatggtacaggcggactcagggtgcgtgatcaactggaagggccgcgggctcaagtgcggttccgggatcttcgtcactaacgaggtgcatacgtggaccgggcagtacaagttccaggccgacagtcccaaggggctaagtgccgccatagggaaggcctgggaggaaggcgtgtgcgggatccggagcgcgacccgcctggagaacatcatgtggaagcaaatctccaacgagctcaaccacatccttttggagaacgacatgaaatttactgtagtggtgggcgacgtggccggtattctagcccaagggaagaagatgatccggccccagcccatggaacacaaatacagctggaagaattggggcaaggccaagattataggggccgacgttcagaacagcacatttattatcgatggcccgaacacgccggagtgcagcgacgaccaacgcgcgtggaacatctgggaggtggaggattacggcttcgggatcttcactaccaatatttggctgaagctgcgggactcctacacgcaagtctgtgaccaccgactcatgagcgccgcaatcaaggactccaaagccgtgcatgcggacatgggatattggatcgagagcgaaaagaacgagacgtggaagctggcgcgggcctccttcatcgaggtgaagacctgcatctggcccaaaagccacaccctgtggtcgaacggggtgctcgagagcgaaatgatcatccccaagatctacggcgggcctatctcccaacacaactaccgccccgggtacttcacccagacggccggcccctggcacctggggaagctggaattagacttcgacctgtgtgagggaaccaccgtggtggtcgacgaacactgtgggaatcgggggccgagcctgggaaccactaccgtgacgggcaagatcatccatgagtggtgttgccggtcttgcacgctcccgccgctccgcttccgaggagaggacgggtgctggtacggcatggaaatccgccccgtgaaggagaaggaagagaacctggtgaagtcgatggtgtcagctgggtcgggtgaggtggactcgttctccctggggctgctgtgcatctccatcatgatcgaggaagtcatgcgctcccgctggagtcgcaagatgctcatgacgggcactctggcggttttcttcctcctcattatgggccagctaacctggaacgacttaatccggctgtgcatcatggtcggggcaaacgcgtctgaccgcatggggatggggaccacgtacctagccctgatggccaccttcaaaatgcgcccgatgttcgcggtcggcctccttttccgtcgcctgacaagcagggaagtgctcctgttgaccatcgggctctctctggtcgccagcgtggagctgcccaacagtctcgaggaactgggggacggccttgccatggggatcatgatacttaagcttctgactgacttccgcagccaccagctctgggccaccctgctgtccatgactttcatcaagaccgcattcagcctgcactacgcgtggaaaacgatggccatggttctgtcaatcgtcagcctgttccccctctgtctgtacaccacatcccaaaagacgacgtggctgcccgtgttgctgggctccctggggtgtaagccgcttaccatgttcctgatcgctgagaacaaaatctggggccgcaagtcttggcccctgaacgagggcatcatggccgtcgggatcgtctccatcctcctgagctcgctgctcaaaaacgacgtccccctggccggccccctgatagctggaggcatgctcatcgcctgctacgtaatctcggggtccagcgcagacctatccctggagaaggccgcagaggtgagctgggaggaagaggcagagcactccggcgccagccacaacattctcgtggaggtgcaggatgatggcaccatgaagatcaaggatgaggaacgcgacgacactctgacgattctgctcaaggccaccctgctggcagtctctggggtgtacccgctcagcatccccgcgaccctcttcgtatggtgcttctggcagaagaagaaacaacggtccggcgtcctgtgggacactcccagccctcccaaggtggagagagccgtactcgacgacgggatctaccggataatgcagcggggcctgctggggcggtcccaggtaggcgtcggagtgttccaggagaatgtcttccacaccatgtggcacgtaaccagaggcgcggtgctgatgtatcagggcaagcggctcgagccctcttgggcctcggtgaaaaaggacctgatcagctacgggggggggtggcgcctgcaaggatcctggaacaccggcgaggaggtccaggtgatcgccgtagagccagggaaaaaccccaagaatgtgcagaccgcgcctggcaccttcaagactcccgagggggaggtgggcgccatcgcactcgacttcaagcccggtacttcagggagtcccatcgtgaaccgggagggaaagatcgtggggctgtacggcaacggggtcgtaaccacgtccggcacgtacgtgagcgccatcgcccaggcgaaggcgtcccaggagggcccgctgcctgagatcgaagacgaggtgttcagaaaacggaacctcaccatcatggatttacaccccgggtcggggaagacccgccggtatctgccggccatagtccgggaggccatcaagcgcaaaatgcgcaccctcatcctggcgcccacgcgagtggtcgcctccgagatggccgaggccctgaagggaatgcccatccggtaccagaccacagccgtcaagagcgagcacactggcaaggagatagtggacctcatgtgccacgcgacgttcaccatgcgtctgctgtcacccgtgcgggtcccgaactataacatgatcatcatggacgaggcccactttacggacccgagctccatcgctgcacgagggtacatcagcacacgggtgggaatgggtgaagccgctgcgatctttatgacggccacgccccccgggtccgtggaggcctttccacagtcgaacgcagtcatccaggacgaggagcgcgacatcccagaacggtcctggaacagcggctacgagtggatcaccgacttccccggcaagaccgtgtggttcgttccctcgatcaaagcgggcaacgacatcacgaactgtctccgcaaaaacggcaagcgggtcatccagctgagcagaaagaccttcgacactgagtaccagaagaccaagaacaacgactgggattacgtggtgacgaccgacatcagcgagatgggcgccaatttcagagccgatagggtcatggacccgcgtcgctgcctgaagcccgtgatcttaaaggacggccccgagcgggtcatactggccggtcctatgccggtgaccgtggcgagcgcggcccagagacggggccgaatcgggcggaaccacaacaaagagggcgaccagtacatctacatggggcagcctctgaccaacgacgaagaccacgcccactggacggaagctaagatgctactggacaacatcaacacccccgaaggcatcatccccgccctgttcgagccggagcgcgagaaatcagctgccatcgacggcgagtaccgcctgcgcggggaggccagaaagaccttcgttgagctgatgagaaggggcgacttacccgtgtggctcagccacaaggtggcaagcgagggctttcagtactccgatcggcgctggtgcttcgacggtgagcggaataaccaggtgctggaggagaacatggacgtggagatttggaccaaggagggagagcgcaagaagttgcggcccaggtggctcgacgcgcggacttacagcgaccccctggccctcagagagttcaaagagtttgccgccgggcgacgttcggtgagcggcgacctaatcctggagatcgggaagctaccacagcatttgacccagcgggcgcagaacgcgctggacaacttggtcatgctgcacaactccgaacagggcggccgcgcctaccggcatgccatggaagaactgcctgacaccatagaaacactgatgttactggcactgatcgcggttctcacgggcggcgtgaccctgttctttctgtcaggtaaggggttaggtaagacttccattggcctgctgtgcgtcatggcctcaagcgtactcttgtggatggcgagtgtggagccccattggatcgccgcctccatcattctggaattcttcctcatggtcctgcttatccccgagccggaccgccagaggacgccccaggacaatcaactcgcgtacgtggtgatcggccttctgttcatgatcctcaccgtcgccgccaacgagatgggcctactggagacgaccaagaaggacctcggcatcggccacgtggccgtggagaaccaccaccacgccgcgatgctggacgtagatcttcaccccgcaagcgcctggaccctatacgcagtggccacgacgatcatcacccctatgatgcggcacactatcgagaataccacggccaacatctctcttaccgccatcgctaaccaggctgcgatcctgatgggactcgacaaagggtggccgatcagtaagatggacataggcgtgcccctgttggcactaggctgttactcccaggtcaaccccctgaccctgaccgccgcagttctcatgctggtggcccactacgcgatcatcggccctggcttgcaggccaaagccacgcgggaggcgcagaaacgtaccgccgcggggattatgaagaaccccacgatcgacggaatcgtcgccatcgacctagaccccgtagtgtacgacgccaagttcgagaagcagctggggcagatcatgctcctcatcctgtgtacctcgcagatcctgctcatgcgcacgacttgggccctgtgcgagtccataacgctggccaccgggcccctaacgaccctgtgggagggtagcccaggaaaattctggaacaccacaatagcggtttccatggccaacatcttccgcggcagctacctcgctggggccgggctcgccttctcactgatgaagtccttagggggcggcaggcgggggacgggcgctcagggggagactctcggcgagaagtggaagcgccagctgaaccaactgagcaagtccgaatttaatacctacaagcggagcgggataatggaggtggacagatccgaggccaaggagggcctgaagcggggtgagacaacgaaacacgccgtgagccgggggaccgctaagctgcggtggtttgtcgagcgcaacctggtaaagcctgagggcaaggtgatcgacctcgggtgcggccgcgggggatggtcctactattgcgcgggcctgaagaaggtcaccgaggttaagggatatacgaagggcggccctgggcatgaggagcccatcccgatggccacgtacggttggaacttggtgaagctgcacagcggcaaggacgtcttcttcatcccgcccgaaaagtgcgacaccctcctgtgcgatatcggagaatctagccccaacccgaccatagaggagggtcggacacttcgggtgctcaaaatggtggagccctggctgcgcggcaatcagttttgcatcaagatcctgaacccttacatgccctccgtcgtcgaaacgctcgagcagatgcagcggaagcacggaggcatgctggtgcgcaacccgctaagcagaaacagcacccacgagatgtattgggtcagctgcggaacagggaatatcgtgtccgccgtaaatatgactagccgcatgctcttgaatcggtttaccatggcccaccgtaagcccacgtacgagcgcgacgtcgacctgggcgcagggacacgtcatgtggcggtggaacccgaggtcgctaacctcgacatcatcggccagagaatagagaacatcaagcacgagcacaaatctacctggcattacgacgaggacaacccctacaagacctgggcgtaccacgggagctacgaggtgaagccgtctggaagcgccagcagtatggtcaacggagtggtgaaattactgacaaagccgtgggacgtcattccgatggtaacccagattgcaatgaccgacaccacgcccttcgggcagcagcgggtatttaaggaaaaggtcgacacccgcaccccgaaggcgaagcggggcacggcacaaataatggtggtgacggcccgctggctctggagcttcctgtcccggaataaaaagcccagaatctgcacccgggaggagttcactcgcaaagtccggagcaacgccgccatcggggcggtgttcgttgacgaaaatcagtggaactcggcgaaggaggccgtcgaggacgatcgcttctgggacctggttcacagggagcgcgagctccacaagcagggcaagtgcgcaacttgcgtgtacaacacgatggggaagcgggaaaagaagctgggcgagttcggcaaggcgaaggggagtcgcgctatctggtacatgtggctaggcgcccggttcctcgaattcgaagccctcgggttcatgaatgaagaccactggttctcccgtgagaacagcctctccggagtcgagggggagggtctccataagttaggctacatcctgcgggatatcagcaagatacccgggggcaacatgtacgccgacgacacagcggggtgggacacgcgaatcaccgagggtgatctccagaacgaggccaagataacggacatcatggagcccgagcacgcgctgctggccaagagcatattcaagctaacctaccagaacaaggtggtaagagtccagagacccgccaagaacggcaccgtgatggacgtgatcagccgcagagaccagcgtgggtccggccaagtcggaacctacgggctgaacacgttcaccaatatggaggcgcagctgatacgccagatggagtcggaaggaatctttagtcccaatgagctcgagacccccaacctcgccgaacgagtgctggactggttggagaagtacggcgtggagcgactgaagcgcatggccatcagcggcgatgactgcgtcgtgaagccgatcgacgaccggttcgcaaccgccctaacggcactcaacgatatggggaaggtgcgcaaggacatcccccagtgggagccgtctaagggctggaacgattggcagcaggtccccttttgcagccaccattttcaccagctcatcatgaaagacgggcgagagattgtggtgccgtgccgcaaccaggacgagttagtcggccgtgcccgcgtgagccagggagccggctggtccctccgtgagaccgcctgcctcggcaagagttacgcccagatgtggcagctgatgtacttccataggcgggacctacgcctagctgccaacgccatctgctccgcggtgcccgttgactgggtgcccaccagccggaccacgtggtccatccacgcgcatcaccagtggatgaccaccgaggacatgctgtctgtgtggaaccgcgtctggatcgaggaaaacccctggatggaggacaagacccgcatctcatcctgggaggacgtgccctatctcggggagcgggaggatcagtggtgtggttccctgatcggtctgacggcccgcgccacctgggccacgaacgtccaggtcgccatcaaccaggtgcggcgcctcatcggcaacgagaactacagcgactacatgaccagcatgaagcggttcaagaacaagagtgaacccgagggggcgctgtggtaa

SEQ ID NO: 24797 - RNA, 9876 nt, synthetic construct
  misc_feature 1..9876: note = derived and/or modified CDS sequence (opt11) from DENV-2__AJ968413__SS-prME
  source 1..9876: mol_type = other RNA
accgcgggtatgatcataatgctgatcccgacagttatggctttccacctgaccacccgaaatggggagcctcatatgatcgtaagccgtcaggagaagggcaagagcctgctattcaagaccgaggacggcgtgaacatgtgcaccctcatggcgatggacctgggggagctgtgcgaggacaccatcacatataagtgccccctgctgcggcagaacgagccggaggacattgattgctggtgcaactccacctcaacctgggtcacctacggcacgtgcaccaccaccggcgaacatcggcgcgagaaacgatcggtcgccctcgtgccccacgtgggcatgggcctcgagacccgcacagagacgtggatgtcgagcgagggcgcctggaagcacgcccaaaggatcgagacgtggatactgcgccacccggggtttaccttgatggccgccatccttgcctataccatcggcactacccatttccagcgggccctaattttcatcctactcaccgccgtggcgccctccatgacaatgcgttgcatcgggatctcgaatcgggacttcgtggagggcgtttccggcgggagctgggtcgacatcgtgctggagcacggctcctgtgtgaccacgatggccaaaaacaagcctacccttgacttcgagttgatcaagaccgaggcgaagcagcttgccacgctgcgcaagtactgtattgaggccaagctcacgaacaccacaacagagtcccggtgtccaacgcagggggagcccagcctgaacgaggagcaggacaagcgcttcgtctgcaaacacagcatggtggacagaggttggggcaacggttgcggcctgttcgggaagggcgggatcgtgacctgtgcgatgttcacgtgcaagaagaacatggagggcaaaatcgtccagcccgagaacctcgagtataccatcgtgatcacgccccactccggtgaagagcacgcggtgggtaacgacaccggcaaacacgggaaggagatcaagatcacgccgcagagctccatcaccgaggccgagctgacaggatacggcacagtcaccatggagtgcagcccgcgcaccggcctggactttaacgagatggtgctcctgcagatggagaacaaggcctggctggtgcaccggcagtggttcttagacttaccactaccctggctccccggcgccgacacccaagggtccaattggattcagaaggagacgctcgtcaccttcaagaacccgcacgcgaagaagcaagacgttgtagtcctgggatcacaggagggggccatgcacaccgccctcacaggggcgacggaaatccagatgagctccggtaatctgctattcaccggccacttgaaatgtcgcctgcggatggataagctccagctcaagggcatgagctactcaatgtgcacagggaagtttaaggtggtcaaggagatcgccgagacccaacacggcacgatcgtggtgcgcgtacagtacgagggggatggcagcccatgcaagatacccttcgaaatcatggacctggaaaagcggcatgttctagggcgcctcatcaccgtgaaccctatcgtaacggagaaggattccccggtcaatatcgaggcggagccgcccttcggggacagctacgtgatcataggcgtcgagcccgggcagctaaagctgaactggttcaaaaagggctccagcattggccagatgttcgagaccacgatgagaggcgctaagcggatggccatcctcggcgacacagcttgggacttcggctccctgggcggcgtgttcacctctatcggcaaggccctgcaccaggtgttcggggcaatctacggcgcggccttctccggggttagctggacgatgaagatcctcatcggggtgataatcacgtggattggcatgaactcgcgtagtacctccctctctgtgtcgctggtcctggtaggggtggtaaccctctacctgggcgtggtggtccaggccgacagcgggtgcgtggtgtcctggaagaacaaagagctgaagtgtggcagcggcatatttataaccgataacgtccacacatggactgagcagtacaagttccagccggagagcccctccaagctcgctagcgccatccagaaggcccaccaggaaggcatatgcggcatccgctccgtgaccagactggagaacctgatgtggaagcagatcacgcccgaactcaatcatatcctgtcggagaacgaggtcaaactgacgatcatgaccggtgacatcaagggcatcatgcatgccgggaagcggtcccttcggccccagccgacagaactgaggtatagctggaagacctggggtaaggccaagatcctgtccacggagagccacaaccagaccttcttgatcgacgggccggagaccgccgagtgccctaacaccaaccgcgcctggaattccctagaggtcgaggactacgggtttggcgtgtttacgaccaacatctggttgaagctcagggagaagcaggacgtgttctgcgacagcaagttaatgtctgcggcaatcaaggacaaccgcgccgtccatgcggacatggggtactggatcgagagcgccctgaatgacacctggaaaatcgagaaggcctcgttcatcgaggtgaagagttgccactggcctaagtcacacaccctctggtcgaacggcgtcctggaatccgagatgatcatccccaaaaacttcgcaggccccgtgtctcaacacaactaccggccaggttaccacacccagacggccgggccgtggcacctgggaaaactcgagatggactttgacttctgtgagggcacgaccgtggtggtcaccgaggactgtgggaaccgcggcccaagcctgcgtacaaccaccgcgtccggcaagttaatcaccgagtggtgctgccgcagctgcacgctgccccccctcagatacaggggggaagacggctgctggtacgggatggagatccggccgctaaaggagaaggaggaaaacctcgtaaactccctggttaccgccggccatgggcagatcgacaacttcagcctgggggtcctcggcatggccttgttcctggaggagatgctccgcaccagggtggggactaagcacgccacgctcctggtggctgtctccttcgtgaccctcatcaccggcaacatgagcttccgcgacctagggcgtgttatggtgatggtgggcgcaacaatgacggatgatatcgggatgggcgtgacctacctggcgctactggccgcgtttaaggtaagacccactttcgcggcaggcctgctcctgcgcaagctgacctctaaggagctaatgatgacgactatcggcgttgtcctgctgagccagtccaccatacccgaaaccatcctcgagctgacggacgccctggccctgggcatgatggtcctgaagatcgtcaggaaaatggagcgctatcagctggctgtaaccatcaccgccatattgtgtgtgcccaacgccgtgatcttgcagaacgcctggaaggtctcctgcacgatcctggccgtggtgtccgttagcccactccttcttacttccagccagcaaaaggctgactggatcccactcgcgctgaccattaaggggctgaaccccaccgccatcttcctcaccacgctgagtcggacatccaagaagcgctcttggcccctgaacgaagccattatggctgtcggcatggtcagcatcctcgcgtccagcctgttaaagaacgacatcccgatgaccggtcctctcgtcgccgggggcctacttaccgtgtgctacgtgctcacggggcggagcgctgaccttgagctggagaaggccgccgacgtacgctgggaggaccaagcggagatctccggcagttccccaatcctcagcatcactatctccgaggacggtagcatgtccatcaagaatgaggaggaagagcagacgctgaccatactcatccggacaggcctactagtgatcagcggcttattcccggtgtccatcccgatcacggccgccgcctggtatctctgggaagtcaagaagcagcgagccggtgtgctttgggacgttccctccccgccgcctgtcggcaaggcagagctggaagatggggcataccggatcaagcaaaagggcatcctcgggtacagtcagatcggagcaggggtgtacaaggaggggaccttccacaccatgtggcacgtgacacgaggcgcggtcctgatgcacaaggggaagcggatcgagccaagctgggccgatgtgaagaaggacctgatcagttacggagggggctggaagctcgagggcgagtggaaggagggggaagaggtgcaggtccttgcgctggagcccggcaagaacccccgcgccgtgcagacaaaacctggcctcttcaagacaaacaccggtaccatcggggcagtgagcctggacttctcccctggcacgagcggctcccccatcatcgacaaaaaggggaaggtggtgggcctgtacggtaatggagtggtcacccggaatggcgcctacgtgtcggccatagcccagaccgagaaatccatcgaagacaacccggagatcgaggacgatatattccgcaagaagaggctgaccatcatggacctccaccctggagccggcaagacgaagaggtatctgcccgccatcgttagggaggccatcaagcgcgggctgcgtaccctcattctcgcgcccacaagggtcgtggccgccgagatggaggaggccctgagaggcctgccaatacggtatcagacccccgccatccgcgcagagcacacgggtcgggaaatcgtcgatctcatgtgccacgccaccttcaccatgcgcctgctcagccccgtacgtgtgcccaattataacctgatcatcatggatgaggcccacttcactgacccagcctcgatcgccgcacggggctatatcagtacgcgggtggagatgggggaggccgccgggatcttcatgaccgccacgccgcccggcagcagagaccccttcccgcagtccaacgcccccatcatggacgaggaacgggagatacccgaacgcagctggaactccgggcacgaatgggtcaccgatttcaagggtaagacggtgtggttcgtaccatcaatcaaagctgggaacgacatagccgcctgcctacggaagaatggcaagaaggtaatccaattgtcccgaaagactttcgacagcgagtacgttaagacccggacaaacgactgggacttcgtggtcacgaccgacatctccgagatgggcgccaacttcaaagcggagcgcgtgattgacccgcggaggtgcatgaagcccgtaatcctgaccgacggggaggagcgggtcatcctggccggccccatgcccgtgacccactcctccgccgcccagcgccggggacgcatcggccgcaatccaaagaacgagaacgaccaatatatctacatgggggagccactagagaacgacgaggactgcgcccactggaaggaggcgaagatgctgctggacaacatcaacacgcctgaagggattattcctagcatgttcgaaccggagcgggagaaagtggacgccatagacggcgaatatcgccttcgcggggaagcccgcaagaccttcgttgacctgatgcggcgcggcgatttaccggtgtggctcgcctacaaggtcgccgcggaggggatcaattacgccgaccggcggtggtgcttcgacggcatccggaataaccaaatcctcgaggagaacgtggaggtggagatctggaccaaggagggggagcgcaagaagctgaaaccccggtggctagacgctaggatctactccgacccgctggcccttaaggagttcaaggagttcgccgcaggccgcaagagcctcaccctgaacctgatcaccgagatgggccgcctccccacctttatgacccagaaggcccgggacgccctggacaatctggccgttctccacaccgcggaagccgggggccgagcctataatcatgcgctgtctgagttacccgagacgctcgaaacccttctgcttctgaccctgctcgccacggtgaccgggggcatcttcctcttcctaatgagcggtcggggtatcggcaagatgacgctcggaatgtgctgcatcatcaccgcgtccatactgctgtggtacgcgcagatccagccccactggatcgccgcaagcataatcttagagttcttcttgattgtgctgctcatcccggagcccgagaagcaacgcacgccgcaggataaccagctgacgtatgtcgtgatcgccatcctgactgtggtcgcggccacaatggccaacgagatgggcttcctcgagaagacgaaaaaagatctggggctgggcagtataaccacgcagcagcccgagtcgaacatactcgacattgacctgcgcccggccagcgcctggacattgtacgccgtggccaccacctttgtgaccccgatgctcaggcacagtatcgagaacagctccgtcaacgtgagcctgaccgccatcgccaatcaggccaccgtgctgatgggcctggggaagggctggcccctttcgaaaatggacatcggggtccctctgctcgcgatcggctgctacagccaggtgaatccgatcaccctaacggcggccctgctcctactggtggcacattacgcgatcatcggaccagggttacaggccaaggccaccagagaagcccagaagcgcgccgccgccgggatcatgaagaaccccacagttgatgggataactgtgatcgacctggaccccatcccgtacgatccaaagtttgagaagcagctcggccaggtgatgctcctcgttctgtgcgtgacccaggtgttgatgatgcgcacgacctgggccctgtgcgaggcgctcaccctcgccacgggcccgatatccacgctgtgggaggggaaccccgggcggttctggaacacaaccatcgccgtcagcatggcaaacatcttccgaggctcgtacctggccggcgccgggctcctgttctctataatgaagaacactaccaacacccggcgcggcacagggaatatcggcgagacgctgggcgagaaatggaagaaccggttaaacgctctggggaagtccgaatttcagatttacaagaagtccggcatccaagaggtggaccgcaccctggccaaggaggggattaaaaggggagaaaccgaccaccacgctgtctcccgcggtagcgctaaactccggtggttcgtggagcgcaacatggtcacaccggagggcaaagtggtcgacctgggctgtggtaggggcgggtggtcttattactgcggtgggctaaaaaatgtgcgcgaggtgaagggcctcacgaagggtggacccggccacgaagagcccatccccatgagcacctacggctggaacctggtccggctgcagtccggcgtggacgtgttcttcactccgcccgagaaatgcgacaccctgctatgcgacatcggagagagctccccgaaccccaccgtggaggcgggtcgaacgctgcgggttctcaatctggtggagaactggctgaacaacaatatccaattctgcatcaaagtcttgaacccgtacatgccatcagttatcgagaagatggaggcactccaacgcaaatacggcggcgccctggtgagaaaccccctgagccgcaactccacgcacgagatgtactgggtcagcaacgcatccggaaacatcgtgagctccgtaaacatgatcagccggatgctcatcaatcgcttcaccatgaagcacaaaaaggccacctacgagccggacgtcgacctggggtccggaacgcgcaacattgggatcgagtcggaggtgccgaacctcgacatcatcggcaagcgaatcgagaagatcaagcaagagcacgaaacctcctggcactacgaccaagaccacccctacaagacctgggcctaccacggcagctacgagactaagcagacggggtccgcgagtagcatggttaacggcgtcgtaagacttctgaccaagccctgggatgtggtcccgatggtgacacagatggctatgactgacaccacccccttcgggcagcagcgggtcttcaaggagaaagtggacacgaggacccaggaaccgaaggagggaactaagaagctgatgaaaataaccgccgaatggctctggaaagaacttggcaagaagaagactccccggatgtgcacccgcgaggagtttacgaggaaggtgcgcagcaacgcagccttaggggccattttcaccgacgagaacaagtggaaatccgcacgtgaagccgtagaagattcccggttctggggattggtcgacaaagagcggaacctgcacttggagggaaagtgcgagacctgcgtgtacaacatgatgggcaagcgcgagaaaaagctcggggagttcggcaaggcaaagggctcccgtgccatctggtacatgtggctgggggcacgattcttagagttcgaggctctaggtttcctgaacgaggatcattggttcagtcgcgaaaactccctaagcggcgtcgaaggcgagggcctccacaagcttggctacatcctgcgcgacgtcagcaaaaaggagggcggggctatgtacgccgacgataccgcgggctgggacacgcggatcaccctagaggacctgaagaacgaggaaatggtgaccaatcatatggagggtgagcacaaaaagctggccgaggctatcttcaagctaacctaccagaacaaagtcgtgagagtgcagcggccgacgccccgcggcacagtcatggacattatctcccgtcgcgaccagcgcggatcgggccaggtgggtacttacgggctgaacacattcacgaacatggaggcccagctgattcgccagatggaaggcgagggtgtgttcaagtccatacagcacctcaccgtgaccgaggagatcgcggtgcagaactggcttgcgcgcgtgggccgggagcgcctgagccggatggcgatcagcggcgacgattgtgtcgtgaaacccctcgacgaccgcttcgccagcgccctgaccgccctgaacgacatggggaaggtgcggaaggatatccagcagtgggagccctcccgcggctggaacgactggactcaggtcccgttttgctcacaccacttccacgagctcatcatgaaagacgggcgggtgctggtggtcccctgcagaaaccaggacgagctgataggacgtgcgcgcatctcccagggggccgggtggagcctacgggagaccgcctgcttgggtaagtcctacgcccagatgtggagccttatgtactttcaccgccgggacctgcgcctggccgcgaatgccatctgctccgcagtgccaagccattgggtgcctacgtctcggaccacctggagcatacatgccaagcatgaatggatgacaactgaggacatgctgaccgtctggaaccgcgtgtggatacaggagaacccgtggatggaggacaagacccccgtggagtcttgggaggagatcccctacctcgggaaacgcgaggaccagtggtgtggcagcctgatcggcctgacgagcagagcaacatgggcgaagaacatacaaaccgctattaatcaggtcaggtccctcatcggcaacgaggagtacaccgactacatgcccagcatgaagcggttccgccgcgaggaagaggaagccggggtgttatggtag

SEQ ID NO: 24798 - RNA, 9876 nt, synthetic construct
  misc_feature 1..9876: note = derived and/or modified CDS sequence (opt11) from DENV-2__AB543624__SS-prME
  source 1..9876: mol_type = other RNA
agcgcggggatgatcatcatgctgatccccaccgtgatggccttccacttaaccacccgcaatggggagccgcacatgatcgtgggcatccaggaaaagggcaagagcctgctgttcaagaccgaggacggcgttaatatgtgcaccctcatggcgatggatctgggggagctgtgcgaggacaccatcacctacaaatgccccctcctgcggcagaatgaacctgaggacatagactgctggtgtaacagcacctctacctgggtgacctacggaacctgcacgaccaccggcgaacaccgccgggagaagcgctcggtcgccctggtgccccacgtggggatgggcctcgagacccggaccgagacctggatgtccagcgagggggcctggaagcacgcccaacgcatcgagacctggatccttcggcaccctgggttcacgattatggccgcaatcctggcatacaccatcgggactacgcatttccaacgcgtcctcatcttcatattgctgacggccgtggccccaagcatgaccatgcggtgtatcggcataagcaacagggacttcgtggaaggcgtctccggcgggagctgggtcgacatcgtgctcgagcatgggtcctgcgttaccaccatggcgaagaacaagcccacgttggacttcgagctgataaagacagaggcgaagcagcccgccaccctaaggaagtactgcatcgaggccaagctgaccaacaccaccaccgagagccgctgcccaacccaaggggagccgtcccttaaggaggagcaggacaagcggttcgtatgcaagcatagcatggtggaccgcggttgggggaacggctgcggcctgttcggcaagggcgggatcgtcacttgtgctatgttcacatgcaagaagaacatggagggtaagattgtacagcccgagaacttggagtacaccatagtggtcacaccccactccggcgaagaacacgcggtgggcaacgacacagggaagcacggcaaggagatcaaggtcactccgcagagctcgatcaccgaggccgagcttatcgggtacggcaccgtcacgatggagtgcagcccccggaccggcctcgacttcaacgagatggtgctgctgcagatggaaaataaggcctggctcgtgcaccgccagtggttcctcgacctgcccctgccctggctgccgggagctgacaaacaggagtccaattggatccagaaagagaccttggtaacgttcaagaacccccacgctaaaaagcaggacgttgtcgtcctcggcagccccgagggggcgatgcacaccgcacttacgggcgccacagagatccagatgagcagcggaaatctccttttcaccggccaccttaaatgccggctgaggatggacaaacttcaactgaagggcatgagctactccatgtgcaccgggaagttcaaggttgtcaaggagatcgccgagacgcagcatggcactatcgtgatccgggtgcagtatgagggggacggcagcccctgcaaaattccgttcgagatcatggacctggagaagcgctacgtcctcggccggttgatcaccgtgaatcctatcgtgacggagaaggacaaccccgtaaatatagaggcagagcccccgttcggggattcctacatcatcatcggcgtggaacccggacaacttaagctcaattggttcaaaaagggcagcagtatcggacagatgttcgagacgaccatgcgcggtgcgaagcgcatggccattctgggcgacaccgcctgggacttcgggagcttgggcggcgtgttcacctccatcggcaaagccctccatcaggtcttcggggccatctatggcgcggcctttagcggcgtgtcctggacgatgaagatcctgatcggggtgatcattacctggataggaatgaacagccggtccaccagcctatccgtctcactggtgttggtggggatcgtcaccttgtacctgggcgtgatggtgcaggcagactccgggtgtgtggtgtcctggaagaataaggagctcaagtgcggttccggcatctttatcacggacaatgtacacacctggaccgagcagtacaagtttcagcccgagagtcccagcaagctggcctccgctattcaaaaggcccaggaggaggggatctgcggaatacgcagcgtcacccggctggagaacctcatgtggaaacaaatcgccccggagctgaaccacatcctggccgagaacgaggtgaagctcacgattatgaccggtgatatcaagggaatcatgcaggccgggaagcgctctttgcggccccagcccaccgagttgaagtacagctggaagacctggggcaaggcgaaaatgctgagtacggagagctataatcaaaccttcctgatcgacggcccggagactgccgaatgtcccaacaccaacagggcctggaactccctggaggtggaggactacgggttcggcgtcttcacgaccaatatctggctcaaattgaaggagaggcaggacgctttctgtgacagcaaactgatgtccgcagccatcaaggataaccgagccgtgcacgcggacatggggtactggatcgaaagcgcgctcaacgacacctggaagatcgagaaggcttccttcatcgaggtcaagaactgccactggcccaagtcacacaccctgtggtccaatggcgtcctggagagcgagatgatcattcccaagaacctcgcgggccccgtgtcccagcacaactaccggcccgggtaccacacccagatcgcgggcccctggcacctggggaaactggaaatggactttgacttctgcgacggcaccacagtgatcgtcaccgaagattgcgggaaccgtggccccagcctccggaccacgactgcctcggggaaacttatcacagagtggtgctgcaggagctgcaccctgccgcccctacggtatagaggggaggacggctgctggtacgggatggagatccggcccctgaaggagaaggaggagaacctggtgaatagcctcgtaacggccggccacgggcaggttgataacttctcgctgggcgttctcggcatggccctgttccttgaagagatgcttcgcacccgggtggggacaaagcacgccatcctcctggtcgccgtgagcttcgtgaccctgatcacgggcaacatgtccttcaaggacctagggagagtcgtggtaatggtaggcgccaccatggccgacgacatcgggatgggcgtgacctacttagctctgctcgccgccttcaaggtgcgtcccaccttcgccgccggccttctgctccgcaagctgacttccaaggagcttatgatgaccaccatcggaatcgtcctcctgtcccagagcacgatcccggagaccgttctggagttaaccgacgcgctggccctggggatgatggtgctcaagattgtacgaaacatggagaagtaccagttggcggtgaccattatggcgattctgtgtgtcccaaacgccgtgatcctccagaacgcgtggaaggtgtcctgtaccatcctcgccgtagtgagtgtgagccccctgctcctgacatcatcccagcagaagaccgactggatccccctggcattgactatcaaggggttaaacccgactgccatattcctgacgaccctcagtcggaccaataagaagcgatcctggcccctgaatgaggcgatcatggccgtaggaatggtgagcatcttggcctctagcctcctgaagaacgacatccccatgaccggccccttagtggccggtggcctcctgacggtctgctacgtattgaccgggcgatccgccgacctcgagctggagcgtgcgaccgatgtgaagtgggaggatcaggccgagatctctggctcgagccccattctgagcatcactatctcggaggacggtagcatgagtatcaagaatgaggaggaggagcagacgctcaccatcctgatccggacaggcttactcgtcatcagcgggttgttccctatctccatccccatcaccgcggccgcctggtacctgtgggaggtaaagaagcagcgcgcaggggttctctgggacgttcccagccctccgccgatgggcaaagccgagctggaggacggggcctacaggatcaagcagaagggcatcctggggtactcccagattggcgccggcgtatacaaggaggggacgttccacaccatgtggcacgtgaccaggggcgccgtcctcatgcacaaggggaaacggattgagccgtcttgggcggacgtgaagaaagacctgatctcctacggcggaggctggaaactggagggggaatggaaggagggggaagaagtacaggtgttggccctggaacccggcaagaatccccgcgccgtacagaccaagcccggcctgttcaagactaataacggcacgataggagccgtgagcctcgacttctccccgggcaccagcggatcccctatcatcgacaagaaggggaaagttgtgggtctgtatgggaacggggtggtcactcggagcggtgcctacgtgtccgcgattgcccagaccgagaaatccatcgaggacaaccccgagatcgaggatgacatcttccgcaagagacgactcacgatcatggacttacaccccggggccggtaagaccaagcggtacctcccagccatcgtgcgggaggcaatcaagcgggggctgagaactcttatcctcgcccccacccgggtcgtggcagctgagatggaggaggccctgcgtggcctacccatccggtaccagacgccggcgatccgcgccgagcataccgggcgcgagattgtcgacctcatgtgccacgccacctttaccatgcggctgctgtccccggtccgcgtgcccaactacaacctcatcatcatggacgaggcccacttcacagacccggccagtatcgcagcccggggctacatctccactcgcgtggagatgggcgaagcggccggtatcttcatgactgccacgccgcccggcagccgggatccattcccccagagcaatgcgccgatcattgacgaggagcgcgagatccccgagcgatcctggaactcggggcacgagtgggtaacggacttcaagggcaagacggtgtggttcgtcccctccatcaaggccgggaacgacatcgccgcctgcctacgcaagaacggcaaaaaggtcatccagctgtcgcggaagaccttcgactccgagtacgtgaagacccgtacgaacgactgggacttcgtggtgaccaccgacatcagcgagatgggcgcgaacttcaaggctgaacgggtaattgatccccgccgttgcatgaagcccgtcatcctcaccgacggggaggagcgcgtcatactggccggaccgatgccggtaacccactccagcgccgcccagcgccgcgggcggatcggccgcaatcccaagaacgaaaacgaccaatacatatacatgggcgagccgctggagaacgacgaggactgcgcgcactggaaggaggccaaaatgctcctggacaacatcaatacccctgagggcatcatcccctccatgtttgaacccgagcgggagaaggtggacgccatcgacggcgagtaccgcctgcgcggggaggcgcggaagacattcgtcgaccttatgcgccggggcgacctgccggtgtggctggcctataaggtggctgccgaggggatcaactacgcggacaggcgttggtgctttgacggcatcaaaaacaaccagatcctcgaggaaaacgtcgaggtggagatctggaccaaagaaggggagcgcaagaaactgaagccgcggtggctggacgcccgcatctacagcgacccactcgcccttaaggagttcaaggagttcgcagccgggcgtaagtccctgacgctcaacctaatcaccgagatgggccgcctgcccaccttcatgacccagaagacacgcgacgccttggacaacctggccgtcctgcacacggccgaggccgggggccgcgcctacaaccacgctctcagcgagctgccggagaccctggagaccctcctgctgctcacgctgttggctaccgtgaccggcggcatcttcctattcctgatgtccgggcggggtatcggaaagatgactctggggatgtgctgcatcatcaccgcgagcatcctcctgtggtacgcccagatccagccccactggatcgccgccagtataatattagagttcttccttatcgtactgctgatacccgaacccgagaagcagcgcaccccgcaggacaatcaactcacgtacgtcgtgatcgctatcctgaccgtggtcgcggccaccatggcaaacgaaatgggcttcttagagaagacgaagaaggacctcggacttggcagcatcgccacccagcaccccgagtccaacatcttagacatcgacctacggcccgcctctgcgtggaccctgtacgcggtggccaccacgttcatcaccccgatgctgcgccactccatagaaaatagtagcgtgaacgtttccctcaccgccatcgctaaccaggcgaccgtcctgatgggtctggggaagggctggccgctcagcaagatggacattggggtgcccttgctggccatcggctgctactcccaggtcaaccccatcacgctcaccgccgctctactgctcctggtggcgcactatgccatcatcgggcccggtcttcaggctaaggcaacccgggaggcacagaagcgggcggccgccggcatcatgaagaacccgaccgtggacgggatcacggtcattgacctggaccccattccctacgacccgaagtttgagaaacagctgggacaggtgatgctgctcatcttatgcgtgacccaggtcctgatgatgcggaccacgtgggccctctgcgaggccctgaccctagctaccgggccaattagccccttatgggagggcaaccccggcagattttggaataccacaatcgccgtgtccatggccaacatttttagaggcagctatctggctggggctgggctcctcttctccatcatgaaaaacacgaccaacacccgccgcggcaccggcaatatcggcgagacgctgggcgagaagtggaaatcccgtctgaacgcgctcggaaagagcgagttccagatctacaaaaagtctggcatccaggaggtggatcgtaccctggccaaagaggggatcaagcggggtgagaccgaccatcacgcagtcagccgcgggagcgccaagctgcggtggttcgtggagcgcaacatggtgacgcccgagggcaaggtcgttgacctcggctgtgggcggggcggctggtcctactactgcggcgggttgaagaacgtgcgagaagtcaagggactgacgaagggcgggccgggtcacgaggagcccattcccatgagtacctacgggtggaacctcgtccggctgcagagtggcgtggacgtcttcttcatacctcccgagaagtgcgatacactgctatgcgacattggcgagagctcccccaaccccaccgtggaggccggacggacgcttcgcgttctgaacctcgtggagaactggctcaacaaccacacccacttctgcatcaaggttctgaacccgtacatgccttccgtgctggagaagatggaggccctccaacgcaagtacggaggggccctagtccggaaccccctgtcccgcaacagcacccacgagatgtactgggttagcaacgcctcaggcaacatcgtcagctccgtcaacatgattagccggatgctcattaatcgcttcaccatgcggcacaagaaggccacgtacgagccagacgtggacctggggagtggtacccgcaacatagggatcgagagcgagataccgaatttggacatcatcggcaagcgtatcgaaaagatcaagcaggagcacgaaacctcctggcactacgaccaggaccacccatacaagacctgggcgtaccatggcagctacgagaccaagcagacgggttccgccagctccatggtgaacggcgtcgtgcgcctcctgaccaagccctgggatgtactgcccaccgtcacccagatggccatgacggacaccacccctttcgggcagcagcgcgtgttcaaggagaaggtggacacccggacgcaagagcccaaggaaggcacgaaaaagctcatgaagatcacggccgagtggctgtggaaggagctgggaaagaagaaaacgccgcgcatgtgcacgcgggaggagttcacccgcaaggttcggagcaacgccgcgctcggggccatcttcaccgacgaaaacaaatggaagtccgcccgcgaggccgtggaggacagccggttttgggagctggtggacaaggagcgcaacctgcacctcgagggcaagtgcgagacctgcgtatacaacatgatggggaagcgggagaagaagctgggcgagttcgggaaagcgaaaggctcccgcgcgatctggtacatgtggctgggcgcccggttcttggagttcgaggccctggggttcctgaacgaggaccactggttcagtcgcgagaactctctctccggcgtggagggggagggccttcacaagctggggtacatcttgcgggacgtctccaaaaaggagggcggcgccatgtacgcggacgacactgccggttgggacacccgcataaccctagaggacctgaagaacgaggagatggtaaccaaccacatggagggcgagcacaagaagctcgccgaagccatcttcaagctgacgtaccagaacaaggtggtccgggtacaacgccccaccccgcgggggactgtcatggacatcatcagccgcagggaccagcgcggctcaggacaggtaggcacctacggcctgaacacgttcaccaacatggaggcgcaactcatccggcagatggaaggggagggtgtgttcaagaacatccagcgcttgaccgtgacagaggaggtcgctgtgcacaactggctggcgcgcgtggggagggagcgcctctcccggatggccatcagcggcgacgactgcgtcgtgaagccgttagacgaccgctttgccaacgccctgacggcgctcaacgatatgggcaagatccgcaaagacatccagcagtgggagccgtccaaagggtggaacgactggacccaagtgcccttctgcagccaccatttccacgaattgattatgaaggacggccgcgtcctagtggtaccgtgtagaaaccaggacgagctcatcgggcgcgcccggatcagccagggcgccgggtggagcctgcgagagaccgcctgcctcggcaagtcgtacgcccagatgtggagcctcatgtatttccatcggagggacctgcggctggcggccaatgccatctgctccgctgtccccagccactgggttcccacctcccgcacgacctggtccattcacgcaaagcacgagtggatgacgaccgaggatatgctcacggtgtggaaccgggtctggattcgcgagaacccctggatggaggacaaaaccccggtggaatcctgggaggagataccgtacttaggcaagcgggaagaccagtggtgcgggagcctgattggcctcacctcccgcgcgacctgggctaagaacatccaggccgccatcaaccaggtgcgaagcctgatcgggaatgaggagtataccgactacatgccctccatgaagcgcttccgccgggaggaagaggaggccggcgtcctatggtga

SEQ ID NO: 24799 - RNA, 9876 nt, synthetic construct
  misc_feature 1..9876: note = derived and/or modified CDS sequence (opt11) from DENV-2__AB189122__SS-prME
  source 1..9876: mol_type = other RNA
acggcgggcgtgatcatcatgatgatccccaccgtgatggcgttccatctgaccacccgcaatggggagccccacatgatcgtgtcgcggcaggagaagggtaagtcccttttgtttaagaccgagaatggggtgaacatgtgtaccctaatggccatggatctcggcgagttgtgcgaggacactatcacctacaactgcccactgctccgccagaacgagcccgaggacatcgactgctggtgcaacagcacctccacctgggtcacttacggtacttgtaccgccaccggcgaacatcggcgcgagaagcggagcgtggccctggcaccccacgttggaatggggctggagactcgcactgagacctggatgagtagcgagggggcttggaagcacgcgcaacggatcgagacctgggtcttaagacatccgggcttcacgatcatggccgccatcttggcctacaccattggcaccacgtacttccagcgtgtgctgatcttcatcctcctgacggcggttgcaccctccatgacaatgcgctgcatagggatctccaatcgggatttcgttgagggcgtgtccggcgggtcctgggttgacatcgtactggagcatggctcatgcgtgaccaccatggcgaagaacaaaccaacgctcgacttcgagctgatcaagaccgaggccaaacaccccgccaccctgcgaaagtactgcatcgaggcgaagcttactaacacgacgaccgccagccgttgcccaacccagggggaaccgtccctgaacgaggagcaggataagcgcttcgtatgcaagcatagcatggtcgaccggggctggggcaacgggtgcgggctgttcgggaaaggcgggatcgtcacgtgcgccatgttcacgtgcaagaagaacatggaaggtaaggtcgtccaaccggagaacctcgagtacacgatcgtaatcaccccccactcaggcgaggagaatgccgtggggaacgacaccggcaagcacgggaaggagatcaaggtaacgccgcagagctccatcaccgaggccgagctgaccggctacggtaccgtgactatggaatgctccccccgaaccgggctggactttaatgagatggtgctcctgcagatggagaacaaagcgtggctggtccaccggcagtggttcctcgatctgcccctgccatggctgccaggcgccgacacccagggatccaactggatccaaaaggagaccttggtcaccttcaaaaaccctcacgccaagaagcaagacgtagtggtcctgggaagccaggagggtgctatgcacacggcccttaccggcgcgaccgagatccaaatgagcagtgggaacctgctgttcacgggccatttgaaatgtcgcttacggatggacaaactgcagctcaagggcatgtcttactccatgtgcaccgggaagttcaaggtcgttaaggaaatcgccgagacccaacatggcaccatcgtaatccgcgtccaatacgagggggacggcagcccctgcaaaatccccttcgaaatcatggacttagagaagcgacacgtgctggggcggctcatcacggttaatcctatcgtcaccgaaaaagattcccccgtaaatatcgaggccgaaccgcccttcggtgactcatacatcatcataggcgttgagcctgggcagctgaaactgaactggttcaagaagggctccagcattgggcagatgttcgagactaccatgcgcggcgccaagcggatggcgatcttaggcgacactgcctgggacttcgggtccctcggcggggtctttacctccatcgggaaggctctgcatcaggtctttggtgctatctacggcgccgcgtttagcggcgtgagctggaccatgaagatcctgatcggggtcgtgatcacctggatcggaatgaactccagaagcacgtccctgagcgtgtcgctggtcctggtgggggtggttaccctctaccttggtgtgatggtgcaggcggactccgggtgcgtcgtctcctggaagaacaaggagctgaagtgcggctcgggcattttcatcaccgacaacgtacacacttggacggagcaatacaaattccagcccgagtctccctccaaattggccagcgccattcagaaggcccacgaggaggggatctgcggaatcagatccgtcacccggctggagaacctgatgtggaagcagatcactccagagctcaaccacatcctctcagagaacgaggtgaagctaaccatcatgacgggggacattaagggcatcatgcaggcggggaagagatccctccgaccgcagcccaccgagctgaagtacagctggaaggcatggggcaaggccaagatgctttcgaccgaactccacaaccacacattcctgattgacggccccgaaactgccgagtgcccgaacaccaaccgagcctggaacagcttagaggtagaggactacggcttcggcgtcttcaccactaacatatggctaaagctgaaggagcgccaggacgtcttctgtgactccaagctgatgagcgcggcaataaaggacaaccgggccgtgcacgcagacatggggtactggattgagagtgccctcaacgacacgtggaagatcgaaaaagctagcttcatcgaggttaagtcctgccactggcccaagagccacaccttatggtcgaacggcgtgctcgagagcgagatgattatcccgaagaacttcgcaggtcccgtgtcccagcataactaccgcccggggtaccacacccagaccgccggcccctggcatctcggtaagctggagatggacttcgacttttgtgagggaacgacggtcgttgtgaccgaggactgtgggaaccggggccccagcctgcgcaccaccacggccagcgggaagctgatcaccgagtggtgttgccggtcctgtaccctgcccccgctgcgttacaggggagaagacggctgttggtatggtatggagatacgccccttgaaggagaaggaagagaacttggtcaatagcctggttactgctggccatgggcagatcgataacttctccctcggcgtgctcggcatggcgctgttccttgaagagatgctgcggacaagggtcgggaccaagcatgccatcctgctagtggccgttagcttcgtcacgctgatcaccggcaatatgtccttcagagacctggggcgcgtgatggtgatggtcggcgccacgatgaccgacgacatcgggatgggtgtgacctacctcgcgctgctggctgccttcaaggttcgtcccacctttgccgcgggcctcctgctgcggaagttgacgagcaaggaactgatgatgacaaccatcgggatcgtcttactctcccaaagcaccatccccgagacgatcctggagctgaccgacgcgctcgccctcgggatgatggtgctgaagatcgttcgtaacatggagaagtaccaactcgcagtgaccatcatggcaatcctgtgcgtgccgaacgctgtcatcttacagaacgcttggaaggtgtcctgcacgacgctcgccgtggtctcagtgagcccccttcttttaacctcgtcccaacaaaaggccgattggatccccctggccctgaccattaaaggcctcaaccccacagcgatcttcctgactacccttagccggacctccaagaagaggtcatggccgctcaacgaggcgatcatggccgtgggcatggtctcaatcctagcaagctcccttctcaagaacgacatacccatgaccggccccctggtggccgggggcctgcttaccgtgtgctacgtgttaaccgggagaagcgcggaccttgagctcgagcgcgccgccgacgtgcggtgggaggagcaggccgagattagcggctccagccccatactgtccatcactatctctgaggacgggtccatgagcatcaagaacgaggaggaggagcagaccctgacgatcttgattcgcaccggcctactggtcatctccggtctcttccctgtctcgatccccatcaccgccgcggcctggtacctgtgggaagtgaagaaacagcgggccggggtgctttgggacgtcccctcgccgccgccagtgggcaaggctgagctcgaggacggggcctacagaatcaagcagaagggaatactggggtacagccagatcggggtgggcgtttacaaggaggggaccttccacaccatgtggcacgtgactcggggcgcggtgctgatgcataaagggaaacgcatagagccctcctgggccgacgtgaagaaagacctcatctcttacggcgggggctggaagctggagggagagtggaaggagggggaagaagtccaggtgctggccctggaacccggcaagaatccccgggcagtccaaacgaagccggggctcttcaagaccaacaccggcacgatcggggccgtgtcgcttgacttcagtcccggcacctccggtagccccattgtggacaaaaaggggaaggtggtgggcctttacgggaatggcgtggtcacccgctccggcacctacgtgagcgccatcgcgcagacggaaaagaacattgaggacaatcccgagatcgaggacgacatcttccggaagaagcgcctgaccataatggatctgcaccccggggccggcaagaccaagaggtacctgcccgctatcgtgcgggaggcgatcaagcgagggctccgcaccttaattctggccccgacacgggtcgttgctgccgagatggaggaggccctccgcggactgccgatacggtaccagactcccgcgatacgggccgaacacaccgggcgcgagatcgtggacctgatgtgccacgccaccttcacgatgcgactcctgtcccccatacgcgtcccaaactataacctgatcatcatggatgaggcccattttacagaccccgccagtatcgcggcccggggctacatcagcacccgtgtggagatgggtgaggccgctggcatcttcatgactgcaacgcctcccggctcccgggacccgttcccccagagcaacgcgcccattatggacgaggaacgcgaaatccccgagcgatcttggaattccgggcacgagtgggtgaccgactttaagggcaagacagtctggttcgtgccctccatcaaagcagggaacgacatcgcggcctgcctccgtaagaacggcaagaaggtgatccagctgagccggaagacctttgatagtgaatacatcaagacgcgcaccaatgactgggacttcgtcgtaaccaccgacatctcagagatgggcgcgaactttaaggcagagcgagtgatcgatccccgccggtgcatgaagcccgtcatcctgacggacggggaggagcgcgtaatcctcgccggccccatgccggtgacccactccagtgccgcccagcggcgcggcagagtcggtcgcaaccccaagaatgaaaacgaccagtacatctacatgggagagcccttagagaacgacgaggactgtgctcattggaaggaggccaagatgctactcgacaacatcaacacgcccgagggcatcatcccctccatgtttgagcccgagcgcgagaaggtggacgctatcgacggcgagtaccgcctgcgcggggaagccaggaagaccttcgtcgacctgatgagacggggggacctccccgtgtggttggcctaccgcgtggctgccgaggggatcaactacgccgataggcgctggtgcttcgacggcgtcaaaaacaaccagatcctggaggagaacgttgaagtggagatctggacgaaagagggtgagcggaagaagctcaagccacgctggcttgacgcccgtatctacagcgaccccctagctttaaaggagttcaaggagtttgccgccggaagaaagtccctgaccctaaatctcatcaccgaaatgggccggctacccaccttcatgacgcaaaaggcccgcaacgccctggataacctcgcggtcctgcacactgccgaggccggaggccgggcctacaaccatgcactgtcagaactccccgaaaccctggagaccctgctcctgctgacactcctggcgaccgtaaccgggggtattttccttttccttatgtccggaaagggcatcgggaagatgaccctggggatgtgctgcattatcaccgctagcgtgctgctgtggtatgcccagatccagccgcattggatcgccgcctccatcatactggagttcttcctaatcgtcctcctgatacccgaacccgaaaagcagcgcacgccccaggataatcagctcacctatgtggtgatcgcgatcctcaccgtagtcgccgcgaccatggccaacgagatgggctttctggagaagacgaagaaggacttcggactgggctccatcgccacccaacagccggagtccaacattttagatatagacctgcgtccggctagcgcctggaccctctacgccgtagccaccacgttcatcacgcccatgctccgccacagcattgagaactcaagcgttaacgtcagtctaactgccatcgccaaccaggccacggtcctgatgggcctcgggaagggatggcccctcagcaaaatggacatcggggttccgctgctggcaatcggctgttactcccaggtgaaccctatcacactgaccgccgcgctcctccttctggttgcccactacgccattatcggacccggcctccaggcaaaggcaacgagggaggcacagaagcgtgccgccgccggaatcatgaagaaccccaccgtcgacgggatcaccgtgatcgacctagacccgatcccctacgacccgaagttcgaaaagcagctggggcaggtgatgctactggttctgtgcgtcacccaggtgcttatgatgcgaaccacctgggccctgtgcgaagcgctaacgctcgccaccgggcccatcagcaccctgtgggaggggaatccggggcgtttctggaatactacgatcgctgtctcaatggccaacatctttaggggctcttacctggctggcgcgggcctcctgttttccattatgaagaacaccgcaaatacccggcgcggcaccgggaacacgggcgagactctgggcgagaagtggaaaaaccggctcaacgccttagggaagtccgagttccaggtgtacaagaagtcggggatacaagaggtggaccggacccttgcgaaggaggggatcgagcggggtgagaccgaccaccacgcggtaagccgcggctccgccaagctccggtggttcgtcgaacgcaacctggtaacgccggagggcaaagtcgtggacctgggctgcgggcggggagggtggagctactactgcggggggttaaagaacgtgaaggaagtcaagggcctaaccaagggcggtcccggacacgaggagcccatcccgatgtccacctacggatggaacctggtgcgcctgcagtcaggcgtggacgtcttcttcaccccgcccgagaagtgcgacacgctgttatgcgacatcggggagtccagccccaacccgactgtagaggccggccggacgctccgcgtgctgaacctggtcgagaactggctcaacaataacacccagttctgcattaaggtgctgaatccctacatgccctccgtgatcgaaaagatggaggccctgcagcggaagtatggcggggcgctggtcagaaacccgctcagtcggaacagcacccacgaaatgtactgggtctccaacgccagcggaaatatcgtgtccagcgtgaacatgatctcccgaatgttaatcaaccgtttcacgatgcgccataagaaagcgacatacgagccagacgtggacctggggagcggtacacggaatattggaatcgaatcggagatccccaaccttgacatcatcggcaagcgcattgagaagatcaagcaggagcacgagacatcatggcactacgaccaggaccacccctataagacctgggcttaccacggctcctacgagactaagcagacagggtctgcaagcagcatggtaaacggggtcgtgcgcctgctaacgaagccttgggacgtcatccccatggtgacacaaatggccatgaccgacacgacccctttcgggcagcaacgggtgtttaaggagaaggtcgacacgcgtactcaggaacccaaggagggcaccaaaaaactcatgaagattaccgcggaatggctgtggaaggagctgggcaagaagaagacgccgaggatgtgtacgcgcgaggagttcacccggaaagtacgctcgaatgccgccctgggagccatattcaccgacgagaataagtggaagtccgcacgggaggccgtggaggactcggggttttgggagcttgtagacaaggagcgcaatctgcacctcgagggtaagtgcgagacgtgcgtgtacaacatgatgggaaaaagggagaaaaagctgggcgagttcggcaaggcgaagggcagccgcgccatctggtacatgtggctcggagcccggttcttagagttcgaggcactgggcttcctgaatgaggaccactggttctcccgtgagaacagcctgtccggggttgaaggcgagggtcttcacaaattgggctacatcctcagagacgtcagcaaaaaggagggcggggcaatgtacgccgacgacaccgccggctgggatacccgcataacgctggaggacctgaagaacgaggagatggtgaccaaccacatggaaggtgagcacaaaaaactcgccgaggctatattcaagctgacgtatcagaacaaagtggtccgcgtgcagagacccaccccccggggcaccgtgatggacataattagccgacgcgaccagagagggtctggccaagtagtgacgtacggcctgaacaccttcaccaacatggaggcccagctcatccggcagatggaaggggagggagtgtttaagtccatccagcacctgaccgtcacggaggagatcgccgtaaagaactggctagcccgcgtcgggcgcgaacggctcagtcgtatggccatttccggcgatgattgcgtcgttaagcccctggacgaccggttcgcgtccgccctgaccgccctcaacgacatgggcaaggtgcgcaaagacatccagcaatgggagccgagccgggggtggaatgactggacccaggtgccgttctgttcccaccacttccatgagctgatcatgaaggacggacgggtgctggtggtcccctgccggaaccaggacgagctcatcggccgcgcccggatttctcagggcgccgggtggtcactgcgcgaaaccgcgtgtctgggaaaatcatacgcccagatgtggagcctcatgtacttccaccgccgcgacctgcggctggccgccaacgccatctgtagtgccgtaccctcccattgggtgcctacgtctcgaaccacctggtccatccacgccacccatgagtggatgacaacggaagatatgctcaccgtgtggaatcgggtctggatccaggagaatccctggatggaagacaagacccccgtggagtcctgggaggagattccctatctgggcaagcgagaggaccagtggtgcgggtccctgatcggcctcaccagccgggccacatgggccaagaatattcaaaccgcgatcaaccaagtgcgtagcctgatcgggaacgaggaatacacggactatatgccctcgatgaagcggttcagacgcgaggaggaggaagctggcgtgctgtggtga

SEQ ID NO: 24800 - RNA, 9876 nt, synthetic construct
  misc_feature 1..9876: note = derived and/or modified CDS sequence (opt11) from DENV-2__AB189123__SS-prME
  source 1..9876: mol_type = other RNA
accgccggcgtgattatcatgatgatccccaccgttatggccttccacttgacaacgcggaatggcgaaccccacatgatcgtttcgcggcaggagaagggcaagtccctccttttcaagaccgagaatggggtgaatatgtgcaccctgatggccatggacctgggtgagctgtgcgaggacacaatcacctacaactgccccctgctccgccagaacgagcccgaagacattgactgctggtgtaacagcacctccacctgggtcacctatgggacgtgcacggccaccggggagcaccgtcgcgagaagcggagcgtggccctcgcgccccacgtcggcatggggctagagacacgcaccgagacctggatgtcgagcgagggcgcatggaagcatgcgcagcggatcgagacctgggtcctccggcaccccgggtttacgatcatggccgctatcctggcctacactattggcactacctacttccaacgcgtgctgatattcatcctcctgactgcggtggccccgtccatgactatgcgctgtatcgggatcagcaaccgggacttcgtagagggcgtgtccggcgggagctgggtagacatcgtcttggaacacggcagttgcgtgaccaccatggccaagaacaagcccacactcgatttcgagctgatcaagaccgaggccaagcatcccgccacattgagaaaatactgtatcgaggcgaaacttaccaacacgacgacggccagtcggtgcccaacccagggggagccctcgctgaacgaggagcaggacaagcgattcgtttgcaagcacagtatggtcgaccgcggctggggcaacgggtgcggcctattcgggaaaggcgggatcgtgacgtgcgcgatgttcacgtgcaagaagaacatggaagggaaggtggtgcaacccgagaatctcgaatacactattgtgatcacaccccattccggcgaggaaaacgccgtggggaacgacactggcaagcacgggaaggagattaaggtcaccccgcagagctccatcaccgaggccgagctgaccggctacgggaccgtaacgatggagtgtagcccccgcaccggcctggacttcaacgagatggtgctgctacaaatggagaacaaggcgtggctggtccaccggcagtggttcctcgacctgcctctgccctggctcccaggggcggacacgcaaggctccaactggatccagaaagagaccctggtgacgtttaagaaccctcacgccaagaagcaggacgtagtggtgctgggcagccaggagggggccatgcataccgcccttaccggtgccacggagatccagatgtcctctgggaacctgctgttcactggccatctcaagtgccgactcaggatggacaagctgcagcttaagggcatgagctactccatgtgcaccggcaagttcaaggttgtgaaagagatcgcagagacccagcacggcaccatcgttatacgcgtccagtacgagggggatgggtcgccatgcaagataccttttgagatcatggacctggaaaagcggcatgttctgggcaggctcatcaccgtgaacccgatcgtcacggagaaggactctccggtgaacatcgaggccgagccgccattcggagacagttacatcatcatcggcgttgagccgggacagttaaagctgaactggttcaagaagggctcctccatcggtcaaatgtttgagaccacgatgcgcggagccaagcggatggctatactgggcgataccgcgtgggactttgggtccctgggcggggtcttcaccagcattggtaaggcgcttcaccaggtgttcggggcaatctacggcgcggcgttctccggcgtgagctggaccatgaaaatcctcatcggggtcgtgatcacgtggatcggcatgaactctcgtagcacgtcactgagcgtgtccctggtcctggtgggagtggtcaccttatacctgggcgtgatggttcaggctgatagcgggtgcgtcgtttcttggaagaacaaggagctgaagtgtggcagcggtatcttcataaccgacaacgttcacacgtggactgaacagtacaagttccagcccgagagcccctcgaagctcgccagcgccatacagaaggcccatgaggaggggatttgcggaataagatccgtcactcgcctcgagaacctgatgtggaagcaaatcacacccgaactcaatcacatcctgagcgagaacgaggttaagttgaccatcatgacgggagacataaaaggcataatgcaggcggggaagcggtccctccgcccgcagcccaccgagctgaagtactcttggaaggcctggggcaaggccaagatgctgtccaccgagctccacaatcacacttttctgatcgacggccccgaaacggcagagtgcccgaacaccaatcgggcatggaactctctagaggtggaggactacgggttcggcgtcttcaccaccaatatctggttgaaattaaaagagcgccaggacgtgttctgtgactccaagctgatgagcgcggccatcaaggacaaccgagccgtccacgccgacatggggtattggatcgagtccgctttgaacgacacgtggaagatcgagaaggcgagcttcatagaggtcaagtcctgccattggccaaagagccacactctgtggtcaaacggcgttttagaaagcgagatgatcatccccaagaacttcgccggcccggtgtcccagcacaactaccgccccgggtaccacacccagaccgccgggccctggcatctcgggaagttggagatggacttcgacttttgtgagggcaccacagtagtggtgacagaggactgcggaaaccggggaccctctctgcgaaccaccactgcttccggcaagctcataaccgaatggtgttgtcggtcctgcacgctgccacccctgcgctaccgcggtgaggatgggtgctggtacgggatggagatcaggccactcaaagagaaggaggagaacctggtcaacagcctcgtgaccgcgggccacggccagatagacaacttctccctcggcgtgctgggaatggccctgttcctcgaggagatgctccggacgcgcgtcgggaccaagcacgccatcctgctcgtggccgttagcttcgtcaccctgatcaccggaaacatgtccttccgggacctggggcgtgtgatggttatggttggagctaccatgaccgacgacataggcatgggcgtaacctacctggcgctccttgctgcattcaaagtgcgccccaccttcgcggccggcctcctactccgcaagctcactagcaaggagctgatgatgaccaccatcggaatcgtactgctctcccagagcaccatccccgagacgatcctggaattgacggacgccctcgccctgggcatgatggtgctaaagatcgtccgcaacatggagaagtaccagctcgccgtgaccatcatggccatcttatgcgtgccgaacgccgtaatcctgcaaaatgcctggaaggtatcctgcacgactctcgccgtggtcagcgttagcccccttctgctaacctcatctcagcagaaagccgattggattcccctggccctgaccatcaaagggctcaaccccaccgcgatcttcctcacgaccctgagccggacctccaagaagcgctcctggccgctcaacgaggcgataatggcggtgggcatggtctcaatcctggcaagctccttgctcaaaaacgacatccccatgaccggacccttggtggccgggggcttgctcacggtgtgctacgtattgaccgggaggagcgcggacctggagcttgaacgcgcggccgatgtgcggtgggaggagcaggccgagatcagcggctccagccccatcctctccatcaccataagcgaggacgggagtatgagcatcaagaacgaggaggaggaacagaccctgaccatcctcatccgcaccggtctgctggtaatcagtggcctattcccggtcagcatccccatcaccgccgcggcctggtacctatgggaggtgaagaagcagcgggcaggggtactgtgggatgtccctagcccgcctcccgtgggcaaggctgagctcgaggacggggcataccgcatcaagcagaaaggcatcctgggatacagccagatcggcgcgggcgtgtataaagagggtacctttcacacaatgtggcacgtcacgcggggcgccgtgcttatgcataaggggaaacgcatcgagccctcctgggcagacgtaaagaaagacttgatcagctacggagggggctggaagctggagggcgagtggaaggaaggggaggaggtccaggttctggcgctcgagcccggcaaaaacccccgggcggtacagaccaagcccgggctgttcaagaccaacaccggcacgatcggggcggtcagtctagacttcagcccaggcacctccggcagccccatcgtagacaagaagggaaaggtggtcgggctctacgggaatggcgtggtgacccgctcaggcacctatgtcagcgccatagcccagacagagaagaatatagaggacaaccccgagatcgaggacgacatcttccggaagaagcgcctgaccatcatggacctgcaccccggggccgggaagaccaagcggtacctacccgcgatcgtgcgggaggccatcaagcgggggctccgcaccttaatattggccccgacccgggttgtcgccgccgagatggaggaagcgcttcggggcctgcccatccgctaccagactccggccatccgggctgagcacacaggtcgtgaaatagtcgacctgatgtgccacgccaccttcacgatgcgtctcctgtcacccattcgggtgccgaactacaacctgatcataatggacgaggcccacttcaccgaccctgccagcatcgccgcccgcggctacatcagcacccgcgtcgagatgggcgaggcggctgggatcttcatgaccgcgacacctccaggctccagagaccccttcccccagagcaacgcaccgatcatggatgaggagcgcgagataccggagcggtcctggaacagcgggcacgagtgggtgaccgacttcaagggtaagaccgtgtggttcgtcccatccataaaagccggaaacgacatagcggcgtgtctccgcaagaatggcaagaaggttatccaactgtcccggaagacctttgactccgagtacattaagacacgcaccaacgactgggatttcgtggtcaccacagatatctccgaaatgggggccaacttcaaggccgagagagtcatcgaccctagacggtgcatgaagcccgtgatactaacggacggagaggagcgcgtaatactcgccggcccgatgcctgtgacccactccatcgcagcgcaacggcgggggagggtcggccgcaaccccaaaaacgaaaacgaccagtacatctatatgggggagccccttgaaaatgacgaggactgcgctcactggaaggaggccaagatgctgctggacaacatcaataccccagagggcatcatcccgtctatgtttgagccggagcgcgagaaggtcgacgccatcgacggcgagtacaggctgcgcggggaggcccggaagacattcgtggacctgatgcgccggggcgacctccccgtatggctagcataccgcgtggccgccgaggggataaattacgctgaccggaggtggtgcttcgacggcgtgaagaacaaccagatccttgaggagaacgtcgaagtcgagatctggacgaaggaaggcgagcggaagaagttgaagccgcgctggctggacgcccggatctacagcgatcccttggcgctcaaagagtttaaagagttcgccgcaggcagaaaaagcctgaccctaaacctcatcactgagatgggccggctgcccaccttcatgactcaaaaggcacgcaacgcgctggacaaccttgccgtactgcacactgccgaggcagggggccgagcctacaaccacgcgctgtccgaactccccgagaccctggagaccctgttactcctgacgttgctggcgacggtcaccgggggcatcttcctgttcctcatgagcggcaaggggataggcaagatgaccctggggatgtgctgcataatcacagcgagtgtgctgctgtggtatgcgcagatccagccccactggatcgccgcgtctatcatactggagttcttcctgatcgttctgctgatccccgagccggagaagcagcgcacgccccaagacaaccagctgacctacgtcgtgatcgcgatactcaccgtggtcgccgccaccatggcaaacgagatgggcttcctcgagaaaacgaagaaggacttcgggctgggctccatagcgacccaacaaccggagagcaatatcctcgatatcgacctgcggcccgcctccgcctggacactgtacgccgttgctacaacgttcattacccccatgttgcgccattcgatcgagaacagttcagtgaacgtcagccttaccgctatcgccaaccaggcaaccgtgctaatgggcttagggaagggatggccgctgtcaaaaatggacatcggggtccctctgcttgccatcggctgctacagccaagtcaatcccatcacgttgaccgcggccctgctactactggtggcccactacgccatcattggccccggcctccaggccaaggcaacccgggaggcacagaagcgcgcggccgccggcatcatgaagaacccaaccgtggatgggatcacggtcatagacctggatccgataccctacgaccccaagttcgagaagcagctgggccaggtgatgctcctggtactgtgcgtaacccaggtgttgatgatgcggactacctgggcgttatgtgaggcactgacgctcgcgaccgggccaatatccaccctctgggagggtaaccctgggcgcttctggaataccacgatcgcggtgtcgatggccaacatcttccgcggctcctacctggcgggcgccgggctcctgttcagcataatgaagaacaccgccaacacccggagaggaacagggaacacgggcgaaaccctgggcgagaagtggaagaaccggttaaacgccctggggaagtccgagttccagatctacaagaagtccggcatccaggaggtcgaccggaccttggcaaaggaggggatcgaacggggcgagaccgaccaccacgccgtgagcaggggtagcgccaagctccggtgttttgtggaaagaaacctcgtcacacccgagggtaaagtggtagacctcggttgcggacggggcgggtggtcctactactgcggcgggttgaagaacgtcaaggaagtaaaggggctgacgaagggcgggcccggccacgaggagcccatcccgatgagcacctacggatggaacttggtgcgcctccagtccggcgtagacgtctttttcacgccgcccgagaagtgcgacacgctattatgcgatatcggtgagtcttcccccaatcccacagtggaagccggccgaaccctgcgcgtcctgaacctggtggagaattggcttaagaacaacacacaattctgcatcaaggtgctgaacccgtatatgccgagtgtcatcgagaagatggaggccctgcaacggaagtacggcggggcgctggtccgcaatccgctctcccggaactccacccacgagatgtactgggttagcaacgcctccgggaatattgtcagctctgtgaacatgataagccgcatgctgatcaaccggttcacgatgcgccacaaaaaggccacctacgagcccgacgtagatcttggatccgggaccaggaacatcgggattgagagcgagatccctaatctcgacatcattggcaagcgcatcgagaagataaagcaggaacacgagacctcctggcactatgaccaggaccacccctacaagacctgggcctaccatggcagctacgagaccaagcagaccggttctgcctcatccatggtcaacggcgtggtgcgcctgctgaccaagccgtgggacgtcatccccatggtgacgcagatggcgatgaccgacaccaccccctttgggcagcagcgcgtcttcaaggagaaagtagacacgcgcacccaagagcccaaggagggcacgaaaaagttgatgaagatcacggccgagtggctgtggaaggaactgggaaagaagaagaccccgcgtatgtgcacgcgcgaagagttcacccgaaaggttcgcagcaacgccgccctaggggccattttcaccgacgagaacaagtggaagtccgcgcgggaggccgtggaggactcaggcttctgggagctggtggacaaggagcgcaatctgcaccttgaggggaagtgcgagacctgcgtatacaacatgatgggcaagcgtgagaagaagctgggagagtttggtaaagcaaagggatcccgcgccatctggtatatgtggttgggtgcgcggtttttggagttcgaggccctgggcttcctgaacgaagaccactggttcagccgcgagaactcccttagcggggtcgagggcgaggggctgcacaagctgggctacatcctccgcgacgtgtccaagaaggaaggaggggccatgtacgccgacgacacagccggttgggacacccggattaccttagaggacctgaagaacgaagagatggtgacgaaccatatggagggcgaacacaagaagttagcggaggccatcttcaaactgacctatcagaataaggtcgtgcgcgtacaacgcccaacgccccggggcaccgttctagacatcatcagccgccgggatcagcgggggtcgggacaggtggtcacgtacggcctaaacacattcaccaacatggaagcccagctgatccggcagatggaaggcgagggcgtcttcaagtccatccagcatttgaccgttacggaggagatcgccgtgaaaaactggctcgcccgcgtcgggcgagaaaggctgagccgcatggcgatatccggcgacgactgtgtagtgaagcccctggacgaccggttcgccagcgcccttaccgccctgaacgacatgggtaaggtccgcaaggacatccagcagtgggaacctagtcgtgggtggaacgactggacccaggtgcccttctgtagccaccacttccacgagctgatcatgaaggatggccgtgtgctagttgtgccctgccggaaccaggatgagttaattgggcgcgcacgaatctcccagggggcgggatggtcgctgcgcgaaactgcctgcttgggcaaatcctatgcccagatgtggagcctgatgtacttccaccggcgcgacctgcggctggccgcaaacgcgatctgctccgccgtccccagccactgggttccgacgtcccgaaccacctggagcatccacgcaacccacgagtggatgacgacggaggacatgctgaccgtgtggaaccgggtttggatacaggagaatccctggatggaggacaagactcccgttgaaagctgggaggagatcccctacctgggcaaacgagaagaccagtggtgcggtagcctcatcgggctcacctcccgggccacgtgggcgaagaacatccagacggccatcaaccaagtgcgcagcctaatcgggaacgaggagtacaccgactatatgccgagcatgaagcgtttcaggcgcgaggaggaggaggccggcgtgttgtggtga

SEQ ID NO: 24801 - RNA, 9876 nt, synthetic construct
  misc_feature 1..9876: note = derived and/or modified CDS sequence (opt11) from DENV-2__AB189124__SS-prME
  source 1..9876: mol_type = other RNA
acagcaggagtgatcatcatgatgatacccaccgtcatggcctttcatttaaccacacgtaatggcgagccccacatgattgtaagccggcaggaaaagggcaagtccctcctgtttaaaaccgagaacggtgtgaacatgtgtacgttaatggccatggacctcggcgagctgtgtgaggacaccatcacctataactgtccccttctccgccaaaacgaacccgaagatatcgattgttggtgtaacagcacgtccacctgggtcacctacgggacgtgtaccgcaaccggcgagcatcggcgcgagaaacggtcggtggccctggcgccccacgtgggcatggggctggaaactcgtaccgagacctggatgagtagcgagggcgcctggaagcacgcgcaaaggattgagacctgggtcctccgccatcccgggtttacgataatggcggcgatccttgcatataccatcggcacgacctacttccagagagtgttaatcttcattctcctgacagcggtggccccctccatgacaatgaggtgcatcggcatctcgaatagggatttcgtggagggcgtctccggcgggagctgggtcgatatcgtgctggagcacggctcctgcgtgactactatggccaaaaacaagcctacactagacttcgagctaataaagaccgaagccaagcaccctgccaccctacgcaagtactgcatcgaggccaaattaaccaatacgactacagccagccggtgcccaacccagggggagccttccctgaatgaggagcaggacaaacgcttcgtgtgcaagcactcgatggtcgaccgaggctggggcaacggctgcggcctgttcggaaagggcgggatcgtcacgtgtgccatgtttacgtgcaaaaagaacatggagggcaaggtggtccagccggagaacctcgagtacaccatagtgatcacgccccactccggcgaggagaatgccgtgggcaacgacacgggcaagcacgggaaggagatcaaggtaacgccccagagctcgataaccgaagcggagctgactggctacggtaccgtgacgatggagtgtagcccccgcaccggcctggacttcaacgaaatggtgctcctgcagatggagaataaggcgtggctcgttcacaggcagtggttcttagacctgcccctgccctggctcccgggggctgatacccagggctcaaactggatccagaaggagacactcgtgacattcaaaaacccccatgccaaaaagcaggatgtcgtggtgcttggcagtcaagagggcgccatgcacaccgcactcacgggcgcgaccgaaatccagatgtctagcggtaacctgctgttcaccggacacctcaaatgccgcctgcggatggacaagctgcagttaaagggcatgagctattccatgtgtactgggaagttcaaggtcgttaaagaaatcgccgagacccagcacgggaccatagtgatccgcgtacagtacgaaggggacggaagcccctgcaagatcccattcgagattatggaccttgagaagcgtcacgtgctgggtcgcctcatcacggtaaaccccatcgtcaccgagaaggactctcccgtgaacatcgaggctgagccgccattcggggacagctatatcatcataggggtggaaccgggtcaactcaagctgaactggttcaagaagggctccagcatcgggcagatgttcgagacaaccatgcgcggcgccaagaggatggccatcctcggtgacacggcttgggattttgggtccctgggcggggtctttaccagcatcggcaaagccctgcaccaagtgttcggggccatctatggtgcggcgttctccggcgtttcgtggaccatgaagatcctaatcggtgtcgttatcacctggatcggcatgaactcccgctctacttccctgagtgttagcctggtgctggtgggagtagtgaccctctacctgggcgtgatggtgcaggccgacagcgggtgcgtcgtgtcctggaagaacaaggagttgaaatgcggctcggggatctttataactgacaatgtgcacacctggactgagcaatataaattccagccggagtcaccctccaaactcgccagcgcgatccaaaaggcccatgaggagggcatctgtggcatccggtccgtaacccgcctcgagaacctgatgtggaagcagattacccccgagctcaaccacatcctgtcggagaacgaagtgaagctgaccatcatgacgggagacatcaagggcatcatgcaggcgggaaagaggtcgttacgcccgcagccgaccgagctgaagtactcgtggaaggcctgggggaaggccaagatgttgtccaccgaactccacaaccacaccttcctgatcgacgggcccgagacggcggagtgcccgaacaccaaccgggcctggaatagcctggaggtggaggactatgggtttggagtcttcaccaccaatatctggctcaagttgaaggagcgccaagacgtcttctgcgactccaagctgatgagcgcggccatcaaggacaaccgggctgtgcacgccgacatgggttactggatcgagtcggccctcaacgatacgtggaagattgaaaaagcgtctttcatcgaggtcaagtcctgccattggcccaagagccacaccctgtggagtaatggcgtgctggaaagcgagatgataatccccaagaatttcgccggccccgtgtcccagcacaactaccgaccgggataccacacacaaaccgcggggccctggcacctcgggaagctggagatggacttcgacttctgcgagggcactacggtcgtcgtgaccgaggattgcgggaaccgtgggcccagcctgcgcaccaccacggcgagcggcaagctcatcacggagtggtgctgccggtcttgcaccctgcccccgcttcgctaccggggggaggacggctgttggtacgggatggagatccgccctctcaaggagaaagaagagaacctagtcaacagcctggtgaccgccggtcatgggcagattgacaacttctccttgggcgtgctgggtatggcgctgtttctcgaggagatgctgcgtacgcgcgtcggtaccaaacacgcgatactgctcgtggccgtgagcttcgtgaccctcatcaccgggaatatgtcctttcgggacctgggccgggtcatggtcatggtcggcgccactatgacggacgacatcgggatgggcgtgacctacctcgcactgctggctgccttcaaggttcgccccaccttcgccgccggcctcttgttgcgcaagctcacgtcgaaggaactgatgatgacgactatcgggatcgtactgctctcccagtccaccatccccgagacgattctggagctgacggacgctctcgcgctgggcatgatggtgctgaagatcgtgcgcaatatggagaagtaccagctcgccgttaccattatggccatcctgtgcgtaccgaacgccgtaatcctccagaacgcgtggaaggtctcctgcaccacgctggctgtggtcagcgtttcccccctgctgctcaccagcagtcagcagaaagccgactggattcctctggccctgactataaagggattgaaccccaccgcgattttcctgaccactctgagccggacctcgaagaagcgctcctggccgctcaatgaggccatcatggccgtgggcatggtttccattctcgcttcctcactgctcaaaaatgacatccccatgaccggcccattagtggccggggggctcctcacggtgtgctacgtcttaaccgggcgaagcgcagacctggagctcgagcgcgcagccgacgtgcggtgggaagaacaggctgagatcagcggctccagccccatcctgtccattacaataagcgaagacgggtccatgagcataaagaacgaggaagaagagcagaccttaacgatcctcatcaggaccggtctgctggtgatctccggcttgttcccggtcagcattcccatcacagccgcggcctggtatctttgggaggtgaaaaaacagcgggctggggtgctgtgggacgtcccctctcctccgcccgtgggtaaagccgaactcgaggacggcgcctatcgcataaagcagaaaggcatcctggggtatagtcaaataggggcgggggtctacaaggaagggacctttcacacgatgtggcatgtcacgcgtggcgccgtcttaatgcacaaggggaagcgcatagagccctcatgggctgacgttaagaaggacctcattagctacggtgggggctggaagctggaaggcgagtggaaggagggggaggaagtccaggttttagccttggagccgggcaaaaatccgcgtgccgtccagaccaagcctgggctgttcaaaaccaacaccggaacgataggggccgtctccttagacttcagcccgggcacctccggctcccctattgtggacaagaaggggaaagttgtcggcctctacgggaacggcgtagttactcgctcgggcacctacgtctcagccattgcccagacggagaagaatatcgaggataaccccgagatcgaggatgacatcttccggaagaagcgcctgacgatcatggacctgcatcccggggccgggaagacgaagaggtacctaccggcgatcgtgcgcgaagccatcaagcgggggcttcgcaccttaatccttgctccgacgcgggtggtcgctgcggagatggaggaggcgctccgaggcttacctataagataccagacccccgctatccgggcggagcataccggccgcgaaatcgtagacctgatgtgccacgcaacctttacgatgcggctcctgtcacctatcagagtcccgaactacaacctgatcataatggacgaggcgcacttcaccgaccccgcgtctatagccgcccgaggctacataagcacacgcgttgaaatgggagaggcggcggggatcttcatgaccgcaacgcctcccggcagtcgggacccgttccctcaaagcaatgcccccatcatggacgaggagcgcgaaatccccgagcggtcctggaacagcgggcacgaatgggtcaccgacttcaagggcaagaccgtttggttcgtaccgtccatcaaggccgggaacgacatcgctgcgtgcctcaggaagaacggaaagaaggtgattcagctgagccggaaaacttttgattccgaatacataaagacgcgcacaaacgactgggacttcgtggtgacgacagacattagcgagatgggtgccaacttcaaggcggagcgggtgattgacccgcgccggtgcatgaaacccgtgatcctgactgatggggaagaacgcgtgatcctcgccggccctatgcccgtgacccactccagcgccgcgcagcggcgcggtcgggtggggaggaacccgaagaacgagaatgaccagtacatatacatgggggagccgctggaaaacgacgaagactgcgctcattggaaagaagccaagatgcttctcgacaatatcaatacccccgaaggcataatcccgtctatgttcgagccagagcgcgaaaaggtcgacgccatcgatggagagtaccggctgcgcggggaggcgcggaagacgttcgtggacctgatgcgccgtggggacctccccgtctggttagcgtaccgcgtggccgccgaagggatcaactacgctgaccggcgctggtgcttcgatggcgtgaagaataatcaaattctggaggagaacgtggaggtggagatctggacgaaggagggggagcggaagaagctcaaacctcgatggctggacgctcggatatacagcgaccccctggctttgaaagagtttaaggaattcgcggccggccggaagtccctgaccttaaacctcatcacggagatgggccggctgcccacctttatgacgcagaaggcccggaacgcgttagataacctagccgtgctgcacactgcagaagccgggggtcgggcctacaaccacgcgctgagcgagctgccagagaccctggagaccctgctcctgttgacactcctggcaaccgtcactggtggaatctttctgtttctcatgtccggcaaggggataggcaaaatgaccctggggatgtgctgcatcatcacggcatctgtgctgctctggtacgcccagatccaaccgcactggatagccgcgtccataatcctggaattcttcctgatcgtgctcctgatcccagagccagagaagcagcgcacgccacaggacaatcagctgacctacgtcgtgatcgccatcctcacagtggtcgccgccactatggccaacgaaatggggtttctggaaaagacgaagaaagactttgggctgggcagcatcgctacccagcagccggagtccaacatcctagacatcgacctgcggcccgcaagcgcctggaccttgtacgccgtagccaccaccttcatcacccccatgctccgacacagcatcgagaattccagcgttaacgtctcgttgacagccatagccaaccaggccactgtcctgatgggcctcggtaagggatggccgctgtcaaagatggatatcggagtgcctctgttagccatcggctgctactcgcaggtaaaccccattaccctgaccgcggcattactcctgctggttgcccactacgccattatcgggcccggcctccaggccaaggcgacccgggaggcccagaagcgcgctgccgccggtatcatgaagaacccgacagtggatggaattacggtcatcgaccttgacccgataccgtacgaccccaagttcgaaaagcagcttgggcaggtgatgctactcgtgctgtgtgtcacgcaggtgctaatgatgcggacgacctgggcgctgtgcgaggccctaacgctcgccacagggcctatcagcaccctgtgggaggggaatccggggaggttctggaacaccacgattgccgtgtccatggccaatatcttccgtggcagctacctggcgggtgccggactcctgttcagcatcatgaaaaacaccgccaacacccggagaggaacggggaacacgggagagactctgggcgagaagtggaagaacagactgaacgccctgggcaaatccgagttccagatttataagaagtccggcatccaagaggtggaccgcaccctggcgaaggaggggatcgagcgtggtgagaccgaccaccacgccgtcagccgagggagcgcaaagctccgttggttcgtagagcgtaacctggtcacgcccgaagggaaggtggtagacctgggatgtgggcgaggtggttggagctattattgcggtgggctcaagaacgtcaaagaagtgaagggactgacaaagggcgggcccggccacgaagaacctatcccgatgtccacctacgggtggaacctggtgcggcttcagagcggcgtagatgtgttcttcacgccgcccgagaagtgcgacacgctgctatgcgacatcggggagtcttcgcccaaccctaccgtggaggctgggcggacgctcagagttctaaacctggtggagaactggctcaagaacaatacgcaattctgcatcaaggtactgaatccatacatgccaagtgtcatcgagaagatggaggccctgcagcggaagtatggcggggcgctggtgcggaacccgctcagtcggaacagcacccacgagatgtactgggtgtccaacgccagcggtaacattgtctccagtgtaaacatgatctcccgcatgctgatcaataggttcaccatgcgccacaagaaggctacctacgagcccgacgtggacctggggagcggcacccggaacattggaatcgagagtgaaattcccaacctcgacatcataggcaagcgcatagagaagatcaagcaggagcacgagacctcatggcactacgaccaggaccacccctacaagacatgggcttaccacggcagctatgagaccaagcaaaccgggagcgccagctcgatggtcaacggcgtggtacgtcttctgacaaaaccatgggatgtcattcccatggtcacgcagatggcgatgaccgacaccacccccttcgggcaacagagggtgttcaaagagaaggtagacacccgcacccaggagcctaaggaggggacaaagaagctcatgaagatcaccgccgagtggctgtggaaggagctaggcaaaaagaagacgccgcggatgtgcacacgcgaggaattcacccggaaagtgcgctccaacgccgccctcggtgccatattcaccgacgagaacaagtggaagagcgcccgtgaggcggtcgaagactcgggattctgggagcttgtggacaaggaacgcaacctgcacttggagggaaaatgcgagacgtgcgtatacaatatgatgggcaagcgggagaaaaagctgggggagttcggcaaggccaagggtagtcgcgcaatctggtatatgtggctgggggcgcggttcctcgagttcgaggccctaggtttcctgaacgaggatcactggttctctcgcgagaacagcctctccggggtcgagggcgagggcctgcacaagttaggctacatccttagagacgtttccaagaaggagggcggggctatgtatgccgacgacactgcaggctgggacaccagaatcactttagaggacttaaagaacgaggagatggtgaccaaccacatggagggggaacataaaaagctcgccgaggccatatttaaactgacgtaccagaacaaagtagtccgagtgcagcgcccaacacctagaggcacagtcatggacatcatcagccgccgggatcagcgcgggagcggccaagtggtgacgtatgggctgaacaccttcacgaacatggaggcacagctcatccggcagatggagggggagggggtgttcaagagtatccagcacctcacagtgacggaggaaatagccgtgaagaattggctggccagggtcggacgcgaacgcttatcaaggatggctatcagcggcgacgattgcgtagtgaagccacttgacgaccggttcgcatctgccctgacggccctcaacgacatgggaaaggtccggaaggatatccaacagtgggagcccagcagggggtggaacgactggacccaggtgccgttctgcagtcatcatttccacgagctgatcatgaaagacggccgcgttctggttgtgccctgccggaaccaggatgagctcatagggcgcgcccggatctctcagggcgccgggtggtccctgcgcgagaccgcgtgcctaggcaagagctacgcccagatgtggtcactcatgtactttcatcggcgggacttacgccttgccgccaatgcgatctgcagcgccgtgccctcccactgggtcccgacgtcacgcaccacctggtcaatccacgcgacccatgagtggatgaccacggaggacatgctaaccgtatggaatagggtctggatccaggagaacccctggatggaggataagacccccgttgagagctgggaggagatcccctacctgggcaaacgggaggaccagtggtgcgggtccctgataggcctcaccagccgggccacttgggcgaaaaacatccagacggctatcaatcaggtgaggagcctgatcgggaacgaggagtacaccgactatatgccgtccatgaagcggttccgcagagaggaggaggaggcgggcgtattatggtga

SEQ ID NO: 24802 - RNA, 9876 nt, synthetic construct
  misc_feature 1..9876: note = derived and/or modified CDS sequence (opt11) from DENV-2__AB122020__SS-prME
  source 1..9876: mol_type = other RNA
actgccggcgtgatcgtcatgctgatccccaccgcgatggccttccacctcaccacccggaacggggagccccacatgatagtcggccggcaggagaaggggaagtccctgctgttcaagaccgaggatggcgtgaacatgtgcaccctgatggccatcgatctgggcgagctgtgcgaggacacaatcacatacaaatgcccattactgcgccagaatgagcccgaggatattgactgctggtgcaactcaaccagcacctgggttacctacggtacctgtaccaccactggtgagcatcggcgcgagaagcgctccgttgccctggtgccccacgtcgggatggggctcgagacaagaaccgagacctggatgagctccgaaggggcctggaagcacgtgcaacggatcgagacttggatcttgcgccacccgggcttcacgatcatggccgcgatcctggcctacaccatcgggaccacgcacttccagcgggcactcatcttcatcctgctgaccgctgtggcgcccagtatgaccatgcgttgtatcggcatctccaaccgggacttcgtcgagggcgtgagcgggggttcctgggtggatatcgtactcgagcacgggagctgcgtgaccaccatggccaaaaacaagcccacactggacttcgagctaatcaagaccgaagccaagcaacccgccaccctcaggaagtactgcatcgaggcgaagcttacgaataccaccaccgagagccggtgcccgactcagggcgagcccagccttaatgaagaacaggacaagcggttcatatgtaagcactccatggtagaccgaggatgggggaacggctgtgggctgttcggaaaagggggcatcgtaacctgcgcgatgttcacttgcaagaagaacatggaggggaagatcgtgcagcccgagaacctggagtacaccatcgtcatcacgccccactcgggcgaggagcacgcagtaggcaacgacaccggcaagcacggaaaggagataaagatcaccccgcagtcctccaccaccgaggccgaactgacggggtacggcaccgtcaccatggagtgcagccctcggaccggcctcgatttcaacgagatggtgttgctgcagatggaggacaaggcctggctcgtccaccggcaatggttcctggacctgcccctcccctggttgccaggggccgacactcagggcagcaattggatacaaaaggagaccctggtgaccttcaagaatccccacgcaaagaagcaggacgtggtcgtgctcgggtcccaagagggcgccatgcataccgccctgacgggggcaaccgaaatccagatgtcgtcaggcaatctgctgttcaccggccacctgaaatgtagactgcgaatggataagctccagttgaaaggtatgtcctacagcatgtgcacaggcaaattcaagatcgtcaaggaaatcgccgaaactcagcacggaactatagtcattcgcgtgcagtacgagggcgatggaagcccttgcaagatcccctttgagattacagatctggaaaagcgacacgtactcggccggctgatcaccgtgaacccgatcgtgacggaaaaggatagcccggtcaacatagaggctgagccgccgttcggcgactcctacatcatcgtgggggtggagccgggccagctgaagctcaactggttcaagaaggggagctccataggccagatgtttgagaccaccatgcgcggagccaagcgaatggccatcttaggtgacaccgcttgggacttcgggtcattgggtggtgtcttcacgtccatcgggaaggccctccaccaggtgttcggggcgatctatggagccgccttcagcggagtgtcctggacgatgaagatactgatcggtgttataatcacctggatagggatgaacagcagatccaccagcctgtccgtgagcctggtgctcgtcggcgtggtcaccctgtacctgggggctatggtccaggcggacagcggctgcatcgtgagctggaagaacaaggagttaaagtgcggctccgggatcttcatcaccgacaacgtgcacacctggacagagcagtacaaatttcaacccgagagcccatcaaagctggctagcgctattcagaaagcccacgaggagggcatctgcgggatccgaagcgtcacgaggctggagaacctcatgtggaagcagatcacccccgagctcaaccacatcctcagcgagaacgaggtgaagctcaccatcatgaccggcgacatcaaggggattatgcaggccggcaagcggagcctgcggccgcaaccgacggaactcaaatacagttggaagacgtggggcaaagcgaagatgctaagcaccgagtcccacaaccagaccttcttaatcgacgggcctgagacagctgagtgccctaacaccaaccgggcctggaacagcctggaagtggaggattacggattcggtgtcttcaccaccaacatctggctcaaactgcgtgagaagcaggacgtattctgcgactccaaactgatgagcgccgccatcaaggacaaccgggcggtgcatgccgacatgggctactggatcgagtccgccttaaatgacacctggaagatggagaaggccagcttcattgaggtgaagtcctgtcactggcccaagagccacacgctatggtccaacggcgttctcgagagcgagatgatcatccccaagaatttcgccgggcccgtgtcccaacataactacaggcccggatatcacacacagaccgcggggccctggcatttggggaagctggagatggattttgatttctgcgagggcacgacggtcgtggtgactgaggactgtggtaatcggggcccaagcttacgcaccactacggccagcgggaagctcatcactgaatggtgctgcaggtcctgtaccctccccccgctacgttaccggggtgaagacggttgctggtacggcatggagatccgccccctaaaagagaaggaagagaatttagtcaacagcctggtgaccgccggtcacggacaaattgacaatttctccctcggagtgctgggaatggccctgtttctcgaggagatgctgcgaacacgcgtcggaaccaagcacgcgattctgctcgttgctctctcttttgtgacactgataaccgggaacatgtccttccgggacctcggtcgcgtcatggtgatggtaggggccacgatgaccgacgacatcggcatgggcgtgacctacctggccctgcttgccgcgttcaaggtgcgcccgacttttgccgctgggctcctgttgcggaagttgacgagcaaagagctgatgatggccactatcggcatcgccctgctgtcccagagcaccctgcctgaaaccatactcgagctgacggacgcgcttgccctcgggatgatggtgttgaaaatcgtaaggaacatggaaaagtaccagctggccgtgaccatcatggccatctcttgtgtgccgaacgccgtgatcctccaaaacgcgtggaaggtgtcatgcaccattctggccgccgtgtccgtaagccccctgctcctgacctccagccagcagaaagccgattggatccccctggcgctcacgattaaaggtttgaaccctaccgccatcttcctgaccaccctctctcgaacgagcaagaaacggagttggcctctaaacgaggccatcatggccgttgggatggtaagcatactggcctccagccttctgaagaacgacatccccatgaccgggcccctggtggcgggcgggctcttgaccgtgtgctacgtcctgaccggccggagcgccgacctcgagttggaacgcgccgccgacgtgaagtgggaagatcaggccgagatctccggcagctcccccatactgtccataacgatttccgaggacggtagcatgtccataaagaacgaagaggaggaacagacccttaccatcctgatacggaccggcctgctggttatcagcggggtctttccagtgtctatcccaataaccgccgccgcctggtacctgtgggaggtgaagaaacagcgcgccggcgttctgtgggacgttccgagcccaccgcccgtagggaaggcggaactcgaggacggcgcgtatcggatcaagcagcgcgggatcctagggtattcccagattggcgcaggggtctacaaggagggcacgttccacactatgtggcacgtgacacgcggagccgtgctgatgcaccgcggcaagcgaatcgagcccagctgggccgacgtcaagaaggacctcatctcctacgggggcggctggaagttagagggggagtggaaagagggcgaggaggtccaggtactggcccttgagcccgggaaaaacccacgcgcggtccaaacgaagcccggtatcttcaaaactaacaccgggacgatcggcgccgttagcctggacttctcccccggcaccagcgggtccccaatagtggacaggaagggtaaggtggtggggctgtacggtaacggtgtggtcacgcgcagtggagcctacgtgtccgccatcgcgcagaccgagaagtccatcgaggacaaccccgagatcgaggacgacatcttccggaagaagcgtctcaccatcatggacctgcaccccggtgcagggaagaccaagcggtacttacccgctattgtgcgcgaggctatcaagcggggactgcgcacactcatcttggcaccgacccgcgtcgttgcggccgagatggaggaggccttacgagggttgcctatccgctaccaaacccccgccatccgggcggagcacaccggacgtgagatcgtggatctcatgtgccacgcgacctttaccatgcggctgctcagccccgttcgcgtgccaaactacaatctaatcatcatggacgaggcacatttcaccgaccccgcctccattgcggcccgcggctacatcagcacccgcgtcgagatgggggaggcggccggcatcttcatgaccgccacgccgcccgggtcccgggacccattccctcagtccaacgctcccatcatggacgaggagcgagagatccccgagcgatcctggaacagtggtcacgagtgggtcactgatttcaaggggaaaaccgtgtggttcgtgccgtccatcaaggcgggaaatgacatcgccgcctgcctgcgtaagaacggcaagaaggtgatccagctgagccggaagacgttcgattccgagtacgtaaagacacgcgcgaacgattgggacttcgtggttaccaccgacatctctgagatgggggccaactttaaggcggagcgagtgatcgacccccgcagatgcatgaagcctgtgatattaacggacggggaagagcgcgtcatcctggccggacccatgccggtgacccactccagtgccgcccagcgtcgcggacgaattgggcggaaccccaagaacgagaatgaccagtacatctacatgggcgagccgctcgagaacgacgaggactgcgcccactggaaagaggccaagatgctgctggacaacattaacacccccgagggcatcattccgtcaatgttcgaacccgagcgagagaaagtagatgccatagatggggagtacaggctccgaggcgaggcccggaagaccttcgtcgacctgatgcgccgcggggacctgcccgtatggctcgcttacaaagtggctgcggagggcatcaactacgcggaccgcaagtggtgtttcgacgggatcaagaacaaccagatcctagaagagaacgtcgaggtggagatctggacgaaggagggcgagagaaagaagctgaagccgcgctggctcgacgcccggatctacagcgaccccctggcgttgaaggagttcaaggagttcgcggccggccgcaagtccctcaccttgaaccttatcaccgagatgggccgcctccccacattcatgacgcaaaaggcccgcaatgccctggacaatctggccgttctccacaccgcggaggtcggcgggcgagcctacaaccacgcactaagcgagctgcccgagacattggagactcttctgttactgacgctgctcgcgaccgtgaccggcggcatcttcttgttcctaatgtctgggaagggcatcgggaaaatgacactcggcatgtgctgcatcatcaccgccagcattctgctctggtacgcgcagatacaaccgcactggatcgcagcctcgattatcctcgagttcttcctgatcgtcctgctcatccccgagcccgagaaacaacgcactccccaggacaaccagctaacctacgtggtgatcgccatcctgaccgtggtggccgcgaccatggccaacgagatgggtttcctcgaaaagacgaagaaggacctgggattcggctcgatcaccacccaggagtctgaatccaacatcctggacattgacctccggcctgccagcgcgtggactctttacgccgtggcgactaccttcgtcactcctatgctgcgccattccatcgagaacagctccgtgaatgtaagcctcaccgccatcgccaatcaggccacggtcctgatggggctcggcaaggggtggcccctgtccaaaatggacataggagtgcccctgctagccatcgggtgttacagccaggtgaacccgatcaccctaactgccgccttgctgctcctggtcgcgcattacgccatcatcggccctggcctgcaggcgaaggccacccgggaggcccagaagagggcggccgcgggcatcatgaagaaccccacggtggacggcatcaccgttatcgacctcgagcccatcccgtacgacccaaagtttgagaagcagctggggcaggtcatgctgctcatcttatgcgtgactcaggtgctaatgatgcggaccacatgggccctctgcgaggccctcaccctggccaccggccccatctccaccctctgggaggggaaccccgggcgcttctggaatacgaccatcgccgtaagcatggcaaacatcttccggggttcctacctggccggcgccggccttctttttagcatcatgaagaataccacaaacacgcgccgcggaaccggcaacgtgggcgagacgttgggcgagaaatggaagtccagattgaacgccctcgggaagagcgagttccagatctacaagaagtccggtatccaggaagtggaccgcaccctggcaaaagagggaatcaagcgcggtgaaacggaccaccacgctgtgtcacgcggctctgccaagctgcggtggtttgtggaaagaaacatggtgaccccggaaggcaaggttgtggacctcgggtgcggccgcggaggctggagctactactgcgggggcctgaagaacgtgcgcgaggtcaagggcctgacaaaaggcggccccgggcatgaggagccaattcctatgtctacctacggctggaacctcgttcggctgcagagcggtgtcgacgtcttttttacgcctcccgagaaatgcgacacgctcctctgtgacatcggcgagagctcccccaaccccaccatagaagcaggccgcaccctgcgggtgctgaaccttgtggaaaattggctgaataacaatacccaattctgcatcaaggtcctaaacccgtacatgccaagcgtgatcgagaagatggagacgctacagagaaagtacgggggtgcacttgtccggaaccccctgtcccgcaacagcacccatgagatgtactgggtgtccaacgcgaccggcaacatcgtgagctccgtgaatatgatcagccggatgttaatcaacagattcacaatgaagcataagaaggccacgtacgagccggacgtagacctcggcagcgggacccggaatatcgggatcgagagcgagatccccaacctggatattatcggaaagagaatcgagaagatcaaacaggagcatgaaacctcctggcactacgaccaggatcacccctacaaaacctgggcctaccacgggagctacgagacgaagcagaccggctccgccagctccatggtgaacggggtggtccgcctgctcaccaagccctgggacgtcgtcccgatggtcacacagatggctatgactgacacgaccccgtttggccagcagcgcgtgttcaaggagaaggtggacacccgcacgcaagaaccgaaggaaggaaccaagaagctgatgaaaataaccgcggaatggctgtggaaggaactcggaaaggagaagacgccccggatgtgcacgcgcgaggagtttacccggaaggtccgtagcaacgctgccctgggcgcgatattcaccgatgagaataagtggaagtccgcccgcgaggctgttgaggacgggcgcttctgggagctggtggaccgcgagcggaacctacacctagagggcaagtgcgagacctgcgtctacaacatgatgggaaagcgggagaagaagctgggggaatttggcaaggccaagggtagccgcgccatctggtacatgtggctcggcgcacggttcctggagttcgaagcgctggggttcctcaacgaggaccattggttttcacgtggcaactccctgtcgggagtggagggcgagggcctgcaccggctcggctacatcctgcgcgaggtgggtaagaaggaaggcggcgctatgtacgccgacgacacggccgggtgggacacaaggatcaccctggaggacctaaagaacgaagagatggtgaccaaccacatgaagggcgagcataaaaagctggccgaggcgatcttcaaactgacgtaccaaaacaaggtggtccgcgttcagcggccgacgccacgcggtacagtgatggacatcatatcacggaaggaccaacgaggctccgggcaagtcgggacttacggcctcaatactttcacgaacatggaggcccagctgatccgccagatggagggagaggggatcttcaagtccatccaacacctgaccgccaccgaggagattgcagtgcagaactggctcgcccgggttgggcgcgagcggctgagccgcatggcaatctctggtgacgactgtgtcgtcaagccgatagacgaccggttcgcctccgccctgacggcacttaacgatatgggcaaagtgcgcaaggacatccagcaatgggaaccctcccgtgggtggaacgactggacccaggtccctttttgcagccaccacttccacgaattagtgatgaaggacggacgcgtgttggtcgtgccctgccggaaccaagacgagctcatcggccgcgcacggatttcccaaggggctggctggtcccttaaggagacagcctgcctggggaagtcctacgctcagatgtggacgctcatgtacttccaccgccgggacctgagactggccgccaacgcgatctgcagcgccgtgccctctcactgggtgcccaccagccggacgacctggtccatccatgccaagcacgagtggatgacaaccgaggacatgctagccgtgtggaaccgcgtgtggatccaggagaatccgtggatggaggacaaaacccccgtcgagagctgggaggaggtgccctacctgggaaagcgcgaggaccaatggtgcggttcccttatcggcctcaccagccgcgcgacatgggccaagaacattcagaccgccatcaatcaggtgcggtcactgatcggcaacgaggaatacacggactacatgccgtccatgaagcgcttccgcagagaggaagaagaggccggtgttctatggtga

SEQ ID NO: 24803 - RNA, 9876 nt, synthetic construct
  misc_feature 1..9876: note = derived and/or modified CDS sequence (opt11) from DENV-2__LC121816__SS-prME
  source 1..9876: mol_type = other RNA
accgtggggatgatcattatgctgatccccacggccatggcctttcacctcaccacccgcaacggtgaaccacacatgatagtcagccggcaggagaagggcaagagcctgctgtttaagacggaggacggagtaaacatgtgcaccctcatggccatggatttgggggagctgtgcgaggacactgttacctacaattgccccctcctgcgtcagaatgaacccgaggacatcgactgctggtgtaacagcacaagtacctgggtgacatacgggacctgcaccgccaccggggagcaccggcgcgaaaagcggtcggtagctctggtaccgcacgtaggaatgggcttagagacccgaaccgagacgtggatgtcctcagagggtgcctggaaacacgcccaacggattgagacctggatcttacgccaccccggattcacgatcatggcagctatcctggcgcacaccatcggaaccacctactttcagcgggttcttatattcatcttgctgacagctgtggcgccctccatgaccatgcgctgcatcgggatctctaatcgggatttcgtggaaggggtgtccggcgggagctgggttgacatcgtcctagagcacggctcgtgcgtgacaactatggctaagaacaagccgacgttagattttgagctcattaaaaccgaggccaaacagcccgccacgttacgcaagtactgcattgaggccaaactaaccaatactacaaccgcgagtcggtgcccgacgcagggggagccttccttaaacgaggagcaggacaagcgcttcgtatgtaagcacagcatggtcgaccggggatggggcaatgggtgcggcctcttcgggaaaggcggaatcgtgacctgcgccatgtttacgtgtaagaagaacatggagggtaagattgtgcaacccgagaacctggagtacacgatcgtcatcacaccccactccggcgaagagaatgccgtcgggaacgacacgggaaagcacgggaaggaggtgaaggtcaccccgcagtccagtatcacggaggcggagctcacgggctacggtaccgtgacgatggagtgcagtccccgcaccggcttagacttcaacgagatggtgctgttgcagatggagaacaaggcttggcttgtacaccgccagtggttcctggacttacctctcccctggttgccgggcgcggacacccaagggtcgaactggatccagaaggaaaccctggtgacgttcaagaatccccatgccaagaaacaggacgtagtggtgttaggcagccaggagggagctatgcacacggccctgaccggcgccacagaaatacaaatgtcctccgggaacctcttgttcacgggccatctgaagtgccgcctacggatggataagctgcagcttaaaggcatgtcatactccatgtgtaccgggaagttcaaggtcgtgaaagaaatcgcggagacccagcacggcacgatcgtgattcgtgtacagtacgagggtgacggctctccctgcaagataccctttgagatcatggacttagagaagaggcacgtgttagggcgtcttattacggttaacccaatagtcaccgagcgcgattccccagtgaacattgaggccgagccacctttcggtgactcatatatcatcattggggtggaaccggggcagctgaagctctcctggttcaaaaagggcagctcaattgggcaaatgttcgagaccaccatgcggggcgcaaaacgcatggccatcctgggcgacacagcctgggacttcggtagcctcggcggggtctttacgagcatcggcaaggcgctgcatcaagtgtttggggccatctacggcgcagcgttcagcggcgtgtcctggaccatgaagattctaataggggtcgtaatcacttggatcgggatgaacagccggtccacgagcttatccgtgagcttagtcctcgtaggggtggtcaccttatacctgggcgtgatggtgcaggcggactccggttgcgtcgtgagctggaaaaacaaggagcttaaatgcggcagcggcatcttcatcactgacaacgtgcacacctggacggagcagtataaattccagcccgagagccccagcaagctggcctccgccatccagaaggcctacgaagagggaatctgcggcattcgatctgtaacacggctggagaacctcatgtggaaacaaataacaccagaactgaaccatattctgtccgagaacgaggtgaagctgacgatcatgacgggtgacatcaagggcataatgcaggccggtaagaggagcttgcggccgcagcccaccgaattaaaatactcttggaagacctgggggaaggcgaaaatgttgagcaccgagcatcataaccagacgttgctgattgacggtcctgagaccgcggagtgtccgaacaccaatcgcgcctggaacagtctcgaggtcgaagactacgggtttggcgtcttcaccacgaacatctggctgaagctgaaggagcggcaggacgtgttctgcgacagcaagctcatgtccgccgccatcaaggacaacagagcggtgcacgcggacatgggatactggattgagagcgctctgaacgacacctggaaaattgagaaggccagtttcatcgaggtcaagagctgtcactggcccaagtcgcacacactatggagcaatggcgtgctcgagagtgagatgataatccccaagaacttcgccggtccggtgtcccaacacaactatcggccgggatatcacacacagaccgcgggtccatggcacctcggcaagctggagatggactttgacttctgcgaaggtacgacagtggtcgtgaccgaggactgcggtaaccgcggtcccagcttgaggaccacgaccgcctcagggaaattaataacagaatggtgctgccgaagctgcaccctacccccgctccggtaccgcggggaagacggctgttggtatggtatggagatccgacctcttaaggagaaggaggagaacttggtgaactctctggtcacggccggacatggacagatcgacaacttcagcctgggcgtacttggcatggccctcttcctggaggaaatgcttaggacccgggtcggcaccaagcacgcactcctcctggtggccgtttcttttatgactctcataacgggcaacatgagcttccgcgatctcggacgcgtaatggtcatggtcggcgcggccatgaccgatgacatagggatgggcgtcacctacctggccttattagctgctttcaaggtacggcccacttttgccgcaggcctgcttctgcgcaagctgacgtcaaaggaactcatgatgaccaccatagggatcgtgctgctttctcagtccaccattcccgagaccatcctcgagctgacggacgctctggcgctcgggatgatgatccttaagatcgtgagaaatatggaaaagtatcagcttgcagtgaccatcatggccatcctctgcgtcccgaacgccgtgatcctgcagaacgcctggaaggttagctgcacgatcctggcggttgtgtccgtgacgcccctcctcttgaccagcagccggcagaaggccgactggatacctctagccctgaccataaaggggctcaaccccaccgccatcttcctcactaccctgtcgcggaccaataaaaagcgctcctggcctcttaacgaagcgatcatggcggttggcatggtctcaatacttgcttccagtctgctgaagaacgacattcccatgaccggacccctcgtggcggggggactgctcacggtctgttatgtgctcacagggagatcggccgatctggaactggagcgcgcggctgacgtccggtgggaggaccaggcggagattagcggcagctcacccatcctcagcatcactatctcagaggatgggtccatgtccattaagaacgaggaggaggagcagaccctgacgatcctgatacgcaccggcctactggtcatctcaggcctgttcccggtgagcattcccatcaccgcagccgcttggtacctctgggaggtgaagaagcagcgggcgggggtcctctgggatgtcccgagcccaccgcccgtggggaaggccgaactggaggacggagcttaccgcatcaagcaaaagggcatccttgggtactcccagatcggcgctggcgtctacaaggaagggaccttccacaccatgtggcatgtcacgcgaggtgcggttctgatgcacaagggcaaaaggatagagccgagctgggccgacgtacgcaaggatctcatctcatacggcggcggctggaaattggagggcgagtggaaggagggggaagaggtccaggtgctggccctggaaccgggtaagaatccccgcgccgtccaaactaagccaggcctgttcaaaaccgacaccggtacgatcggggccgttagcctagacttctcccccggcaccagcgggtccccaatcgtggacaagaaagggaaggtggtgggcctttacgggaacggcgtggtcacccgtagcggcacctacgtgtccgcgatcgcccagaccgaaaagagtattgaagacaaccccgagatcgaagacgatatcttccgcaagcgtcgcctgaccatcatggacctccatcccggggcgggtaagaccaagcgctacttaccggctattgtgcgtgaagcgatcaagcgagggcttcgaacccttatcctggccccgactagggtcgtagcagccgagatggaggaggctctgagaggcttgccaatccgctaccagacccccgcgatacgggcagaacatacaggaagagaaatcgtcgatttgatgtgccacgcaaccttcacgatgaggctgttgtcccccgtacgcgtgccaaactataacctcattatcatggatgaggcccacttcaccgacccagccagtatagcggccagggggtacatcagcaccagggtggaaatgggagaggccgcggggatttttatgaccgccacgccccccggctcgcgggacccgtttccccagagcaatgcacctattatggacgaggaacgcgagatccccgagcggagttggaactccggacacgagtgggtgacagacttcaagggcaagaccgtgtggttcgtgccgtccatcaaggccggcaatgatatagccgcctgtctgcgcaagaacggcaagaaggtcatacaactcagccggaaaacatttgactccgaatatattaaaacccgcactaacgactgggactttgtggtgacgaccgacatcagcgagatgggcgcaaactttaaggcagaacgcgtcatcgatccccgccgttgcatgaagcccgtcatcctgacggacggggaggagagagtcatcttggccggtcccatgcctgtaactcattccagcgctgctcagcgccgtggacgcatcggccggaacccaaagaacgagaacgaccaatatatatatatgggggagcccctcgagaacgacgaggactgcgcgcactggaaggaggccaagatgctgctggacaacatcaatacccccgagggcatcataccgtcaatgtttgaaccggagcgcgagaaggtggatgcgattgacggagagtaccggctgcgcggggaagcccggaaaaccttcgtcgacctgatgcgccggggcgacctacccgtctggctcgcctaccgtgtcgcggccgaagggatcaactacgccgaccggcgttggtgctttgatggtgtaaagaacaaccagatcctggaggagaatgtggaggtggagatctggaccaaggagggcgagcggaaaaagttaaagcctcgctggctcgacgcgcggatctactctgaccccctggcattaaaggaattcaaggaattcgcggccgggcgaaagtccttaaccctgaatctgatcaccgagatggggcggctccccacgtttatgacacagaaggctcgcaacgctctggacaacctggcggtcttacacaccgctgaggcaggcggacgggcgtacaaccacgccctgagtgagctgcctgaaaccctcgagaccctgttattgctaacgctcctcgcgaccgtaaccggcgggatcttcctgttcttaatgtccggcaagggtattgggaaaatgacacttgggatgtgttgtatcattacggcgagtatactgctgtggtatgcccaaatccaaccccactggatcgccgcctccatcatcctcgagttctttctgattgtgctgctaatccccgagcccgagaagcagcgcacgccccaggacaaccaactgacatatgtggtgatcgcgattctgaccgtggtcgccgctacgatggccaacgagatgggatttctagagaagacgaagaaggacttcgggctgggaagcatcgcgacccagcagccggaatccaatatactggacatcgacctccggccggccagcgcctggactttatacgctgtggctacaacgtttattacccccatgctgcgccacagtattgagaacagctccgtgaacgtctcactcaccgccatcgcgaaccaggcgactgtgctcatggggctggggaagggctggccgctcagcaaaatggacatcggggtcccactgctggccatcggctgttacagccaggtcaaccccataacgctcaccgccgccctgctgctccttgtggcccactacgccatcatcggcccggggctgcaggccaaggctacgcgggaagctcagaaaagagcggcagccggtatcatgaagaatcctacagtggacgggatcactgtcatcgacttagatccaatcccctacgaccccaagttcgagaagcagcttggccaagtgatgttgctcgtgctgtgtgtcacgcaggtactgatgatgcggaccacttgggccctctgcgaggctctgacgctggccactgggcccatctccaccctctgggagggcaatccgggacgcttctggaacaccacgatcgcagtgtccatggctaatatattccgcggaagctacctggcaggtgctggattactcttttcaatcatgaagaatacgaccaacacccggcgcggcacgggcaataccggagagacgcttggcgagaagtggaagaaccggctgaatgccctcggcaaaagcgagttccaaacttataaaaagtccggcatacaggaggtcgacagaacgctggcgaaggagggcatcaagcgcggtgagaccgatcatcacgccgtgtcacgcgggtccgcgaaactgcggtggttcgtggagcggaaccttgtgacacccgagggcaaagtggtggacttgggttgcgggagaggcggatggagctactattgtgggggcctgaagaatgttcgcgaggttaaaggtctgaccaaggggggacccggccacgaagagccaatacctatgtcaacgtacggttggaacctggtccggctacagagcggcgtcgacgtgtttttcacgccccccgagaagtgcgacactctcctatgcgacatcggcgagtcaagcccaaaccctaccgtggaggccggccgcaccctgcgggttctcaacttggtagaaaactggctgaacaacaacacacagttctgtatcaaagttctgaatccctatatgccctccgtcatcgagaagatggaagccctccagcgcaagtacggcggtgccctcgtacgcaacccgctgtctaggaattcgacccacgagatgtattgggtgtccaacgcaagcggcaatatcgtatcatctgtgaacatgatctcgaggatgttaatcaaccggttcaccatgcggcacaagaaggcgacgtacgagccggacgtggacctgggaagcgggacgcggaacattggtattgaatcagagacccccaacctggacatcatcggcaaacgcatcgagaaaatccggcaagagcacgagacctcttggcattacgatcaggaccatccctataaaacctgggcctaccacggttcatacgaaaccaagcaaactggctccgcgtcatcgatggtcaacggggtagtccgcctactgacgaaaccgtgggacgtgatccccatggtgacccaaatggccatgacggacaccaccccctttgggcagcagagggttttcaaagagaaggtcgacacccgcacccaggagcctaaggagggcaccaagaagctgatgaaaatcaccgccaagtggttatggaaggagttaggcaagaaaaagacaccgcgcatgtgtacgcgcgaggagttcactaggaaggtccgaagcaacgcggctttaggggccattttcaccgatgagaacaagtggaagtccgcccgggaggccgtagaggactcccgcttctgggagctcgtggataaggaacggaacctgcacctggagggcaagtgcgagacctgtgtctataacatgatgggcaagcgcgagaaaaagttgggggagttcggaaaagcaaaggggagccgggccatctggtatatgtggttaggtgccagattcctggagttcgaggccctcggctttctgaacgaggaccactggttctcgagggaaaacagcctgagtggcgttgagggggaaggcctccacaagctggggtacatcctgcgagacgtgtcaaaaaaggagggcggcgccatgtacgccgacgacacggcaggttgggacacgcggatcaccttggaggatctgaagaacgaggaaatggtgaccaaccacatggagggggaacacaagaaattggccgaggcaatcttcaagctcacttaccagaacaaggtcgtgcgcgtgcagcgccccacgccgcggggaaccgtcatggatatcatcagccgccgtgaccagagggggtccgggcaggtaggcacttacggcctgaatacgttcaccaacatgggtgcgcaactgatccgtcaaatggagggcgagggcgtgttcaagagcatacaacacctgactgctaccgaggaaatcgctgtccaagactggctggccagagtgggccgcgaacgcctgtcccgtatggccatcagtggggacgactgcgtggtcaaacccctcgacgaccgcttcgcgtccgccttaacggcgttgaacgacatggggaaagtgcggaaagatatccagcaatgggagccgtcccggggctggaatgattggacccaggtgccattctgctctcatcacttccacgagttaatcatgaaggacgggcgggttctggtggttccgtgcagaaaccaggacgagctgatcgggcgggcgcgcatctcgcagggcgcaggctggtccctccgggagacagcatgcctggggaaatcttatgcccagatgtggtcactcatgtacttccaccgccgggacctccgcctggcagccaacgccatatgcagcgccgtcccctcccactgggtcccgaccagccgcaccacgtggtcgatccacgcaaagcatgaatggatgacaacagaggatatgctgaccgtgtggaatcgtgtctggattcaggaaaacccctggatggaggataagacacccgtggagagttgggaagagatcccctacctcgggaaacgagaggatcagtggtgcgggtccctgatagggctaacctctcgagcaacatgggccaagaacatacaaacggcgattaaccaggtaaggagcctgatcggaaacgaagagtatacggattacatgccatccatgaagcgtttccgccgggaagaggaggaggctggtgtcctctggtga

SEQ ID NO: 24804 - RNA, 9876 nt, synthetic construct
  misc_feature 1..9876: note = derived and/or modified CDS sequence (opt11) from DENV-2__LC111438__SS-prME
  source 1..9876: mol_type = other RNA
accgcaggcattatcatcatgatgattcccacggtgatggcattccacctgactacgagaaacggggaaccccacatgatcgtcagccggcaggaaaagggcaaaagcctcctgttcaaaaccgaaaacggggtgaatatgtgcaccctgatggctatggacctcggggaactttgcgaggacaccatcacttacaactgccccctgctccgccagaacgagcccgaggacatcgattgctggtgcaacagcacctcaacctgggtgacctacggtacctgcaccgccaccggcgagcatcgacgcgagaagcggagcgtcgccttagtgccccacgttggcatggggctggagacccgcaccgaaacatggatgtccagcgagggtgcctggaagcacgcccagcggatcgaaacctgggtgctacgccaccccgggttcaccatcatggcggctattctggcctataccatcggtaccacgcattttcagcgtgtactgatcttcatcctccttacagccgtggcgccctccatgaccatgcgctgcatcgggatcagcaaccgggactttgtcgaaggcgtgagtggcgggtcgtgggtggacatcgtcctggagcacgggtcctgtgtgaccaccatggccaaaaacaagcccactctcgacttcgagctgatcaagacagaagctaagcaccccgccaccctgcgcaagtactgcattgaggcgaagctcaccaatactaccaccgcaagccggtgcccaacgcagggagagccttccctgaatgaggagcaggacaagaggttcgtatgcaagcacagcatggtcgaccggggctggggcaacggctgtggcctgttcgggaagggcgggatagttacgtgtgccatgttcacatgcaaaaagaacatggaaggcaaggttgtccagcccgagaatctcgagtacaccatcgtgatcacaccgcactcaggggaggagaacgccgtggggaacgacacgggcaagcacgggaaggagatcaaggttacgccgcagagctccatcaccgaggccgagctgaccggatacgggaccgtgacaatggaatgcagcccccggaccggcctggacttcaacgaaatggtcctcctgcagatggagaataaggcatggctggtccaccgtcagtggttcctcgacctgcccctgccctggctgccgggagcggatacccaggggtccaactggattcagaaggagacactggtgacgttcaagaatccgcatgccaagaagcaggacgtcgtggttttaggcagccaggaaggcgccatgcataccgccctcaccggcgctacggagatccagatgtcatccgggaacctgttattcaccggccacctcaagtgccgcctgcggatggacaagctgcagctcaagggcatgagctacagcatgtgcaccgggaagtttaaagtcgtgaaggagatcgcggagacccaacacggcaccattgtgatccgcgtccagtacgagggggacgggtcaccttgcaagatcccctttgagatcatggaccttgaaaagcgccatgtactgggccgcctcatcaccgtgaaccctatcgtcaccgagaaggatagccctgttaatatcgaggccgagcctcctttcggggatagctacatcataattggcgtggaacctgggcaactgaaactatcctggttcaagaaaggcagctccatcgggcagatgttcgaaaccactatgcgcggcgccaaacggatggcgatcctcggcgacacagcctgggacttcgggtccctaggaggggtctttacctcgatcggcaaggcgctgcaccaagtcttcggcgccatctatggcgcggccttctcgggcgtgtcctggaccatgaagatcttaatcggggtcgtgattacctggatagggatgaacagccgcagcacgtctctgtccgtgtccctggtcttagtgggggtagtcaccctgtacttaggcgtgatggtgcaggcagactccggctgtgtagtgagctggaagaacaaggagctgaagtgcggcagcggaatcttcatcactgacaacgtgcacacctggacggaacaatataagttccagcccgagagcccgcccaagctcgcgtcggccatccagaaggcccatgaagaggggatttgcggcatccggagcgtcacccgtctggagaacctgatgtggaaacagatcaccccggagttgaaccacatcctgagcgagaacgaggtgaagctgaccatcatgacgggggacatcaaaggaataatgcaagctggcaagagatccctccgaccccagcccacagagctgaagtacagctggaaggcctggggtaaagccaagatgctgtcgaccgagctccacaaccacaccttcttaatcgacggtccggagacggccgagtgccccaacacgaaccgggcctggaacagcctggaagtggaggactacgggttcggcgtcttcaccactaacatctggctcaagctgaaggagaagcaggacgtgttctgcgactccaagctaatgagcgccgcgatcaaggacaaccgcgccgtgcacgctgacatggggtattggatcgagtccgctctcaacgacacgtggaagatcgagaaggctagtttcatcgaggtcaaatcttgccactggcccaagagccacacgctgtggtctaacggcgtgttagagtcagagatgattatccccaagaacttcgccggaccagtgagtcagcataactaccggcccgggtaccacacccagaccgccggcccatggcacctcggcagcctggagatggacttcgacttctgcgagggcaccacggtcgtcgttactgaggactgcggaaaccgtggcccaagcctccggaccaccacggcgtccggcaaacttatcaccgagtggtgctgccgatcgtgcaccctgccgcccctacgctatcgcggggaggacgggtgctggtacggaatggagatccggcccctcaaggagaaggaggagaacctggtgaactccctcgtaaccgccggtcacgggcagattgacaacttctctctcggagtcctgggcatggctctgttcctggaagagatgctgcgcacgcgggtcgggaccaagcacgccatcctcctcgtggccgtttccttcgtcaccctgataacgggaaacatgagcttccgcgacctgggacgggtgatggtgatggtcggtgccactatgacggacgatatcgggatgggcgtgacctacctcgccctgcttgcggccttcaagatccgcccgaccttcgccgccggcctcctgctacgcaagctcacgtccaaggagctgatgatgacaacgatcgggatcgtgttactatcccagtccaccatcccggagactatactggagctcaccgacgccctcgcgctcggcatgatggtgctgaagattgtgcgtaatatggagaaataccagttggccgttaccatcatggccatcctgtgtgtgcccaacgccgtgatcctgcagaacgcatggaaggttagctgcaccacactcgcggtggtttctgtcagccccctgttactcaccagttcccaacagaaggcagattggattcccctggcactcacgatcaaagggcttaatccgaccgccatctttcttacgaccctgtcccgcacctccaagaagcggtcctggccgttgaacgaggcgatcatggcagtgggcatggtgagcatcctggcctccagcttactcaagaacgacatccccatgacaggtcctctggtcgccggcggcctgctcacggtgtgctacgtgcttaccggcaggtcggctgacctggagcttgagagagcggccgatgtccgctgggaggagcaggccgagatctccggcagctccccgatcctgagcatcactatttccgaggatgggagcatgagtatcaaaaacgaagaggaggagcaaactcttacaatcctgatccggaccggtctgctggtgatctcgggactcttccccgtgtccatccccattaccgctgccgcgtggtatttatgggaggtcaagaagcagcgtgccggggtgctgtgggacgttccctccccgcctcccgtcgggaaggcagagctcgaggacggggcctaccggatcaagcagaagggcattttggggtacagccagatcggcgcaggcgtgtacaaagaggggaccttccacaccatgtggcacgtgacgcgcggcgcggtcctcatgcacaaggggaagcgcatcgaaccgagctgggccgacgtcaaaaaggatttaatatcctacggcggagggtggaagttggagggcgagtggaaggagggggaggaggtgcaggtactggcactcgagccaggcaagaacccccgcgccgtgcagaccaagcccgggcttttcaagaccaacaccggcacgataggtgccgtcagcctggatttctctccgggaaccagcggcagtcccatcgtcgacaagaaggggaaggtagtgggcctctacgggaacggcgtcgtgacccggtcgggcacctacgtgtccgccatcgcacagacggagaagtccatagaggacaaccccgagatcgaggacgacatctttaggaagaaacggctcaccatcatggacctacaccccggggccggcaagaccaagcgctatctgcctgccatcgtccgggaggcaatcaagagagggctccgtaccctgatcctggcccccacacgtgtagtggccgccgagatggaagaagccctccggggcttgcccatccgttaccagactccagcgatccgcgccgagcacaccggtcgtgagatcgtcgatctgatgtgccacgcgacctttactatgcgcctcctgagcccgatccgggtgcccaactacaatttaatcatcatggacgaggctcacttcaccgatcccgcctccatcgctgcccgcggatatatctcgacacgggtggaaatgggggaggcggcggggattttcatgaccgccacgcctccgggctcgcgcgatccgttcccccagtctaacgcgcccatcatggacgaggagcgggagattccggagcgctcttggaacagcggacatgagtgggtcaccgacttcaagggcaagaccgtgtggttcgttccctccattaaggccgggaacgatatcgccgcctgcctcagaaagaacggtaagaaggtgatccagctgagccgcaagaccttcgactccgagtacatcaagacacggacaaacgactgggacttcgtcgtgaccaccgacatcagcgaaatgggcgcaaacttcaaggctgagcgcgtcatagacccccgacgctgcatgaagcccgtgatcctcacggacggggaggaacgggtgatactggcaggaccgatgcccgttacccactccagcgccgctcaacgcagagggcgtgtcggccggaaccctaagaatgagaacgaccagtacatctacatgggagagccgctggagaacgacgaggactgcgcacattggaaggaagccaaaatgctgctcgacaacatcaacactccggagggcatcatcccgtccatgttcgagcccgagcgcgagaaagtggacgcgatcgacggagaataccgcctgcgcggggaggcccgcaaaaccttcgtcgacctgatgcggcgcggtgacctcccggtgtggctggcctatagggtcgcggcggaggggatcaactacgccgaccgccggtggtgcttcgatggcgtgaagaacaaccagatcctggaggagaacgtggaggtcgagatctggaccaaggaaggcgagcggaagaaactcaaaccccgttggctcgacgcgcgcatatatagcgaccccctggccctgaaggagtttaaggagttcgcggccggccggaagagtctggcattgaacctcatcacggaaatgggccgactgcccaccttcatgacgcaaaaggcccggaacgcgcttgacaacctcgcagtcctgcacacggccgaggctgggggccgcgcctacaaccacgctctgagtgagctccccgagacgctggagaccctgctcctgttgaccctcctggccacggtcaccgggggcatcttcctattcttgatgtctggcaaggggatcggcaagatgactatggggatgtgctgcatcatcaccgcgagcatcctactctggtacgcccaaatacagccccattggatcgccgcatccatcatactcgagtttttcctaatagtgctgctcatccccgaacccgagaagcagcgtaccccgcaggacaaccagctgacctacgtggttatcgctatcctgaccgtagtcgccgccaccatggccaacgagatgggctttttagagaagaccaagaaagacttcgggctgggtagcatagcgacgcagcaacccgagagcaacatcctcgacatcgacctccgccccgcctctgcctggaccctgtacgccgtggcgaccaccttcatcacgcccatgctgcggcacagcatcgagaactccagcgtcaacgtttccctcaccgccatagccaaccaagccaccgtattgatggggctgggcaagggctggccgctatccaagatggacatcggcgtccccctgctagccattggttgctactcccaagtgaaccccatcaccctcatggcggccctgctgctcctggtggcccactacgcaattattgggcccggcctacaggccaaagcgacgcgcgaggcccagaagcgggccgcagccggcatcatgaagaacccgaccgtagacgggatcaccgtgatcgacttagatccaatcccctacgaccccaagttcgagaagcaattgggtcaggttatgctgctcgtcctatgcgtgacccaggtcctgatgatgcgcacgacctgggcgctgtgcgaggctctgacgctcgccaccgggccgattagcacgctctgggagggtaatcccgggcggttctggaataccaccatcgcagtctccatggctaacatctttaggggatcctacctggcgggcgccgggctcctgttctccataatgaagaacaccgccaacacgcggcggggaacggggaataccggcgaaacgctgggtgagaagtggaagaaccgcctgaacgccctcgggaagtcagagttccagatttataagaaatcaggaatccaggaggtagacaggacgcttgcgaaggaggggatcaagcgcggagagaccgaccaccacgccgtgagccgggggtccgccaagctgcgctggttcgtggaacgtaaccttgtgacccccgaaggcaaggtggtcgacctgggctgcgggcgcggcgggtggagctactactgcggaggtctgaagaacgttaaggaggtgaagggcctcacgaagggcgggcccggacacgaggaacctatccccatgtcaacgtatgggtggaacctggtccggctccaatcgggagtggacgtgttcttcactccacccgagaagtgcgacactctgctatgcgacatcggggagagttcaccaaatcccaccgtcgaggccggccgcacactgcgggtgctcaatctagtggagaattggctgaacaacaacacccagttctgcatcaaggtactcaacccgtacatgccgagcgtgatcgagaagatggaggccctgcagaggaagtacggcggggcactggtgaggaaccccttgtcccgcaacagcacccacgaaatgtattgggtctcgaacgccagcggcaatatcgtgtccagcgtgaacatgatctcccggatgctcatcaaccgcttcaccatgcggcacaagaaagccacctatgagcccgacgtggacctggggagtggcacacgcaacatcgggatcgagtccgaaactcctaacctggacataatcggtaagcggattgagaagatcaagcaggagcacgagaccagctggcactacgatcaggaccacccgtacaagacctgggcttaccacggcagttacgaaacgaagcagaccgggagcgcctcaagcatggtgaacggcgtggtccggctactgaccaagccctgggacgtgatccccatggtgacccagatggcgatgacggacaccacgccctttgggcagcagcgagtcttcaaggagaaggtagacacccgaacacaggagccgaaggagggtactaagaagctaatgaagattacggcgaagtggctctggaaggagctgggcaagaagaaaacgccccggatgtgcacacgggaggagttcacgcgcaaagtccgttcgaatgccgccttaggggccatcttcaccgatgagaataagtggaagtccgcgcgagaggcagtggaggattccggcttctgggagctcgtggacaaggaacggaacctgcatctcgaggggaaatgtgagacgtgtgtctacaacatgatgggcaagcgcgagaagaaacttggtgagttcggcaaggccaagggctcgcgggccatctggtacatgtggctgggggcaaggttcctggagttcgaagccctcggtttccttaacgaggaccattggttttcccgagaaaacagcctctcgggagtggagggcgagggcttacacaagctcgggtatatcctgcgcgacgtatccaagaaggaaggcggggccatgtacgccgacgacacagccggatgggacacccggatcaccctcgaggacctgaagaacgaggaaattgtcaccaactatatggagggggaacataagaagttagcggaggccatcttcaagctcacgtaccagaacaaggtcgtgcgcgtccagcggcccacgcctaggggcaccgtaatggacatcatcagccggcgagaccagcgggggagtggtcaagtggtaacctacggcctgaacacgttcaccaacatggaagcccagctgatcaggcagatggagggggagggcgttttcaagagcatccagcacctcacggtgacagaggagatcgccgtggagaactggctggtgcgggtggggcgggagcgactgtcccgcatggcgatcagcggggacgattgcgtcgtgaagcccctcgacgaccgcttcgcgtccgccctgacggccctgaacgatatgggcaaggtccggaaggacatccagcaatgggagcccagccgaggctggaacgactggacccaggttcccttttgctcccaccacttccacgagttgatcatgaaagacggcagggtgctggtggtaccctgccgcaaccaggacgaactcattgggcgggcccggatcagccagggcgcggggtggtccctcagggagacggcgtgcctgggcaagagctacgcccaaatgtggtccttgatgtacttccaccgccgggatctccgcctggccgccaatgcaatctgtagcgcagtgccgtcacactgggttccgaccagccggacgacctggtccatacacgccacacacgagtggatgactaccgaggacatgttgaccgtctggaacagagtgtggatccaggagaacccgtggatggaggataagacacccgtggaaagctgggaggagattccgtacctcggcaagcgagaggaccagtggtgcgggagcttgatcggactgaccagccgcgccacctgggccaaaaacatccagacggcgatcaaccaggtccggtcgctcatcgggaacgaggagtatactgactacatgcccagtatgaagcgctttcggcgcgaggaggaggaggcgggagtgctgtggtga

SEQ ID NO: 24805 - RNA, 9876 nt, synthetic construct
  misc_feature 1..9876: note = derived and/or modified CDS sequence (opt11) from DENV-2__KF744400__SS-prME
  source 1..9876: mol_type = other RNA
accgcaggcatgatcatcatgctgatccccactgttatggccttccacttgacgacccgtaacggtgaacctcacatgatcgtcagccggcaggaaaagggcaagagcctgctgttcaagaccgagaacggggtgaacatgtgcacactaatggcgatggacctgggcgagctatgcgaggacaccatcacttacaaatgccccctcctgcgccagaacgagccggaggacattgactgctggtgcaacagcaccagcacctgggtgacgtacgggacctgcacaaccaccggcgagcaccgacgcgagaagcgaagcgtcgccctggtgccacacgtgggcatggggttggagacacggacggaaacctggatgagcagcgaaggcgcttggaagcatgcgcagcggatcgagacgtggatcctacgtcatccagggttcaccctgatggccgcaatacttgcctacacaatcggcaccacgcacttccaaagggcgttgattttcatcctgctcaccgcggtcgcacccagcatgaccatgcgatgtatcgggatcagcaaccgggacttcgtggagggcgtgtccggcgggagctgggtagatatcgtcttggaacatggctcctgcgtgaccacaatggccaagaacaagcccaccctggacttcgagctcatcaagaccgaggccaaagagcccgccaccctgcgcaagtactgcattgaggccaagctgacaaacacgaccaccgagagtcggtgcccaacacaaggggaaccctccctcaacgaagaacaggacaagcggtttgtttgcaagcactcaatggtggatcgaggctgggggaacgggtgtggcctgttcggaaagggagggatagtgacctgcgctatgttcacgtgtaaaaagaacatggagggtaagatagtccagccagagaacctggaatataccatagttattactccccactccggagaggagcatgccgtcggaaacgacaccggcaaacacgggaaggagatcaagatcacccctcagagctccaccaccgaggcggagctcacgggctacgggaccgtgacgatggagtgctcacctcgtaccggcctggactttaatgaaatggtgctgctacaaatggagaacaaggcctggctggtgcaccgacagtggtttttggaccttcccctgccttggctgcccggggccgacacacaggggagcaactggatccagaaggagactctcgtcacctttaagaacccacacgcgaagaagcaggacgttgtcgtgctgggaagccaggaaggcgccatgcacaccgcgctgacaggtgccacagacatccagatgagctccgggaaccttctgttcaccggacacctgaaatgccgtctcaggatggataagctgcagctgaagggcatgagctattcaatgtgcacggggaagttcaaggtggtcaaggaaatcgccgaaacgcagcatggcaccatagttgtgcgggtccaatacgagggggacggcagcccatgcaagatcccattcgaaatcatggaccttgagaagagacatgtgctgggccgcctgatcaccgtgaacccgatcgtcacggaaaaggactcccccgtaaacatcgaggccgagccgcccttcggtgacagctacgtgataatcggcgtcgagcctgggcaactcaagctgaactggttcaagaagggcagcagcatcgggcagatgttcgaaacaacaatgcgcggggcaaagagaatggccatcctgggcgacaccgcttgggacttcgggtccttaggtggggtattcaccagcatcggcaaggctctgcaccaggtgttcggggcgatctacggcgccgccttctccggcgtcagctggacaatgaagatcctgatcggggtcattatcacctggattggcatgaactccagaagcaccagtctgagtgtgtcgctcgtcctggtgggggttgtcaccctgtaccttggggtcgtcgtccaggccgactccgggtgtgtagtgtcgtggaagaacaaggagctgaagtgcggcagcggcatctttatcactgacaacgtccacacttggaccgagcagtataagttccaacccgaatctccctctaaacttgcgtcagctatacagaaagcgcaccaggaggggatctgtgggattcggtcagtgactcgcctcgagaacctgatgtggaagcagatcacgcctgaactgaaccacatcctcagcgagaacgaagtgaaactaaccatcatgacgggggacattaagggtatcatgcacgccggaaaacggtccctgcgcccacaacccactgaactgcgatattcctggaagacttggggcaaggctaaaatcctgtccaccgagagccacaatcagacgttcctaatcgacggccccgagaccgcggaatgcccgaataccaaccgcgcctggaactcccttgaggtcgaagactacgggttcggcgtctttacaaccaatatatggctgaagctgcgggagaaacaagacgccttctgcgaccccaagctcatgtctgccgccattaaggacaaccgagctgtgcacgctgacatggggtactggatcgaatccgcccttaacgacacgtggaagatcgagaaggcgagcttcattgaagtcaagaactgtcactggcctaagtcccacacactgtggagtaacggcgttctcgagtccgaaatgattatcccaaagaatttcgccggtccggtatcccagcacaactaccggcccgggtaccatacgcagaccgcggggccctggcacctagggaaactggaactcgacttcgacttctgtgagggcaccaccgtcgtggttacggaggactgcggtaaccgcggaccctccctacgcacgaccaccgccagcggaaaactcatcacagagtggtgctgccgctcgtgcaccctcccacccctgcgatacaagggcgaggacggctgttggtatggtatggagatccgtcccctgaaggagaaggaagagaacctcgtctcctcactggtgaccgccggccacggacagatagacaacttctccctgggtgtgctcggcatggccctgttcttggaggaaatgctccggacacgcgtcgggatgaagcacgctatcctgcttgtagcggtgagcttcgtcacgctgatcacaggcaacatgtccttccgggacctggggcgagtgatggtaatggtcggcgcgaccatgaccgatgatatcgggatgggcgtgacttacctggccctcctggctgcgttcaaggtgagacccaccttcgccgcagggttactactacggaagctgaccagtaaggagctcatgatgacgacaattgggatcgtactactgtcccaatccaccatacccgagacaatcttggagctgaccgacgccttagcccttggcatgatggtgctgaagattgtgcgaaagatggagcgataccagttggctgtcaccatcatggctatcctctgcgttcccaactccgtcatcctgcaaaacgcctggaaggtgtcatgcacaatactggccgtggtgtccgtgagcccccttctactgacctcgtcgcagcaaaaagccgactggatccccctcgccctgaccatcaagggccttaatccgactgcaattttcctcaccaccctttcccgcacttccaagaagcggtcctggccccttaacgaggccatcatggctgtaggcatggtgagcatcctcgcgtcgagtctgctgaagaacgacatccctatgacaggtccactcgtggccggtggccttctgaccgtgtgctatgtcctcaccgggcgcagcgccgaccttgagctggagaaggccgcagacgtgcgatgggaggaccaggctgaaatctccggcagctccccaattctcagcgtgatcgtatccgaggatggtagcatgtccatcaaaaacgaggaggaagaacaaatcttaaccatcctaattcgcactggcctcctggtgattagcggactgttccccgtgtccatcccgatcaccgcggccgcctggtatctctgggaggttaagaagcagagggccggggtgctgtgggatgtgcctagcccgccgcctgtcggcaaggcggaactcgaggacggagcataccgcataaagcagaaggggatcctcgggtacagccagatcggcgcaggcgtgtacaaggaagggaccttccacaccatgtggcacgtaacacggggcgccgtcctgatgcacaaggggaagcgcatcgagccaagctgggcggacgtgaagaaggacctgatatcgtacggcgggggttggaagctcgaaggcgagtggaaggagggggaagaggtgcaggtcctggcgttggagcccgggaaaaacccacgggccgtgcagacaaagcctggcctctttaagaccaacgccggcaccataggggccgtgagcctggacttcagcccgggcacctccggttcgcccatcatcgacaagaaggggaaggtagtgggtctctacgggaatggagtggtaacgcgaaacggcagctacgtgagtgccatcgcccagaccgagaagtccattgaggacaaccccgaaattgaggacgacatcttccgaaagaagagattgaccatcatggacctccaccccggggccggcaagaccaagcggtacctgccggcaatagtgcgagaggccatcaaacgcgggttacgcactctcatcctggcgccgacccgggtcgtggccgccgagatggaggaagcgctgaggggcctccccatcagataccagacccccgcaatccgggcggaacacaccgggcgcgagatcgtcgacctcatgtgccatgcaacgttcaccatgcgactattgagcccgatccgcgtacctaactataacctgatcattatggatgaggcacatttcactgaccccgcttcgatcgccgcgaggggctatattagcacccgcgtggagatgggcgaggccgctgggatcttcatgactgctacgccgccgggctccagagacccattcccgcagtctaacgccccgatcatggacgaggagcgcgaaatacccgagcggtcatggaacagcgggcacgagtgggtgaccgacttcaagggtaagacggtctggttcgtgccctccatcaaggcggggaacgacatcgccgcctgcctgcgaaagaatggcaagaaggttatccagctgagccggaagacgtttgactccgagtatgttaagacacgcaccaacgactgggactttgtggtgaccacagacatctctgagatgggcgcgaacttcaaagccgagcgggtcatcgacccccgccgctgcatgaaacctgtcatactgaccgacggggaagaacgcgtaatcctggctggcccaatgcccgtcacccactccagcgccgcccagcgtcgcgggagaatcggccgtaacccgaagaatgagaacgaccaatacatctatatgggggagcccctcgagaacgatgaggactgcgcacactggaaggaggcgaagatgctcctggataatatcaacacgcccgagggcatcattccctccatgttcgagccggagagggagaaagtggacgctatcgacggcgagtatcggctccgcggggaggccaggaagacgttcgtcgacttaatgcgcaggggcgacctgccagtctggttagcctacaaggtggccgcggaggggatcaactacgctgaccgacggtggtgcttcgacggcatccggaacaaccagatcctggaagagaatgtcgaggtggaaatttggacaaaggagggagagcggaagaaactgaagccacgctggctcgacgcacgcatctacagcgaccccctggcactgaaggagttcaaggagttcgcggccggccgcaagagcctcaccctgaatctgatcactgagatgggccggctccccacattcatgacccagaaggcacgcgatgccctggacaacctggccgtgctccacaccgctgaggccggtggtagagcctacaaccacgccctgagcgagctaccggagaccttggagacactgctgttactgactctgctcgcgacggtcaccggaggcatcttcctgttcttgatgtccggtcgcggtatcggcaaaatgacgctcgggatgtgctgcatcataactgcgtccatcttactatggtacgcccagatccagccacactggatcgccgcatcaatcatcctcgagttcttcctgatcgtattgctgatccctgagccagaaaagcagcggacccctcaggacaaccaactgacatacgtggtaatcgccatcctgacagtggtggcggccacgatggccaacgaaatgggcttcttggagaaaaccaagaaggacttgggcttgggatctatcgccacccaacagcccgaaagcaacatcctggacatcgacctgcggccggcctccgcgtggaccctgtatgccgtcgcgacgaccttcattacccccatgctcagacacagcatagaaaactccagcgtaaacgtatcgctgaccgcgatcgcaaaccaggcgacggttctgatgggtctcgggaagggctggccgctgagcaagatggatatcggggtgccactgcttgccatcggctgctactcccaagtgaatcccatcaccctgaccgcagccctgttgctcctggttgcgcactacgctattatagggcccggccttcaggccaaggcgacccgcgaggcccagaagcgcgcggccgccggtataatgaagaacccgacggtagacggcatcacggctatcgatctggacccgatcccttacgaccccaagttcgaaaaacagctgggtcaggtgatgctcctggtcctgtgtgtcacccaggtactcatgatgagaaccacgtgggcgctgtgcgaggcgctgacccttgccaccggaccgattagcacgctgtgggaaggtaaccctgggaggttctggaacacgaccatcgccgtctcgatggccaacatcttccggggcagctacctggccggcgcggggcttctattctccatcatgaagaacacaactaacacgaggcggggaaccggtaacataggcgaaaccctgggcgagaagtggaagtcccgcctcaatgcactgggcaagtccgagttccagatctacaagaagtccggcatacaggaggtcgatcggaccctagctaaagagggtataaagcgcggcgaaacggaccaccacgccgtctctcgtggcagcgccaagctcaggtggttcgtcgagcgtaacatggtaacaccagagggcaaggtagtcgacctcggctgcggtcgcggcgggtggagctactattgcggcggtcttaaaaacgtgagggaggtgaagggcctgaccaaaggagggccaggccatgaggagccgatccccatgagcacctacggatggaacctggtgcgcctgcaatccggagtggacgtgtttttcacgccgcccgagaagtgcgacacccttctgtgcgacatcggggagagcagcccgaatcccacggtcgaggcaggccggaccctccgagtcttgaacctggtagaaaactggttaaataacaatactcagttctgcatcaaagtcttgaatccatacatgccatccgttatcgagaaaatggaggcactccagcggaagtatggcggcgcccttgtgcgcaaccccctgagcagaaattccacacatgagatgtattgggtctccaacgcctcaggcaacatcgtaagctctgtgaacatgatcagccgcatgctcatcaacagattcaccatgaagcacaagaaagcgacttacgaacccgatgtcgacctggggtctgggacctgcaacatcggtatcgagagcgaagtccccaacctggacatcatcggcaaacgcatcgagaagatcaagcaggaacacgagacttcctggcattacgaccaagaccacccgtacaagacctgggcttaccacggcagctacgaggccaagcagaccgggagtgcgtccagcatggtgaacggcgtcgttcgtctcttaaccaagccctgggacgtgatcccaatggtaacgcaaatggccatgaccgacaccacccccttcgggcagcaacgggtcttcaaggagaaggtggacacgaggacccaggagccgaaggagggtaccaagaagctgatgaagatcaccgccgagtggctctggaaagagctgggcaagaagaaaacgccccgcatgtgcacccgcgaagagttcaccaggaaagtccgcagcaacgccgccctgggggccatattcacggacgaaaacaaatggaagtcggcgcgggaggcagttgaagacagtcgcttctgggagttggtcgataaggagcggaacctgcaccttgagggcaagtgcgagacgtgcgtgtacaacatgatgggaaagcgagagaagaaactcggagagttcgggaaggccaagggctccagggcgatctggtacatgtggctgggcgcccgatttctggagtttgaggctctcgggttcctcaacgaggaccactggtttagcagggaaaatagcctcagcggtgtggagggggagggcctctacaagctgggatatatcctgcgggacgtcagcaagaaggagggcggcgccatgtacgccgacgacaccgccgggtgggatacccggattaccctcgaggacctcaaaaatgaggagatggttacgaaccacatggagggcgagcataagaaacttgcggaggcaatcttcaaacttacctaccagaacaaggtggtccgcgtacagcggcccactccccgtggcaccgtcatggacatcatcagcagacgcgatcaacggggctccgggcaggtcggaacgtatggcctgaacaccttcaccaacatggaggcccagctgatccgccagatggagggggagggtatcttcaagtcaattcagcaccttaccgcgaccgaggagatcgccgttcagaactggctaactcgcgtgggcagggagcgcctgagccgaatggccatctccggggacgattgcgtcgtgaagcctctcgatgatcgcttcgccagcgccctgactgctctgaacgatatgggcaaggtgcgtaaagatatccagcaatgggaacccagccgcggatggaatgactggacccaggtccccttctgttctcatcatttccacgagctcatcatgaaagatggccgcgtgcttgtggtcccctgccgcaatcaggacgaactgatcggacgggcccgcatctcccagggcgccgggtggtcactccgcgagacggcgtgtctgggcaagtcatacgcgcagatgtggagcctgatgtacttccacagacgagatttgcgcttagccgccaacgccatttgctccgcggtgccgtcgcactgggtgcccacctcccggaccacctggagcatccacgctaagcacgagtggatgacaacggaagatatgctgaccgtctggaatagagtttggattcaggagaatccctggatggaggataagacccccgtggaatcatgggaggagattccgtacctcgggaagcgggaagatcagtggtgcgggtctctgatcgggctgaccagccgcgcaacgtgggccaagaacatacagaccgcgatcaaccaggtccggagcctcatagggaacgaagagtacacagattacatgcccagcatgaaacggtttcgccgcgaagaggaggaggcaggcgtgctgtggtaa

SEQ ID NO: 24806 - RNA, 9876 nt, synthetic construct
  misc_feature 1..9876: note = derived and/or modified CDS sequence (opt11) from DENV-2__KF744401__SS-prME
  source 1..9876: mol_type = other RNA
accgccggcatgatcatcatgctgatccccaccgtgatggccttccacctcacgaccaggaatggggaaccccacatgatcgtctcacggcaggagaagggcaagtccctgctgtttaagaccgaaaacggagtgaacatgtgcactctcatggccatggacctgggcgagctgtgcgaggacaccattacttacaagtgccccctcctgagacaaaacgagccggaggacatcgattgctggtgcaacagcaccagcacctgggtgacctatgggacctgcaccacaacgggcgagcatcggcgagagaaacggagcgtcgccctagtgccacacgtcggaatggggctcgagacccgcaccgagacgtggatgagctcggagggcgcctggaagcacgcgcagcggatcgagacatggatcctgcgtcaccccgggtttaccctaatggccgcgatcctcgcctacaccatcggcaccacacacttccagcgggccctgatcttcatcctgctcaccgccgtcgcgcccagcatgactatgcgctgcatcgggatctcgaaccgggactttgtggagggcgtgtccggcgggagctgggttgatatcgtgcttgaacatggttcctgcgtgactacgatggcaaagaacaaacccacacttgacttcgaactcatcaaaaccgaggccaaggagccggccactctgcgcaagtattgcatcgaggccaaactgacgaacaccacgaccgagtcgcggtgccccacgcaaggggagccctccttgaacgaggagcaggacaagaggtttgtctgcaaacactctatggtggacaggggctggggcaatgggtgcggtctcttcgggaaaggcgggatcgtgacctgtgcgatgttcacatgcaagaagaacatggaaggcaagatcgtccagcccgagaacctggaatacactatcgtgatcacgcctcattccggggaggagcacgcagtcgggaacgacaccggcaagcacggaaaggaaataaaaatcaccccgcagagctccaccaccgaggcggagctcactggctacgggaccgtcactatggagtgcagcccccgcaccggcctggacttcaacgaaatggtgctgctccagatggagaacaaggcctggttggttcaccggcagtggttcctggacctcccgctgccttggctgccgggagccgacactcaggggtccaactggatccagaaggagacccttgtcacgttcaagaacccccacgcgaagaagcaggacgtggtggtgcttggctcacaagagggagccatgcacacagcgctgaccggcgcgaccgagatccagatgagctccggaaatctcctcttcactggccatctaaagtgccgcctccggatggataagctacagttgaagggcatgagctattccatgtgcaccggcaagtttaaggtcgtcaaggagatcgccgagacgcaacacggcaccatagtggtgcgcgtccagtacgaaggggacggcagcccctgcaagatccccttcgagatcatggacctcgagaagcggcacgtcctgggccgccttattacagtgaacccgatcgtcaccgagaaggactccccggtgaacatcgaggcggagccgcccttcggggacagctatgtgattatcggcgtagagccggggcagctcaaactgaactggttcaagaagggctcgagcataggacagatgtttgagacgaccatgcgaggagccaagcggatggccatactgggcgacaccgcctgggactttggttccctcggtggggtgttcactagcatcggcaaagccctgcaccaggtgttcggagcgatctacggcgccgcattcagtggggtcagctggacgatgaagatcctgataggggtgataattacctggatcggaatgaactcccgcagcacttccctgagcgtttccctcgtcctggtgggggtggttacactgtatcttggggtggtggtccaggccgatagcgggtgcgtggtttcctggaagaacaaggagctaaagtgcggcagtggcatcttcatcacggacaacgtccacacctggaccgagcagtacaagttccagcccgagagcccgtccaaactggcgagcgctatccagaaggcccaccaagaggggatctgcggcatccggagcgtgacccgccttgaaaaccttatgtggaagcaaattacgccagagctgaaccacatcctcagcgaaaatgaagtaaagctgaccatcatgactggggacatcaagggcatcatgcacgccgggaagcggtccctgagaccgcaaccgaccgagctgcggtactcttggaagacgtggggcaaggcgaagatcctttccaccgaaagccacaaccaaactttcctaatcgacgggcccgagaccgcggagtgcccgaacactaacagagcctggaactccctcgaggtcgaggactacgggttcggcgtcttcaccactaatatctggcttaagctgcgggagaaacaggacgccttctgcgaccccaaacttatgagcgccgccatcaaggacaaccgcgcggtgcatgccgacatgggctactggatcgagtccgccctgaatgacacctggaaaatcgaaaaggccagcttcatcgaggttaagaactgccactggcccaagagtcacaccctttggagcaacggcgtccttgagtccgagatgataatccccaaaaactttgccggccccgtgtctcagcacaactaccggcccgggtaccacacgcagaccgcggggccctggcacttgggcaaactggaattggacttcgacttctgtgagggcaccaccgtcgtggtgacggaggattgcgggaatagaggcccctccctgcggaccaccaccgccagcggaaagctgatcacggagtggtgctgtaggagctgcaccctccctccactgcggtataagggggaagacgggtgctggtacgggatggagatccgccccctgaaggagaaggaggagaacttggtctccagcttagtgaccgcaggccacgggcaaatcgacaacttttccttgggcgtcttagggatggctctcttcctggaggagatgctccgtacccgcgtcgggatgaagcatgcgatcctactagtggccgttagcttcgtcacgctcatcaccggcaacatgtccttccgggatctggggcgcgtgatggtgatggtcggagccacgatgaccgatgacatcggaatgggcgtgacgtacctcgccttgctagccgccttcaaggtgcgtcccaccttcgcggccggcctgctcctgaggaagcttacctctaaggagttgatgatgaccacgatagggatagtcctgctgtcccagagcaccatcccagagacaatcctcgagctgaccgacgccctggctttgggcatgatggtgctgaagatagtccgcaagatggagcggtaccagctagccgtcacgatcatggccatcctctgtgtgcccaactccgtcatcctccagaacgcgtggaaggtgagctgcaccatcttagccgtagtatcagtcagccccctcctgcttacctccagccaacagaaggcggactggatcccactcgcgctgaccatcaaggggctgaacccgacagccatcttcttgaccactctttcccggaccagcaagaagcggtcctggcccctcaacgaagcgatcatggccgtgggaatggtcagcatcctcgcgtcgagcctactgaaaaacgatatccccatgacgggccccctcgtggccggcggcctgctgaccgtatgctacgtcctcaccgggcgcagcgcagacctggagctggagaaggccgccgacgtgcggtgggaggaccaagcggagatcagtggcagctcaccgatcctcagcgtgatcgtgtcagaggacgggagcatgtccatcaagaacgaggaggaggagcagaccctcacgatcctgatccggacaggtctcctggtgatcagcggactgttccccgtctctatccccatcaccgccgccgcctggtacctctgggaggtcaagaagcagcgggccggggtgctgtgggacgtgcccagcccgccgcccgtgggtaaggcggagctggaggacggtgcctatcggatcaagcagaagggcatcctggggtattcccagatcggggccggcgtgtacaaagaggggacctttcacaccatgtggcacgtgacgcggggcgccgtgctgatgcacaaggggaagcgcatcgagcctagctgggccgacgtgaaaaaggacctgatcagctacggtgggggctggaagctggagggggagtggaaggagggagaggaagttcaggtcctcgccctggagcccggcaagaaccccagagcagtgcagaccaagccgggcctattcaagacaaacgcgggcaccatcggggccgtgagcctggacttctcccccggcactagtggctcccccatcatagacaagaaagggaaggtggtgggcctgtacggcaacggcgtggtcacaagaaacggctcatacgtgtccgccattgcgcagacagagaagagcatcgaagacaaccctgagattgaggacgacatcttccggaagaagcgactgaccatcatggatcttcaccccggagccggcaagactaagcggtacctgcccgccatcgtgcgcgaggctattaagcgtgggctgcgcacactgatcctcgcgccaacccgagtcgtggccgccgagatggaggaggcccttcgcggcctccccatccgttaccaaactcctgccatcagagctgagcacaccgggcgcgagattgtcgatctgatgtgccacgccaccttcaccatgaggctgctcagccctatccgcgtccccaactacaacctgatcatcatggatgaagcccacttcaccgaccccgccagtatagccgcgcggggttatataagcacgcgcgtggagatgggagaggcggccggtatcttcatgaccgcaacgccccccggcagtcgggacccgttcccccagagcaacgccccgatcatggacgaggagcgagagatccccgagcggtcctggaacagcgggcatgagtgggtgaccgacttcaagggaaagacggtatggttcgtgccctccatcaaggcagggaacgacatagccgcgtgccttcgcaagaacggcaagaaggtgatccagctcagccggaagaccttcgactccgagtatgtcaagacccgaaccaacgattgggacttcgtggtaacaacggacatctcagagatgggcgccaacttcaaggcggagcgggtaattgatccccgacgttgcatgaagcccgtgattctgaccgacggggaggagcgagtgattctggctggcccgatgccagtcactcacagcagcgccgcccagaggcgcgggagaatcggtcgtaaccccaaaaatgagaacgatcagtacatctacatgggggagcccctcgagaatgacgaggattgcgcccactggaaggaggccaagatgctgttagacaacatcaacacgccggaaggcatcattccctccatgttcgagcccgagcgcgagaaggtagacgcgatagatggcgagtaccgtctccgcggggaggcgcggaagaccttcgtggacctgatgcgccggggtgacctgccggtatggcttgcgtataaggtggccgcggagggcattaactacgccgaccgccggtggtgcttcgacggcattcgcaacaaccagattctggaggaaaatgtcgaggttgaaatctggaccaaggagggggagagaaagaagttaaagcctcgctggctcgacgcccggatctatagcgaccctctggccctgaaggaatttaaggagttcgccgccggccgcaagtccctcacccttaacttgatcactgaaatgggtcggttacccactttcatgacccagaaggcgcgcgacgcgctggacaatctggcggtgctacacactgccgaggccgggggccgggcatacaaccacgcgttaagcgagctgccggagacgctcgagaccctgctgcttctgaccctgttagccaccgtcaccggcgggatcttcctgttcctgatgtccgggagggggatcggcaaaatgaccctaggaatgtgctgcataatcaccgcgagcattctgctgtggtatgcccaaatccagccccactggatcgccgcttccatcatcctcgagtttttccttatcgtgcttctcatccccgagcccgagaagcaacggaccccgcaagataaccagctgacctacgtggtcatcgccattttgacggtggtcgcggccacaatggccaacgagatgggctttctggagaagaccaagaaggacctggggctgggtagcatcgcaactcagcagccagagagtaacatcctcgacatcgatttgcgtcccgcctccgcgtggacactatatgcagtcgccaccaccttcatcacccccatgctgcggcacagcatcgagaacagctctgtgaatgtgtccctgacggccatcgccaatcaagcgaccgtcctaatgggcctcggcaaaggctggccgttgagcaagatggatatcggggtgcccctgttagctatcggatgctatagtcaagtgaacccgatcaccctgaccgccgctctactcctactggtcgcgcactacgccatcatcgggcccggcctccaggccaaggccacacgcgaggctcagaaacgggcggccgcgggcattatgaagaatccaaccgtcgacggcataacggccatcgacctggatcccatcccctacgaccctaagttcgagaagcaactgggccaggtgatgctcctggtcctttgcgtgacccaggttctagtcatgcgcacgacctgggcactgtgtgaggcgttgaccctcgccacagggccgatctcaactctgtgggaaggtaatccagggcgcttctggaataccaccatcgcagtgtccatggccaatatcttccggggcagctacctggccggcgcgggcttactgttttccatcatgaagaacaccacgaatacccgccgggggaccgggaacataggcgaaacgcttggcgagaaatggaagtcccgcctcaacgcactgggcaaaagtgaattccagatttataagaagtccggaatccaggaggtggaccggacgctggccaaggaggggatcaagcgcggcgaaactgaccaccacgccgtctcccgggggagcgctaagctccgctggttcgttgagcgaaacatggtgacaccggagggcaaggtcgtggacttaggctgcggaaggggcgggtggtcgtactactgcggtggactaaaaaacgtgcgtgaggtcaaaggcctcaccaagggcgggcccggacacgaggagccgatacccatgagcacgtacgggtggaacctggtgcgcctgcagtctggcgtagacgtgttcttcacgccacccgagaagtgtgataccctcctgtgcgatatcggcgaatcaagcccgaaccctacagtggaggccggtcggacgctgcgcgttttaaacctggtagagaactggctgaataataacacacaattctgcatcaaggtgctgaacccctacatgccttccgtgatcgaaaaaatggaggcccttcaacggaagtacggcggggccttagtccgcaaccccctgagccggaattccactcacgagatgtattgggtgtcgaacgcctcagggaatatcgtaagctcagtcaatatgatttctcgcatgctcatcaaccggtttacaatgaagcataaaaaggcgacgtacgagccagatgttgacctggggtccggcacgcgcaacatcgggatagagagcgaggtgcccaacctggatattattggcaaaagaatcgagaagataaagcaggagcacgagacctcctggcactacgaccaggatcacccttacaagacctgggcctaccacgggagctacgaggccaagcagaccggaagtgcaagctccatggtcaacggagtggtgcggctcctgacgaagccctgggacgttatccccatggtgacccagatggccatgaccgacaccacgcccttcgggcagcagcgcgtgttcaaagagaaggtcgatacccggacccaggagccgaaggaaggcaccaaaaagttgatgaagatcacagcggagtggctctggaaagagctgggcaagaagaagacgccgcgcatgtgcaccagggaagagttcacgcgcaaggtcagaagcaatgccgccctgggggccatcttcacggatgaaaacaagtggaagtccgcccgcgaggcggttgaggatagccggttctgggagctcgtggacaaggagcgcaacctgcatctggagggcaagtgcgagacatgtgtttacaacatgatggggaagcgggagaaaaagctcggagagttcgggaaggcaaagggctcccgcgccatctggtacatgtggctgggcgcccggttcctggagttcgaggcattggggttcctgaacgaggaccactggtttagtcgcgaaaacagcctgtccggcgtcgagggggaaggcctctataagctgggatacatcctgcgcgacgtgagcaagaaagagggcggcgccatgtacgccgacgacaccgccggatgggacacccgcataacccttgaggacctgaagaacgaggagatggtcaccaaccacatggaaggcgaacataagaagctggcggaggcgatattcaagcttacttaccagaataaagtcgtccgggttcaacgccccacgccccgggggacagtcatggacatcatctccaggcgggaccaacgcggcagcgggcaggtcggcacctacggcctcaacacgttcaccaacatggaggcacagctcatccgacagatggagggggagggcatcttcaagtctatccagcacctgacggccaccgaggaaatcgccgtgcaaaattggctgacacgggtcgggcgcgagcggctctctcgcatggccatctccggcgatgattgcgtggtaaagccgctcgacgacaggttcgcgagcgccctgaccgccctgaacgacatgggcaaggtccgcaaggatatccagcaatgggagccctctagagggtggaacgactggacccaagtgcccttctgtagccaccacttccacgagcttatcatgaaggacggccgagtgttggtcgtgccctgccggaaccaggacgagttgatcggacgtgccaggatctcccagggagctgggtggagcctccgcgaaactgcgtgcctgggcaaatcctacgcccaaatgtggagcctaatgtacttccaccgtcgcgatttacggctggccgccaacgccatctgctccgcggtgccgagtcactgggttccaacctcgcgcacaacatggagcatccacgccaagcacgaatggatgacgaccgaggacatgctcaccgtctggaaccgtgtgtggatccaggaaaacccctggatggaggacaagacccccgttgagagctgggaggagattccgtacctcggcaagcgcgaggatcagtggtgcgggtccctgatcggcctgacgtcacgagccacctgggccaagaacatccagacagcgattaaccaagtgaggtccctcatcgggaacgaggaatacaccgactacatgcccagcatgaagcgtttccggcgcgaagaggaggaggccggcgtattatggtga

SEQ ID NO: 24807 - RNA, 9876 nt, synthetic construct
  misc_feature 1..9876: note = derived and/or modified CDS sequence (opt11) from DENV-2__KF744402__SS-prME
  source 1..9876: mol_type = other RNA
accgcgggcatgatcatcatgctgattcccacagtgatggccttccacctcaccacccgcaacggggagccccacatgatcgtgtctcggcaggagaagggtaaaagcctgctgttcaaaaccgaggacggggtgaacatgtgcaccctcatggccatggacctgggcgagctgtgcgaggacaccatcacctacaagtgccccctgctgcgacagaacgagcccgaggacatcgactgctggtgcaatagcaccagcacctgggtgacctacggtacgtgcactaccaccggcgagcaccggcgcgagaagcggtctgtagccctggtgccccacgtgggcatggggctcgagacccgcaccgagacctggatgtctagcgagggcgcctggaagcacgcccagcggatcgaaacatggatcctacgccaccccgggttcacactgatggctgcgattctcgcctacaccattggcaccaccaacttccagcgggccctgatcttcatcctgctcaccgctgtcgctccttccatgaccatgcgctgcatcgggatctctaatcgggacttcgtggagggcgtgtcgggcgggtcgtgggtcgacatcgtgctggagcacggctcgtgcgtgaccacgatggccaagaacaaaccaaccctagattttgaactaatcaagacagaggccaagcaccccgccacgctgcgcaaatactgtatcgaggcaaagctgacgaacaccaccaccgagagccggtgcccgacgcagggggagccctccctcaacgaggagcaggacaaacgcttcgtctgcaagcacagcatggtggaccggggctggggcaacggatgcggcctcttcggtaaaggcgggatcgtcacttgcgcaatgttcacgtgcaagaagaacatggagggcaagatcgtccaacccgagaacctcgagtacaccattgtgatcacgccgcattccggcgaagagcacgccgtaggtaacgacaccggcaaacacgggaaggagatcaaggtcaccccgcagagctcgatcaccgaggccgagctcaccggctacgggacggtgaccatggagtgtagcccccgcaccggcctagacttcaacgagatggtgctgttgcagatggagaacaaggcctggctggtccatcgacaatggttcctggacctccccctaccctggctgccgggcgccgacacccaggggtccaattggatacaaaaggagacgctcgtgaccttcaagaacccacacgcgaagaagcaggacgtggtcgtgctgggcagtcaggaaggggccatgcataccgccctgaccggcgccacggagatacagatgagttccgggaacttactcttcaccggccacctgaaatgccgcctccgaatggataagctgcagttgaaaggcatgtcgtactccatgtgtactgggaaattcaaggttgtgaaggagatcgccgagactcaacatggaacgatcgtggtacgcgtgcaatacgagggggacggcagcccctgtaagatccccttcgagatcatggatctagaaaagcggcacgtgctggggcgcttgatcaccgtcaacccgatcgtgaccgagaaggattcccccgtgaacatcgaagcggagccgccctttggggacagctacgtcatcatcggcgtggagccggggcagctcaagctaaattggttcaaaaaaggttccagcatcggacagatgttcgagactacgatgcgaggggccaaacggatggccatcctgggcgacaccgcctgggacttcggttccctgggcggtgtgttcacttcaattggcaaggccctccaccaagtatttggagcgatctacggcgccgccttctccggcgtgagctggaccatgaaaattctgattggggttatcatcacgtggattggtatgaattcccggtcgacttcactgagcgtctccctcatcctggtcggggtggtgaccttgtatctcggagtggtcgtccaggccgatagcgggtgcgtagtgtcctggcggaacaaggagctgaagtgcggcagcggcatcttcatcaccgataacgtccacacgtggaccgagcagtataagttccagcccgagagcccctctaagctggcgagcgccatacagaaggcccatcaggagggaatttgcggcatccgctccgtgacccggctcgagaatctgatgtggaagcagatcacccccgagctgaaccacatcctcagcgagaacgaggtgaagttgacgatcatgaccggggacatcaagggcatcatgcacgccgggaagcgctccctgcggccgcagcccacagagctccgctacagctggaagacctggggacgggccaagatcctgtccacggagagccacaaccagaccttcctgatagacggaccagagactgcagagtgcccgaataccaatcgcgcctggaactctcttgaggttgaggactacggctttggcgtattcacgaccaacatctggctgaagctgaaggagcggcaggacgtattctgcgactcgaagttaatgtcggccgcaatcaaggataacagggcggttcacgctgatatggggtactggatcgagagcgccctcaacgacacttggaagatcgagaaggcctccttcatcgaggtcaagagctgccactggcccaagtcccataccttgtggagcaacggcgtgctcgaatccgagatgatcatacccaagaactttgccggccctgtgagccagcacaactaccggccggggtaccacactcaaaccgccgggccctggcacctggggaaactagagatggatttcgacttctgcgagggcacaaccgtggtagtcaccgaggactgcgggaacaggggcccctccctcagaacgactaccgcgtccggaaagctgatcacggagtggtgctgccgcagctgtacgttacccccgttacggtacagaggcgaggacggttgctggtacgggatggagatccggcctcttaaggagaaggaggagaacctggtgaactccctcgtgaccgccggccacgggcagatcgacaacttcagcctgggcgtccttggcatggccctcttcctggaggagatgctgcgcacgcgcgttgggactaaacacacgattttactggtggcagtctcgttcgtcaccctgatcaccggtaacatgagcttccgggaccttggtcgcgtgatggtcatggttggcgcgaccatgacggacaacatcgggatgggcgtcacttacctggccctgctggccgccttcaaggtccggcccaccttcgccgcgggcctcctgctcagaaagctgacctccaaggagctgatgatgaccaccatcgggatcgtgctgctgagccagtccaccatccccgaaaccatcctggagttaacggacgccctcgcgctgggcatgatggtgctcaagatcgtacggaacatggagaagtatcagcttgctgtgaccatcatggccatcctgtgtgtaccgaacgcagtgatcctccagaacgcctggaaggtgagctgcaccatcctggccgtcgtgagcgtgagccccctgctcttgacctccagtcagcagaaagccgactggattcccctggccctcacgatcaaggggctgaacccaaccgcgatctttctaaccacgctctccagaactagcaagaagcggtcctggccgctgaacgaggccatcatggcggtcggcatggtgagcattctggcttcctcgctcctgaagaacgacatccccatcactggcccccttgtggctggcggtctcctgacggtctgctacgtgctgaccgggcgcagcgccgacctggagctggagcgggccgccgacgtgcgctgggaggagcaggctgagatctccgggagttctcccatcctgtctatcatcatttccgaggatgggagcatgtccatcaagaacgaggaggaagagcagacgctcactatcctgatccggaccggcctgctcgtcatttctggcctgttccccgtgtccatccccatcaccgcggccgcgtggtacctgtgggaggtaaagaaacagcgcgctggggttttatgggacgtacccagccccccgccggtcggcaaagcagagctggaagacggggcgtaccggatcaaacagaagggcatcctggggtactcccagatcggcgcgggcgtctacaaggaggggaccttccacactatgtggcacgtgacaagaggagccgtgttaatgcacaagggcaagaggatcgagcccagctgggccgacgttaagaaggacctgatatcctacgggggggggtggaagctggaaggcgagtggaaggagggggaggaggtccaggtgcttgccctggagcccggcaagaatcctcgcgcggtgcagaccaagcctgggctgttcaagaccaacgccggaaccatcggggccgtgagcctcgacttctcccccggtaccagcggctcccccatcatcgacaagaagggaaaggtggtcggtctgtacgggaacggcgtggtcacacggaacggcagttacgtctccgcaatcgcccagactggcaagtccatcgaggacaatccggagatagaggacgacatcttccgcaagaagagactgacgatcatggacttgcaccctggtgcggggaagaccaagcgctacctcccggccatcgtacgagaggctatcaagcgaggcctgcgcaccctaatcctcgccccgacccgagtggttgcggccgaaatggaagaggcccttcgcgggcttcctatccggtaccagactccggccatccgggccgaacacaccggacgggagatcgtggacctcatgtgccacgcgacgttcaccatgcgcctgctgagccccatccgggtgccgaactacaacttgatcatcatggacgaagcccacttcaccgatcccgcctccatcgccgccagaggctacatcagcacccgtgtcgagatgggggaggccgccggcatctttatgaccgcgacgccgcccgggtcccgggacccgttcccccaatctaacgcccccatcatggatgaggagcgggagattcctgagagatcctggaacagcggacatgagtgggtcacggactttaaggggaagaccgtctggttcgtcccttccatcaaggccggcaacgacattgcggcctgcttacggaagaacggtaagaaggtcatccaactaagtaggaagacatttgactccgagtatgtgaagacccggactaatgactgggactttgttgtgaccaccgacatcagtgaaatgggggccaacttcaaggccgaaagggtgattgacccccgacgctgcatgaagcccgtcatcctcactgacggggaagagagagtgatcctggctgggcccatgccggtgacgcactccagcgccgcccagcgccgcggccggatcgggcgcaaccccaaaaacgagaacgaccagtacatctatatgggcgagcccctggagaacgacgaggaccatgcacactggaaggaagccaagatgctcttagacaacatcaacaccccagaaggcatcatcccgtccatgttcgagccagaacgggaaaaggtcgacgcgatcgacggggagtaccgtctgcggggcgaggcccgcaagacgttcgtggacctcatgcggcgcggcgacctgcccgtgtggcttgcttataaggtcgccgccgagggcatcaactacgctgatcggcgctggtgttttgacgggatccgcaacaaccagatccttgaggagaatgtggaggtcgagatctggaccaaagagggagagcgcaaaaagctgaagccgcgctggctggacgcgaggatctacagcgaccccctcgccctgaaggagttcaaggagttcgccgccggccggaaatccctgacgctcaacctgataaccgagatggggcgtctaccaaccttcatgacacagaaggcgcgggatgccctcgacaacctggccgtgttgcataccgcggaagcgggcgggcgcgcctacaaccatgcgctcagcgagcttccagagaccctggagaccctcctgctactcaccctgctggccacggtgacgggcggaatctttctcttcctgatgtccgggaaaggcatcgggaagatgaccctgggcatgtgctgcatcatcaccgccagcgtcctcctgtggtacgcgcagatccagccacactggatcgccgcttccatcatcctggagttcttcctgatagtccttctgatccccgagccagagaagcaacggactccgcaggataaccagctcacgtacgtggtcatcgccatcctaaccgtggtggcagcgaccatggccaacgaaatgggcttcctggagaagaccaagaaggacttcggcctcggctcgatcgccacgcagcaaccggaaagcaatattctggacatcgacctgcgcccagctagtgcatggactctctacgcggtcgcaaccacttttataactccaatgctgcggcacagtattgaaaactccagcgtgaatgtgagcctgaccgccatcgctaaccaggccaccgtcctcatggggctgggcaaaggatggcccctaagcaagatggacataggcgtgccgctcctggcgatagggtgctactcccaggttaaccccatcaccctgacggccgcactcctgttactcgtagcccactacgcgatcatcggccccggccttcaagccaaagctaccagggaagcgcagaagcgcgccgcggcgggaatcatgaagaaccccacggtggacggaatcaccgttatcgacctggacccgattccctacgaccccaagttcgagaagcagttagggcaagtcatgctactggtgctctgcgttacgcaagtcctgatgatgcggacgacctgggccctttgtgaggccttaaccctggccaccggcccaatcagcacattgtgggaagggaatccgggccgcttttggaacaccaccatcgcggtgtctatggccaacattttccggggcagctatttggccggtgccggcctgctgttctccattatgaagaacacgacgaacacccgccgggggaccggcaacatcggtgaaaccctcggggagaagtggaagtcccgtctgaacgctctgggcaagtccgaatttcagatatacaaaaaatccgggatccaggaggtggacaggaccctggcgaaggagggcatcaagcgcggtgagaccgaccaccacgccgtctcccggggcagcgccaagctgagatggtttgtggagcgcaacatggtgacccccgagggtaaggtcgtggacctggggtgcggccgcgggggctggtcctactactgtgggggtttgaagaacgtccgggaggttaaaggcctgacgaagggcgggcccgggcacgaagagccgatcccgatgtcaacctacggctggaacctggttcgcctccaatccggggtggacgtctttttcacgccccctgagaagtgcgacaccctgctgtgcgacatcggtgagagcagccccaatccgacggttgaggctggccgtaccctccgcgtgctgaatctggtcgagaattggcttaacaacaatacccagttctgcattaaggtgctgaacccctacatgccttccgttatcgagaagatggaggcgcttcagagaaaatacgggggcgccctggttcgcaacccgctcagccggaactccacgcacgaaatgtactgggtgtccaacgcctccggtaatatcgtgagctccgtaaacatgatcagtagaatgttaatcaaccgcttcaccatgcggcacaaaaaagcgacgtatgagccagacgtggacctgggctccggcacccgcaacatcggcattgagagcgaggtgcccaatctcgacatcattggtaagcggatcgagaagataaagcaggagcacgaaacctcttggcactacgaccaggaccacccctacaaaacctgggcctaccacgggtcttacgaaacgaagcaaaccggctccgcgagctccatggtgaacggggtagtgcgcctgttgaccaagccgtgggacgttatccccatggtgacgcagatggccatgaccgacaccacccctttcggccagcagcgggtgttcaaggagaaggtcgacacccgcactcaggagccgaaggagggaacaaagaagctcatgaaaatcaccgccgagtggctgtggaaggagctgggtaagaagaagactccgcggatgtgtacgagggaggagtttacacggaaggtgcgctcgaacgccgccctcggcgcgatcttcaccgacgagaacaagtggaagtccgcccgggaggccgtcgaggactcgcgcttctgggaactggtggacaaagaacggaaccttcacttagaagggaaatgcgagacctgcgtgtacaacatgatgggcaagcgcgagaagaagcttggggagttcggcaaggccaaaggctcacgcgccatctggtacatgtggctcggggcgcgcttcctcgagttcgaagccctggggttcctgaacgaggaccactggttttcccgggagaattcgctctccggggtcgagggcgaggggctccataagctgggctacatcctcagagacgtgagcaagaaggagggcggggccatgtacgccgacgatacggcgggctgggatacccggattaccctagaggacctgaaaaacgaggaaatggtgacaaaccacatggagggggaacacaagaagctggccgaggccattttcaagttaacgtaccagaacaaggtcgtgagagtacagcggcccacgccccgcggcaccgtcatggacataatctcccgccgggaccagcgcggtagcggccaggtgggcacctacgggctgaacacgttcaccaacatggaggcccagttaatccgccagatggagggagagggggtgtttaaatccatacagcacctgaccgccaccgaggagatcgctgtccagaactggctagccagagtgggccgggagcgcctcagtagaatggccatctccggcgacgactgcgtggtcaagcctctggacgaccgcttcgccagcgccctgacggcattgaacgacatggggaaggtgcggaaggacatacagcagtgggagccgtcccgcggctggaacgactggacccaggtgcctttctgctctcaccatttccacgagctaatcatgaaggacgggcgggtactggtggtaccttgccgcaaccaggacgagctcataggccgggctcgcatctcccagggcgctggctggagcctgcgggagaccgcatgcttgggcaagtcctatgcccagatgtggtcgctcatgtatttccaccgccgggacctccgcctggcggccaacgccatctgctccgccgtccccagccactgggtgccaacctcccggacgacctggagcatccacgccaagcatgagtggatgaccaccgaggacatgctcactgtgtggaaccgcgtctggatccaggagaacccctggatggaggacaagacgccagtagagagctgggaggagatcccctatctgggtaaacgtgaagaccaatggtgcgggtccctcatcgggctgaccagcagagctacgtgggccaaaaacatccagaccgcaatcaaccaggtgcgctccctaatcggcaacgaggaatacacggactacatgccgagcatgaagagattcagacgggaggaggaggaggccggtgtcctgtggtga

SEQ ID NO: 24808 - RNA, 9876 nt, synthetic construct
  misc_feature 1..9876: note = derived and/or modified CDS sequence (opt11) from DENV-2__KF744408__SS-prME
  source 1..9876: mol_type = other RNA
accgcgggaatgatcatcatgcttatccctaccgtgatggcattccacctcaccacacggaacggggaacctcacatgatcgtcagccggcaagaaaagggcaaatcgctgctgtttaagaccgaggacggagtgaatatgtgcactctaatggcgatggacctgggtgagctgtgcgaggacaccataacctacaagtgccccctactgcggcagaacgagcccgaggacatcgactgctggtgcaactccacctccacctgggtgacctacgggacttgcaccaccaccggcgagcaccgccgcgagaaacggagcgttgccctggtgccccacgtcggcatgggattggagacacggacagagacctggatgtccagcgagggcgcctggaagcacgcccagcggattgaaacgtggatactacggcaccccggttttaccctgatggcggcgattctcgcctacaccatcggcaccacgaattttcagcgggccctgatcttcatcctgctcaccgccgtcgcgccctccatgactatgcggtgcattgggatctcgaatcgggatttcgtggagggcgtgtctggcggtagctgggtcgacatcgtcctggaacacggctcatgcgttaccacaatggccaagaacaagcctacactggacttcgaacttatcaagacagaggccaagcatcctgccaccctacgtaaatattgcattgaggccaagttgaccaacaccacgaccgcaagcaggtgcccgacgcaaggggagccttccctcaacgaggagcaggacaagcgcttcgtctgcaagcattccatggtagaccgtggctggggaaacgggtgtggcttattcgggaaaggggggatcgtgacctgcgccatgttcacgtgcaagaagaacatggagggtaagattgtacagcccgaaaatctggaatatacaatagtcatcaccccccactccggcgaggaacatgccgtggggaacgacactggcaagcacgggaaggagatcaaaataacaccccaaagctccatcaccgaggctgagctcaccggatacggtacggtcaccatggagtgtagcccccgcacgggcctgggtttcaacgagatggtgctactccaaatggaggataaggcgtggctcgtgcaccggcagtggttccttgacttaccccttccctggctgccgggcgcggacacacagggatcgaactggatccagaaagagacgctcgtcacattcaagaacccccacgccaaaaagcaagatgtggtggtcctggggtcccaggagggtgccatgcacactgccttaactggggccacggaaatccaaatgagttcgggcaacctcttattcacaggccaccttaaatgccgccttcggatggacaagctccagctgaagggaatgtcctactctatgtgcacgggcaagtttaaggtggtcaaggaaatcgcagaaacccagcatgggacaatagtggtgcgcgtccaatacgagggagacggctcaccctgcaagataccgttcgagatcatggacctcgagaagcggcacgtgctggggcgcttgatcacggttaacccaatagtgaccgagaaagattctccagtgaacatcgaggccgagccgcctttcggcgactcttacgtcatcatcggcgtcgaaccgggccagctaaagctgagttggttcaagaagggtagctcaataggacagatgttcgagaccaccatgcgcggtgccaagcgtatggctatcctaggggacacggcatgggactttggcagcctcgggggcgtattcacatccatcgggaaggcgctacaccaggtcttcggcgccatttacggggcggccttctccggggtatcctggactatgaagatcttgatcggcgtgatcataacatggatagggatgaacagccgctccacctccctgagcgtgtcactcgttttggtgggcgtggtcaccctgtatctcggggtggtggtccaggcggactccgggtgcgttgtgagctggcggaataaggagctgaagtgcgggagcgggatattcatcaccgataacgtccacacgtggaccgagcagtacaagttccagcccgagagcccctccaagctggcctcagctatccagaaggcccaccaagagggcatctgcggcatccgcagcgtcacccggctcgagaacctaatgtggaagcaaatcacccccgagttgaaccacatcttgtccgagaacgaggtgaagctgaccatcatgacgggtgacataaagggcataatgcaagccggaaagcgcagccttcggccgcagcccacagaactccggtactcctggaagacctggggcaaggcgaagatattgtccactgagtcccacaatcaaaccttcctgattgacgggcccgaaaccgccgagtgcccgaacacaaaccgggcctggaacagcctggaggttgaggattatgggttcggggtattcacgaccaatatctggctgcgcctccgggaaaagcaggacgccttctgcgactccaagctcatgagcgcagcgattaaagacaaccgcgccgttcacgccgacatgggctactggatcgagtccgccctgaatgacacctggaagatcgagaaggccagtttcatcgaggtcaagtcatgtcactggcccaaaagccacaccctgtggtccaacggcgtgctggagtccgaaatgatcatccccaagaactttgcggggcccgtgagccagcataactatcggcccggttatcacacccagacggccgggccttggcacctcggcaagctggagatggatttcgacttctgcaaggggaccaccgtcgtggtaaccgaggactgcggcaaccgcggcccgtcactgcgtacgacgactgcgagcgggaagctaatcaccgagtggtgctgtcgctcctgcacactgcccccgctccgttaccgcggcgaggacgggtgttggtacggaatggagatccggccgctaaaggagaaggaggagaacctggtcaatagtctcgtcacggccggccacggtcagatcgacaatttcagtctgggagtgctgggtatggcactgtttctagaggagatgctgcgcacccgcgtcggcaccaagcatgccatcctattagtggccgtgtctttcgtcactcttataactgggaacatgtccttccgggacctcgggcgtgtgatggtcatggtcggtgctactatgaccgacgacataggcatgggcgtgacgtacctggccctgctcgccgccttcaaggtacggcccaccttcgctgcagggttactgctgcgcaagctgactagcaaagagctgatgatgaccacgatcggcatcgtcctcttgtcccagtcgaccatcccagagacgatcctggagcttaccgatgccttggcgctgggcatgatggtgctcaagattgtgcggaacatggaaaagtaccagctggcggtcacgatcatggccatcctgtgcgttccgaacgctgtcatcctccaaaacgcctggaaggtatcctgcaccatcctggcggtagtcagcgtgagccccctgctgctgaccagctcccagcagaaggccgattggatccctttggccctcacaattaaggggctgaacccgacggccatattcctgaccacactctcccgcacatcaaagaaacgcagctggccgttgaacgaggcgataatggcagtgggcatggtcagtattctggccagctccctccttaagaacgacatccccatgacagggcccttggtggcagggggcctactgacagtttgctatgtacttaccggccgctccgccgacctcgagctggaaaaggcggcagatgtccgttgggaagaccaggccgagatcagcgggagcagtcccatcctgtcaataatcatcagcgaagacggctccatgagcatcaagaacgaggaggaggagcagaccctgacaattctgatccgcaccggtcttctcgtgatctccggtctgttcccggtgtcaatacccatcactgccgcagcgtggtatctttgggaagtgaagaagcagcgggccggggtactctgggacgtacccagcccgccgcccgtgggaaaggcggagctggaggacggcgcctaccgcatcaagcaaaaggggatacttggctacagccagattggggcaggcgtctacaaggaggggacgttccacaccatgtggcatgtaacgcgcggtgccgttttgatgcacaagggcaaacgaattgagcccagctgggccgacgttaaaaaggacctgatcagctacgggggaggctggaaactggaaggggagtggaaggagggcgaggaggttcaagtgttggcactggagcccgggaagaaccccagagccgttcagaccaaacccggcctgttcaagaccaacgccggaacgatcggcgccgtatcccttgatttcagcccaggcacgtctgggagccccatcatcgacaagaaaggcaaggtggtgggcctgtacggtaacggcgtcgtgacccgaaatgggtcctacgttagtgccatcgcacagaccgagaagtccatcgaggataaccccgagattgaggacgatatctttcgcaaaaagcgcctaaccatcatggatctgcacccaggagctggtaaaacaaagaggtatctccccgcgatcgtccgcgaggccatcaagcgggggctaaggaccctgattctcgcgccgacccgggtagtcgctgccgagatggaggaggcgctccgggggttgcccatacggtatcagacacccgctatccgggccgagcacactggccgcgagatcgtggacctcatgtgccatgccaccttcacaatgcggttactgtccccaatccgcgtgccgaattataatctcatcatcatggatgaagcacattttaccgaccccgccagcatcgccgcgcggggctatatctcgactcgagtggagatgggggaggcggccggaatcttcatgacggcgacgccacccggcagccgagatccattcccccaatctaacgcccccatcatggacgaggagcgggagatacccgaacggagctggaattccgggcacgagtgggtgacagacttcaaggggaagactgtgtggttcgtccccagcatcaaggcgggcaacgacattgctgcgtgcttgcgcaaaaacggcaagaaggttattcagttgtcgcggaaaacctttgacagcgagtatgtaaaaacccgcacgaacgattgggacttcgtggtcacgaccgacatctctgaaatgggtgccaactttaaggccgagcgggtgatcgacccgcgccggtgcatgaagcccgtgatcttaactgacggtgaggagcgcgtcatcctggccggcccaatgccggtcacccatagctccgccgcacaacgtaggggtagaattggccggaaccccaagaatgagaatgaccagtatatatatatgggcgaacccctcgaaaacgacgaagactgcgcccattggaaggaggccaagatgctcctagacaatatcaatactcccgagggaatcatacctagcatgttcgagcctgaacgcgagaaggttgacgccatcgacggggagtatcgactgcgtggcgaagctcggaagacttttgttgatctcatgcgtcgcggtgacctgccagtttggctagcgtacaaggtggccgcggagggcatcaactacgccgaccgccggtggtgcttcgatggtatccgcaacaaccaaatcctcgaggagaatgtcgaggtggagatctggaccaaggagggcgagcggaaaaaactaaagccgcgctggctggacgcccggatttacagtgaccccctcgcactgaaggagttcaaggagttcgcggcaggacgcaagtcattgaccctcaacctgatcacggagatgggtcgactgcccacctttatgacccagaaagcacgcaatgcgctggacaacttggcagtcctgcacaccgctgaagccggcggtcgggcatacaaccacgctctgtccgagttgcccgagacgctggagaccttgttattgctcaccctgttggccaccgtgacgggcggaatcttcctattccttatgagcgggaagggcatagggaagatgaccctgggtatgtgctgtatcatcaccgccagtgttctcctatggtatgctcagatccaaccgcactggattgccgcgtcaatcatcctagagtttttcctcatcgtcctgctgatccccgaacccgagaaacagaggacgccacaggacaaccagttaacatacgttgtaatcgccatcctcactgtagtggccgctactatggccaatgaaatgggtttcttggagaaaaccaagaaggacctcggcctcggctccatcaccacacagcagccagagtccaacatcctggacatcgacctaaggccagccagcgcctggaccctgtatgcggtggccaccaccttcattacgcccatgcttaggcactcaatcgagaatagctcagtcaacgtatcactcaccgcaatcgcgaaccaagcaaccgtgttgatgggtctgggcaaggggtggcccctctcgaagatggatatcggcgtccccctgctagcaattgggtgctactcccaggtgaaccccattaccttgacggccgcgctgctgctcctggtcgcacactacgccatcatcggtccaggcctccaggccaaagctacccgggaggcgcaaaaacgcgccgccgcggggattatgaagaaccccacggtcgacggcattaccgtcatagacctagacccgatcccgtacgaccccaagttcgagaaacagctgggccaggtgatgctgctcgttctgtgtgtgacccaagttctgatgatgcgcacaacttgggctctatgcgaggcgctgacgctggctacgggccccatctccaccctgtgggaggggaacccgggtcggttctggaatacaactatcgccgtctctatggccaatatcttccgcggatcctaccttgctggggcgggcctactgttcagcatcatgaagaacacgaccaatactcggaggggcacgggaaatatcggggaaacgctgggagagaagtggaagagccggctgaacgcgctcgggaagagcgaattccagatctacaaaaagtccgggatccaagaggtcgaccgaactctcgcgaaggagggtataaagcggggggagactgatcaccacgccgttagcagaggctccgcgaagctgcggtggttcgtcgagcgcaacatgatcacgcccgagggcaaggtggtggacctcgggtgcggccgcggcggctggtcctactactgcggcgggttgaagaacgtcagggaggtgaaggggcttactaagggcgggcccgggcacgaggagcccatcccgatgtccacctacggctggaacctcgtgcggctgcagagtggtgtcgacgtcttcttcacgccgcccgagaagtgcgacaccctgctctgcgacatcggcgaatcgtcccccaacccaaccgtggaagccggtcgcaccctgcgggtcctaaatctcgtcgaaaactggctcaacaacaacacccagttctgcataaaggttctgaacccttacatgccctcggtcatagagaagatggaggccctgcagcgcaaatatggcggtgccctcgtacgcaacccgttatcgagaaatagcacccacgaaatgtactgggtgtcaaacgcttcaggcaacattgtctccagtgtgaacatgatttcgcgcatgctgatcaaccgctttacaatgaagcacaagaaagcgacttacgagcccgatgtggacctcggctcgggaacccgcaacatcggtattgagtccgaggtccctaatttagacatcatcggcaagcgaatcgagaaaatcaagcaggaacacgagacgagctggcactacgatcaggaccacccctataagacctgggcctatcacggtagttacgagacgaagcagacgggctctgcttcgagcatggtgaacggcgtggtcaggctcctgaccaaaccttgggacgttatccccatggttacccagatggccatgacggatacgaccccttttggccagcaacgcgtatttaaggagaaggtagacacccgcactcaggaacccaaggagggcacaaagaagctgatgaagattactgccgagtggctgtggaaggagctcgggaagaagaagaccccgcgaatgtgcacgagggaggagtttacccggaaggtgcgctccaacgcggctctgggcgcaatctttaccgacgagaacaaatggaagtccgcccgggaggccgtcgaagactcacgcttctgggagcttgtggacaaggagcggaacctccacctggaaggaaagtgcgagacctgtgtttacaacatgatgggcaagcgcgagaagaaactgggagagtttggcaaagcaaagggcagccgggccatctggtacatgtggctcggggcgcgattcctggagtttgaggccctgggatttctcaatgaggaccactggttcagcagagaaaattcgttaagcggggtggagggcgaggggcttcataagctcgggtatattttgcgcgacgtgtcaaagaaggagggcggcgccatgtacgccgatgacacggccggctgggacacccggattacactggaggacctcaagaatgaggagatggtcaccaaccatatggaaggcgagcacaaaaagctcgccgaggccatcttcaagttgacgtaccagaacaaggtggtacgcgtccagcgcccaacgccccgaggcaccgtgatggacattattagccggcgcgaccagcgcgggtccgggcaggtgggcacttacgggctgaacacattcactaatatggaggcgcaactcatccggcagatggagggcgaaggggtcttcaagagcatccagcacctcacagccacagaggagatcgccgtgcagaattggctcgcccgcgtgggcagagaaagactgtcccggatggcaatcagcggcgatgactgcgtcgtgaagcccctggacgaccgcttcgcgagtgccctcactgccctgaacgatatggggaaggttcggaaagacatccaacagtgggaaccctcaaagggctggaatgactggacacaggtccccttttgctcccaccacttccatgagctgatcatgaaagatgggagggtcctcgtggtcccctgtcgaaatcaggatgagctgatcggacgcgcccgcatatcgcagggcgccggctggtctctccgcgagaccgcttgcctcgggaaaagctatgcccaaatgtggtccctgatgtacttccaccgcagggatctacgtctcgccgccaatgcgatctgtagcgcggtaccctcccactgggtgcccaccagccgtacgacctggagcatccatgccaagcatgaatggatgactaccgaggacatgctaaccgtctggaatcgagtctggattcaggagaatccctggatggaggacaagacacccgttgagtcctgggaggagatcccctacctaggtaagagagaagaccagtggtgtgggtcactgataggcctcacctcccgggcgacctgggcgaagaacatccagaccgcgatcaaccaggtccggagtctgatcggcaacgaggagtacactgactacatgccgtccatgaagcgcttccggcgggaagaggaagaggccggggttctatggtga

SEQ ID NO: 24809 - RNA, 9876 nt, synthetic construct
  misc_feature 1..9876: note = derived and/or modified CDS sequence (opt11) from DENV-2__JX669476__SS-prME
  source 1..9876: mol_type = other RNA
accgccggcgtgatcgtcatgctgatccccaccgccatggcgttccatctcaccactcgcaacggcgaaccccacatgattgtgggtcggcaggagaagggcaagagcctgctgtttaaaaccgaagacggcgtgaatatgtgcaccctcatggccattgacctgggggaactgtgcgaggacaccatcacctacaaatgcccgcttctgaggcagaacgagcccgaagacatcgattgctggtgcaattcgacctcgacttgggtcacctacggcacctgcaccaccacgggcgagcaccggcgcgagaaacggtccgtggccctggttccccacgtcgggatgggtttggagacccgcacagagacctggatgagcagcgaaggagcctggaagcacgtgcagcggatcgagacctggatcttgcgacaccccggcttcaccatcatggctgcgatattggcctataccattgggaccactcacttccagcgcgccctcatcttcatcctgttgaccgccgtggcgcccagcatgaccatgcgctgcatcggcatctccaaccgggacttcgtcgagggagtaagcgggggcagctgggtggacattgtcctcgagcacgggagctgcgtgaccaccatggcaaagaataagcccaccctggacttcgagctgattaagaccgaggctaagcagcccgctaccctccgcaagtactgcatagaagccaaattgacgaacaccaccaccgagtctcggtgcccgacgcagggcgagcctagtctgaacgaggagcaggacaagcgcttcatctgcaagcactccatggtagaccggggctgggggaacggctgcggactgttcggtaagggcgggatcgtcacatgcgcgatgttcacatgcaagaagaacatggagggcaaaatcgtgcagagcgagaacctagagtacacgatcgtgatcacgccccactccggggaggagcacgccgtcggcaacgacaccgggaagcacgggaaggagatcaaaatcacaccccagtcttccaccaccgaggccgaactcacggggtatggcacagttaccatggagtgtagcccgcgcaccggccttgattttaatgagatggtcctgctgcaaatggaggataaggcgtggctcgtccaccggcagtggttcctggacctaccactcccctggctgcccggggccgacacgcagggctccaattggatacagaaggaaaccctagtgaccttcaagaacccacacgctaagaaacaggacgttgtcgtgctcgggagccaggagggcgccatgcacaccgccctaacgggggccaccgaaatccaaatgtcatccggcaacctcctgtttaccggccacctgaagtgccgcctgcggatggacaagttacagctgaaggggatgagctactccatgtgcaccggtaagttcaaaatcgttaaggagatcgccgagacgcagcacggtaccatagtaattcgcgtgcagtacgaaggcgacggcagcccctgcaagatccccttcgagattacagacctggaaaagagacacgtgttagggcgcttaatcaccgtgaatcccatagtgaccgagaaggactccccggtcaacatcgaggcggagccacccttcggggactcgtacatcatagtgggggttgagcccggccagttgaagctcaactggttcaagaaagggtcttcgattgggcagatgttcgagactaccatgagaggcgctaagcggatggccatcctgggggacaccgcctgggactttggctcgctcggcggcgtattcacgagcatcggtaaggccctccaccaggttttcggtgcaatctacggtgctgccttctccggggtgtcttggaccatgaaaatcctgataggagtcatcataacctggatcgggatgaactcccgcagcacctccctaagcgtgagtctggtgctcgttggcgttgtgacgctttacctgggggccatggtacaagcggacagcggttgtatcgtctcctggaagaacaaagaattgaagtgcggcagcggaatcttcatcaccgataacgttcacacctggactgagcaatacaagttccagccggagttccccagcaaactggcatccgccattcagaaggcgcacgaagagggaatctgcgggatccggagcgtcacgcgcctcgagaacctcatgtggaagcagataacccccgagctgaaccacattctctccgaaaacgaggtgaagctaaccatcatgaccggtgacatcaaggggatcatgcaagccggaaagcgcagcctgcgcccgcagccgacggagctgaagtattcctggaagacctggggcaaggcgaagatgctgtctaccgaatcccataatcagaccttcctgatcgacgggcccgagactgccgagtgcccaaacacaaaccgggcatggaacagcttggaggtggaggactacggcttcggggtttttacaaccaacatctggctaaagctgcgggagaagcaagacgtgttctgcgactccaagctgatgagtgccgccatcaaggacaaccgagctgtgcacgccgacatgggctactggatcgagagcgccctcaatgacacctggaaggtcgaaaaggcttctttcatagaggtcaagagttgccactggcccaagtcccacacgctgtggagtaatggagtgctggagagcgagatgatcatcccaaagaacttcgccggccccgttagccagcacaactatcgtcccggctaccacacccagaccgccgggccgtggcacctcggcaaattagagatggattttgacttctgcgagggaacaacggtggtggtcaccgaggattgtgggaaccgcggcccctcgctgcgcaccactacggcgagcgggaagctcatcaccgagtggtgctgtcggtcctgcaccctgccgcccctacgttaccgtggcgaggacgggtgttggtacgggatggagatacgcccgttgaaggagaaagaggagaacctagtgaacagcctggtgacagccgggcacggtcagatagacaacttctcattaggcgttctggggatggcactgttcctggaggagatgctgcggacacgcgtgggcaccaagcacgcaatcctgctcgttgccctgtccttcgtcacactgattaccggcaacatgtccttccgtgacttaggtcgtgtgatggtgatggtcggggccaccatgaccgacgatatcgggatgggcgtgacttacctggcgctactcgccgcattcaaggttcgccccactttcgccgccggcctgctgttgcgtaagctgacgagcaaagagcttatgatggccactatcggcatcgccctgctctcccaatcgaccttacccgagaccatactcgagctgacggacgcgctggcgttagggatgatggctctaaagattgttaggaacatggaaaagtaccagttggccgtcacaatcatggccatctcctgcgtgccgaacgcggttatactccaaaatgcctggaaagtgagctgcacaatcctggctgccgtctccgtcagcccgctgctactgacttccagccagcagaagactgactggatccccctggcactcaccatcaagggcctgaatcccaccgccatcttcctgaccacgctctcccgcaccagcaagaagaggtcctggcccctgaacgaagccattatggcggtagggatggtcagtatactggcctctagcttgctcaagaacgatatcccgatgactgggcccctggttgcgggcgggctcctgaccgtgtgctacgttttgacgggccggtccgctgacctcgagctggagagggccgccgacgtgaagtgggaggaccaggctgagatcagtgggagctcgcccatcctttccattacgatctccgaggatggctccatgtccattaagaacgaggaggaggaacaaaccctcaccatcctgatccggaccggtctgctcgtgatctcaggtgtcttccccgtgtctatcccgatcacggcggccgcctggtacctatgggaggtaaagaagcaacgcgccggcgttctgtgggacgtgccctcaccaccacctgtagaaaaagctgagctcgaggacggggcgtacagaattaagcagcgaggcatcctggggtactcccagatcggggctggcgtctataaggaagggacgttccacaccatgtggcatgtgacccggggagccgtgctgatgcaccgcggaaaacggatcgagcccagctgggccgacgtcaaaaaggatctcatctcctacggcgggggctggaagctggagggcgagtggaaggagggcgaggaagtccaggtgctagccctcgaacccggcaaaaacccaagggcggtccagacgaagcccggtatttttaagactaacactggcaccatcggggccgtgagcctggacttctcccccggcacaagcggctctcccattgtggaccgaaagggaaaggtcgtgggactgtacgggaacggtgtggtaacccgctcaggcgcttatgtgtccgccatagctcagaccgagaagtccatcgaagacaacccagagattgaagatgacatcttcagaaaaaagcgcctcaccataatggacctccacccaggggccggcaagaccaaacggtacctgcccgccatcgtgcgcgaggcgattaagcggggactgcgcaccctcatcctggcccccacccgagtcgtggcggccgagatggaggaagccctccggggcttgccaatacgttaccagaccccggccatacgggccgagcacactggccgcgagatcgtggacctgatgtgccacgccaccttcaccatgcggcttctctctcccgtccgcgttccaaattacaacttaatcattatggatgaggcccacttcaccgacccggcgtccattgccgcccgcggctacataagcacccgcgtcgagatgggcgaggcggccggaatcttcatgaccgccacgccgcccggctctagagaccctttcccccaaagcaacgcccccatcatggacgaggaacgcgaaatccccgagaggtcatggaatagtggacacgagtgggtcaccgacttcaagggcaagacggtttggttcgtgccctccatcaaggccggcaatgacatcgccgcatgtctgcgaaagaacggtaaaaaggtgatacaactcagcagaaagacctttgactcagagtacgtgaagacccgggcaaacgactgggacttcgtggtcacaacggacatcagcgagatgggcgccaacttcaaggcggaacgggtgatcgatccacgccgctgtatgaagcccgtgatactgaccgacggggaggaacgcgtcatactggccggccccatgcccgtgacccactccagcgccgcccagcgtcgcgggagaatcggccggaacccgaagaacgaaaacgaccagtacatctacatgggggagccgctcgagaacgatgaggattgcgcccattggaaggaggcgaagatgctcctggacaacatcaataccccagaaggcatcatcccgtccatgttcgagccggagcgagagaaggtggatgccatcgacggagagtatcggctccgcggggaagcccggaagacttttgtcgacctcatgcgccggggcgacctgccagtgtggctcgcctacaaggtggccgcggaagggatcaattacgccgaccgcaagtggtgcttcgacggcatcaagaacaaccagattctggaagagaatgttgaggtggagatctggaccaaggagggggagcggaagaagttaaagccccgctggctcgacgcccggatttacagcgacccgctcgccctgaaggagttcaaggagttcgctgccggccgcaagtcccttacccttaacctgatcaccgagatgggccggctccccacgttcatgacccagaaggcccgcaacgccctggacaatctggccgtcttgcacaccgcggaggtcgggggccgggcctacacacatgccctgagcgaactgcccgagacgctcgagaccctgctgctcttaactttactcgccgccgtgaccgggggcatctttctcttcctaatgtcgggtaaagggatcggaaagatgaccctcggaatgtgctgcatcattacggctagcatcctgctgtggtatgcccagatccagccccactggatcgccgcttccataatcctcgagtttttcctgatcgtcctactcatcccggagccagagaaacagcgcacgccccaggacaaccagctgacctacgtggtgattgctatcctgactgtcgtggccgcaacgatggcgaatgagatgggcttcctcgagaagacaaagaaggacctggggttcggcagcataacaacccaagagagcgaatccaacatactggacatcgacctccggccagccagcgcgtggacgctgtatgcggtggcgaccacctttgtgacgccgatgctgcgccactccatcgagaacagctccgtgaacgtaagcctcacggccatcgctaaccaggcgactgtcctgatgggcctggggaagggctggcccctctccaagatggacatcggggtgcccttgctggcgatcggctgctactctcaggtcaacccgataactctcaccgccgccctgttgttactggtcgcccactacgcaatcatcgggccgggcctgcaggccaaggccacccgagaggcgcagaagcgcgccgcggccggtatcatgaagaatcccaccgttgacggcataacggtgattgacctcgagcccattccttacgacccgaaatttgagaagcagctgggccaggtcatgctgctcatcctttgcgtgacccaggtacttatgatgcgaacgacctgggctttatgcgaggccctgacccttgcaaccgggcccatcagcacgctctgggaaggcaatcccggccgcttctggaacacaaccatcgccgtctcaatggcaaacatatttcgcggttcctacctggccggcgccggtctcttattcagcataatgaagaacaccacgaacacccggcgcggcaccgggaatgtgggtgaaaccctgggtgaaaagtggaagtcccggctgaatgccctcgggaagagcgagttccagatctacaagaagtccggcatccaggaggttgaccgcacgctggctaaggaggggataaaacggggcgaaacagaccaccacgccgtttcacgcgggtcagcgaaactgcggtggttcgtcgaacgcaacatggtgacccccgagggcaaagtcgtagatctcggctgcgggcggggcgggtggagctactactgcggcgggctgaagaatgtgcgtgaggtcaaaggcctgacaaagggcggaccgggacacgaagagccgattcccatgtccacgtacgggtggaatctcgtgcggctgcagtcgggcgtggatgtcttcttcacgccgcccgagaaatgcgacacattgttatgcgacatcggtgaaagctcccccaaccccacgatagaggcaggccgtacccttcgggtgctgaatctcgtcgaaaattggctgaacaacaacacgcagttctgcatcaaggttctgaacccctacatgcccagcgtgatcgagaagatggagaccctccagcgcaaatacggcggggcactagtgcggaaccccctatcccggaacagcacccacgagatgtactgggtctccaacgcaaccggcaacatcgtgtcttctgtgaacatgatcagccggatgctgatcaatcgcttcactatgaaacacaagaaggctacctacgagcccgacgtcgacctcgggtccggcacacggaacatagggattgagtcggagatcccgaacctggacatcatcggcaaacgtatcgaaaaaatcaagcaggagcacgagatctcctggcactacgaccaagaccacccctacaagacctgggcctatcacggcagctatgagacgaagcagaccgggtccgccagctccatggtgaacggagtggtaagactgctcaccaaaccctgggacgtggtgcccatggtcacccagatggcgatgacggacaccacccctttcggtcagcagcgggtgtttaaggaaaaggtggacaccagaactcaggagcccaaggaaggtaccaagaagctaatgaagatcaccgctgaatggctgtggaaggagctcggcaaagagaagacgccccgtatgtgcacgcgtgaagagttcacgcgcaaagtccgcagcaacgccgccttaggcgccgtgttcaccgacgaaaacaagtggaagtccgcgcgggaggccgtggaagatgaccgcttctgggagcttgtcgaccgggaacgcaatctacacctggagggcaagtgtgagacctgtgtgtacaacatgatggggaaacgagagaagaagctaggcgagttcgggaaggccaagggctctcgtgcaatctggtacatgtggctcggcgcgcggtttctggagttcgaggccctgggtttcctcaatgaggaccactggttttctagaggcaacagcctgtctggggtcgagggagaggggctccatcggctcggttacatcctccgcgaggtgggcaagaaggagggcggggccatgtacgcggatgacacggccgggtgggatacccggatcaccctcgaggatctcaaaaacgaggagatggtgacaaaccacatgaagggcgagcacaagaagttagcggaggccatcttcaagctgacgtaccagaataaggtcgtgcgcgtgcagcgacccaccccgaggggtacggttatggacatcataagtcggaaggatcagcggggcagcggtcaggtggggacttacggcctaaacacgttcaccaacatggaggcccagctaatccgccagatggagggggaaggcatcttcaaatccatccaacacctgaccgccaccgaagagatcgccgtccagaactggctcgcacgtgtcggccgtgaacggctgagccgcatggccatcagcggggacgattgcgtggtgaagcccatcgacgaccggttcgccagcgccctgacagccctcaacgacatgggcaaggtacggaaggacatccaacagtgggagccatcccgggggtggaacgactggacccaggtacccttctgtagccaccacttccacgagttggtaatgaaggacggccgagttctggtagttccctgtcggaatcaggatgagctcatcgggcgcgcgcggatctcccagggcgccgggtggagccttaaggagaccgcgtgcctggggaaatcatacgcgcaaatgtggaccctcatgtacttccatcgtcgagacttgcgcctggcagcgaacgccatctgtagtgccgtcccttcccactgggtacccacttctcggacgacctggtccatacacgccaagcatgagtggatgacgaccgaggacatgctcacggtgtggaaccgcgtctggattcaggagaatccctggatggaggacaagacccctgtggaaagctgggaggaagtcccttaccttggaaagcgagaggatcagtggtgcgggtccctgataggtctcacgagccgtgcgacttgggccaagaacatccagacggccatcaatcaggtcagaagcctgatcgggaacgagggctacaccgattacatgccctccatgaagcggttccgacgggaggaagaggaggccggcgtgctgtggtag

SEQ ID NO: 24810 - RNA, 9876 nt, synthetic construct
  misc_feature 1..9876: note = derived and/or modified CDS sequence (opt11) from DENV-2__JX475906__SS-prME
  source 1..9876: mol_type = other RNA
accgtggggatgatcatcatgctcatccccaccgcaatggccttccacctcaccacccggaatggggagccccatatgatcgtgtctcggcaggagaaggggaaaagcctgctattcaaaactgaggacggggtcaacatgtgcaccctcatggcgatggacttgggcgagctgtgcgaggacaccgtgacctataactgtcccctcttgcgacagaatgagcccgaagatatcgactgctggtgcaactctacgtccacgtgggtcacctacgggacctgcaccgcaaccggcgagcacagacgcgagaagcggagcgtagccttagtgccccacgtcggcatggggctcgagacccgcaccgagacctggatgagcagcgagggcgcctggaagcacgcccagcggatcgagacctggatcctgcgacaccccgggttcacgatcatggcggccatcctggcttacaccatcggcaccacttacttccagcgggtgctcatcttcatcctgctgacggcagtggcaccctccatgaccatgcgctgcatagggatcagcaaccgggacttcgtcgagggcgtgtccggggggagctgggtggacatcgtcctcgaacacggctcctgcgtgaccaccatggccaagaacaagcctacgctggacttcgagcttatcaagaccgaggccaagcagcccgcaaccctccgcaagtactgtatcgaggccaagctgaccaacacgaccaccgcgagccggtgcccgacccagggggagccctccctgaatgaggagcaggacaagcgtttcgtgtgcaagcatagcatggtcgaccggggctggggcaacgggtgtgggctcttcgggaagggcgggatcgtaacgtgcgccatgttcacgtgcaagaaaaatatggagggcaagatagtacagcccgagaaccttgaatacaccattgtcatcacgcctcacagcggcgaggagaatgcggtcgggaatgatacgggcaagcacgggaaagaggtgaaggtcaccccgcagagctccatcaccgaagcagagttgaccggctacgggaccgtgacgatggagtgctccccccgcactgggctcgacttcaacgagatggtgctgctgcagatggagaataaggcctggctcgtccatcggcagtggttcttagacctgcccctcccgtggctgcctggcgcagacacccagggctctaactggatccagaaggaaacattagttacgttcaagaacccccacgccaagaaacaggacgtcgtggtgctcggctcccaggagggagccatgcacaccgccctgaccggcgccaccgagatccagatgagctcggggaacctcttgtttacgggccacttaaagtgccggctgcggatggacaagctccagctgaagggcatgagctactccatgtgcacagggaagttcaaggtcgtgaaggagatcgccgagacccagcacggcaccatcgtcatacgcgtgcagtacgagggggacggcagcccctgcaaaatcccgttcgaaatcatggacctcgagaaacggcacgtgctcggccgcctaatcacggtgaacccgatcgtcacggagaaggactcccccgtaaatatagaggccgagccccccttcggggacagctacatcatcatcggtgtggagccgggacaactgaagctctcctggttcaagaagggcagctccatcgggcagatgttcgagaccaccatgcgcggcgccaagcggatggccattctaggcgacacggcctgggacttcgggtcgctgggtggggtctttacctccataggcaaggcactccatcaggttttcggggccatatacggcgctgccttcagcggagtgtcctggaccatgaagatactgatcggcgtcgtgatcacctggatcggcatgaacagccgcagtacgagtctgtccgtaagcctggttctcgtaggggtggtcactctgtacctgggcgtgatggtgcaagcggactccggctgcgttgtcagctggaagaacaaggagctgaagtgcgggagcggcatctttatcaccgacaacgttcacacctggactgagcagtacaagttccagcccgagtcccccagcaagttggcttccgccatccagaaggcccacgaggaaggtatatgcggcatccggagtgtcacccgtcttgagaaccttatgtggaagcagatcacccccgagctgaatcacatcctgtccgaaaacgaggtcaagctcaccataatgacaggggacattaagggaatcatgcaggccgggaagcggtctctgcgcccgcaacccactgagctgaagtacagctggaaaacctggggcaaggcgaagatgctcagcaccgaaccgcacaaccagactttcttgatcgatggcccggagacagccgagtgccccaacactaaccgagcctggaactcccttgaagtggaggactatggcttcggggtcttcaccacgaatatctggctcaagcttaaagagcgccaggacgtgttttgcgacagcaaactgatgtccgccgccatcaaggacaaccgggcggtgcacgccgatatgggttattggattgaaagcgccctcaacgatacctggaagatagaaaaggcatcgttcatcgaggtaaaatcttgccactggcccaagtcccacaccctgtggagcaacggcgtgctggagtccgagatgatcatccccaagaacttcgccggcccggtgagccagcataattaccgccccgggtaccacacgcagaccgcggggccctggcacctaggtaagctggagatggactttgacttctgcgagggcacgacggtcgttgtgactgaggattgtgggaatcggggccccagcctgagaaccacgaccgcctccggcaagctcatcaccgagtggtgctgcagaagctgtacgctgccaccgctgcgctaccgcggggaggatggctgctggtacgggatggagatccgccccctcaaagaaaaggaggagaacctggtcaattccttggtgaccgcaggtcatgggcagatcgacaactttagcctcggcgtgttaggcatggccctgttcctcgaggaaatgctgcggacgcgcgtcggcaccaagcacgcgctgctgctggtggccgtgtcctttatgactctgatcacgggcaacatgagcttccgggatttggggcgcgtcatggtgatggtgggcgccgccatgaccgacgacatcggcatgggcgtgacctacttggccctactggcggccttcaaggtacgacccacattcgccgctggcctgctgctgcggaagctgacgtccaaggagttgatgatgaccaccatcgggatcgtgctcctgagccaatccaccatcccggagacgatccttgagcttacggacgccctggcgctgggcatgatgatcctcaagatcgtccgcaacatggagaagtaccaacttgcagtgaccataatggccatcctgtgcgtccccaacgccgtgattctccagaacgcctggaaagtgtcctgcaccatcctggcggtcgtgtccgtgagccccctgctcctgacgagcagccggcagaaggccgactggatccccctggctctcacgatcaaggggctgaacccgacagccatcttcctgaccacgctctcccggaccaacaagaagcggagctggcccctaaacgaggccattatggcggtcggcatggtatccattctggcctcgagtctcctcaagaacgacatcccaatgaccggccccctggtggccgggggcctcttaaccgtctgctacgtactgacgggcaggagcgccgacctcgagcttgagcgggcggccgacgtgcgttgggaggaccaggccgagatcagcggctccagcccgattctgtccattaccatcagcgaggacggctccatgagcatcaagaacgaggaggaggaacaaaccctcaccatcctgatccggacgggcttactcgtcatctcaggcctgtttcccgtgagcatccccatcaccgccgcggcgtggtacttgtgggaggtgaagaagcaacgcgccggggtcctctgggacgtgccctcgccgccgcccgtgggtaaggccgagctcgaagacggagcctaccggatcaagcagaagggcatactggggtacagccaaatcggggccggcgtgtataaggaagggaccttccacaccatgtggcatgtgacccggggtgcggtgctcatgcataaggggaagcggatagagccgtcctgggccgatgtacgcaaggacctgataagctacggcggtggctggaaactggagggcgagtggaaggagggggaggaggtacaggtgctcgccctggagcccggcaagaacccccgtgcagtccaaacgaagcccgggttgttcaagaccaacaccggcaccatcggggccgtgtctttagacttcagcccaggcacgtccggcagccctatcgtggacaagaaggggaaggtggtgggcctgtatgggaatggcgtggtcacaaggtccggaacgtacgtaagcgcgatcgcacaggccgagaagtccatcgaggataaccccgagatcgaggacgacatcttccggaagcgccggctgacgatcatggacctgcatcccggggcgggcaaaacaaagcgctacctgcccgcgatcgtgcgggaagccatcaagcgagggctgcgcacactgatcctggcccccacccgggtcgtagctgcagagatggaagaggcgctgcgaggcctgcctatccggtaccagacccccgccatccgcgccgagcacacgggtcgggaaatcgtggacctaatgtgccacgccaccttcaccatgcgcctgttaagcccggtccgggtgcccaattacaacctcatcatcatggacgaggctcacttcaccgacccagccagcatcgccgctcgcggctacatatccacgcgggtggaaatgggtgaggccgccgggattttcatgacggcgacgccgcccggcagcagagacccattcccccagagcaacgcgcccatcatggacgaggagcgggaaatccccgagcgcagctggaactcggggcacgagtgggtcaccgacttcaagggcaagacggtgtggtttgttcccagcatcaaggcggggaacgacatcgcagcgtgcctccggaagaacggcaagaaagttatccagctgtcccgcaagacatttgacagcgagtacatcaagaccaggactaacgactgggacttcgtggtgacgaccgacatctcagagatgggcgccaacttcaaggcagagcgcgtgatcgaccctcggcgctgcatgaagcccgtgatcctcaccgacggggaggaacgggtgatcctagccggcccgatgcccgtcacccacagcagcgccgcgcagcgccgagggcggatcggccgcaaccccaagaatgagaacgaccagtacatctatatgggagagcccctggagaatgacgaggactgcgcccactggaaggaggccaaaatgctcctggacaacatcaacacgccggagggaattattccttctatgtttgagcctgagcgggagaaagtcgacgccatcgacggggagtaccgtctgcgcggtgaggcccgcaagacattcgtagacctcatgcggcgcggcgacttaccggtctggctggcgtaccgggtggccgccgaggggatcaactatgcagaccgcagatggtgcttcgacggcgtcaagaacaaccagatcctcgaagagaacgtggaggtggagatctggaccaaagaaggcgagcgcaaaaagctcaagccccggtggctcgacgcccgcatctactccgatccactcgcgctgaaggagttcaaggaatttgccgccggccgcaagtcgctgaccctcaaccttatcacggagatgggccgccttccaacgttcatgacccagaaggcacggaacgcgctcgacaacctggcagtcctacacaccgcagaggctggtggccgcgcctacaaccacgcgctctccgaactcccggagacgctggaaaccttactgctcctcaccctgcttgccaccgtgaccggggggatcttcctctttctgatgagcggcaaagggatcggcaagatgacgctcggaatgtgttgcataatcactgcctccatcctcttgtggtacgcccagatccagccgcactggatcgccgcgagcattatcctggagtttttcctcatcgtgctgctgatccccgagccggagaagcaacggaccccgcaggacaaccagttgacctacgtcgtgatcgccattctaactgtggtagccgcgaccatggccaacgaaatgggtttcctggagaaaacaaagaaggacttcgggctcggctccatcgcgactcagcagcccgagagcaacatcttggacatcgacctgcgccccgccagcgcctggacgctctatgcggtcgccaccacctttatcacccccatgctgagacactccatcgagaactcctccgtgaacgtctcgctgacggccattgcaaaccaggccaccgtgctcatgggccttgggaagggctggccgctgtctaagatggacatcggggttccgctccttgccatcggctgctatagccaggtaaacccaatcaccctgaccgcggccctcttactactagtggcccactacgccataatcgggcccggattgcaggccaaggcaacgagggaggctcagaagcgcgccgccgcaggtatcatgaagaaccctaccgtggacgggatcacggtcatcgatctggatcctatcccgtacgaccccaagttcgagaaacagctcggacaggtgatgctcctggtgctttgcgtcactcaagtgttgatgatgcggacgacctgggcgctctgcgaggccttaaccctggccacagggccgatctccacgctgtgggaaggcaacccggggagattctggaacacgaccatcgcggtcagcatggccaatattttccggggctcctacctcgcaggcgccgggctgctgttctcgatcatgaagaatacaacgaacacccgtcgcggcacagggaacaccggcgaaactctcggcgagaagtggaagaaccgcctgaacgccctcgggaagtccgaattccagatatacaagaagtcaggcatacaggaggtcgacaggacgctcgcaaaggaggggatcaagcgcggcgagaccgaccaccacgcggtgtcccgtgggagcgccaagctgcgctggtttgtggagcgaaatctggtcacccccgaaggcaaggtggtggacctcggctgcgggagaggcgggtggtcctactactgcggcgggctgaaaaacgtccgggaggtgaagggcctgacaaagggcggccccggccacgaggagccgatccccatgagcacctacgggtggaacctcgtgcgcttacaatccggcgtcgacgtatttttcacgcctcccgagaaatgcgacaccctgctctgcgacatcggggagagctcccccaaccccacggtggaggctggccggaccctgcgcgtgctgaacctcgtggagaactggctgaacaacaatactcagttctgcatcaaagtgctgaacccgtacatgccgtcagtcatcgagaaaatggaggccctgcaacggaagtacggtggggccctcgtgcgcaacccattaagccggaatagtacccacgaaatgtactgggtgtccaacgcgtccggtaacatcgtgagctctgtgaacatgataagccggatgctgatcaatcgcttcaccatgcgtcacaagaaggccacttacgagcccgatgtggatctcgggtccggaacacgcaatatcgggatcgagagcgaaacccccaacctggacatcattgggaagcggatcgagaaaataaagcaggagcatgagacctcctggcattatgaccaggaccatccgtacaagacgtgggcctatcatggcagctacgagaccaaacagacagggtcggccagctccatggtaaacggcgtggtgcgcctgctcaccaagccctgggacgtcatccccatggtcacgcaaatggccatgaccgacaccaccccctttgggcagcaacgggtgttcaaggaaaaggtggatacgcggacccaagagcccaaggaaggcactaaaaaactgatgaagatcacggcggaatggctgtggaaggaactcggtaagaagaagacgcccaggatgtgcacccgcgaagagttcacccggaaagtgcgcagcaacgccgcactgggtgccatcttcaccgacgagaacaagtggaagtccgccagggaggcggtcgaagactcgagattctgggaactggtggacaaggagcggaacctccatctagagggcaagtgcgagacctgcgtgtacaacatgatggggaagcgcgagaaaaagctgggcgaattcgggaaggccaagggctcccgggccatctggtacatgtggctcggggcccggttcctggagttcgaagcgctggggttcctcaacgaagaccattggttcagtcgggagaactcactgagtggcgtcgagggggagggcctgcacaagttggggtacatcctgcgcgacgtcagcaagaaggagggaggcgccatgtacgccgacgacacggccggttgggacacccggatcaccctggaggatcttaagaacgaggagatggtgacgaatcacatggagggcgaacacaagaagctggccgaggcgatattcaagctgacttaccagaacaaggtcgtgcgcgtgcagcggcccacgccccggggcaccgtaatggacatcatctcccggcgggaccagcgcggcagcggccaggtgggtacatatggcttaaacacctttaccaacatgggggcccaactgatccggcagatggagggggaaggagtgttcaagtccatccagcacctgacggccacggaggagatagccgtccaggactggctcgcccgcgtggggcgcgaacgcctgagccgaatggctatctcaggcgatgattgtgtcgtcaagccgctggacgaccggttcgcctcggcgttaaccgccctgaacgacatggggaaggtgcggaaggatatccagcagtgggagccctcccgcggctggaacgactggacccaggtaccattctgcagccatcactttcacgagctgatcatgaaagacgggcgggtcctcgttgtgccctgtcggaaccaggacgagctgatcggccgggcccgcatatcccagggggcgggatggagcctacgggagaccgcatgtttaggcaagtcctacgcccagatgtggagcctgatgtacttccaccgccgggacctacgcctcgccgcaaacgccatttgcagtgccgtcccaagccactgggtgcctacctcgcggactacttggagcatccacgccaagcacgagtggatgaccaccgaggacatgttaacggtctggaaccgcgtctggatccaagagaatccctggatggaggacaagacccccgtggagtcctgggaggagatcccttacctggggaagcgcgaggaccagtggtgcggcagcctcatcgggctcacttctcgggccacctgggcgaagaacatccaaacggccataaaccaggtgaggtccttgattgggaacgaagagtacacagactatatgcccagcatgaagcgcttccgccgggaggaggaggaggcaggggtcctctggtga

SEQ ID NO: 24811 - RNA, 9876 nt, synthetic construct
  misc_feature 1..9876: note = derived and/or modified CDS sequence (opt11) from DENV-2__JX669477__SS-prME
  source 1..9876: mol_type = other RNA
accgccggcgtgatcgtcatgctgatccccactgcgatggcgttccacctcaccacacgcaacggtgaaccccacatgatagttggccggcaggaaaaagggaagagcctgctgttcaagactgaggacggtgtcaacatgtgcaccctcatggccatcgacctgggggaactatgcgaggacacgattacctacaagtgccccctgctgcgccagaacgagccggaggacatcgactgttggtgtaatagcacatctacctgggttacctacgggacctgcaccactacgggcgagcaccggcgcgaaaagcggtccgtcgccctggtgccacacgtggggatgggcctagagactcgcaccgagacatggatgagctccgaaggggcctggaagcacgtgcaacgcatcgagacctggatcctgcgccacccgggcttcaccatcatggcagcgatcctggcctataccatagggaccacgcacttccagcgggccctcattttcatcctgctgaccgctgtggcgcccagcatgaccatgcgctgcatcggcatctccaatcgggactttgtcgagggcgtcagcggaggctcgtgggttgatatcgtcctcgagcacggaagctgcgtgaccacgatggccaagaacaagcccaccctagatttcgagctgattaaaaccgaggccaagcaacccgctaccctacgcaaatactgcattgaggcaaagctgacgaataccaccaccgagtcccgctgcccgacgcagggcgaacccagcctgaacgaggaacaggacaagcgcttcatatgcaagcactccatggtggaccggggctgggggaacggctgcgggctgttcggcaagggcgggatcgtgacttgcgctatgttcacatgcaagaagaacatggagggcaagatcgttcaaccggagaatctggagtacaccattgtgatcacgccgcacagcggtgaggaacacgccgtaggtaacgacaccgggaagcacggcaaggagatcaagataactccgcagtcctcaaccaccgaggccgagctgacgggttacggcaccgtgaccatggagtgcagcccccggaccggcctagacttcaatgagatggtgctgctgcagatggaggataaagcctggctcgtccaccgccagtggttcctggatttacccctcccctggctccccggggccgacacgcagggcagcaactggatacagaaggagaccctggtgaccttcaagaacccccacgcgaaaaaacaggatgtggtcgtgctcgggagccaggagggcgccatgcacacagcccttacgggggccactgagatccagatgtctagcggcaacctcctcttcaccggccacctgaagtgccgcctgcggatggacaagctccagttgaaggggatgtcctacagcatgtgcaccggcaaattcaagatcgtcaaggagatcgccgagacgcaacacgggaccatcgtgatccgcgtgcaatacgagggggacggctccccctgcaagatccccttcgaaatcaccgacttagagaagcggcacgtcttagggcgcctgatcaccgtaaacccaatagtgactgagaaagactcccccgtcaacatcgaggcggagccgcccttcggagattcctatatcatcgtgggtgtggagccgggccagctgaagctcaattggttcaagaaggggagctccatcggccagatgttcgagaccaccatgcgcggcgccaaacggatggccatcctgggggacaccgcctgggacttcggcagcctcggcggggtcttcacttccatcggaaaggccctccaccaggtgttcggggcgatctacggagccgccttcagcggggtgagttggaccatgaagatcctgatcggcgtcatcatcacctggatcggcatgaacagccgctcgacgagcctgtctgtgtctctggtgctcgtcggcgtcgtgacgctgtacctgggagccatggtacaagcggactccggctgcatcgtatcatggaagaacaaggaactcaagtgcggctccgggatcttcataacagacaacgtgcacacctggaccgagcagtacaagtttcaaccagagagcccctctaaactggcctccgccattcagaaagcccacgaggaggggatttgcgggatccggagcgtcacgcgcctggaaaacctcatgtggaaacagatcacccccgagctgaaccacatactatccgagaacgaggtgaagctcaccattatgaccggcgacatcaaggggatcatgcaggccggaaagagaagcctgcgcccgcagcccacggagttaaagtactcctggaagacatggggcaaggccaagatgttaagcaccgagtcccacaaccagacgttcctgatcgacgggcccgagacagccgagtgtccgaacaccaaccgggcctggaacagcctggaggttgaggactatggcttcggagtcttcaccaccaacatttggctcaagcttcgcgaaaaacaggacgtgttctgtgactccaagctgatgagcgccgccattaaagataaccgggcggtccacgccgatatgggctactggatagaaagtgccctcaatgacacctggaagatggagaaggccagcttcatagaagtcaagtcctgccattggcccaagagccacacgctgtggtctaacggagttttggagtcagagatgatcattcctaagaacttcgccgggcccgtgtcgcagcataactaccgccccggctaccacacccagaccgcggggccctggcacctcggcaaactggaaatggacttcgacttctgcgaaggaaccactgtcgtggtcaccgaagactgcggcaatcgtggaccctccctgaggacgaccacggccagcgggaagctcatcacggagtggtgctgtcggtcctgtacactgccccccctgcgctatagaggcgaggacgggtgctggtacggcatggagatacgccccctcaaggagaaggaggagaatctggtcaacagcttagttaccgcgggccacgggcaaatcgacaacttttccctcggcgtactgggcatggctcttttcctggaggagatgctgcggacgcgcgtcggcactaagcacgcgatcctgctcgtcgccctgtctttcgttacattgatcaccgggaacatgtccttcagagatctcggccgtgttatggtgatggtgggggcaaccatgacggatgacatcggcatgggcgtcacttacctggccctgctcgccgcattcaaagtgcgacccaccttcgccgccgggctgttgctccggaagctgacgagcaaggagctgatgatggccaccatcggcatcgcgctcttatcccagagcaccctgcccgagaccatactggagctgacggacgcgctggccctcgggatgatggcactgaagatcgttcgaaacatggagaagtatcagctggccgttaccatcatggccatctcttgcgtgcccaacaccgtgatcctccagaacgcgtggaaggtcagctgcaccatcctggctgccgtgtccgtgagcccccttctcttgacgtccagccagcagaaggccgactggattcccctggcgctcacaattaagggcctgaaccccacagccattttcctgacaacgctgtcccggacctcgaaaaagcgctcctggccgctgaatgaagcgatcatggccgtcggcatggtgagcatcttagcttcctctcttctgaagaacgatatccccatgaccgggccgctggttgcgggcgggctcctaaccgtgtgctacgtcctgacgggccggagcgccgacctcgagctagaacgcgcagcggatgtcaagtgggaagaccaggccgaaatctccggaagctcccccatcctgagcatcacaatctccgaagatgggtcaatgtccatcaagaacgaagaggaggaacagaccctcaccatcctgattcggacgggcctgttagtgatcagcggagtgtttcctgtatccatccccatcacggcggccgcctggtacctgtgggaggtgaagaagcaacgtgccggcgtgctgtgggacgtcccaagcccgccccccgtggggaaggccgaactcgaggacggagcgtatcggatcaagcagcgcgggatcctgggctattcccagataggggccggggtatacaaagaggggaccttccatacaatgtggcacgtcacccgcggggccgttctcatgcaccgcggcaagcggatcgagcccagctgggccgatgttaagaaggacctcatctcctacgggggaggttggaaactggagggggagtggaaggagggcgaggaggtccaagtgctagcccttgagcccgggaagaacccccgcgcggtgcagactaagcccggcattttcaagaccaacacaggaacgatcggagccgtcagtctggactttagtcctggcacaagcgggtcccccatcgtggaccggaaaggcaaggtggtcggtctgtacggcaacggcgtggtgacccgcagcggggcctacgtgtcagcaatagctcagacggaaaaatccatcgaggacaaccccgagatcgaggacgacatcttccggaagaagcgcctcaccatcatggacctgcaccccggcgccgggaagacgaagcggtacctgcccgccatcgtgcgcgaggcgatcaagcggggcctccgcacactcatcctggccccgactcgcgtggtcgcggcagagatggaagaggccctgcgggggctccctattcgctaccagacccccgccatccgggctgagcataccggccgcgagatagtggacctgatgtgccatgcgacctttaccatgcggctcctcagcccggtgcgcgttccgaactataacctgatcatcatggacgaggcccacttcaccgaccccgcttccatcgccgcacggggctacatcagcacgcgcgtggagatgggggaggccgccggcatcttcatgactgccacgcctcccgggtcccgggacccgttcccccagagcaacgcccccatcatggacgaggagagagagatccccgagcggtcctggaacagcggtcacgagtgggtgaccgatttcaaggggaagacggtctggttcgtcccgagtattaaggcgggcaacgacatcgccgcctgcctgagaaagaacggcaagaaggtgatccagctctcccggaagaccttcgactccgagtacgtcaaaacccgcgccaatgactgggacttcgtggtaacgactgacatctcagaaatgggggcgaacttcaaggcggagcgggtcatcgacccccgccggtgcatgaagcccgtgatcctgaccgacggcgaagagcgcgttatcctggcaggccccatgccggtcactcactccagcgcagcccagcggcgtggccgcatcgggcggaaccccaagaacgagaatgaccagtacatctacatgggagagcccctcgagaatgatgaagactgcgcccattggaaggaggcgaagatgttactggacaacatcaacaccccggaaggcataatcccgagcatgttcgagccggagcgagaaaaagtggacgcgatcgacggggagtaccggctccgcggcgaggcccggaagacgttcgtagaccttatgcgccgcggggacctgcctgtatggctcgcctacaaggtggccgcggagggcatcaattacgcggatcgcaagtggtgcttcgacggtatcaagaataaccaaatcctggaggagaacgtggaggtcgagatatggaccaaggagggcgagcggaagaagttgaagcctcgctggctcgacgcccggatctacagtgaccccctagccctgaaggaattcaaagagtttgcggctggccgtaagtccctcacacttaacctgatcaccgaaatggggcggctccctacttttatgacccagaaggcacgtaacgccctggacaacctggccgtgctccatactgcggaggtaggcgggaaggcccacacgcatgccctgagcgagttgcccgagacactcgaaaccctgctgctcttgaccctgctcgccgcggtcactggcggcatctttctgttcctgatgtccgggaagggcatcgggaagatgaccctcggcatgtgttgtatcatcacggcgagcatcctgctctggtacgcacagatccaaccgcactggatcgccgcttccatcattctcgagttcttcctgatcgtgctgctcatacccgagcccgaaaagcagcgaactccccaagacaaccagctgacctacgtcgtgatcgcaatcctgaccgtggtggcggcaacgatggccaacgagatgggtttcctcgagaagaccaagaaggacttgggctttggcagcatcactacgcaggagtcagagtcaaacatcctcgacatcgacctccgcccggccagcgcgtggacgctatacgcggtagccaccaccttcgtgaccccaatgctacggcactccattgagaactcgtcggtaaacgtgagcctcaccgccatcgcgaaccaagcgaccgtgctgatggggctgggcaagggatggcccctcagtaagatggacatcggcgtccctctgctggccatcggatgctacagccaggtgaatcctatcacgttgaccgccgccctgctgttactggtggcccactacgcgattatcggccccggcctgcaagccaaggccacgcgcgaggcccagaagagggccgcggccggaatcatgaagaaccccaccgtcgacggcatcaccgtgatcgacttagaacctatcccttacgaccccaagttcgagaagcagctggggcaggtcatgttattaatcctgtgtgtgacgcaagtgctaatgatgagaactacctgggccctatgcgaggccctgaccctggccaccggccccatcagcacgctctgggaggggaaccccggccggttctggaacaccaccatcgcggtgagcatggccaatatcttccgggggtcatacctggccggggcaggcctcctgttcagcatcatgaagaacaccacgaacacgcgccgggggaccgggaacgttggagagaccctgggagaaaagtggaagtcccgcctgaacgcgctcggcaagagcgagttccaaatttacaagaagagcgggatccaggaggtggaccggacgctggccaaggagggcataaaacgcggggagaccgaccaccacgccgtaagcagaggctccgccaagctgcgctggtttgtcgaacggaatatggtcaccccggaagggaaggtcgttgacctcgggtgcggacgcgggggctggagctattactgcgggggcctgaaaaacgtgagagaagtgaagggcctgaccaagggcgggcccgggcacgaagagcccatccccatgtccacgtacggctggaacctcgttcgcctgcaaagcggggtggacgtgttcttcactcctcccgaaaagtgcgacaccctgctctgtgacatcggagagagctccccgaaccccaccatcgaggccggccggacactgcgcgtcctgaacctcgtggagaattggctgaataacaacactcagttctgcataaaggtgctgaacccgtatatgccgtcggtgatcgagaaaatggagaccctccagcggaagtacgggggcgcgctggttcgcaaccccctgtcccggaacagcacccatgaaatgtactgggtgtccaacgccaccggtaacatcgtcagctccgttaacatgatcagccgcatgctgatcaatcggtttacgatgaagcacaagaaagccacgtacgagccggacgtggacctcggcagtgggacacgcaacatcggtatagagagcgagatccctaacctggacatcataggcaagcggattgaaaagatcaagcaggagcacgagacctcctggcactacgaccaagaccacccttacaagacttgggcctaccacggaagctacgagaccaagcagaccggctccgccagctccatggtgaacggggtggtgcgcctgctcaccaagccctgggatgtcgtgccgatggtcacgcagatggcgatgaccgataccacccccttcgggcagcagcgcgtatttaaggagaaagtggacacgcggactcaggagcccaaggagggcaccaagaagctgatgaagatcaccgccgagtggttatggaaggagttagggaaggagaaaaccccccggatgtgcacccgggaagagtttacccgcaaggtgcgcagcaacgctgccctgggcgcagtcttcaccgacgagaataagtggaagagcgcgcgagaagccgtggaggacggacggttctgggagctggttgaccgcgagcggaacctccacctggagggcaaatgcgagacttgcgtatacaacatgatggggaagcgcgagaaaaagctcggcgagttcggcaaagccaagggtagccgggccatctggtacatgtggctcggcgcgcgcttcctggagttcgaggctctcgggttcttgaatgaagaccactggttctcccgcgagaacagcctgtcaggcgtggagggggagggcctgcaccgcctcggatacatcctacgggacgtctccaagaaggagggcggagccatgtacgccgatgataccgccgggtgggacacccgcattaccctggaggacctgaagaatgaggagatggtgacgaatcacatgaagggcgaacacaagaagctggcggaggccatcttcaagcttacgtaccagaataaggtggtccgggtgcaacgcccgacgccccggggcaccgtgatggacatcatcagcagaaaggaccagcggggatccggccaggtcgggacgtacggcctcaacacattcacgaatatggaggcacagttgatacgccagatggagggtgagggcatcttccggagcattcagcacttgaccgcaacggaggaaatcgccgtgcagaactggctcgcgcgggtgggccgcgaacggctgtcccgcatggcgatcagcggggacgactgcgtcgtgaagcccattgacgaccgattcgcgtccgccctgaccgcactcaatgacatgggcaaggtccgcaaggacatccagcagtgggagcctagccgggggtggaatgactggacccaggtgccgttctgctcacaccactttcacgagctggtcatgaaggacgggcgcgtgttagtcgttccctgccggaaccaggacgagctcattgggcgcgcgcggatcagccagggcgccggctggtccctgaaggagaccgcctgcctgggcaagtcgtacgctcagatgtggactctcatgtacttccaccgccgggacttacgcctggccgcgaacgccatctgcagcgccgtgcccagccactgggtccccacgtccagaaccacctggagcattcacgctaagcacgaatggatgaccacggaagacatgctcgcggtgtggaatcgcgtgtggatccaggagaacccgtggatggaggacaagacgcccgtcgagtcctgggaggaggtgccctacctgggcaagcgggaagaccagtggtgtggcagcctgatcggcctcaccagccgcgccacctgggccaagaatatccagacggcaatcaaccaggtgcggtccctgatcgggaacgagggctacactgactacatgcccagcatgaagcgattccgcagagaggaggaggaggccggagtcctgtggtga

SEQ ID NO: 24812 - RNA, 9876 nt, synthetic construct
  misc_feature 1..9876: note = derived and/or modified CDS sequence (opt11) from DENV-2__JX669478__SS-prME
  source 1..9876: mol_type = other RNA
accgccggcgtgatagtcatgctgatcccgaccgccatggcattccacctcacaacccgcaatggggagccccacatgatcgtgggtcggcaggagaaagggaagtcccttctgttcaaaaccgaggacggcgtgaacatgtgtaccttgatggccatcgatctgggggagctgtgtgaggacaccatcacctataaatgccccctccttcgtcagaacgagcccgaggacatcgattgctggtgcaacagcaccagcacgtgggtcacctacgggacctgcactaccacgggcgagcaccggcgcgagaaacggtcagtggcactggttccccacgtcgggatgggcctcgagacccgcaccgaaacctggatgagctccgagggggcgtggaagcacgtgcagcgtattgagacctggattctgcgccacccgggcttcaccatcatggccgccatcctggcctacaccatcggaactacgcactttcagcgggccctcatctttatcctgctgaccgccgtggcacccagcatgaccatgcgctgcatcggcataagtaaccgggacttcgttgagggcgtgagcggcggctcctgggtggacatcgtactcgaacacggcagctgtgtgaccacgatggctaagaacaagcctactctggacttcgagctgatcaagacagaggccaaacagcctgccaccctcaggaagtactgcattgaggcgaagctgacaaataccactaccgagtccaggtgcccgacgcagggagagcccagcctgaacgaggaacaggacaagcgcttcatctgcaagcactccatggtcgaccggggctggggcaacggctgcgggttgttcgggaagggcgggatagtgacctgcgcgatgttcacgtgtaagaaaaacatggaggggaagatcgtccagcccgagaacctggagtacaccatcgtgatcacgccccacagcggggaggagcacgccgtcggcaacgacaccgggaaacacggcaaggagataaagatcactcctcagtccagcacgaccgaggccgaactgacggggtacggcaccgtgaccatggagtgcagccctaggaccggcctcgacttcaacgagatggtgctgctgcagatggaggataaagcctggctagttcaccggcagtggttcctggacctgcccctcccgtggctgccgggagcagacacgcaggggagcaactggatccagaaggagaccctggtgaccttcaagaatccccacgcgaagaagcaggacgtggtcgtgctcgggtcccaggagggcgccatgcacaccgccctgacgggggccaccgaaatccagatgagcagcggcaacctcctgttcaccggccacctgaaatgccgcctacggatggacaagctccagttgaagggaatgtcctacagcatgtgcaccggcaagttcaaaatcgtcaaagaaatcgccgaaacgcagcacggcaccatagtgatccgcgttcagtacgagggcgacggatccccctgtaagatccccttcgagatcaccgacctggagaaacggcacgttctcgggcgtcttatcaccgtgaacccgatcgtgacggagaaggacagccccgtcaatatcgaggcggagccacccttcggcgactcctacatcattgttggggtggagccgggccaactgaagctcaactggttcaagaaggggagctccatcgggcagatgttcgagaccaccatgcgcggagccaagcgtatggccatcctgggggacaccgcgtgggacttcggcagcctcggcggagtcttcacgtcgatcgggaaggccctccaccaggtgttcggggcgatctatggcgcggctttcagcggtgtgagctggacgatgaagatcctgataggcgtcatcatcacctggatcgggatgaactcgcgctccaccagcctgtccgtgagcctggtgctcgtcggcgtggtgacgctgtacttaggggccatggtccaggcggactccggctgcatcgtgagctggaagaacaaggagctcaagtgcggctccggtatcttcatcaccgataacgtgcacacctggaccgagcaatacaagttccagcccgaaagccccagcaagctggcctccgccatccagaaggcccacgaagagggcatctgtggaatacgtagcgtcacgcgcctggagaacctcatgtggaagcagataacccccgagctgaaccacatcctgtcagaaaacgaggtgaagctcacgatcatgaccggcgacatcaaggggatcatgcaggcgggcaagcggagccttcgtccgcagcccacggagctaaagtactcgtggaagacctggggcaaggccaagatgctcagcaccgagtcccacaaccagaccttcctgatcgacggaccagagaccgccgagtgcccaaataccaaccgggcttggaactcgctggaggtggaagactacggcttcggggtcttcacaaccaacatctggctcaagctgagggagaagcaggacgtgttttgtgactccaagctgatgagcgcagccatcaaggataacagggccgtgcacgctgacatggggtactggatcgagtccgccctcaacgacacgtggaagatggagaaggccagcttcatcgaggttaagtcctgccactggccaaagagccatacactgtggtccaacggcgtacttgagagcgagatgatcatcccgaaaaacttcgccgggcccgtgtcccaacacaactaccgtccgggctatcacacccagaccgctgggccctggcacctcggtaagctggagatggacttcgacttctgcgaggggaccactgtcgtagtcaccgaggactgcggcaaccggggcccgagcttgcgcaccacaacggcaagcggcaagctcatcaccgagtggtgctgccggtcctgcaccctgcccccgctccgctatcggggcgaggacgggtgctggtacggcatggagatccgccccctcaaggagaaggaggagaacctggtcaacagcctggtaaccgccgggcacggccagatagacaacttctccctcggtgtgctggggatggcgctgttcctcgaggagatgctgcggacgcgcgtcggcaccaagcacgcgatcctgctcgtcgccctgagctttgtgaccctgattaccggcaacatgtcctttcgggacctcggccgcgtcatggtcatggtaggggccacgatgacggacgacatcggcatgggcgtcacctacctggccttactcgccgcattcaaggtgcgccccacctttgccgccgggctgctgctacggaagctgacgagcaaagagcttatgatggccaccatcggcattgccctcctgtcgcagagcactctgccggagaccatcctcgagctgacggacgcgctggccctcgggatgatggccctgaagatcgtgcgcaacatggagaagtaccagcttgccgtcaccatcatggccatctcttgcgtcccgaacgcagtgatcctccagaacgcctggaaggtcagctgcaccatacttgccgctgtgtccgtgagccctctgttgctaaccagctcgcagcagaaggcggactggatccccctggcactcactatcaagggtctgaaccccaccgccattttcctgaccaccctatccagaacgagcaagaagcgctcttggccgctgaacgaggccatcatggccgtcggcatggtgtccatcctggcgagcagcctcctgaagaacgacatccccatgaccgggcccctggtcgccggcgggctcctgaccgtgtgctatgtgctgacgggccggagcgccgatctcgagctggagcgcgccgccgacgtcaagtgggaggatcaggcggagatctccgggagctcccctatactgtcaatcacgatctccgaggacggcagcatgtccatcaagaacgaggaggaggagcaaaccctcactatcctcatccggactggcctgctcgtgatcagcggggtgttcccggtctccataccaatcaccgccgcggcctggtacctgtgggaggtgaagaagcagcgcgccggagtactgtgggatgtgccatcgccgccgcccgtggggaaggctgagctcgaggacggcgcgtatcgcatcaagcagcgcggcattttcggctattctcagatcggcgccggggtctacaaggagggcacgttccacaccatgtggcacgtcacccgcggcgccgtgctgatgcaccgcggcaagcggatcgagcccagctgggccgatgtgaagaaggatctgatctcctacgggggcggctggaaactagagggggagtggaaggagggtgaggaagttcaagttctagctctggagcccgggaagaaccctcgcgccgtgcagaccaagccagggatcttcaagacgaacaccgggaccatcggcgcggtctctctcgacttctcccccggcacctctgggagtccgatcgtcgaccggaagggcaaggtcgtcgggctgtacggtaacggcgtggtcacgcgcagtggggcctacgtctccgcgatcgcccagaccgagaagtccattgaggacaaccccgagatcgaggacgacatcttccggaagaagcggttaaccatcatggacctccacccgggtgccgggaagaccaagcggtacctgcccgccatcgtgcgagaggccattaaacggggccttcgcacgctgatcctagcgccgacccgcgtggtcgcggccgagatggaggaggccctgagagggctgcccatccgctatcagacacccgccatccgcgcggagcacacaggccgcgagatcgtggacctcatgtgccacgccacgttcaccatgcggctgttgtcacccgtacgcgtcccgaattacaacctaatcatcatggacgaggcccacttcaccgacccggcctccatcgccgctcggggctatatcagcacccgcgtggagatgggggaggccgccggcatcttcatgacggccacaccgcccgggagccgggacccgtttccccagagcaacgcacccatcatggacgaggagcgcgagatccccgagcggtcgtggaacagcggccacgagtgggtgaccgacttcaaggggaagaccgtctggttcgtgccctccatcaaggccggcaacgacatcgcggcctgcctgcgcaagaacggcaagaaggtgattcagctgagccggaagacgttcgactccgaatacgtcaagacgcgtgcaaatgactgggacttcgtggtgacaaccgacatcagcgagatgggggcaaacttcaaggccgagcgggtcatcgacccccgccggtgcatgaagcccgtgatactcacggacggcgaagagcgagtgatccttgccggtccaatgccggtcactcactccagcgcagcccagcggcgcggtcgcatcgggcggaatcccaagaatgagaacgaccagtacatctacatgggcgagcccctggagaacgacgaggactgcgcgcactggaaagaggctaagatgctcctggacaatatcaacacccccgaaggcatcatcccgtccatgttcgagcccgagcgcgagaaggtggacgccatcgacggggagtaccggctgcgtggcgaggcccggaaaacgttcgttgaccttatgcgccgcggggacctgcccgtatggctggcctacaaggtggcggccgagggcatcaactacgccgaccgcaagtggtgctttgacgggatcaagaacaaccagatcctcgaggagaacgtcgaggtcgagatctggaccaaggagggcgagcggaagaagctgaagccgcgctggctggacgctcgaatctacagcgacccactcgcgctgaaggagtttaaggagttcgccgccggccgcaagtcactgaccctcaacctgatcaccgagatgggtcggctgcccacctttatgacgcaaaaggcccgcaatgccctcgacaatctggcggtgctgcacaccgccgaggtgggcgggaaggcgtacacacatgccctctccgagctgcccgaaacactggagacgctcctgctgctgaccctgctggccgcggtgaccggcggaatcttcctcttcctgatgtccggtaagggtatagggaagatgacactgggcatgtgctgcataatcaccgccagcatcctcctctggtacgctcagatccaaccgcactggatcgccgcctccattatcttggagttctttctcatcgtgttgctgataccagaacccgagaagcagagaacgccccaggacaaccagctcacctacgtcgtgatcgcgatcctgaccgtggtcgccgccacaatggccaacgagatggggtttctggaaaagacgaagaaggacctcggtttcggtagcatcaccacccaagagagcgagtcgaacatcctggacatcgacctgcggccggccagcgcgtggaccctctacgcagtggctacgaccttcgttacccccatgctgcggcacagtatcgaaaacagctcagtcaacgtgagcctgaccgccatcgcgaaccaggccaccgtgctcatggggctgggaaaggggtggcccctgtccaagatggacatcggcgtccccctcctggcgatcggctgctacagccaggtgaacccgatcaccctgacggccgcgctcctgctgctggtagctcattacgccataatcggccccggcctacaagccaaggcgacgcgcgaggcccagaaacgggccgccgccgggatcatgaaaaatcccacggtcgacggcatcaccgtgatcgatctggagcccatcccgtacgaccccaagttcgaaaagcaactcgggcaggtcatgctgctgatcctctgcgtcacgcaggtgctaatgatgcgcaccacatgggccctgtgcgaggccctcaccctggcgaccggccccatctccaccctgtgggaggggaatcccgggcggttttggaacacgaccatcgctgtgagcatggccaacatcttcagaggctcctacctcgccggggctggtctgcttttctccattatgaagaacaccaccaacacgcgccgggggacaggcaacgtcggcgagaccctgggggagaagtggaagtcccgcctgaacgctctgggcaagagcgagttccagatctacaagaagtccgggatccaggaggtggaccggaccctcgccaaggagggtatcaagcgcggggagacggaccaccacgccgtgagccggggctccgccaagctgcgctggttcgtcgagcggaacatggtgaccccagaggggaaggttgtcgacctggggtgtggccgcgggggctggagctactactgcgggggcctcaagaacgtgcgtgaagtgaagggcctgaccaagggcggccccggccacgaggagcccatccccatgtccacctacggctggaacctggtccgcctccagtctggcgtagacgtgttcttcacgccgcccgagaagtgcgacaccctgctgtgcgacatcggcgagagctcccccaaccccaccatcgaggcgggccggaccctccgcgtcctgaacctggtggagaactggctaaacaacaacacccagttctgcataaaggtgctgaatccgtacatgccctcggtcatcgagaagatggagacgctgcagcggaaatacgggggcgccctcgtgcgcaaccccctgagccggaacagcacccatgagatgtattgggtgtccaacgccaccggaaacatcgtcagctcggtgaacatgatcagccgcatgctgatcaaccggttcaccatgaagcacaagaaggccacgtacgagccggacgtggacctgggctccgggacccgcaacatcggcatcgaaagcgagattcccaacctcgacatcatcggcaagcggatcgagaagattaagcaggagcacgagacctcgtggcattacgaccaggaccacccctacaagacgtgggcctaccacgggagctatgagactaagcagaccggctccgcgagctccatggtaaacggtgtggtgcgcttgcttaccaagccctgggacgtcatccctatggtgacccagatggccatgacggataccacccctttcggccagcagcgcgtgttcaaggagaaggtcgacactcggacgcaagagcccaaggagggcaccaagaaactcatgaagattaccgccgagtggctgtggaaggagctggggaaggagaagacgccccggatgtgcacgcgggaggagttcacccgcaaggtgcggagcaacgccgccttgggcgcggtgttcaccgacgagaacaagtggaagtccgcccgcgaggccgtcgaggatgggcggttctgggagctggtggatcgcgaacggaaccttcacctcgagggcaagtgcgagacctgcgtgtacaacatgatgggaaagcgcgagaagaagctgggggagttcggcaaggccaagggtagccgggcgatctggtacatgtggctgggcgcccgcttcctcgaattcgaggccttagggttcctgaacgaggaccactggttctcccggggaaactctctgagcggggtcgagggcgagggcctgcaccgcttagggtacattctccgggaggtaggcaagaaggaggggggcgccatgtacgccgacgacacggcggggtgggacacccgcatcaccctcgaggatctgaagaacgaggagatggtcaccaaccacatgaagggggagcacaagaagctcgccgaggcaatcttcaaactgacttaccagaacaaggtggtgcgcgttcagcgtccgacgcccaggggcaccgtgatggacatcatctccaggaaggaccagcgggggtcaggccaggtggggacctacggcctgaacacgttcaccaacatggaggcccagctcatcaggcagatggagggcgaggggatcttcaagtccattcagcacctgaccgccacagaggagatcgcggtccaaaactggttggcgcgcgtgggccgggagcgcctcagcaggatggccatctccggggacgattgcgtggtcaagcccatcgacgaccgctttgccagcgccctgacggctctgaacgacatgggcaaggttcggaaggacatccagcagtgggagccctcccgcggatggaacgactggacccaggtgccgttttgcagccaccatttccacgagcttgtcatgaaggacggccgagtgttagtggtcccctgtcgcaaccaagacgagctgatcggccgggcccgcatctcccagggggcgggctggtcgttgaaggagaccgcctgcctggggaagtcatacgcccagatgtggaccctgatgtactttcaccggcgcgacctccggctggctgctaacgccatctgctctgccgtgccctcacactgggtgcccaccagccgaacgacatggtcgatccacgcgaagcacgagtggatgaccacagaggatatgctggccgtctggaaccgggtgtggatccaggagaacccgtggatggaggacaagacgcccgtggagagctgggaggaggttccctacctcggcaagcgcgaagaccagtggtgcgggtccctgatcggcctgaccagcagagccacctgggccaagaatatccagaccgctatcaaccaggtgcgctcgctcatcggtaacgaggggtacatcgattacatgccctccatgaagcggtttcgccgcgaggaggaggaggcgggcgttctgtggtga

SEQ ID NO: 24813 - RNA, 9876 nt, synthetic construct
  misc_feature 1..9876: note = derived and/or modified CDS sequence (opt11) from DENV-2__JX669480__SS-prME
  source 1..9876: mol_type = other RNA
actgccggcgtgatcatcatgctgatccccaccgccatggccttccacctcactacccgaaatggggaaccccacatgatcgtgggccggcaagaaaagggaaagtccctgctgttcaagaccgaagatggcgtgaacatgtgcactctcatggccatcgacctgggtgaattatgcgaggacaccatcacctacaagtgccccctcctgaggcagaacgagcccgaggatatcgactgctggtgcaactctacgagcacctgggtgacctacggtacttgcactaccacgggcgagcatcggcgcgagaagcgctccgttgcgctggtgccccacgtggggatgggcctcgagactcgcaccgagacctggatgagctccgagggggcctggaagcacgtccagcggatagagacgtggatcctccgtcatccgggcttcgccattatggctgctatcctggcctacacgatcgggaccacccattttcagcgggcactcatcttcatcctgctgaccgcggtcgccccctcaatgaccatgaggtgcatcggcatctccaaccgggacttcgttgaaggcgtcagcggcggcagttgggtggatatcgtgctcgagcacgggtcatgtgtcacgactatggccaagaacaagcccacgctggatttcgagctgataaagaccgaggccaagcagccggccacgctacgcaagtactgcattgaggcgaagctaactaacacgaccaccgagtccaggtgcccgactcagggagaacccagcctgaacgaggagcaggacaagcgtttcatctgcaagcacagcatggtggaccgtggctgggggaacggctgcggcctctttggcaaaggcgggatcgttacgtgcgccatgtttacgtgcaagaagaacatggaggggaaggtcgtgttacccgagaacttggagtacaccattgtgatcacgccccatagcggggaggagcacgccgtcggcaatgacaccgggaagcacggcgaggagatcaagatcaccccgcagtccagcatcaccgaggccgagctcaccgggtatgggaccgtgacgatggagtgcagcccccggaccggcctggatttcaacgagatggtgctgttacagatggaggagaaggcctggctggtccaccggcagtggttccttgatttgccccttccctggctgccgggggccgacacacagggctcgaactggattcagaaggagaccctcgtgactttcaagaaccctcatgccaagaagcaggacgttgtcgtgctcgggtcacaagagggggctatgcacaccgcgctcaccggggccaccgagatacagatgagcagcggtaacctcctcttcacagggcacctgaagtgccgcctccggatggataagctgcagttgaagggtatgtcctacagcatgtgtaccggaaagttcaaaatcgtaaaggagatcgcggagacccaacacgggaccatcgtgatccgcgtgcagtatgaaggtgacggcagcccctgtaagatccccttcgagattatggacctcgaaaagcggcacgtcctggggcgcctgatcacggtgaacccgatagttaccgagaaggacagccccgtcaacatcgaggccgagccgcccttcggcgactcctacatcataattggggtggagccggggcagctcaaactgaactggttcaagaaggggagctccatcggccaaatgttcgaaaccaccatgcggggcgcaaagcggatggcaatcctgggggatactgcgtgggatttcggcagcctcgggggcgtgttcacctccatcgggaaggcgctccaccaggtcttcggcgccatctacggggccgcctttagcggagtgtcttggaccatgaagattttaatcggcgttataatcacctggatcgggatgaactctcgctccacaagtctgtccgtctcgcttgtgctggttggcgtcgtgacgttgtacttaggggcgatggtgcaggctgactcggggtgtgtcgtgtcgtggaagaacaaggagctgaaatgcggctccgggatcttcatcactgacaacgtgcacacctggaccgagcagtataagttccagccggagagccctagtaaactggcctccgccattcaaaaggcccacgaggaaggcatctgcgggatccggagtgtcacgcggctcgaaaacctgatgtggaagcagataacccccgagctgaaccacatcctctccgaaaacgaggtaaaactcaccatcatgacgggggacatcaaagggatcatgcaggccggcaagcgtagcctgcgaccgcagcccaccgagttaaagtattcctggaagacctggggcaaggccaagatgctgagtacggagtcccacaaccagacgtttctgatcgacgggcccgagaccgccgagtgcccgaacacaaatcgggcttggaactcgctcgaggtggaggattatggcttcggtgtcttcactacgaacatttggttaaagctgcgtgagaagcaggacgtcttctgcgactccaagctcatgtcggccgcaatcaaggacaaccgggccgtccacgcagatatgggctactggattgaaagtgccctgaacgacacctggaaaatggagaaggcctctttcatcgaggtcaaatcttgccactggccaaagagccacacactgtggtccaatggagtacttgagagcgagatgatcatccccaagaatttcgcgggccccgtgtcgcagcataactaccgcccaggctaccatacccagaccgccggtccctggcatcttggcaagctggagatggacttcgatttctgcgaggggacgacagtcgtggtgacagaggactgcggcaaccggggccccagcctgcgcacgacgaccgccagcgggaagctcatcaccgaatggtgctgcaggagttgcactctgcctccgctccgctaccgaggcgaagacgggtgctggtacggaatggagatccgccccctgaaggaaaaggaggagaatctggtcaacagcctcgtgacagctgggcacggacagatcgacaacttctccctaggagttctggggatggccctcttcctggaggagatgctgcggacccgagtcggtaccaagcacgccatcctcctggttgccgtcagctttgtaaccctgataacaggtaacatgtcattcagagacctcggccgcgtaatggtgatggtaggggtgaccatgaccgacgacattggcatgggcgtgacctacctggccctgctagccgcattcaaggtacgcccaaccttcgccgccgggctgctgctccggaagctgacctcaaaggagctgatgatggccacgatcggcataaccctcctgtcacagagcaccatccccgagaccatccttgaactcaccgacgccctggcgcttggcatgatggtgctcaagatcgtacgcaatatggagaaatatcagctggccgttaccattatggccatatcctgcgtccccaacgccgtcatcctgctcaacgcctggaaggtcagctgcacgatcctggcggcggtgtccgtcagcccactgctcctgacctccagtcagcaaaagaccgattggatccctctggccctcaccatcaagggactgaaccccacggccatcttcctgaccacgctctcccggacctccaagaagcgctcctggcccctgaacgaagcggtaatggcagtgggcatggtctctattctggcctcctctctcctgaagaacgacatccccatgacggggcccctggtggccggtgggctcctgaccgtttgttacgtgctgaccggccggagcgctgatctcgagctggagcgcgcggccgacgtgaagtgggaggaccaggccgagatctccggtagctcccccatcctgagcatcaccatctcagaggacggcagcatgtccatcaagaacgaggaagaggaacagacgttaaccattttgataaggaccggcctgctcgtgatcagcggggtcttcccggtgtccattcccatcactgctgccgcatggtacctgtgggaagtgaaaaagcaacgcgctggagtcctgtgggacgtgcccagcccgcctcccgtgggtaaggcggagctcgaagacggcgcctacagaatcaagcagcgcgggatcctgggctattcccagatcggcgccggagtatataaggaaggcaccttccacacgatgtggcatgtgacccgcggggcggtgttaatgcatagaggaaagcggatcgagccctcatgggccgacgtaaagaaggacctcatctcctacgggggcggctggaagctggaaggagagtggaaggagggcgaggaggtccaagttctcgccttggaacctgggaagaatccccgcgccgtccagacaaagcccggcctgttcaagaccaacacgggcaccataggtgccgtcagcctggacttttcccccggcacctctgggagtcccattgtggaccggaagggcaaggtcgtggggctctacggcaatggcgtggtcaccaggtcgggggcgtacgtgtcagctatcgcccaaacagagaagtctatcgaggacaaccccgagattgaggatgacatatttcgaaagaagcgcctgaccatcatggatctgcaccccggcgccggaaagactaagcggtacctgcccgctatcgtgcgcgaagctatcaagcgaggcctccgcaccctgatattggctccgacgcgcgtcgtggccgccgaaatggaggaggcgctgagggggctgcccatccgctaccagacgcccgcgattcgggccgagcacaccggccgcgagatcgttgacctgatgtgccacgctaccttcaccatgcggctcctgagccccgtccgcgttccaaactacaacctgatcatcatggacgaggctcactttaccgaccccgctagcatcgctgcccggggttatatcagcacgcgcgtggaaatgggtgaggccgccggcatcttcatgaccgctactccaccaggctcccgcgacccgttcccccagtctaacgctcccatcatggacgaggagcgggagatccccgagcggtcgtggaactcagggcacgagtgggtcaccgactttaaggggaagacagtatggtttgtcccgtccattaaggccgggaacgacatcgccgcgtgcctccgcaaaaacggcaagaaggtcatccagctgagccggaagaccttcgacagtgagtacgtgaaaacgcgtgcaaacgattgggacttcgtggtcaccacagacataagtgaaatgggggccaacttccgggccgagcgcgtgatcgacccgaggcgctgtatgaagcccgtcatcctgaccgacggcgaggaacgggtcatcctcgccgggccgatgccggtgacgcacagctcagcggcccagcgccgcggccgtgttgggcgcaatcccaaaaacgagaacgatcaatacatctacatgggcgagcctctggaaaacgacgaagactgcgctcactggaaggaagccaagatgctgctggacaacattaacacccccgaaggcatcatcccatccatgtttgagcccgaacgcgagaaggtcgacgccatcgacggggagtaccgcctgcggggtgaagcgcgcaaaaccttcgtggacctgatgcggagaggggacctacctgtgtggctggcgtatcgggtcgcagcagaggggataaactacgccgaccgccggtggtgcttcgacgggatcaagaacaatcagatcctggaagagaatgtggaagtcgagatctggactaaggaaggcgaacgcaagaaactcaagcctcgatggctagacgcacgcatatatagcgacccgttggcactaaaggagttcaaggagtttgccgccggccgtaagtccctgacgctgaacctcatcactgagatgggacgccttcctaccttcatgacgcagaagacgagagacgcgctggacaacctcgccgtgctgcacaccgcagaggccggcgggcgagcttacaaccacgcgctgagcgagctccccgagactctggagacgctgctgctgctgacgttactggccaccgtaaccggcggcatcttcttattcctgatgtcggggaaaggcattgggaagatgacgctgggcatgtgctgtatcatcaccgccagcatactgctctggtatgcccagatccagccgcactggatcgccgcgtccatcatcctggagttcttcctgatcgtcctgctgatccccgagcccgagaaacagagaacgccgcaggacaaccagttgacctatgtggtgatcgccatcctcacagtcgtggccgccaccatggccaatgagatgggtttcttagagaagacgaagaaggacctgggactcggcagcatcaccacccaagaaagcgaatccaacatcctggacatcgacttgcgaccggcgtctgcctggaccctctatgctgtcgcaacgacgtttgtcacccccatgctacgtcattcgatcgagaatagctcggtcaacgtgagcctcacagcaatagcgaaccaggccacggtactcatggggctgggcaaggggtggccgctatctaagatggatatcggcgtgcctctcctggcaatcggctgctacagccaagttaacccgatcaccctgaccgccgcgctcctgcttcttgtagcccactacactatcatcggccccggtcttcaggccaaggcgacaagggaagcccagaagcgcgcggccgccgggatcatgaagaaccctaccgtggacggcatcaccgtgattgacctggagcccataccgtacgacccaaagttcgagaagcagcttggacaagtaatgctgctgatcttgtgtgtcacccaggtgctcatgatgcggacgacctgggccctgtgcgaagccctcaccctggcgaccggccccatctccacgctgtgggaggggaaccccggccgcttttggaatacaaccatcgctgtctcgatggctaacatcttccggggctcctacctagccggggccggcctgctattcagcatcatgaagaacacgacgaacacacgccggggcaccgggaacattggcgagaccctcggggaaaagtggaagtcccgcctgaacgcgttgggcaagtctgagttccagatttacaagaaatccgggatccaggaagtggaccggacactcgccaaggagggcatcaagagaggggaaacagaccaccatgccgtgagccgaggctccgctaagctgcgatggtttgtggagcggaacatggtcaccccggaggggaaggtggtcgacctagggtgtggccgcgggggctggagctattactgcgggggcctaaagaatgttcgcgaggtgaagggcttaaccaagggcgggccgggccacgaggagcccatcccaatgagtacttacgggtggaatctggtccgcctccaaagcggggtggacgtcttctttacaccacccgagaagtgcgacaccctgctgtgcgacatcggcgagagctcccccaaccccacaatcgaggcgggccggaccctccgcgttctaaacctggtggagaattggctaaacaacaacacgcagttctgcataaaggtgctgaacccgtatatgccttccgtcatcgagaagatggagactctgcagcggaagtacgggggcgccctcgtgcgcaacccgctctctcgtaatagcacacacgagatgtactgggtctccaacgcaaccggtaacatcgtaagttccgtaaacatgatcagccgcatgctgataaatcgattcactatgaagcacaagaaggccacctacgagccggacgtagacctgggcagcggaacccggaacatcggcattgagagcgagatccccaatctcgatataatcggcaagcggattgagaagatcaagcaggaacacgagacctcctggcactacgaccaagaccatccctacaagacgtgggcgtaccacgggtcctacgagactaagcagacgggatccgcgagttccatggtcaacggggtggtgcggctgctaaccaagccctgggatgttgtgcctatggtaacacagatggcaatgaccgacaccacccccttcggccaacagcgtgtctttaaggaaaaggtggacacacgaacccaggaacccaaggaaggtacaaagaagctgatgagaatcactgccgagtggttgtggaaggagctggggaagaaaaagacgccccgcatgtgcacccgcgaggagttcaccagaaaggtgcgcagcaacgccgcccttggcgcgattttcacggacgagaacaagtggaagtccgctcgggaagccgttgaagacagtcgcttctgggagctagtggaccgggagcgcaacttacacctcgagggaaagtgcgagacgtgcgtctacaacatgatgggcaagcgggagaaaaagctgggcgagttcggcaaggccaagggcagtcgcgctatctggtacatgtggctcggggcacggttcctcgagttcgaagccctgggctttctgaacgaggaccactggtttagccgcggcaacagcctatcaggtgtggagggggaggggctgcaccggctaggctacatcttgcgcgacgtgtctaagaaggagggcggagccatgtacgccgacgacaccgctggttgggatacccggataacgctggaggatttaaagaacgaggagatggtgacgaaccacatgaagggcgagcacaagaagctggccgaggcaatcttcaaacttacctatcagaataaggtggtgcgcgtccagcgccctactccacgggggaccgtgatggacatcatcagtaggcgcgaccagcgcggtagcggccaagtgggcacttacggcctgaacaccttcaccaacatggaggcccagctcattcggcagatggagggggagggcattttcaaatccatccagcatctgaccgtcacggaggagattgccgtgcagaactggctggcgcgcgtgggccgagagcgcttgagccggatggctatctccggggacgactgcgtagtgaaacccttggacgaccgcttcgcgagcgccctgaccgccttaaacgacatggggaaggtgcggaaggacatccagcagtgggaacccagccgcgggtggaacgactggactcaggtaccgttttgcagtcaccacttccatgagcttgttatgaaggacggccgagtactcgtcgtgccctgccgcaaccaggatgagcttataggccgggcgaggatcagccagggcgccggctggtcactcaaagagaccgcctgtctggggaaaagctacgcccagatgtggaccctcatgtacttccaccggcgcgacctgcggctggctgcgaacgccatatgctctgccgttccgtcccactgggtccccacgtcaaggaccacatggtccatccacgccaagcatgagtggatgaccacggaggatatgctcgccgtgtggaaccgcgtgtggatccaggaaaatccctggatggaggacaaaacccccgtcgagagctgggaagaggttccctacctgggcaagcgtgaggaccagtggtgcgggagcttaatcggcctgacctctcgagcgacctgggccaagaatatccagacggccatcaatcaggtgcggtctttgatcgggaacgaagagtataccgactacatgcccagcatgaagcgtttccggcgagaagaggaggaggccggcgtcctgtggtga

SEQ ID NO: 24814 - RNA, 9876 nt, synthetic construct
  misc_feature 1..9876: note = derived and/or modified CDS sequence (opt11) from DENV-2__JX669483__SS-prME
  source 1..9876: mol_type = other RNA
acagcgggcgtgattatcatgttaatcccgaccgccatggcatttcatttgactacccgcaacggcgagccccatatgatagtgggtaggcaggagaagggaaagtccctccttttcaagaccgaagatggcgtgaacatgtgcacgctcatggccatcgacctaggggaactttgtgaagacaccatcacctacaaatgccccttactgcggcaaaatgagcccgaggacattgactgttggtgcaactcaacttccacttgggtcacctatgggacctgtacgaccacgggcgagcacaggagagagaagcggtcggtagcgctggtgccacatgtggggatgggcctcgagacccgcaccgaaacctggatgagcagtgagggggcctggaaacacgtccaacgcatcgagacgtggatattgcgccaccctggtttcgccataatggcagccatcttggcgtacaccatcgggacaacccacttccaacgggcacttatcttcatcctgttaacggcagtggcccccagcatgacaatgcggtgcatcggcatctccaaccgggacttcgtggagggtgtcagcggggggtcgtgggtggacatcgttctcgagcacgggtcgtgcgtcaccaccatggccaaaaataagccaacgctggacttcgagttgataaaaaccgaggcaaaacaacccgccaccctcagaaaatactgcatcgaggcgaagctgaccaacactaccaccgagtcccgttgtcctacgcagggagagcccagcctcaatgaagaacaggacaaacgcttcatctgcaagcactcgatggtagacagaggatggggcaacggctgcggcttgttcggcaagggggggatcgttacctgtgccatgttcacttgcaagaagaacatggaggggaaggtcgtgctgcccgaaaacttagaatacaccatcgtgattacgccgcacagcggtgaggaacacgccgtcggcaacgacacaggaaagcacggtgaggagatcaaaatcaccccccagtcctcaattacagaggccgagctcaccgggtatggcaccgtgaccatggagtgctccccccgcaccggactggattttaacgagatggtgctgctacagatggaggagaaggcttggctagtgcatagacagtggttccttgacctccccttgccttggctcccaggggcggatacccaaggcagcaactggattcagaaggagacactcgtcactttcaagaacccccacgccaagaagcaggacgtggtggtactggggagccaagagggtgcgatgcacaccgccctgaccggggcgactgagatccagatgagctcgggtaacctcctattcacgggccacctaaaatgccggctccggatggataagctccaactgaagggaatgtcctattctatgtgcaccggcaagttcaaaattgtcaaggaaatcgcggaaacacagcatggaacgatcgttatcaaagtgcagtacgaaggtgacggatctccttgtaagatccccttcgagatcatggacctcgagaagaggcacgttctgggtcgactgatcacggtgaatccaatcgttacggagaaggacagccccgtcaatattgaagctgagccacccttcggcgattcctacatcataatcggggtggagcctggccagctcaagcttaactggttcaaaaaagggagtagcatcggccagatgttcgagacgaccatgaggggagcgaagaggatggccatcctgggggacactgcctgggattttggcagtttggggggggtgttcacctccattgggaaggcgctgcatcaggtctttggcgctatctacggcgccgcgttctcgggggtctcctggacgatgaagatcttaataggagtgataataacatggatcggcatgaactcccggtccacgtcgttatccgtcagcctcgtgttagtaggcgtggtgaccctgtacctcggggcgatggtgcaagcagactccggatgcgtcgttagctggaaaaataaagagctgaagtgtgggtccgggatattcattaccgacaacgtccacacatggaccgaacagtacaaatttcagcccgagtcaccttcgaagctggcctccgctatccagaaggcacacgaggaaggtatatgtggcatccgcagcgtcacccgtctagagaacctgatgtggaagcagatcacccctgaattgaatcacatcctcagcgagaacgaggtgaaactcacgataatgacgggcgacataaagggaattatgcaggcggggaaacgctcactgcgaccgcagcccaccgaactgaagtactcctggaagacctggggcaaggccaagatgctgagcaccgagagccacaaccagacctttctgatcgacggacccgagacggccgagtgtccgaatacgaaccgcgcctggaacagcctcgaggtggaagactacggattcggggtcttcaccacgaacatctggttgaaactgcgggaaaagcaggacgtgttctgtgattcaaagctcatgagcgccgcgattaaggacaaccgagccgtacacgccgatatgggctactggatcgagagtgccctcaatgacacgtggaaaatggagaaggctagcttcatcgaagtaaagtcctgccactggcccaagagccatactctctggtccaacggcgtgctcgagtcagaaatgatcataccgaagaactttgcggggcccgtgtcacagcacaactatcgaccgggctaccacacccaaaccgccgggccctggcacctgggcaagctcgagatggatttcgacttctgtgagggcaccaccgtggtggtaacggaggattgcggcaatcgcggcccctcgctccggaccacgacggccagcgggaagctgataaccgaatggtgctgcaggtcctgcaccctgcccccgctcaggtaccgaggcgaggacgggtgctggtacggtatggagatccggccactgaaggagaaggaggaaaacctggtcaactcacttgtaacggccgggcacggtcaaatcgacaacttctcgctgggcgtgctggggatggcactttttctggaggagatgttaagaactcgggtcggaacgaagcacgccatccttctggtagcggtctcattcgtcaccctgatcacaggcaacatgtcttttcgcgatctcggccgtgtgatggtaatggtcggtgtcacaatgaccgacgacataggcatgggcgtgacctacctggcccttctcgccgcgtttaaggtgcgaccgacttttgcggccgggctcctgctccgtaagctaacgtcaaaggaactgatgatggcaaccatcggcataactttactttcccaatccacgatacccgagacaatcctggagctcactgacgccctggcattagggatgatggttctcaagatcgtgcgtaacatggagaagtatcagcttgccgtcacgatcatggccatcagttgcgtcccgaacgccgtgattctgttaaacgcatggaaggtgagctgtacgattctcgcggccgtttccgttagcccactgctgttaacatccagccagcagaagacagactggatcccccttgcgctcaccatcaagggacttaaccctacggccatatttctgaccactctctccagaacgtccaagaaacggtcctggccgctgaatgaggcggtgatggctgtgggaatggtatccattttagcatcctcgctcctgaaaaacgatattccaatgacggggcccctggtggcaggcgggcttctaaccgtttgctatgttctgaccggcaggagcgcggatctcgaactggagcgggcggctgacgtgaagtgggaggaccaggccgaaatctccggaagcagcccgatcctgtcaatcacaatctccgaagatggcagcatgtccatcaaaaacgaggaggaggagcagacgctcaccatcctgatccggaccggactgttagtgattagtggggtctttcctgttagcataccaatcaccgccgctgcatggtacctttgggaggtgaagaagcagcgcgccggcgtactgtgggacgtgccaagccctccccctgtggggaaggcggaactagaagacggggcctaccgaatcaaacagagggggatcctgggctactcgcagatcggcgccggcgtctacaaagagggcaccttccacacaatgtggcatgtaaccaggggggcggtgctcatgcaccggggaaaacgcatcgagccaagctgggctgatgtcaagaaagatctcatttcttacgggggtggctggaagctggaaggggagtggaaagagggcgaagaggtccaagtgctggctcttgagccaggcaaaaacccccgggctgtccagaccaaaccgggtctcttcaagacaaacacgggcaccatcggcgctgtgagccttgacttctcccctgggaccagcggaagtccaatagtggatcgcaaaggcaaagtggttggcctttacggtaacggcgtggtcaccaggagcggtgcgtacgtgagcgcaatcgcccagacggaaaagtccatcgaagacaaccccgagatcgaggatgacatcttccgtaagaagcggcttaccataatggacctacacccgggcgccggcaaaactaagagatacctgccggcaattgtgcgcgaggccattaagaggggcttgcggacactgatcttggctccgacgagggtcgtagcggccgagatggaggaggcgttacgcgggcttccgatccggtatcagactccagccatccgtgccgagcatacagggagggagattgtagatctaatgtgccacgccacctttaccatgcgccttctcagccctgtccgagtgcccaattacaatttaataatcatggacgaagctcatttcactgatcctgcaagcattgcagcccgcggctacatcagcaccagagttgaaatgggggaggctgccggcatcttcatgacggcgacgccgccggggtcccgcgatcctttccctcagtctaatgcaccaattatggacgaggagcgggagatcccagagcgctcctggaacagcggccacgagtgggtgaccgacttcaaggggaagaccgtgtggtttgtgccgtccattaaggctgggaacgatatagccgcatgcctcaggaagaacgggaaaaaggtaatccagctcagcagaaagacattcgattccgaatacgtgaaaacgagagcgaatgactgggacttcgtcgtgaccacggacataagcgaaatgggtgcaaactttcgcgccgagcgcgtgatcgacccccgcaggtgcatgaagcctgtgatcttgaccgacggcgaggagcgcgtcatcctcgcaggtcccatgccggtgacgcacagtagcgcggcgcagcggcgcgggcgggtggggcggaacccgaagaacgagaacgatcagtatatatatatgggggagcccctggagaacgacgaagattgtgcacattggaaggaggccaaaatgcttctcgacaacataaacacgccggagggtatcatcccttccatgttcgagccggaacgcgagaaagtcgacgcaatcgatggggagtatcggctgcgcggcgaggcccgcaagacctttgtggacctgatgcgcaggggtgacctccccgtctggctggcctatcgggtcgcagccgagggcattaattacgcggaccgccgctggtgcttcgatgggatcaaaaacaaccaaatcctggaggagaatgtagaggtagaaatctggaccaaggagggcgagcgaaagaaactcaagccgaggtggctggacgcgcgtatctacagcgatccgctagccctgaaggagttcaaggagtttgccgccggtcgcaagtctcttactctgaatttaatcacagaaatgggtcggctgcccaccttcatgacccagaagacacgggacgcactggacaacttagcggtattgcacaccgcagaggcgggcgggcgggcctacaatcacgctctaagcgaacttccggagacattagagacactgttactcctgacactgcttgcgacggttaccggaggcatttttcttttcttgatgtcggggaaagggatcgggaagatgacccttggaatgtgttgcatcatcactgccagcatactcctgtggtacgcgcagatacagccgcactggatcgccgcatccatcatccttgagtttttcctcatcgtcctcctgatccctgagccagaaaagcagcgcaccccccaggataaccagctgacatacgtggtgattgccattctcaccgtcgtggcagccaccatggccaacgagatgggttttctggagaagacgaagaaagatctcggcctcggcagcattactacccaagagtcggagtcaaatattctcgacatcgaccttcggccggcgtctgcctggaccctctacgcagtggcaacgaccttcgtcacccctatgctccgccattccatcgagaacagcagtgtgaacgtatccctaaccgccatagccaatcaggcgacggtcctcatggggctgggtaaggggtggcccttgagcaagatggacatcggcgtgcccctactagccatcggatgctacagccaggtgaacccgatcaccctcacagctgcgttactgctcctcgtagcacactatactatcatcggccccggattgcaggccaaagcgacgcgggaggcccagaagcgcgctgccgcgggcattatgaagaaccccaccgtggacggcatcacggtcatcgacctcgaacccatcccgtatgacccaaagtttgagaagcagctagggcaggtcatgctgttaatcctctgcgtgacacaggtactcatgatgcgcactacctgggccctgtgcgaggcactcaccctggccaccggcccaatcagcaccttatgggaagggaacccaggcaggttctggaataccaccatcgcagtcagcatggccaatatattcaggggctcctacctcgccggtgccggtcttctgttcagcataatgaaaaataccacgaacacccgccgagggactgggaacatcggagagaccttgggagagaaatggaagagtcggctaaacgcactgggtaagtccgaattccagatatataagaagtccgggatacaagaggtggacaggacgttggctaaggagggcatcaaacgcggcgagaccgatcaccacgccgtgagccgtggatccgccaagctgcggtggtttgtagaacgcaatatggtgacgcccgagggcaaagtggtcgacctagggtgtggccgcggtgggtggtcatattactgcggcggcctaaaaaatgtacgcgaggtaaaagggctgaccaaaggcggccctgggcacgaggagcccatccccatgagcacgtatggctggaaccttgtccggttgcagagcggtgtggatgtgttcttcactcctccggagaaatgcgacaccctgctttgcgacatcggggaatcgtcccccaatcccaccatagaggcgggcaggaccctcagggtcctgaatctcgtggagaactggttgaacaacaacactcaattttgcattaaagtgctgaacccgtatatgcccagcgtcattgagaagatggagacgctccagcggaaatacgggggggccctcgtgcggaatcctttatcccgcaatagtacccacgaaatgtactgggtctccaacgcaaccgggaacattgtcagcagcgtgaacatgatttcacggatgcttatcaatcgtttcactatgaagcataaaaaagccacctatgaaccggacgttgatttgggctccgggaccagaaacatcggcatcgagagcgagatccccaacctcgatatcatcggaaagcggatcgagaagatcaagcaggagcacgagacctcctggcactacgatcaagaccatccctacaagacttgggcataccacgggagctatgagactaagcagaccgggtccgcgagctccatggtcaacggggtggtgcgcttgttaaccaagccgtgggatgtcgtgccgatggttacgcaaatggccatgacggatacaacccccttcgggcagcagcgggtcttcaaagagaaagtcgatactcggacccaagagcccaaggagggcacaaagaaactcatgcggatcactgccgaatggctgtggaaagaactgggaaagaagaagacgccccgcatgtgtacccgggaggagtttaccagaaaggtgcggagcaacgcggccctcggcgcgatcttcaccgacgagaataagtggaagagtgcccgcgaggcagtcgaggactctcgtttctgggaactggtggatcgtgaacggaatctgcatctcgaggggaaatgcgaaacctgcgtctacaacatgatgggcaaaagagagaagaagctgggggagttcgggaaggcgaaggggtcccgggcaatctggtacatgtggctgggggcgcgctacctcgagttcgaagccctgggattccttaatgaagaccactggttcagccgaggcaatagtctgtcgggcgtagagggggagggcctgcaccgcctgggctacatactgcgtgacgtgagcaagaaggaaggcggcgccatgtacgcggacgacaccgctgggtgggacaccagaatcactctggaggacctgaagaatgaggagatggttacgaaccacatgaaaggcgagcacaagaagctcgctgaagcgattttcaaactgacttatcaaaacaaggtagtgcgggtccaacgcccaacaccccggggtaccgtaatggatatcatctcccgtcgcgaccagaggggctctggccaggtggggacatacggtctgaataccttcaccaatatggaagcacagctcatccgccagatggagggagagggtatcttcaagtcgatccagcatctgaccgtcactgaggagatcgctgtgcagaactggctagctcgggtgggccgcgagcggctctctaggatggccatctccggagacgactgtgtggtaaagcccttagacgaccggtttgcctcagctctcaccgctctcaatgacatggggaaggttcgcaaggacattcagcagtgggagcccagccgggggtggaacgactggactcaagttccattttgcagccaccatttccacgagctggttatgaaggacggccgcgtgctagtcgtgccctgccgtaaccaggacgagctcatagggcgcgcgcggatttcccagggcgcgggttggagcttaaaggaaactgcatgcctcgggaagtcctacgcgcagatgtggacccttatgtactttcaccgccgggatctgcgcttggccgcgaacgcaatctgcagcgccgtgccctcccactgggtccccacatcgcgcaccacctggtccatccatgccaagcacgaatggatgacaacggaggatatgctcgccgtctggaaccgcgtatggatccaggagaacccgtggatggaggacaagacccccgtcgagagctgggaggaggtgccctatctcggaaagcgggaagaccagtggtgcgggagcttaatcggcctcacctcccgggctacttgggccaaaaacatccagacggccatcaaccaagtccgcagcctgatcgggaacgaagagtacacggattacatgccctccatgaagcggttccgacgggaagaagaggaggctggcgttttgtggtaa

SEQ ID NO: 24815 - RNA, 9876 nt, synthetic construct
  misc_feature 1..9876: note = derived and/or modified CDS sequence (opt11) from DENV-2__JX669484__SS-prME
  source 1..9876: mol_type = other RNA
accgctggggtaatcataatgctgatccccaccgccatggctttccatcttaccacgcgcaatggggaaccccacatgattgtgggccggcaagagaaagggaagtctctgctgttcaaaaccgaggacggagtgaacatgtgcacactaatggccatcgacctgggtgagctctgcgaggacacgataacctataaatgccccctcttgcgccagaacgagcccgaggacatcgactgttggtgcaatagcacatccacctgggtcacctacgggacctgcaccacaactggcgagcaccggcgcgagaagcgaagcgtagctctggtgccacacgtaggtatgggcctcgagacgcgcactgaaacatggatgtcatccgagggagcctggaagcacgtccagaggatcgagacctggatcttgcgtcacccggggttcgccattatggcggccatcctggcctacacgatcgggaccacacacttccagcgggccctcatcttcattctgctaactgccgtcgcccccagcatgaccatgcgctgcatcggcatctccaaccgggactttgtggaaggcgtctccgggggctcctgggtggacatcgtgctcgagcacggaagctgcgtgaccaccatggccaagaacaagccgacacttgatttcgaactgatcaagaccgaggccaagcagcccgccacactccgcaagtactgcatcgaggcgaagctgacgaacactactaccgagtcccggtgcccgactcagggggagccctctttgaacgaggagcaggataaacgatttatctgtaagcactcgatggtggacaggggttgggggaacgggtgcggcctcttcggtaaaggcggcatcgtgacctgtgccatgttcacgtgtaagaagaacatggagggaaaggtggttctgcccgagaatctggagtacaccatcgttatcacgccgcacagcggcgaggagcacgccgtcggcaacgacactgggaagcacggaaaggagatcaaaatcaccccgcaatctagcatcacggaggccgagcttaccgggtacgggaccgttacgatggagtgtagcccgcgcaccggcctggacttcaacgagatggtgctgctacagatggaagagaaggcatggctagtccaccggcagtggttcctggacctcccgcttccctggctaccgggggcggacactcagggcagcaattggatccagaaggagaccttagtgacgttcaagaacccccacgccaagaagcaggatgtggtcgtcctagggtcccaagaaggcgcgatgcacaccgccctgaccggggccactgagatacagatgagtagcggcaacttgctgttcacgggccacctcaagtgtcgactccggatggacaagctgcaactgaagggcatgtcctatagcatgtgcacaggcaagttcaaaatcgtcaaggaaatcgcggaaacccagcacgggactatcgttatccgcgtgcaatacgagggcgacggctccccctgcaagataccgttcgagatcatggaccttgagaagcggcacgtcctggggcgcctgatcaccgttaaccctatcgtgaccgagaaggacagccccgtcaacatagaggccgaaccgccctttggcgactcctacatcattattggggtggagccgggccagctaaagctgaattggttcaagaaggggtcatccatcggccagatgttcgagacgacgatgcgcggtgccaaacggatggctatactgggggacactgcgtgggacttcggcagcttagggggggtattcacctccattgggaaagcgctgcaccaggtcttcggcgctatctacggcgctgccttcagcggggtgtcgtggaccatgaagatcctgatcggggtgatcatcacctggatcgggatgaactctcggtcgacgagcctctccgtttcgctcgtgctggtgggggtcgtgaccctgtacctcggggcgatggtgcaggccgactcgggctgcgtcgtaagctggaagaataaggagctaaagtgtgggtccggtatcttcatcaccgacaacgtgcatacctggacggagcagtacaaatttcaacccgaaagccccagcaagctcgcctccgctattcagaaggcccacgaggagggcatttgcgggattaggagtgtaactcgcctcgagaacctcatgtggaaacagataacccccgagctgaaccacatcctatccgagaacgaagtgaagctgaccatcatgacgggagatatcaaggggatcatgcaagcaggcaagcggagcctgaggccgcagccgactgagctcaaatactcatggaagacctgggggaaggctaagatgctgagcactgagtcccacaatcagacgttcctgattgacgggcccgagaccgccgaatgtccgaacactaaccgggcgtggaacagcctcgaggtggaggactacggttttggggtcttcaccacgaacatatggctaaagttgagggagaaacaggatgttttctgcgacagcaagctaatgagcgccgcgatcaaggacaaccgggcagtacacgcagacatgggatactggatagagagtgccctaaatggcacttggaagatggagaaggccagcttcattgaggtcaagtcctgccactggcccaagtcccataccctgtggtccaatggagtgctcgagtcagaaatgatcatccccaagaacttcgcgggcccagtgtcccagcataactaccgcccggggtatcatacccagaccgccggcccttggcacctaggcaaactggaaatggactttgatttttgcgagggaacgaccgtcgttgtgaccgaggactgtggaaaccgcggaccgtccctgagaacaactaccgcatccggcaagctgattaccgagtggtgttgccggtcttgtaccctgccccctctccgctaccgcggggaagacggctgctggtacgggatggagatcaggccactgaaggagaaggaggagaacctggttaactcattggtcacggccggccacggccagatcgacaacttttccctgggggtgctgggaatggcgctcttcctggaggagatgctacggactcgtgtcgggaccaagcacgccatcctcctggtggccgtgagcttcgttaccctgatcactggtaatatgtccttcaaggacctcggccgtgtgatggtgatggtcggcgtagccatgaccgacgacatcggcatgggggtaacctacctggccctgctcgctgcattcaaggtcaggccaaccttcgccgccggcctcctgttgcgcaagctgacaagcaaggagctgatgatggcaaccattgggatcacactcctatcccagagcaccatccccgaaacgatcctggagctcactgacgcgctggccctggggatgatggtgttgaaaatcgttcgaaacatggaaaagtaccagctggccgtcaccatcatgaccatctcctgcgtccctaacgccgttatcctgctaaacgcgtggaaggtcagctgcacgattctggcggccgtgtccgtctcccccctgcttttgacgtccagccagcaaaagactgactggatcccactggcgctcaccatcaagggcctgaatccgactgccatcttcctaacaaccctgtcccgcaccagcaagaaacggtcctggccgctgaatgaggcggtaatggctgtggggatggtaagtatcttggcctccagcctcttgaagaatgacatccctatgacggggcccctggtggccgggggacttttaaccgtgtgctacgttctgaccgggcgtagtgccgacctcgagctggaacgggcggccgatgtcaagtgggaggaccaggccgagataagcggcagttcaccaatcctgtcaatcaccataagtgaagacggctctatgtccatcaagaacgaggaggaggagcagacactcaccattctgatccgcaccgggctgctggtgatcagcggcgttttccctgtgagtataccaatcaccgccgccgcgtggtacctatgggaagtgaaaaagcagcgggccggggtcctatgggacgtgcccagcccgccacccgtcggcaaggccgagctcgaggatggggcatatcgcatcaaacagcggggaattctgggctattcccagatcggggccggcgtctacaaggaggggaccttccacacaatgtggcacgtaacgcgcggtgcggtgctgatgcaccgggggaaacgcatcgagcccagctgggcagacgtgaagaaggatctcattagttacggcggggggtggaaactggagggcgagtggaaggagggggaggaagttcaagtgctagccctcgagcccggcaagaacccccgggctgttcagaccaagcccggactgtttaagacaaacactggtacgatcggcgctgtgtctctggacttctcccccggtacgagcggctccccgatcgtggacagaaagggaaaagtggtaggcttatacggaaacggggtggtcacgcggtcaggtgcatacgtctccgcgatcgcccagactgaaaagtcgatcgaggacaaccccgagatcgaggatgacattttccgcaagaaacggcttaccataatggatctgcacccaggggccggcaagacaaaacgctacctgcccgcgatcgtgcgggaggccatcaaacgggggcttcgaaccctgatcctggccccgacgcgcgtcgtagccgctgagatggaggaagctctccgagggttgcccatccggtaccagacgcccgccatccgcgcagaacacaccggtcgggagatagtagacctgatgtgccacgcgaccttcacgatgcgcctactgagcccggtccgcgtaccgaactataatctgatcatcatggacgaggcccacttcacggaccccgcgtcaatcgctgcccgtgggtacatcagcacccgggtggagatgggtgaggccgccgggattttcatgaccgcgaccccgcccggctcccgcgacccgttccctcagtccaacgcccctatcatggacgaggagcgcgaaatccccgagaggtcctggaactccggacacgaatgggtcaccgacttcaagggcaagaccgtgtggttcgtgccgtccatcaaggccggcaacgacatagccgcgtgcctacgaaagaatgggaagaaggtcatccaattgagccgcaagaccttcgactctgaatacgtgaaaacgcgggctaacgattgggacttcgtggtcaccacggatataagcgagatgggcgctaacttccgcgccgagcgggtgatagacccccggcggtgcatgaagccagtgatcctgactgacggggaggagcgcgtcatccttgctggccctatgccggtgacgcattcctctgccgcgcagcggcgcgggcgcgtcgggcgaaaccccaagaacgagaatgaccagtacatctacatgggggagccgctggagaatgacgaggattgcgcacattggaaggaggccaagatgttgctcgacaacattaacacccccgaagggataattccaagtatgttcgagcctgagcgcgaaaaagtcgatgcgatcgatggagagtacaggttacggggtgaggcgcggaaaaccttcgtggacctgatgcggcggggcgacctcccggtgtggctggcctaccgcgtcgccgccgagggaatcaactacgccgacaggaggtggtgcttcgacggcattaagaataaccagatattggaggagaacgtggaggtcgaaatctggacaaaggaaggagagcggaagaagctgaagccgcggtggctggacgcgcggatctattcagaccccctcgccctcaaggagttcaaggaattcgccgccggacgcaagagcctgacactaaatctaataaccgagatgggtaggctgcccaccttcatgacccagaaagcgcgcgacgcgctcgacaacctcgccgttttacacactgccgaggccggaggccgcgcgtacaaccacgccctgagcgagctccccgagaccctggagaccctactcttgttaaccctcttggccaccgtcaccggcgggatcttcctgtttctaatgtccggcaagggtgtcggtaagatgaccctggggatgtgttgcataatcaccgccagcatcctgctctggtatgcccagatccagccacactggattgcggcctccatcatactggagttcttcctgatcgtgcttctgattcccgagcccgagaagcagcgcacgccccaggacaaccagctgacgtacgtggtaatcgcgatactcaccgtggtggccgcgaccatggcgaacgagatgggcttcctagaaaaaaccaagaaggacctgggccttggatctatcacgacccaggagtcggaatccaacatcttggacatcgacctgcggccggccagcgcctggaccctctacgccgtcgccaccacattcgtaaccccgatgctgcgccactcgatcgagaacagctccgtgaatgtcagcctgaccgcgatcgcgaatcaggccacggtactcatgggcctggggaagggctggcccctgtctaagatggacattggggtacccctcctggctatcggatgttatagccaggtcaacccaatcacgctgaccgcagccttactgcttctcgtagctcattacgccatcatcggccccgggctccaggccaaggcgactagagaagcacagaagcgcgccgccgccggaataatgaaaaacccgaccgtggacgggatcacggtcatcgacctcgagccaatcccatacgaccctaagtttgagaaacaactaggccaggttatgctgctgatcctctgcgtgacccaggtcctgatgatgaggaccacatgggccctgtgtgaagctcttactctggccaccggacccatctctaccctgtgggagggcaaccccggccggttctggaacacaacgatcgccgtcagcatggcaaacatcttccgcgggtcctacctagcgggcgctgggctgctgttcagcatcatgaagaacaccaccaatacccggcgcggcacgggcaacatcggggagaccctcggcgagaagtggaagtccagactcaacgccttaggcaagagcgagttccagatctacaagaaatccggcatccaggaggtggaccgcaccttagctaaggaggggattaaacggggcgagaccgaccaccacgcggtctcgagaggctccgccaagctgcggtggttcgtggagcgcaacatggtcacgccggagggaaaggtagttgaccttggctgcgggcggggcgggtggagctattactgcggcggcctaaagaacgtgagggaggtcaaagggctgaccaagggcggtcccggccacgaggagcccatccccatgtccacctacgggtggaacctggtccggctccaaagcggcgtggacgtcttcttcacccctcccgagaagtgcgatacgcttttatgcgacatcggagagagctcccccaaccccacgatcgaggccggaagaaccttgcgggtgctgaacctggtggagaactggctcaacaacaacacccagttctgcatcaaggtcctgaacccgtatatgcccagtgtgatagagaagatggagaccttgcaaaggaagtacggaggggccctggtgaggaacccactctccaggaacagcactcacgagatgtactgggtctctaacgccactgggaatatcgtaagctccgtgaacatgatctcgcgcatgttaatcaatcgcttcactatgaagcataagaaagcgacatatgagccagacgtcgacctggggtccggtacgaggaacattggaatcgagtcggagatacccaatctcgacataatcggtaagcgaatagaaaagatcaagcaagagcacgagacatcttggcattacgaccaggaccacccctacaagacctgggcctaccatggcagctatgagaccaagcagacggggtccgccagctcgatggtgaatggcgttgtccgcctgctaaccaagccatgggacgtggtgccgatggttacacagatggcaatgaccgacacgacgcccttcggccagcagagagtgttcaaggaaaaagtggacacgcgcacccaagagccaaaggagggcacaaagaagcttatgcgtatcaccgcagaatggctgtggaaggaactgggcaagaagaagacgccccgtatgtgcacccgggaggagtttacgcgcaaggttcggtccaacgcggccctcggggcgatcttcaccgacgagaacaagtggaaatccgccagagaggccgtagaggacagccggttctgggagctagtcgaccgcgagcggaaccttcacctagagggcaagtgcgagacctgcgtttacaatatgatggggaagagggagaagaaactgggcgagttcggcaaggcgaagggctcccgggccatctggtatatgtggctcggcgcccgcttcttggagttcgaggccctgggattcctgaacgaggaccactggtttagccggggcaactctttgtccggagtggagggtgaggggctgcatagactggggtatatactccgggacgtcagcaagaaggaaggcggtgcgatgtatgccgacgacacagcaggctgggacacgagaatcaccctagaggacctgaagaacgaggagatggtgatcaaccacatgaagggggagcacaagaaactcgcggaggccattttcaagcttacctaccaaaacaaagtggtcagagtgcagcgccctacgccgcgcggcacggtcatggatatcatttcccggcgcgatcagcggggaagcgggcaggttggaacctatgggctgaacacctttaccaacatggaagcgcaactcatccgtcagatggaaggcgagggtatcttcaagtccatccagcatctgacggtgaccgaggagatagccgttcagaactggctggcccgggtgggacgcgaacggctctcacgcatggcaatatccggtgacgactgcgtggtgaagcctttggacgaccggttcgccagcgcactgactgctctcaacgacatgggtaaggtcaggaaggacatccagcagtgggagccctctcgtggctggaacgactggacacaggtgccgttttgttcacaccacttccacgagttagtgatgaaggacgggcgcgtactagtggtgccctgccggaaccaggacgaactaataggtcgtgcccggatctcgcagggcgccggctggtcactgaaagagacagcctgccttggcaaatcctacgctcagatgtggaccctcatgtatttccaccgccgggacctgcgattagccgccaacgccatttgcagcgccgtcccctcccactgggtgcccaccagccggacaacctggtccatccacgcgaagcacgagtggatgacgaccgaggacatgctcgccgtgtggaaccgagtctggatccaggagaacccgtggatggaagacaagactcccgtggagagctgggaggaggtgccctaccttggaaaacgcgaggatcagtggtgcggcagcctaatcggtctcacctcacgtgccacgtgggccaagaatatccagaccgcgatcaatcaagtccggtctctaatcggcaacgaggagtacaccgactatatgcccagtatgaaacggttccgccgggaggaagaagaggccggcgtactatggtga

SEQ ID NO: 24816 - RNA, 9876 nt, synthetic construct
  misc_feature 1..9876: note = derived and/or modified CDS sequence (opt11) from DENV-2__JX669485__SS-prME
  source 1..9876: mol_type = other RNA
accgcaggggtgatcatcatgctgatccctaccgccatggcgttccacctcaccaccagaaacggggagccccacatgatcgtaggcaagcaggagaaggggaagtccctgctgttcaagacggaggacggcgtgaacatgtgcaccctcatggccatcgatctgggggagctgtgcgaggacaccattacgtacaagtgccccctcctccggcagaacgagcccgaagacatcgactgctggtgcaatagcaccagcacctgggtgacatacgggacctgcaccaccacgggcgagcaccgccgggagaaacgctccgtcgccctggtgccccacgtagggatgggcctcgagacgcggaccgagacttggatgagctccgagggggcctggaagcacgtacagcgtatcgagacgtggatcctgcggcacccgggctttgccatcatggcggccatcctggcctacactataggaaccacccacttccaacgcgccctcatcttcatcctgttaacggcggtggctccctcaatgaccatgcgctgcatcggtatatccaaccgtgacttcgtcgagggcgtcagcggcggctcttgggtggacatcgtcctcgagcacgggagctgcgtcaccaccatggccaagaataagccaacgctggacttcgagctgatcaagaccgaggccaagcagcccgcaaccctccgtaaatactgcatcgaggcgaagctgaccaacacgacaaccgagtcacgctgcccgacccagggtgagcccagcctgaacgaggagcaggacaaacggttcatatgcaagcacagcatggtggatcgaggctgggggaacggctgcggcctcttcggcaagggcgggattgtgacgtgcgccatgttcacgtgcaagaagaacatggagggcaaggtcgtgttgcccgagaacttggagtataccatcgtgataacgccacacagcggggaggagcacgcggtaggcaacgacaccgggaagcacggcaaggagatcaagatcactccgcagtccagcatcaccgaagccgagctcacagggtacggcaccgtgacgatggaatgctccccccggaccggcctggacttcaacgagatggtgctgctccagatggaggagaaggcctggctggtccaccgccagtggttcctggatcttcccctgccatggctgccgggggccgacacccagggcagcaactggatacagaaggagacgctcgtcacgttcaaaaacccccacgccaagaagcaggacgtggtcgtgctggggtcccaagagggcgccatgcacaccgccctgaccggagccactgagatccagatgagcagcggcaacctcctgttcacgggccacctgaagtgccggctccgcatggacaagctgcagctgaaagggatgtcctacagcatgtgcaccggtaaattcaagattgtaaaggagatcgcggagacccagcatggaacgatcgtgatccgggtacagtacgagggcgacggctccccttgcaagattccattcgagatcatggacctcgagaaacgccacgtcctggggcggctgatcacggtgaatccgatcgtgaccgagaaggacagcccagtcaacatcgaggccgaaccgcccttcggcgactcttacatcatcatcggcgttgagccgggccagctcaagctaaactggttcaagaaggggagctccatcggccagatgttcgagaccaccatgcgaggcgccaagcgcatggcgattctgggggatacggcctgggacttcggcagcctggggggcgtattcacctccatcgggaaggcgctgcaccaggtcttcggcgccatctacggcgccgccttcagcggggtgtcgtggaccatgaagatcctgatcggcgtgatcattacgtggatcgggatgaacagccggtcaacgagcctgtccgtctcactcgtgctggtgggcgtcgtgaccctgtacctcggcgcgatggtgcaggccgactccggatgcgtcgtcagctggaagaacaaggaactgaagtgcggctccggtatcttcatcaccgacaacgtacacacctggacggagcagtacaaattccagcccgagtcgcccagcaaactggcctccgccatccaaaaagcccacgaggagggcatctgtgggatccgcagcgtcacccggctcgagaatctaatgtggaagcagatcacccccgagctgaatcacatcctgtccgagaacgaggtgaaactgaccataatgacgggcgacatcaaggggatcatgcaggcgggcaagcgcagcctgaggcctcagcccaccgaactcaagtattcctggaagacctggggcaaggccaagatgctgagcaccgagtcccacaaccagacgttcttgatcgacggccccgagaccgcagagtgcccgaacacgaaccgcgcctggaacagcctagaggtggaggattacggctttggggtcttcacgacgaacatctggctgaaactccgggaaaagcaagacgtgttctgcgactccaagctcatgagcgccgcgatcaaggacaaccgcgccgtgcacgccgacatgggctattggatcgagtccgccctgaacggcacctggaagatggagaaagccagcttcattgaggtaaagagttgccattggcccaagagccacaccctgtggtccaacggggtattagaaagcgagatgatcatccctaagaacttcgcgggccccgtgtcccagcacaactaccggccggggtaccacacccaaaccgccggcccctggcacctggggaagctggagatggacttcgatttctgcgaaggcacgaccgtcgtggtgaccgaggactgcggcaaccgcgggcccagcttgcggacaacgaccgccagcggcaagctgatcaccgagtggtgctgccgttcctgcaccctgccccccctacggtatcgcggtgaggacggctgctggtacgggatggagattcggcccctgaaggagaaagaggagaatcttgtcaacagcctcgtgacggccggccacggccagatcgacaacttctccttgggggtgctgggcatggccttattcctggaggagatgctgcgcactcgggtcggcaccaagcacgccatcctcctggtagccgtgagcttcgtcactctgatcacggggaacatgtccttccgcgatctaggccgtgtgattgtgatggtcggcgtcaccatgacagacgacatcggcatgggggtgacctacctggccctgctcgcggcgttcaaggtccgcccaacgttcgccgcggggctgctgctccgcaagctgaccagcaaggagctgatgatggccaccatcggtatcaccctcctgtcccagagcacgattcccgaaaccatcctggagctcaccgacgccttagcgctgggcatgatggtgctcaagatcgtgcggaacatggagaagtaccagctggccgtcaccattatggccatttcctgcgtgcctaacgcggtgatcctgctgaacgcctggaaggtcagctgcacgatcttggcggtggtctccgttagccccctgctcctgacctccagccagcaaaagaccgactggattcctctcgccctcaccatcaagggcctgaatcccacggccatcttcctgacaaccctcagtcgcaccagcaagaagcggtcatggccgctgaatgaggccgtgatggcggtcgggatggtgagcatcctggcctccagcctcctgaagaacgacatccccatgactggccctctggtggcagggggcctcctgaccgtctgctacgtgctgaccgggcgcagcgccgacctggagctggagcgggcagcggacgtcaagtgggaggaccaggccgagatttccggtagctcccccatcctgagcatcaccatctccgaggacggcagcatgtccatcaagaacgaggaggaggagcaaacccttaccatcctgatccgaacggggctcctcgtcataagcggcgtgttccctgtctccatccccattaccgccgcggcctggtatctgtgggaagtcaagaagcaacgggcgggggtgctgtgggacgtgccctcgccgccgcccgtcgagaaggccgagctcgaggatggcgcctaccgaatcaagcagcgggggatcctgggctactcccagatcggcgctggggtgtataaggagggcaccttccacacaatgtggcacgtgacccgcggggccgtactgatgcaccggggcaagcgcatcgagcccagctgggcagacgtgaagaaggacctcatctcctacgggggcggctggaaactggagggggagtggaaggagggcgaggaggtgcaggtcctggcactcgaacccgggaagaacccccgggccgtgcagacaaagccgggcctgttcaagaccaacacgggcaccatcggggccgtaagcctggacttctcccctggcaccagcgggtccccgatcgtcgaccgcaagggcaaggtggtggggctctacggcaacggcgtcgtgacccggagcggggcctacgtgtccgctatcgcccagacggagaagtccatcgaggacaatcccgagatcgaggacgacattttccgcaaaaagcgtctgacgatcatggacctgcatcccggtgccgggaagaccaagcgctacctgcccgccatcgtccgggaggcgattaagcgcggcttgcgaaccctgatcctggctccgacgcgcgtggttgccgccgaaatggaagaggccctccgcggcctgcccatccggtaccagaccccagcgatcagggctgagcacacaggccgggagatagtcgatctaatgtgccacgcgaccttcacgatgcgcctccttagccccgtgcgggtgccgaactacaacctgataatcatggacgaggcccacttcaccgaccccgctagcatcgcggcccgcggctacatcagcacccgggtcgagatgggggaggccgcgggcatcttcatgaccgccacgccgcccgggtccagggacccgtttccccagagcaacgcgcccatcatggatgaggagcgggagatccccgagcgctcctggaacagcggccacgagtgggtgaccgacttcaaggggaagaccgtgtggttcgtcccgtccatcaaagccggcaacgacatcgccgcctgcttgcggaagaacggcaagaaagtcatccagctgtcccgcaagaccttcgactccgaatacgtcaagacgcgggcgaacgactgggacttcgtcgtcaccaccgacatcagcgagatgggggccaatttcaaggccgagcgcgtgatcgacccccggcgctgcatgaaaccagtcatcctgaccgacggcgaggagcgagtgatactcgccgggcccatgccggtgacgcactcgagcgctgcacagagacggggccgcgtcgggaggaacccgaagaatgagaacgaccagtacatctacatgggcgagccactggagaacgatgaggactgtgcccattggaaggaggccaagatgctgctcgacaacatcaacacccccgagggcatcatcccgtcaatgttcgagcccgaacgggagaaggtggacgccatcgacggggagtaccgcctgcggggcgaggcccgcaagaccttcgtggacttaatgcggcgcggggaccttcccgtctggctggcataccgggtggccgccgagggcatcaactacgctgaccgccggtggtgcttcgacgggatcaagaacaaccagatattagaggagaacgtcgaagtggaaatctggaccaaggaaggcgaacgcaagaagttgaagccgcgatggctggacgcccgcatctattctgaccccttagcgctcaaggagttcaaggagttcgccgcaggtcggaagtccctgacgctcaatctcatcaccgagatgggccgcctgcccacattcatgacgcagaaggcccgcgacgcgctggacaatctcgccgtgctgcacacggccgaggctggcgggcgggcctacaaccacgcgctgagtgagctccccgagactctggagaccctgctcttactgaccctcctggccacggtcaccggcggcattttcctgttcctcatgtccgggaagggcatcgggaagatgaccctgggaatgtgctgcatcatcaccgccagcatcctgctctggtacgcccagatccagccgcactggatcgccgcgtccatcatcctggagttcttcctgatcgtcctccttatcccagagccagagaaacagcggacgccccaggacaatcagctgacgtacgtggtcatcgccatcctaaccgtcgtggccgccactatggccaacgagatgggatttctggagaagaccaagaaggacctgggcctgggcagcatcactacccaggagagcgagtccaacatccttgacattgacctgcgcccggcgagcgcctggacgctctatgccgtcgccaccacgttcgtgacacccatgttacggcattccatcgagaacagcagtgtgaacgtcagcctgactgctatcgcgaaccaggccaccgtgctcatggggctcggcaaggggtggccgctgtccaagatggacattggcgtgcccctcctggcgatcgggtgctacagccaggtcaacccgatcacgctgaccgccgcgctgctgctgttagtggcccactacgccataataggcccaggcctgcaagccaaagccacccgcgaagcgcagaagcgggccgcggccgggatcatgaagaaccccaccgtggacggcatcacggtcatcgacctggagcccatcccgtacgaccccaagttcgagaagcagctcggacaggtgatgctcctgattttatgcgtgacccaggtcctgatgatgcgtaccacgtgggccctgtgcgaggcgctcacgctggccaccggtcctatttccaccctgtgggagggtaaccccggccgtttctggaacactacgatcgccgttagcatggccaacatatttcggggctcctacctcgccggggctggtctgctgttcagcatcatgaagaacaccaccaacacccggcgggggacgggcaacatcggcgagaccctcggggagaaatggaagtcccgcctgaacgcccttggcaagagcgagttccagatctacaagaagtccggaatccaggaggtggatcggacgctcgcaaaagagggcatcaagcgcggagaaaccgaccaccacgccgtcagtcggggctccgcgaagctgcgctggttcgtggagcggaatatggtgacaccggagggcaaggtcgtggacttgggttgcggccgcgggggttggagctactactgtgggggcctcaagaatgtgagagaggtcaagggcctgaccaagggcgggcccgggcacgaggagccgatccctatgtccacctacggctggaatttagtgcgcctccagtcaggggtggatgttttcttcaccccgcccgagaagtgcgacacgctgctatgcgacatcggcgaatcctccccaaaccccaccatcgaggccggccggaccctccgtgtgctgaacttagtggagaactggctcaacaacaacacgcagttctgtatcaaggtcctgaatccttacatgcctagcgtgatcgagaagatggagactctacaacggaagtacgggggcgccttggtgcgcaaccccctgtcccggaattcaacgcacgagatgtactgggtctccaacgcgaccgggaatatcgtgagctccgtgaacatgatcagccgcatgctgattaaccggttcaccatgaagcacaagaaggccacctacgagctggacgtcgacctcggctccgggacgcgcaacatcggcatcgagagcgagaccccgaacctggacattatcggcaagcgcatcgagaagataaagcaggagcacgagacctcctggcactacgaccaggaccacccctacaagacctgggcgtaccacgggagctacgagactaagcagaccggctccgccagctccatggtgaacggggtggtccgactgctcacgaagccatgggacgtggtgcccatggtcacgcagatggccatgaccgacaccacgccgttcggccagcagcgcgtgttcaaggagaaggtggacacgcggacgcaggagcccaaggagggcacgaagaagctgatgaggatcactgccgagtggctgtggaaggagctcggcaaaaagaagacgccccggatgtgcacgcgcgaggagttcacccggaaggtccgcagcaacgctgctttgggagccatcttcactgacgaaaacaaatggaagtccgcccgggaggccgtggaggacagccgcttctgggagctggtcgaccgtgaacgcaacctccatctcgaagggaagtgcgagacttgcgtttacaacatgatgggcaagcgggagaagaagctgggcgagtttggcaaggccaaaggctcgcgcgcgatttggtacatgtggctcggggccaggttcctggagttcgaggccctgggattcctcaacgaggaccactggttcagcagagggaacagcttatccggcgtggagggggaggggctgcaccggctcggctacatcctgagggacgtcagcaagaaggaaggcggggccatgtacgctgacgacaccgccggctgggacacacggatcacccttgaggacctcaagaacgaggagatggtgaccaaccacatgaaaggcgagcacaaaaagctggccgaggccatcttcaagctgacgtatcaaaacaaggtggtccgcgtgcagcggccaaccccgcgcgggaccgtgatggacataatctcccgtcgggaccagcgcgggtctgggcaggttgggacctacggccttaacacgttcacgaacatggaggcacagttgatccggcaaatggagggggagggcatcttcaagtccatccagcatctgaccgtgaccgaggaaatcgcggtgcagaactggctcgcccgcgtcggccgggagcgcctgagccggatggcaatctccggggacgactgtgtggtgaagccactggacgacagattcgcctcagccctcaccgctctgaacgacatggggaaagtacgcaaggacatacagcagtgggaaccctcccgcgggtggaacgactggacccaggtgcccttctgcagccaccacttccacgagctggtaatgaaagacggccgcgtcctcgtggtgccgtgccgcaaccaggacgagctaatcgggcgggcccgcatctcccagggcgccgggtggagcctgaaggagaccgcctgcctcggaaagtcctacgcccagatgtggactttaatgtacttccaccggcgcgacctacggctagcggccaacgctatttgcagtgccgtcccctcccactgggtgcccacctcgcgaacgacatggtccatccacgcaaagcacgagtggatgaccaccgaggatatgctggcggtatggaaccgggtatggattcaggagaacccctggatggaggacaaaacaccggttgagagctgggaggaggtgccctacctgggcaagcgcgaggaccagtggtgtgggagcttaattggcctgacctcccgcgccacctgggccaagaacatccaaaccgcgatcaaccaggtccggagcctgatcggtaacgaagagtacacggactacatgccgtccatgaagcgcttccgacgcgaggaggaggaggcgggcgtcctctggtga

SEQ ID NO: 24817 - RNA, 9876 nt, synthetic construct
  misc_feature 1..9876: note = derived and/or modified CDS sequence (opt11) from DENV-2__JX669486__SS-prME
  source 1..9876: mol_type = other RNA
acagcgggcgtgatcatcatgctgattcccaccgccatggcgttccacctcacgacccgcaacggggagcctcacatgatcgtgggccggcaagaaaaggggaagtccctcttattcaagaccgaggacggcgtgaatatgtgtaccctaatggccatcgacctgggggaactgtgcgaagacaccattacctacaaatgccccctcctgaggcagaacgagcccgaggacatcgactgctggtgtaacagcaccagcacctgggtcacgtacgggacctgcaccaccacgggcgagcaccgtcgcgagaaacggtccgtcgccctggtgccccacgttgggatgggtctcgagacccgcaccgaaacctggatgtcatccgagggggcatggaaacacgtccagcggatcgagacctggattctgcgccaccccgggttcgctatcatggcggccattctggcttacactatcgggactacacatttccagcgggccctcatattcatcctactaaccgcagtggccccctcaatgaccatgaggtgcatcggcatcagtaaccgggacttcgtggagggtgtcagcgggggctcctgggtggacatcgttctcgagcacggtagctgcgtcaccaccatggccaaaaataagcccacgctggactttgaactgatcaagaccgaggccaagcagcccgctactctccgcaagtactgcattgaggcaaagttgacgaacacgaccaccgagtcccggtgcccgacccagggcgagcccagcctgaacgaggagcaggataagcggttcatctgcaagcactcaatggtcgatcggggctgggggaacggctgcggcttgttcggaaaaggcgggatcgtgacgtgcgccatgtttacctgcaagaaaaacatggagggaaaggtcgtgctgcctgagaacttagagtacaccatcgtcatcactccacacagcggggaagagcacgccgttggcaatgacacggggaagcacggagaggaaatcaaaataacgccgcagtccagcattaccgaggccgagctgaccgggtacgggacggtgacgatggaatgctccccccggaccggcctagactttaacgagatggttctgctccagatggaggagaaggcctggctggtccaccggcaatggtttctagacctccccctgccctggctaccgggggccgacactcaaggctctaattggattcaaaaggagacgctcgtcacgtttaagaacccccacgccaagaagcaggacgtagtagtgttagggtcccaggagggcgccatgcataccgccctgacgggcgccaccgagatacagatgtctagcggcaatctactgttcacgggccacctgaagtgccggctacgtatggataagctgcaattaaaggggatgtcctacagcatgtgcacaggcaagttcaagatcgtcaaggagatagcggagacgcaacacgggacaatcgtgatccgcgtgcaatacgagggagatggctccccctgcaagatccccttcgaaatcatggatctagagaaacggcacgtcctggggcgcttaatcactgtaaacccgatcgtgacggagaaggactccccggttaacattgaggccgagccgcccttcggcgactcctacatcatcatcggtgtggagccgggccagctcaagctgaattggttcaagaaggggagctccattggtcaaatgttcgagaccaccatgcgcggcgccaagcgcatggccattctgggggacacagcgtgggacttcggtagtctcgggggcgtgttcacctcaatcgggaaggcgctgcatcaggtcttcggcgccatatacggcgccgcattctccggggtgtcctggaccatgaaaattttaatcggggtgattataacttggatcgggatgaacagccgctccacatcgttgtcagtaagtctcgtactggtaggtgtcgtaaccctgtaccttggggcgatggtgcaggccgattccggctgcgtcgtgagctggaaaaacaaagagctgaaatgcggctctgggatctttataaccgacaacgttcacacctggacggaacaatacaaattccagcccgagagcccgagcaagctggcctccgctatccagaaagcacacgaggagggcatctgcgggatccggtcggtgacccgcctcgagaatctgatgtggaagcagatcacccccgagctgaatcacatcctctcggagaacgaggtgaagctgaccatcatgacgggtgacatcaaagggattatgcaggcgggcaagcggagcctgcgcccgcagcccacagagctcaaatactcgtggaaaacctggggcaaggccaagatgttaagcactgagagtcacaaccaaacgttcctgatcgacggtccagagaccgcagagtgccccaacaccaatcgggcctggaacagcctcgaggttgaggactacggctttggggtctttaccacaaacatctggctgaaattgcgcgagaaacaggacgtgttctgcgattccaagctcatgagcgccgcgattaaggacaatcgggccgtacatgcggacatgggctactggatcgaatccgccctgaacgacacctggaagatggagaaggccagcttcatcgaggtcaagtcatgccactggcccaagagccacaccctatggtccaacggcgtgttggaaagcgaaatgataattccaaagaacttcgcggggccagtgtcacaacacaactaccgcccgggataccacacccagaccgccgggccatggcacctgggcaagctggagatggacttcgacttctgcgaggggaccaccgtcgtcgtgaccgaggactgcggcaaccggggccccagcttacgtaccacaaccgccagcggcaagctgatcaccgaatggtgctgccggtcctgcaccctgcccccgctacgctaccggggggaggacgggtgctggtacggcatggagatccgccctctgaaggaaaaggaggagaaccttgtaaactctttggtgacggccggacacgggcagatcgacaacttctccctgggggtgctggggatggcactcttcctggaggaaatgctgcggacccgcgtcggcactaagcacgccatcttgctagtggccgtgagcttcgtcacgctgattacgggcaacatgagtttccgggacctcggtcgtgtgatggtgatggtcggagtgacaatgacagacgacatcggaatgggcgtgacctacctggcgcttctcgctgctttcaaggtccgacccaccttcgccgcagggctgttactccgcaagctgaccagcaaggagctgatgatggccacgataggcatcaccctcttgtcgcagtcgacgacccccgagaccatcctggagctcaccgacgctctggcgctagggatgatggtgctcaaaatcgtgcgcaacatggaaaagtaccagctggccgtcacgatcatgactatcctgtgcgtgccgaatgctgtgatccttctgaacgcgtggaaggtgtcgtgcaccatcctggcggtggtctctgtcagcccccttctgctgacgagctcacagcaaaagacggactggatcccgctcgcgctgaccattaagggcctgaaccccaccgccatcttcctcaccacgcttagccggacgtccaagaagcgaagctggccgctgaacgaagccgtgatggccgtcggcatggtttccatcttggcgagctctctgctgaagaacgacatacccatgacggggccgctcgtcgcgggtgggctgctgaccgtctgttacgtgcttacgggccggagcgcagatctggagctggagagagcggccgacgtgaagtgggaggaccaggcggaaataagcgggagcagcccaatcctctccatcaccattagcgaggacggctccatgagcatcaagaacgaggaagaagagcagaccctgaccatcttgatacggaccggactcctggtgatctccggggtgttcccggttagcatcccaatcacggctgccgcctggtacctgtgggaggtcaagaaacagcgcgccggcgtgctctgggacgttccgagcccgccgcccgtcgaaaaggcggaactggaggacggggcctaccggatcaagcagcgaggcattctgggatatagccagatcggcgccggagtgtacaaggagggtacgttccacactatgtggcacgtgacccgtggtgccgttctcatgcaccgcgggaagcggatcgagccctcctgggcggacgtaaagaaggacctgatttcttacggcggcggttggaaattggagggcgagtggaaggagggtgaagaggtgcaggtcttagcactggagcccggcaaaaaccctcgcgccgtgcagactaagcccgggctgttcaagaccaataccggcactatcggggccgtgagcctagacttcagccccggcacgtcgggatcacccattgtcgaccggaagggcaaggtggtgggcctgtacgggaacggcgtcgtgacacgcagtggggcatacgtgagtgccatcgcgcaaaccgagaagagtatcgaggacaatcccgaaatcgaagacgatatatttcggaaaaagagactgaccatcatggacctgcatcccggcgccgggaagacaaaacggtacttgcctgccattgtccgcgaagcgatcaaacgggggctgcgtactctgatcctcgcgccgacccgcgttgtggcagccgagatggaggaggccctgcggggacttccaatccgttaccagacccccgccatcagagccgagcacacggggcgcgagatcgtcgacctcatgtgccacgccacgttcaccatgcgattactgtcgccagtgcgcgtgccgaactataatctgatcatcatggacgaggcccacttcaccgacccggccagcatcgccgcgcggggatacatctccacacgcgtcgaaatgggggaggccgcggggatcttcatgacagctacaccgcccggaagccgggatccgttcccccagtctaacgccccaatcatggacgaggagcgagagatccccgagcggagctggaactcgggccacgagtgggtgaccgacttcaagggcaagacggtgtggttcgtccccagcatcaaggcagggaatgacatcgccgcctgcttacgaaagaacggcaagaaggtgatccagctgtcgcggaagacgttcgacagcgagtacgtgaagacccgggccaacgactgggacttcgtggtaacgaccgacatctccgagatgggagcgaatttcagagccgagcgggtgatcgacccccgccgctgcatgaagcccgtcattcttaccgacggcgaggagagggtgatcctggccggccccatgccggtgacacacagctccgccgcccagcgccgcggacgggtcggtcgcaacccaaagaacgagaacgaccagtacatttacatgggcgagcccctggagaatgacgaggactgcgcgcactggaaagaggccaagatgttattagacaacatcaacacgcccgagggcatcatcccgtcaatgttcgagccggagagggagaaggtcgacgcaatcgacggggaatatagactgcgcggtgaggccagaaagacattcgtggatctcatgcgccgcggcgacctgccagtctggctggcttaccgggtggcagcagagggaattaactacgcagaccgccggtggtgcttcgacggcataaagaacaaccagatcctagaagagaacgtcgaggttgagatttggacaaaggagggggagcgcaagaagctgaagccacggtggttggacgctcgcatctattccgaccccctcgcactgaaggagttcaaggagttcgcggccgggcggaagtccctgaccctcaacctaatcaccgaaatgggccgcctcccgacctttatgacccagaaagcccggaacgccctggacaacctggcggtgctgcacaccgccgaggccggaggccgcgcctacaaccatgccctctcggagttacccgagaccctggagactttgctgctcctcacccttctggcgaccgttaccgggggtatcttcctctttttgatgagcggcaaggggatcggcaagatgacccttgggatgtgttgcatcatcacggcctccgtcctcctgtggtacgcccagatccagccgcactggatcgcggccagcatcattttggagttctttctcatcgtgttgctgatacccgagcccgagaagcagaggaccccgcaggataatcagctcacctacgtcgtgatcgcgatcctgaccgtggtcgccgcgaccatggccaacgagatgggcttcctggaaaagaccaagaaggatctcggcctgggctccatcaccacccaagagagcgagagcaacatcctggacatcgatctccggcctgcttccgcgtggacgctgtacgcagtggctacgaccttcgtgacccctatgctgcggcattcgattgagaattcctcggtcaatgtgtcgctcacggcgatcgccaatcaggcgactgttttgatgggacttgggaagggctggcccctttcgaagatggacatcggcgtccccctgctggcgatcgggtgctactcccaggtgaatcctataaccctcaccgcagctctccttctcctggtggcgcactacgccatcataggccctggcctgcaggccaaggccactcgcgaggcgcaaaagagggcggccgctggcatcatgaagaaccccaccgtcgacggcataaccgtcgtggacttagagcccataccgtacgaccccaaattcgagaagcagctgggccaggtcatgctgttgatcctgtgcgtgacacaagtcctgatgatgcgaactacctgggcactctgcgaagccctgactctggcgaccggacccattagcacgctttgggaaggcaacccgggaagattctggaacaccaccatcgccgtctccatggctaacattttccgggggtcatacctggccggcgccgggctcctcttctccatcatgaagaacacgacgaacacccgccggggcacggggaacattggcgaaaccctgggcgaaaagtggaagtcccgcctaaacgcgctcgggaagtcggagttccagatctacaagcggagcggaatccaggaggtggatcggactctggccaaggagggaatcaaacggggcgaaaccgaccatcacgctgtgtcacgcgggagcgcgaaacttaggtggttcgtcgagcgcaacatggtgaccccggaaggcaaggtggtcgacttaggctgcgggcggggcgggtggtcctactactgcggcggcctgaagaacgtaagagaggtcaagggcctgaccaagggcgggcccggccacgaggaacccatcccgatgagcacctacggttggaacctcgttcggcttcagtccggcgtggacgtatttttcacgccgcctgagaagtgcgacactctgctctgcgacatcggtgagtcctcccccaaccccaccatcgaggcgggccgcaccctgcgggtccttaacctcgtcgaaaactggttaaacaacaatacgcagttctgcatcaaggtgttaaacccgtatatgccctccgtcatcgaaaagatggaaacactgcagcgcaagtacggcggggccctcgtgcggaaccccttaagccgcaactccacgcatgagatgtactgggtaagtaacgccaccggcaacatcgtctccagcgtgaacatgatctcccgcatgctgattaacagattcactatgaagcacaagaaggccacatacgaaccggacgtggacctcgggagcggcacccgcaacatcggtatcgagtcggagatccccaacttggacatcatagggaagcggatcgagaagatcaagcaggagcacgagacctcatggcactatgaccaggaccatccatacaagacgtgggcctaccacggctcctacgagaccaagcagaccgggtcagcgtccagcatggtcaacggcgtcgtgcgcctgctcaccaagccctgggacgtggtaccgatggtgacgcagatggccatgacggatacaaccccctttggccagcagcgggtcttcaaagagaaggtggacacgaggacccaggagccgaaggagggcacaaagaagctgatgcggatcaccgccgagtggctgtggaaggagctcggcaagaagaagaccccccgcatgtgcacccgcgaggagttcacccgcaaggtccggtccaacgccgccctgggggccatctttaccgacgaaaacaagtggaagtccgcccgcgaggcagtggaggactccaggttctgggagctggtggatcgcgagcggaacttacatctggagggcaagtgcgagacgtgtgtttacaatatgatgggtaagcgcgagaaaaagctgggcgagttcgggaaggctaaaggctcacgggctatctggtacatgtggctcggagcgcgcttcctggagttcgaggcactggggttcctcaacgaggaccattggttctcccggggcaattccctgagcggggtggagggcgaaggattacaccgcctcggctacattctacgggacgtaagtaaaaaggaaggaggggccatgtacgccgatgacaccgcgggctgggacactcgcatcaccttggaggacctcaagaacgaggaaatggtcacgaatcacatgaaaggggagcacaagaagctggcagaagcggtgtttaaactgacttatcagaacaaggtggtccgcgtgcagcggccgacgccacgcggtaccgtgatggacatcatcagccggcgcgatcagagggggtccggccaggtcggcacatacgggcttaacacctttaccaatatggaggcccagctgatccgccagatggagggggaaggtatcttcaagagcattcagcacctgaccgtcacggaggagatcgccgtgcagaattggctcgcgcgcgtcggtcgcgagcggctgtcccggatggccatcagcggcgacgactgtgtggtgaaacccctggatgaccggtttgcctccgctctcaccgccctgaacgacatggggaaggtccgcaaggatatccagcaatgggagcccagccgaggctggaatgactggacacaggtgccgttctgcagccatcatttccacgagctggttatgaaggacgggcgcgtcttagtcgtgccctgcagaaaccaggatgagctgatcggtagagcgcggatcagccaaggggccggctggagccttaaggagacagcctgtctcgggaagtcgtacgcccaaatgtggacactgatgtacttccaccggcgggacctccgcctcgccgcaaacgccatctgttctgctgtccccagccactgggtgccaacgtcccggacgacctggagcatccacgccaagcacgaatggatgaccaccgaggacatgctggcagtgtggaaccgggtctggatccaagagaacccgtggatggaggataagaccccagttgaatcttgggaagaggtgccctacctggggaagcgcgaggaccaatggtgcggttcgcttatcgggctgaccagccgggcgacctgggccaagaacatacaaacggccataaaccaggtccggtccctgatcggtaacgaggagtacaccgactacatgcccagtatgaagcggtttcgccgggaggaggaggaggccggggtgctctggtag

SEQ ID NO: 24818 - RNA, 9876 nt, synthetic construct
  misc_feature 1..9876: note = derived and/or modified CDS sequence (opt11) from DENV-2__JX669487__SS-prME
  source 1..9876: mol_type = other RNA
accgcgggcgtgatcatcatgctgatccccactgcgatggcgttccacctcacaacccgcaacggggagccccacatgatagtcggccggcaagagaaagggaagtccctgctgttcaagaccgaagacggagtgaacatgtgcaccctcatggcaatagacctaggagagctgtgcgaggacactataacctacaagtgcccgctccttcggcaaaacgagcccgaagatatcgactgctggtgtaacagtaccagcacatgggtgacttatgggacatgcaccaccacgggtgagcaccggcgtgagaaacggtccgttgccctggttccccacgtggggatgggcctcgagacccgcacagagacctggatgagctccgaaggggcctggaaacacgtccaacgcatcgagacctggatccttcgccacccgggcttcgctatcatggcggccattctggcgtataccatcggaaccactcacttccagcgcgccctcatcttcatcctgctgacggcggtagctcccagcatgaccatgcgctgcatcggcatttccaacagggacttcgtggagggcgtcagcggcggctcctgggtggacatcgtgctcgagcacgggagctgcgtcactaccatggccaagaacaagcccacgcttgacttcgagctgatcaagactgaggccaagcagcccgccacactcagaaagtactgcatcgaggcaaagttaaccaacacaacgaccgagtcccggtgcccgacgcagggtgagcccagcctaaacgaagagcaggacaaacgctttatctgcaaacattccatggtggaccgggggtgggggaacggctgtggcctcttcggcaagggcgggatcgtgacgtgcgcgatgttcacgtgcaagaagaacatggagggcaaggtcgtgctgcccgaaaacctggagtacaccataatgataacgccccactcgggggaggaacacgccgttggcaacgacaccgggaagcacggcaaggagatcaagatcactccgcagtcgagcatcaccgaagcagagctcaccgggtacggcaccgtcactatggagtgcagccccaggaccggcctggatttcaacgagatggtgttgctgcagatggaggagaaggcctggcttgtgcaccggcagtggttcctggacctccccctgccctggctgccgggtgcggacacgcagggtagcaactggattcaaaaggagacactcgtcacgttcaagaacccccatgccaagaagcaagatgtggtggtcctgggctcccaagagggtgccatgcacaccgccctcaccggcgccaccgagatccagatgtcaagcggcaacctcctgttcacgggccacctgaagtgccggctccggatggataagctgcagctgaaggggatgtcctacagcatgtgcacgggcaagttcaagatcgtgaaagagatcgcggagacccagcatgggaccatcgtaatccgcgtgcaatatgagggcgatggctccccatgcaagatccccttcgagatcatggacctcgagaagcggcacgtactggggcgcctgatcacggtcaacccgatcgtgacagagaaggacagccccgtgaacatcgaggcagagccgccattcggcgactcctacatcataatcggggtggagccggggcaactcaaattgaactggttcaagaaagggagctccattggccaaatgttcgaaaccaccatgcgcggcgccaagcggatggccatcctgggggacaccgcctgggacttcggcagcctcgggggcgtgttcacctcgatcgggaaggcactacaccaggtgttcggcgccatctacggcgccgccttctctggtgtctcctggactatgaagatactgatcggcgtgattatcacctggatcgggatgaatagccgctccacgagcctgtccgtgagcctcgtccttgtaggcgtggtcaccctgtaccttggggcgatggttcaggccgactccggttgtgtggtcagctggaagaacaaggagctcaagtgcggctccgggatctttataaccgacaacgtacacacctggacggagcaatacaagttccagcccgagtcaccaagcaagctggcctccgccatccagaaggcccacgaggagggcatctgcgggatacggagcgtgacccgcctcgagaatcttatgtggaaacagatcacccccgaactgaaccacatcctatcagagaacgaggtcaagctaaccatcatgacgggagacatcaaggggatcatgcaggcgggcaagcggtcattacgcccccagcccaccgagctcaaatactcctggaagacctggggcaaagccaagatgcttagcacagagtcccacaaccagacgtttctgatcgatgggcccgagaccgccgaatgcccgaacaccaaccgtgcttggaacagcctcgaggtggaagactacggcttcggggtgttcaccacgaatatctggctgaagctgcgcgagaagcaggatgtcttctgcgactccaagttgatgagcgccgcgatcaaggacaaccgggccgtgcacgctgacatgggctattggatcgagagtgccctgaacgacacctggaagatggaaaaagccagcttcatcgaggtgaaatcgtgccattggccaaagtcccatactctgtggtcgaacggcgtacttgagagcgagatgatcatccccaagaacttcgcggggcccgtgtcccagcacaactaccgcccaggctaccacacccagacagccgggccctggcacctcggcaagctggagatggacttcgacttctgcgaggggacgaccgtagttgtgaccgaggactgcggcaaccggggccctagcctccgcaccacgactgccagcgggaagttaataaccgagtggtgctgccggtcatgcacacttcccccgttacgctaccggggcgaagatgggtgctggtacggcatggagatccgacccctgaaggagaaggaggagaacctggtaaatagccttgtcactgcagggcacggacagattgataacttctccctgggcgtgcttggcatggctctcttcctggaggagatgctgcggactcgcgtgggcaccaagcacgccatcctcctagtagccgtgagcttcgtgacccttataacggggaacatgtccttccgtgacctcggccgtgtcatggtgatggtcggggtgacgatgacagacgacatcggcatgggcgtaacctacctagcccttctcgctgcattcaaggttcgccccacgttcgccgcggggctgctcctccggaagctgacaagcaaggagctgatgatggccacaatcgggatcgccctgttatcccagagcaccatccccgagacgatcctggagctcaccgacgcgctggccctcggtatgatggttctcaggatcgtgcggaacatggagaagtaccagctagctgtgaccatcatggccatctcctgcgtaccgaacgccgtcattctcctcaacgcatggaaggtgagctgcaccatccttgccgccgtctccgtgtccccactgctcttgacctcatcgcagcagaagaccgactggatccccctggctctcacaattaagggcctgaatcccaccgcgatctttctgaccaccctctcccgcaccagcaagaagcggtcgtggcccctgaacgaggcggtcatggccgtgggcatggtgagcatcctggccagttcactcctgaagaacgatatccccatgacagggccattggtcgccggcgggctcctgacggtgtgctatgtcttaacgggccgcagcgcggacctcgagctggagcgggccgccgacgtcaagtgggaggaccaggccgagatctccgggtcatccccaatcttgagcatcacgatctcggaggatggcagcatgtccatcaagaacgaagaggaggagcagacccttaccatactgatccgcacgggcctcctcgtaatcagcggggttttcccggtctccatccccataaccgccgcggcgtggtacctgtgggaagtgaaaaagcagcgggccggcgttctgtgggacgtccccagcccacctcccgtggaaaaagccgagttggaggacggggcgtacagaatcaaacagcgaggcatattggggtactcccagatcggcgcgggcgtatacaaggaagggactttccacacaatgtggcacgtcacacgcggtgccgtcctgatgcaccgggggaagcgcatagagcccagttgggcggacgtgaagaaggacctcatctcctacggcgggggctggaagctggaaggcgagtggaaggagggggaagaggtccaggtgctggcgctcgagcctggaaagaacccccgcgctgtgcaaaccaaacccgggctgttcaaaaccaacaccggcaccatcggggcaataagcctggacttctcccctggcaccagcggctctccgatcgtcgaccgcaaggggaaggtggtgggtctctacgggaacggcgtcgtgaccagaagcggtgcctacgtgtccgccatagcccaaacggagaagtccatcgaggacaaccccgagattgaggacgacatcttcaggaaaaagcggctcacgatcatggacctgcaccccggagcgggcaaaaccaagcgctacctgccggccatcgtccgggaggccatcaagagagggctccgcaccctgatcctggctccaacccgagtggtggccgcggagatggaggaggccctccgcggcttgccgatccgctaccagacgcccgccatccgggcagaacacacggggagagagatcgtcgatttgatgtgccacgccaccttcaccatgcgcctcctgagccccgtgcgggtgccgaactacaacctgatcatcatggacgaggcgcacttcacggaccccgcctccatagccgcacgcggctatatcagcacaagggtcgagatgggcgaggccgcggggatcttcatgactgccacgccgcccggctcccgcgacccgttcccgcagtcgaacgcgcccatcatggacgaggagagggagatccccgagcgatcctggaacagcgggcacgagtgggtcacggacttcaagggcaagaccgtttggttcgtcccgtccatcaaggcagggaacgacatcgcggcgtgcctccggaaaaacggcaagaaggtgatccagctgagccgcaaaaccttcgactctgaatacgtgaagacccgggccaacgactgggacttcgtagtgaccacggacatcagcgagatgggcgcaaacttccgcgccgagcgggtgatcgacccccgccggtgcatgaagcccgtcatcctgaccgatggggaagagcgggtgattctcgcgggccccatgcccgtgacgcactccagcgccgcccagaggcgggggcgcatcggacgcaacccgaagaacgagaacgaccagtacatctatatgggggagccccttgaaaatgacgaagactgcgcccattggaaggaggccaaaatgctgttagacaatatcaacacgccggagggtattattccgtccatgttcgagcccgagcgcgaaaaagtcgacgcgatagacggcgaatatcgcctgcgaggggaggctagaaagacgttcgtggacctgatgcgccgtggcgacctcccggtgtggctggcttaccgcgtcgccgccgaggggatcaactacgcggaccggcgctggtgtttcgatggtataaagaacaaccagatactggaagaaaacgtcgaggtggagatatggactaaggagggggagcggaagaagttgaagccgcgttggctggacgcccggatctacagcgaccccttggccctcaaggagttcaaggaatttgccgcagggaggaagtccctgaccctgaatctcatcaccgaaatgggccggctccccaccttcatgacgcagaaagcccgcgacgccctggacaacctcgccgtcctgcacactgcggaagcaggcggccgggcctacaaacacgcgctgtcagagttgccggagacgctggagaccttgctcctgctgactctcctcgccaccgtgaccggcgggatcttcctgttcttaatgtcaggaaagggcatcggcaagatgacgctggggatgtgttgcatcattacagcgtccatccttctctggtacgcgcagatccagccgcactggatcgctgcctcgatcatcctggagttcttcctgatcgtcttactgatccccgagcccgagaaacagcgcactccccaggataaccagctgacctacgtggtgatcgctatcctaacggttgtggccgcgaccatggccaacgagatgggcttcctggagaaaacgaagaaggatctggggctcggctccatcacgacgcaggagagcgagtccaacatccttgacatcgacctgcggccggccagcgcatggacattatatgctgttgcgaccaccttcgtcactcccatgctgcgtcactccatcgagaacagttccgtgaacgtgagcctgaccgccatcgccaaccaggcgaccgtcctgatgggcctaggaaagggctggcccctgtccaagatggacatcggggtgccgttgctggcgattggatgctacagccaggtgaatccgatcaccctgacggccgccctccttctgctagtcgcacactacgccatcatcgggccaggcctgcaggcgaaggccactcgggaggcccaaaagcgcgccgccgcagggatcatgaaaaaccccaccgtggacgggatcaccgttatcgacctggagcccatcccatacgaccccaagttcgagaagcagctcggccaggtcatgctactgattctctgcgttacccaggtgttgatgatgcgcaccacctgggccctgtgcgaggcactcaccctggccacggggcccatctccaccttatgggagggtaaccccgggagattctggaacacgactatcgctgtcagcatggccaacatcttccgcggctcctacctcgccggcgccgggttactgttctctatcatgaagaatacgacaaacacccggcgcggcaccggtaatatcggcgagacgctcggcgagaaatggaagtcccggctgaacgccctgggcaagagcgagttccagatctacaagaagtctggcatccaagaggtggaccgcaccctagcgaaagaaggcatcaagcggggtgagaccgatcaccacgccgtgagcaggggctccgccaagctgcggtggttcgtcgagcgcaatatggtcaccccggagggtaaagtggtcgacctgggctgtgggcggggcgggtggagctactactgtggcgggctcaagaacgttcgcgaagtgaagggactgacaaagggcgggccaggccacgaggaaccgatacctatgtcaacctacgggtggaacctggtccggctccagagcggcgtggacgtgttcttcaccccgcctgaaaagtgcgacactctgctgtgcgacatcggagagtcttcccccaaccccacgatcgaggccggccgcaccctccgggtcctgaacctggccgagaactggctcaataacaacacgcagttctgtatcaaggtgttgaacccgtacatgccctctgtgattgaaaagatggagaccctgcagcgcaagtacgggggagcgctggtccggaatccactttcccgcaactcgacccacgagatgtactgggtttccaatgccacgggcaacatcgtgtcttccgtcaatatgatcagccgaatgctgatcaaccggtttaccatgaaacacaagaaggctacctacgaaccagacgtggacttagggtccggcacccgcaacatagggatcgagagcgagatacccaacctcgacataattggcaagcggatcgagaagatcaaacaagagcacgagacatcctggcactacgaccaggaccacccatacaaaacttgggcctaccacggctcgtacgagaccaagcagaccgggtccgccagctccatggtcaacggtgtcgtgcgcctgctgacgaaaccatgggacgtggtgcctatggtgacacagatggccatgacggacaccacgcccttcggacagcagcgggtgttcaaggaaaaggtcgacactcgcacccaggagcccaaggagggcactaagaagctcatgcggatcacggccgaatggctgtggaaggaactgggcaagaagaagacgccccgcatgtgtacccgggaggagttcacccggaaggtgcggagcaacgccgccctcggggccatatttacagatgagaacaagtggaaatccgcgcgcgaggccgtggaggacagccgtttctgggagctggtcgaccgggagcggaacttacatctcgagggcaagtgcgagacatgtgtgtataacatgatggggaagagagagaagaagctgggcgagtttgggaaagccaaggggtcccgggccatctggtacatgtggctgggcgcacggttcctcgagtttgaggccctggggttcctgaatgaagaccattggttctctcggggcaacagcctttcaggggtggaaggcgaggggctgcaccgcctgggctacatactccgagacgtcagcaagaaggagggcggggccatgtacgctgatgataccgcaggctgggacacacgcataactttagaagatctgaagaacgaggaaatggtgaccaaccacatgaagggggagcacaaaaagctcgcggaggctatattcaagctgacctaccagaacaaggtcgtacgcgtgcagagaccgacgccgcgtggcacagtcatggacatcatatcccggaaggaccagcgcgggagcggacaggtggggacctacggcctgaacacctttaccaacatggaggcccagctaatccggcaaatggagggcgaggggatcttcaagtccatccaacacctgacggtgaccgaggagatcgcagtccaaaactggctggcccgcgtgggccgggagcgattatctcggatggcgatctccggcgacgactgcgtggtgaagcctctggacgaccgcttcgcgtccgccctgaccgcgctcaacgacatggggaaggttcggaaggatatccagcagtgggagccctcccgcggctggaacgactggacccaggtgccgttctgctcacaccacttccacgagctggtcatgaaggacgggcgtgtgctggtggtcccttgcaggaaccaggacgagctcatcggccgtgctcgcatctcccagggggcgggctggagcctgaaggagactgcctgccttggcaagtcttacgcacagatgtggacgctaatgtactttcaccggcgggacttacggctggccgccaacgcgatctgtagcgccgtgccctcccactgggtgcccacctcccgaaccacctggtcgatccacgcaaagcacgagtggatgacgaccgaggacatgctcgccgtatggaaccgcgtatggatccaggagaacccgtggatggaggacaagacccctgtggagagctgggaggaggtcccctacctagggaaacgggaggaccaatggtgtggctccctgatcggattgacctcccgtgccacctgggccaagaacatccaaactgccatcaaccaggtgcggagcctgatcggcaacgaggagtataccgactacatgccctccatgaagcgattccggcgcgaagaggaagaggccggggtgctttggtga

SEQ ID NO: 24819 - RNA, 9876 nt, synthetic construct
  misc_feature 1..9876: note = derived and/or modified CDS sequence (opt11) from DENV-2__JX669488__SS-prME
  source 1..9876: mol_type = other RNA
accgcgggagtgatcatcatgctgatccccactgctatggcgttccacctcaccacccgcaacggggagcctcatatgatcgtcggccgacaagagaaggggaagtccctgctcttcaaaaccgaggacggcgtcaacatgtgcaccctcatggccatcgacctgggagagctgtgtgaggacacgatcacctataagtgccccctcctgcgccagaacgagcccgaggatatcgattgctggtgtaacagcacgagtacctgggtcacgtacgggacctgcaccaccacgggcgaacaccggcgcgagaagcggtccgttgccttggtgccccacgtggggatgggcctcgagaccagaaccgagacctggatgtcatccgagggggcctggaagcatgtacagcggatcgagacgtggatcctgaggcacccgggtttcgcaatcatggcagccatactggcctacaccatcgggaccacacacttccagcgcgccctcatcttcatcctgttaacggcggtggccccaagcatgactatgcgctgcatcggcatctccaaccgggatttcgtggagggagtctccgggggctcctgggtggacatcgtactcgagcacgggagctgcgtcactaccatggcaaagaacaagcccacattagatttcgagctcatcaagaccgaggccaaacagcccgccaccctccgcaagtattgtatcgaagcgaaactcaccaatacgaccaccgagtcccggtgccccactcagggcgagccaagcttaaacgaggagcaggataagcgtttcatctgcaagcactccatggtggaccgcgggtggggaaatggctgcggcctcttcggtaagggcgggatcgtgacgtgcgccatgttcacttgcaagaaaaatatggaaggcaaggtcgtgttgcccgaaaacctggagtacaccatcgtgatcacaccgcacagcggagaggagcacgccgtcggcaacgacacggggaagcatggcaaggagatcaagatcaccccacagtccagcataaccgaggccgagctcaccggctacggcaccgtcacgatggagtgcagcccccgcacaggtctggacttcaacgagatggtgctgctccagatggaggagaaggcttggctggtgcacaggcagtggttcctggacctgcccttgccatggttaccaggggcggacacccagggcagcaactggatacagaaagagaccctagtgacgttcaagaacccccacgccaagaagcaggacgtggtcgttctggggtcacaggagggcgcgatgcacaccgccctgaccggggctaccgagatccagatgagcagcggcaacctcctgttcacgggccatctgaagtgtcgactccgcatggacaagctgcagctgaaagggatgtcctacagcatgtgcaccggaaagttcaagatcgtgaaggagatcgcggagacccaacatggaaccatcgtgatccgcgtgcagtacgagggcgacggctccccttgcaagatccccttcgagatcatggacctcgagaagcggcacgtcctggggcgccttatcacggtgaacccgatcgttaccgagaaggatagccccgtcaacatcgaggccgagccgcccttcggcgactcctacatcatcatcggggtggagccgggccagctcaagctgaactggttcaagaaagggtcatccatcggccagatgtttgagaccaccatgcgaggcgccaaacggatggccatcctgggcgatacggcctgggacttcggaagcctcgggggcgtgtttacgtcgattgggaaggccctgcaccaggtcttcggcgcgatatacggtgcggccttcagcggggtgtcctggacaatgaagatcctaatcggcgtgatcatcacatggatcgggatgaacagccgctccacgtcgctgtccgtcagcctagtgctggtgggcgtcgttaccctgtatctcggggcgatggtgcaggccgactcaggctgcgttgttagctggaagaacaaggagctgaagtgtggttcggggatcttcatcaccgacaacgtgcacacttggacggaacagtacaagttccagcccgagtcgcctagcaagctggcctccgccatccaaaaggcccacgaggagggcatctgcggaattcggagcgtcacccgcctcgaaaacctgatgtggaagcagatcacccccgagctgaatcacatcctctccgagaatgaggtaaagctaaccatcatgacgggcgacatcaaaggaatcatgcaggcaggcaaacgctcgctgcgcccgcagcccaccgagctcaagtactcgtggaagacctggggaaaggccaagatgctgagcaccgagtcccacaaccagacgtttctgattgacgggcccgagaccgccgagtgtccaaacaccaaccgggcatggaatagtctcgaggttgaggactatggcttcggcgtcttcaccacgaacatctggttgaagctgcgcgagaagcaggacgtgttctgtgactccaagctgatgtcggccgccataaaggacaaccgggccgtgcacgccgatatgggatactggatcgagtccgccctaaacgatacctggaagatggagaaggccagcttcatcgaggtaaagtcctgtcactggcccaagtcacacaccctatggtccaacggcgtactcgagtctgagatgattatccccaagaacttcgcgggacccgtgtctcagcacaattatcgcccgggctaccatacccaaacggccggtccctggcacctgggcaagctggaaatggacttcgacttctgtgagggtactaccgtcgtggtgaccgaggactgtggtaaccgcggacccagcctcaggaccacgaccgcaagtgggaagctgatcaccgagtggtgctgccggtcctgtacgctccccccactccgataccggggtgaggacgggtgctggtatggcatggagatccgccccctgaaggagaaagaggagaacctggtcaacagcctcgtgacggcaggccacggacagatcgacaacttctccttgggcgtgctgggtatggccctcttcctggaggagatgcttcggactcgtgtcggcaccaagcacgccatacttctggtggccgccagcttcgtgaccttgatcactgggaacatgtccttccgggacctcggccgcgttatggtgatggtgggggccacgatgaccgacgacatcggcatgggcgtcacctacctggcgctgctcgccgccttcaaggtgagacccacattcgcggcggggctgctgctccggaagctgacgagcaaggaactgatgatggcgactatcggcatcgccctcctgtcgcagagcaccatccccgaaacgatcctggagctcaccgacgcactggcactggggatgatggtgctccgcatcgtccgtaacatggagaagtaccagctagccgtgaccatcatggcgatttcctgcgtaccgaacgccgtcatcctgctcaacgcctggaaggtcagttgcacaattctggccgcggtgtctgtcagccccctgctgctgacctccagccaacagaaaaccgattggatccccctagccctcacgataaagggcctgaaccccaccgccatcttcctgacgacgctctctaggaccagcaagaagcggtcctggcccctaaacgaggctgtgatggccgtcggcatggtgagcatcctggcgtccagcctcctgaaaaacgacatccccatgaccgggccgctggtggccggcgggctcctgacggtctgctacgtgctgaccggccgcagcgccgaccttgagctggagcgggccgccgacgtgaagtgggaggaccaggcggagatctccgggagctcccccattctgagcatcactatctcggaggacggcagcatgtccatcaagaacgaggaggaggagcagactctcacaatcctgatacgcaccggactgctcgtcatctcaggggtgttccctgtgtccatcccaatcacagccgccgcctggtacctgtgggaggtcaagaagcagcgggccggcgtgctctgggacgtgccaagcccgccgcccgtcgagaaagcggaactcgaggacggggcctatcgaatcaagcagcggggcatcctaggctactcacaaatcggcgccggcgtttacaaagagggaaccttccatactatgtggcacgtgacgcgcggcgccgtcctgatgcaccgggggaagaggattgaacccagctgggccgacgtgaagaaagatctcatctcgtacggcgggggctggaaactggagggtgagtggaaggagggggaggaggtccaggtcttggcgctcgagcccggcaagaacccccgggccgtgcagaccaagcccgggctgttcaagactaacaccggcacgataggggctatcagtctggacttctcccccggcacgagcggctcccccatcgtggaccgaaaagggaaggtcgtgggcctctacggcaacggtgtggtcacccgtagcggcgcgtatgtgtccgcaatcgcccaaaccgagaagtccatcgaagataaccccgagatcgaagacgacatatttcgcaagaagcgactgacgatcatggacctgcaccccggggccggcaagaccaagcggtacctgcccgccatcgtgcgggaggccatcaagcgggggctcagaacattgattctggcgccgacccgggtcgtggctgccgagatggaagaagccctccgcgggttacccatccggtaccagacccccgccatccgcgccgagcacaccgggcgggaaatcgtggacctgatgtgccacgccacctttactatgcgcctccttagtcccgtccgggttcctaattataacctgatcatcatggacgaggctcacttcacggaccccgcctccatcgccgcgcgtggttacatcagcacccgcgttgagatgggcgaggccgccgggatattcatgaccgccacgccgcccgggtccagggacccgttcccccagagcaacgcgcccatcatggacgaggaacgggaaatccccgagcgctcctggaacagcgggcacgagtgggtcaccgacttcaaggggaagaccgtatggttcgtcccatccatcaaagcggggaacgacatcgccgcctgcctccggaaaaacggcaagaaggtcatccagctgagccgcaagaccttcgactccgagtacgtgaagacccgggcgaacgactgggactttgtagtcacgacggacatctctgagatgggtgcaaacttccgcgccgagcgggtgatcgacccccgccggtgcatgaagccggtaatcctgaccgatggggaggagagggtcatcctcgccggccccatgccggtcacacactccagtgccgcccagcggcgggggcgcatcggacggaaccctaagaacgagaacgaccagtacatatacatgggggaacccctggagaatgacgaagactgcgcgcactggaaggaggccaagatgctgctagacaacatcaacacccctgaaggcatcataccttccatgttcgagcccgagcgcgagaaggtggacgccatcgacggtgaataccggctacgcggggaggcccggaagacgttcgtcgacctgatgcgtagaggcgacttgccggtgtggctggcctataaggttgcggcagaggggatcaactacgccgaccgccggtggtgcttcgacggcatcaagaacaaccagatcctggaggagaacgtcgaggttgagatatggacaaaagagggtgaacgcaagaaactcaagccgcggtggctggacgcccgtatctacagcgacccccttgcgcttaaggagttcaaggagttcgccgccggaagaaaatccctgactctgaacctcatcacggaaatgggccgcctgcccacgtttatgacacagaaggcccgggacgccctggacaacttagcggtactgcacacagccgaggccggcggccgcgcctacaagcacgccctgagcgagctccccgagacgctggagaccctgttactgctgacattgctggcgaccgtcacaggagggatcttcctgtttttaatgagcgggaaggggatcggcaagatgacgttagggatgtgctgtatcatcactgctagcatactgctctggtacgcccaaatccagcctcactggatcgccgcctccataatcctggagttcttcctgatcgtcctcctgatccccgagcctgagaagcagcggacgccccaggacaaccaactaacctacgtcgtgattgcgatactcacggtggtagccgcgaccatggccaacgaaatggggttccttgagaagaccaagaaggacctcgggcttggctcaatcaccactcaggagagcgagtccaacatcctggacattgacctgcgcccggccagcgcgtggaccctctacgctgttgcaaccaccttcgtgacgcccatgctacggcactccatcgagaacagctccgtaaacgttagcctgaccgccattgccaatcaggccacggtgcttatgggcctggggaaggggtggcccctgtcgaagatggacatcggggtgccactcctggcgatcggctgttacagccaggttaacccgatcaccctgacggccgccctcctgcttctcgtagcgcactacgccattatagggcccgggctacaggccaaggccacacgggaagctcagaagcgcgcggccgcgggcatcatgaagaatcctaccgtcgacggtatcaccgtgatcgacctggagcctataccgtatgacccgaaattcgaaaagcagttgggccaggtaatgctgctgatcctctgcgtcacccaggtgctgatgatgcggaccacgtgggcgctgtgcgaggccctcaccctcgcgacgggtcccatctcgaccctgtgggaggggaacccagggcgcttctggaacacaaccatcgccgtgagcatggccaacattttccgaggctcctacctggccggagcgggactgcttttcagcatcatgaagaatacggccaacacccgccggggcaccggtaacattggtgagaccctgggggaaaagtggaagtcccgcctgaacgccctgggcaagagtgaatttcagatctacaaaaagtccggcatccaggaggtcgacagaacgctcgcgaaggaaggtatcaagcgcggcgagaccgaccaccacgctgtgagccgggggtccgcgaagctgcgctggttcgtggagaggaacatggtcaccccggagggcaaggtagtggatctgggctgcggacgcggtgggtggagctactactgcggcgggctcaagaatgtcagggaggtgaaggggctgaccaagggcgggcccgggcacgaggagcccatccccatgtccacatacggatggaacctggtgcgcttacagagcggcgtcgacgtgtttttcacccctcccgagaagtgcgacaccttactgtgtgacatcggggagagctcccccaaccccaccatcgaggccggccgcacgctccgcgtgttgaacctggccgagaactggttgaataacaacactcagttctgtataaaggtcttaaatccgtacatgccctccgtgatcgagaaaatggaaaccttacaacggaagtacggcggtgccctggtgcgaaaccccctctcccggaacagcacacacgaaatgtactgggtcagcaacgcaaccggcaacatcgtgagctccgtgaacatgatctcacgcatgctgatcaaccgcttcacgatgaagcacaagaaggcgacctacgaaccggacgtcgacctggggtcagggacccggaacatcgggatagagagcgagatccccaacctagacatcatcggcaagagaatcgaaaagatcaagcaggagcacgagacctcatggcattacgaccaggaccacccatacaagacgtgggcataccacggctcatacgaaaccaaacagaccgggtccgccagctccatggtgaacggcgtggtccggctactgaccaagccctgggacgtggtgccgatggtcacacagatggccatgacagacaccacccccttcgggcagcagcgcgtattcaaagagaaagttgacacgcggacccaagagcctaaggagggcaccaagaagttgatgcgcataaccgctgagtggctgtggaaggagcttggcaagaagaagacgccccggatgtgcacgcgcgaggagttcacccgaaaggtcagaagcaacgccgcccttggggccatcttcactgacgagaacaagtggaagtccgcccgggaggcggtggaggacagccgcttctgggaactggtggaccgggagcgcaacctgcacctagagggcaagtgcgagacgtgcgtgtacaacatgatggggaagcgggaaaagaagctcggagagttcggaaaggctaagggctcccgcgccatctggtacatgtggctgggcgcccggtttctggagttcgaggccctggggttcctgaacgaggaccactggttcagccggggcaactccctttccggggtggaaggcgaggggctgcaccggctgggctacatcctccgtgacgtgagcaaaaaggagggcggggctatgtacgctgacgacacagccggctgggatacccggatcaccctggaggacctgaaaaatgaggagatggtcacgaaccacatggagggggagcacaaaaagctcgccgaggccatattcaagctcacctaccagaacaaggtggtccgcgtccagaggcctacgccacggggcactgtgatggacatcatctcccgcaaagatcaacggggcagcggccaggtgggcacttatggcctgaacaccttcaccaacatggaggcgcaactaatcagacagatggagggtgaggggatcttcaaatccatccagcacctgaccgtaacggaggagatcgccgtgcagaactggctggccagggtcggccgcgagcggctttcaagaatggctatcagcggtgacgattgcgtggtgaagcccctagacgatagattcgcaagcgcccttaccgctctcaacgatatgggcaaggtccgaaaggacatccagcagtgggagccctcccgtggctggaacgactggacccaggtgcccttctgcagccaccacttccacgagctggttatgaaggacgggcgggtcctggtcgtaccctgcagaaaccaggacgagctcatcggccgcgcacgaatctcgcagggggccggctggagcctcaaagagaccgcctgcctgggcaagtcctacgctcagatgtggacgctcatgtatttccaccgccgggacctgcgcctagccgccaacgccatctgcagtgcggtcccctcccactgggtgcccacatcacgaaccacatggtccatccacgcaaagcacgagtggatgacgacggaggacatgctcgccgtctggaacagggtctggatccaggagaacccgtggatggaggacaaaacgcccgttgagtcgtgggaggaggtgccctatttagggaagcgggaggaccagtggtgcgggagcttaatcggtctcacatcccgggccacctgggccaagaacatccagacggcgatcaaccaggtccgcagcttaatcggcaacgaggagtacaccgactacatgccctctatgaaaaggttccgccgggaagaggaggaggccggggtgctgtggtga

SEQ ID NO: 24820 - RNA, 9876 nt, synthetic construct
  misc_feature 1..9876: note = derived and/or modified CDS sequence (opt11) from DENV-2__JX669479__SS-prME
  source 1..9876: mol_type = other RNA
accgcgggcgtaatcgtaatgctcataccaacggccatggcattccatctgacaacacgcaacggcgaaccccatatgatcgtcggccgtcaggagaaaggcaaaagcctcctcttcaaaacggaggacggtgtcaacatgtgcaccctgatggctatcgacctgggggaattgtgcgaggacaccatcacctacaaatgtcctctcctcaggcagaacgagccagaagacattgattgctggtgcaatagcacctccacctgggttacgtatggcacatgcaccaccaccggggagcaccgtcgagagaaacgcagcgtggccctagtaccacacgtcggaatgggattagagacacgaaccgaaacatggatgagttcggaaggagcctggaaacacgtacagcgtatagagacttggatcctgagacacccaggtttcacaatcatggccgccatactggcctacacgatagggaccactcactttcaaagagccctaatatttatcttgctgacagcagtcgcaccctccatgacgatgcgttgcatcggaattagcaacagagatttcgtagaaggagtgagcgggggaagctgggtggacatcgtactagagcatggcagttgcgtcacaaccatggcgaagaacaaaccaaccttggacttcgaactgatcaaaaccgaggccaagcagccagcaacactgagaaagtattgcatagaagccaagctcaccaacacaactacagaaagtaggtgtcccacccaaggggaaccttcccttaacgaagaacaggacaagcggttcatctgtaaacatagtatggtggatcgaggctggggtaacggatgcggcctcttcgggaagggcgggatagtaacgtgcgcaatgttcacttgcaaaaagaacatggagggcaagatcgttcaaagtgagaatctcgagtacactattgtgatcacaccccatagcggagaggaacacgccgtaggtaatgacacgggcaagcacggcaaggaaatcaagatcaccccacagagcagcacaaccgaggcagagctcaccggatatggaaccgtcacaatggaatgcagccccagaacagggctagacttcaacgaaatggtgctactacagatggaagacaaagcatggctcgtacatcgacaatggttcttagacctgccattaccgtggctgcccggagccgacacacagggttccaactggatacagaaagaaaccttagtgaccttcaaaaacccacatgctaaaaaacaagacgtagtggtgctaggaagccaagaaggcgccatgcacacagccctgacaggagcaaccgaaatccaaatgtccagcggaaatttacttttcactggtcacctaaaatgccgtctacgcatggacaaacttcaactaaaaggaatgtcatactcgatgtgcacgggaaagttcaaaatagtcaaagaaatcgcagagactcaacatggcaccatagtgatacgcgtgcaatacgaaggtgacggatctccctgcaaaattccattcgagattactgacctcgaaaaaagacacgtcctaggccgattaattacagtcaacccaatagtaacggaaaaggacagccccgtgaatatagaagcggagcccccgttcggagactcttacattatcgttggagtagaaccaggacagctcaaactaaactggttcaagaagggatcctcaatcgggcaaatgttcgaaacaacaatgcgcggagcaaagcgcatggcaatactcggagacaccgcatgggacttcggaagcctaggaggagtcttcacgagcatcggcaaagcgctacaccaagtcttcggagcaatatacggcgctgcgttctcaggtgttagttggacaatgaagatcttaatcggagtcatcatcacatggattggaatgaatagcagatcgacaagtctaagtgtcagcctagttctcgttggagttgtcaccctgtacctcggagcaatggtacaagcggattcaggttgcatagtatcgtggaaaaacaaggaattaaagtgcggaagtggaatattcatcacagacaacgttcacacctggacggaacaatacaaatttcagccggaatccccttcgaagttagcttcagcaatccaaaaagcgcacgaagaaggcatatgcgggatacgatcagtgacaaggctcgaaaacctcatgtggaaacagataacaccggagctcaatcatatcttatccgaaaacgaggtaaaacttacgataatgacaggagacataaagggcataatgcaagcaggcaaacgaagtctacggcctcaaccaacggaattgaagtactcatggaaaacctggggaaaggcgaaaatgcttagtaccgaatctcacaatcaaacttttctaatagacgggccagaaacagcagaatgtccgaatactaaccgagcatggaatagcctagaagtggaggattatggcttcggcgtgttcacaaccaatatctggctaaaattacgtgaaaaacaagacgttttctgcgactcaaaactcatgtctgccgcaataaaagataatagggcagtacatgcggacatgggatactggatcgagtcagcattgaacgacacatggaaaatggagaaagcctcattcatcgaagtgaagtcgtgccactggccaaaatcccacaccctatggtccaacggagtacttgagagcgaaatgatcatccccaaaaattttgccggtccagtgtcccaacacaattacagacccggatatcacacccaaacagcgggaccgtggcacctgggaaaactagagatggacttcgacttctgcgaaggaacaacagtcgttgtgaccgaggactgcgggaacagaggacccagcctccgtacaaccaccgctagcgggaagctaattaccgagtggtgctgtcgatcctgcactctacccccccttaggtacaggggtgaggacggctgctggtacgggatggagataaggccgctaaaggagaaagaagagaatcttgtgaactcccttgtaaccgcaggacatggacagatagacaacttctcattgggggtcctgggcatggccctcttcctcgaagagatgctacggaccagggtggggactaaacacgccatcttactcgtagccctctcctttgtcacgcttattactggcaacatgtcgttccgcgatctaggacgggtgatggtgatggtaggagccacgatgacagacgacatcgggatgggtgtaacgtacctagcgctcctagccgcgttcaaggtccgaccgaccttcgcagccggtctcctactgaggaagctaactagtaaggaactaatgatggctaccatcggtatagcgctcctatctcagtcaaccctaccagagacgatcctagaattaaccgacgcgctcgccttaggtatgatggccttaaaaatagtccgaaacatggaaaaataccagcttgcagtcactatcatggccatatcttgtgtacccaacgcggtgatcctacagaacgcctggaaagtgagttgcaccatattagcggcagtctcagtttcacctctactattaacgtccagccaacaaaaggcagactggataccactagcactaacaataaaaggactcaaccccacggcgattttcctcaccaccttaagccgtacatccaaaaagaggtcgtggcctttgaatgaagcaattatggccgtcgggatggtatcgatacttgcgagctccctcctgaagaacgacatccctatgacaggcccactcgttgccggtggactgctgacagtctgttatgttctaacaggtagatcagcggacctggaactagaacgcgcagccgatgttaaatgggaagaccaagcagagataagcggctcctcaccaatactatcaattacgatatcggaggacggatcgatgagcatcaaaaacgaggaggaggagcaaactctgactatactgatccggacaggactactcgtgattagcggcgtcttcccagtgtcaattcccataacggccgccgcatggtatctgtgggaagtcaagaaacaaagagccggagttctatgggacgtaccatcacccccaccagtagaaaaagccgagctggaagatggagcatatcgaatcaagcagcgcggcatcctgggatacagtcaaataggggccggagtctacaaagaaggaacattccacacaatgtggcatgtgacgcgcggcgccgtcttgatgcaccgcgggaagcgcatcgagccttcttgggcagacgtgaaaaaggacctgatatcctatggcggagggtggaaattggagggggagtggaaggaaggcgaagaggtgcaggtactagcattagagccaggcaaaaacccccgagcagtacaaacaaaacccggaatcttcaaaacaaacactgggacaataggagcagtatcgctggatttctctccggggacaagtgggtccccgatagtagatcgaaaaggcaaggtagtggggctgtacggcaatggcgtagttacgcggtcaggggcctacgtctccgcgatcgcccagacggagaaatccatcgaggacaaccccgaaatcgaggatgatatatttcgaaagaagcggttgactatcatggatctccaccccggtgccgggaaaacgaagcgatacctgccagccatcgtccgggaggcgataaaacgaggactccgcacgctaattcttgctcccacacgcgtcgttgctgccgaaatggaggaagcgctgcgaggcctaccaattcgataccaaacgccagcaatacgagccgagcacactggcagggagatagtcgacctcatgtgccacgcgaccttcacaatgcgactcttaagcccagtgagagtgccaaactacaatctgatcatcatggacgaagcacacttcactgacccggccagcatagcggccaggggatacatatccacgcgcgtggagatgggcgaggccgcaggcatattcatgaccgccacccctcctggaagccgagatccgttccctcaaagcaacgccccgatcatggatgaagaacgagaaatacccgagaggagctggaattcaggacacgagtgggtgaccgatttcaaaggcaaaaccgtctggttcgtacccagcataaaagccggcaacgacattgccgcatgcctcagaaagaacggcaagaaagtcatccaactctcccgaaaaacgttcgacagcgaatacgtaaaaactcgcgccaacgattgggatttcgtagttactacggatatctccgagatgggcgcgaatttcaaagccgaaagggtcatcgacccacggcgatgcatgaaaccagtaatcttaacagacggggaggagcgggtaatcctagcaggcccaatgccggtcacgcactcatccgcggctcaaaggcgcggaaggatcggccgtaacccaaaaaatgagaacgaccagtacatttatatgggcgagccgctagagaacgacgaagactgcgcacactggaaggaagccaagatgctattagacaatatcaacacgccggaggggataataccatccatgttcgagccagagcgagaaaaagtggacgccatagacggtgaataccgcctccgcggagaggcccgcaaaacgttcgtagacctcatgcgaaggggagacctgccagtttggctagcctacaaagtcgcagctgaaggtataaactacgccgacaggaagtggtgtttcgacggcatcaagaacaaccagatccttgaggaaaacgtagaggttgaaatttggaccaaggagggggaaaggaagaagttgaaaccccgatggctcgacgcacgcatctacagcgacccgctcgctctaaaggaattcaaagagttcgccgccggacgtaaaagtctgacgctgaatctaatcactgagatgggcaggctccctacattcatgacacaaaaggcacgcaacgccctagacaatttagcagtgctacacactgcggaagtcgggggtcgagcgtatacacacgcactctcggagctaccagagaccctggaaacgctcttactcctcacgctactcgccgcagtaactggcggaatattcctattcctgatgagcggcaaggggatcggcaagatgacgttagggatgtgttgcattatcaccgcctccatcttactctggtacgcccaaatacagcctcactggatcgcggcatcaataatcctcgaattcttcctcatcgtgctacttattcccgaacccgaaaaacagcgaacaccacaggataaccagctaacctacgtcgtgatcgcaatactcaccgttgtggcagccacgatggcgaatgaaatgggtttcctcgaaaaaaccaaaaaagacctgggattcgggagcatcaccacccaagaaagtgaatccaacattctcgacatcgacctaagaccagcatcggcatggaccttatacgccgtcgcgacgacattcgtgacaccgatgctgcgacacagcatcgaaaacagtagcgtcaatgtcagcctgaccgccatagcgaaccaggccaccgttctaatggggttaggaaagggatggcccttgtcgaaaatggatataggcgtaccgctactagccatagggtgctattcacaggtgaaccctatcacactgacggcggcgctactcttattagttgcccactacgccataataggaccaggtctacaggcaaaagccacccgcgaagcgcaaaagagggcggcagccggaataatgaaaaacccaaccgttgatggcataaccgtaatagacctagaaccgataccctacgacccaaagttcgaaaagcaattaggccaagtcatgctgctaatcctatgcgtaacccaggtactgatgatgaggactacatgggcactctgtgaagcgttaactctggcgacgggaccgatctccacgttgtgggaaggaaacccaggaaggttctggaatactaccatcgctgtgtcaatggcaaatattttcagaggaagctacctagccggggcaggactactcttctccataatgaaaaacacaactaacaccagaaggggaactggaaatgtgggagaaacgctcggcgaaaaatggaagtcccgactcaaggccctagggaagagcgaattccagatttacaaaaagagtggcatacaggaggtcgaccgaacgctggcgaaggaagggattaaacgaggagaaaccgatcaccatgccgtaagcagaggctcagctaagcttaggtggtttgtagaacggaacatggtaactcccgaggggaaagtagtcgacctcggatgcggcagaggcggatggtcgtactactgcggaggactgaaaaacgtccgggaagtgaaaggactaactaaaggcggcccgggacacgaagaaccaattccgatgagcacatacgggtggaacctagtgcggctccaaagcggcgtagacgtgttctttactccacccgaaaagtgcgatacacttttgtgcgacataggagagtcgagtccaaaccctacaatagaagcgggtcgcacccttcgtgtcttgaacttggtagaaaactggctgaacaacaatacccaattctgcatcaaggtactaaacccatacatgccaagcgtaatcgagaaaatggagacgctccagcgcaagtacggaggtgcactggttcgcaatcccttgagtcggaactccacacatgagatgtattgggtatcaaacgccacgggaaacatagtgtcgagcgtaaacatgatctcgaggatgctaatcaacaggttcacaatgaaacacaagaaagcaacctacgagcctgatgtagacctagggtccgggacacgaaacatcggaatagaaagcgagataccgaacctcgatataattggaaaaagaattgaaaaaatcaagcaggagcacgagacaagttggcactacgaccaggaccacccctacaaaacatgggcgtaccacggcagctacgagacaaaacaaaccggctccgctagcagcatggtgaacggggtagtgaggctcctcaccaagccctgggacgtcgtcccgatggtgacccagatggcaatgacggacaccacaccatttggacaacaaagagtattcaaggagaaggttgacacaagaacccaagagccaaaggagggaacgaaaaaactcatgaagatcacagcagagtggctatggaaggaattggggaaagagaagacaccacgaatgtgcactcgggaggaattcacacgaaaggtccgttccaacgcagcactcggcgcagtgttcacagacgaaaacaaatggaaatctgcacgggaagcagtcgaagacggcaggttctgggaactcgtcgacagagagcgaaaccttcacctagaaggcaaatgcgagacttgcgtatacaacatgatgggtaaacgcgaaaaaaaacttggcgaattcggaaaggctaaaggtagtcgagcaatatggtacatgtggctgggagcacggttcctcgagttcgaagcactaggattcctaaacgaagatcactggttcagccgcggcaatagcctgagcggagttgagggcgaaggactgcacagacttggatatatactgagggaagtaggcaaaaaggagggcggggccatgtacgcggacgatacggcaggttgggacacacgcatcaccttagaggaccttaaaaacgaagaaatggtaacgaaccacatgaagggtgagcacaaaaaattggcggaagccatcttcaaactcacataccaaaataaggtcgttcgggtacagcgccctactccgcggggcacagtgatggacatcattagcaggaaggaccagagagggagtggccaagtcggaacatatggcctaaataccttcacaaatatggaggcacaacttattcgacaaatggagggcgaaggaatattcaaaagcatccaacatctcacggcaaccgaagagatcgctgtacaaaactggcttgctagggtaggacgcgagagactgagccgaatggcaatatccggagacgactgcgtcgtaaagccgatagacgaccggttcgcgtccgcactcaccgcccttaatgatatgggaaaggtacgcaaggacatccaacaatgggaaccttcccgcgggtggaacgactggacgcaggtgccattctgtagccatcactttcacgaactagtgatgaaggacggtcgagtgctcgtagtgccctgtaggaatcaagacgaactgattgggcgagcacgcatctcgcaaggcgccggctggtcgttaaaagaaaccgcgtgcctgggaaagtcctatgcccaaatgtggactctaatgtacttccacaggcgggacctcaggctggcagcgaacgcaatatgcagcgcagtgccctctcattgggtgccgacaagccgcacaacctggtcaatccacgctaaacatgaatggatgaccactgaagacatgcttgcggtctggaaccgtgtttggatccaggaaaacccatggatggaagacaaaacgcctgtagagtcctgggaagaagtaccttacctcggaaagcgagaggaccagtggtgcgggtcgctaataggcctcacatccagagccacgtgggcgaaaaatatccaaaccgccatcaatcaagttaggtccctaatcggcaatgaaggatacacagactacatgccgagcatgaagcgatttagacgggaagaagaagaagccggggtgctatggtaa

SEQ ID NO: 24821 - RNA, 9876 nt, synthetic construct
  misc_feature 1..9876: note = derived and/or modified CDS sequence (opt11) from DENV-2__KF744403__SS-prME
  source 1..9876: mol_type = other RNA
accgccgggatgatcatcatgctgatccccaccgtgatggccttccacctcaccacccgaaacggggagcctcacatgatcgtcagccggcaggagaaaggcaaaagcctgctgttcaagaccgaggacggggtgaacatgtgtaccctcatggcgatggacctgggggagctgtgcgaggacaccatcacctacaagtgccccctcctgcgccagaacgagcccgaggacatcgactgctggtgcaacagcacctccacctgggtgacctatgggacctgcaccaccacgggcgagcacagacgggagaagcggagcgtagccctggtcccgcacgtggggatggggctcgagacccgcaccgagacctggatgtcctccgagggcgcctggaagcacgcccagcggatcgagacgtggatcctgcgccatcccgggttcaccctgatggccgctatcctcgcctacaccattggcactacgaactttcagcgggccctgatcttcatcctgctcaccgctgtcgcgccctccatgaccatgaggtgcatcgggatcagcaaccgagacttcgtggagggcgtttccggcgggtcctgggtcgacatcgtactggagcacggttcctgcgtgaccacgatggccaagaacaagcccaccctggacttcgagctcatcaagaccgaggccaagcagcccgccacactgcgcaagtactgcatcgaggccaagctgacgaacaccaccaccgagagccggtgcccgacgcagggggagccctccctcaatgaggaacaggacaagcgcttcgtctgcaagcacagtatggtggaccgaggttggggcaacgggtgcggcctgttcgggaagggcgggatcgtgacctgtgcgatgttcacgtgtaagaagaacatggagggcaagatcgtccagcccgagaacctggagtacaccatcgtgatcacccctcactccggcgaggagcacgccgtggggaacgacaccgggaaacacgggaaggagatcaagatcaccccgcagagctccatcaccgaggccgagctcacaggctacgggaccgttaccatggagtgcagcccccgcaccggcctggacttcaatgagatggtgctgctgcaaatggagaacaaggcctggctggtgcaccggcagtggttcctggatctccccctgccctggctaccaggcgctgacacccagggttccaactggatccagaaggagacgcttgtcaccttcaagaacccccacgcgaagaagcaggacgtcgtggtcctgggcagccaggagggggccatgcacaccgccctgaccggagccacggagatccagatgagctccggaaacctcctgttcaccggccacctgaagtgccgccttcggatggataagctgcagctgaagggtatgagctactccatgtgcaccgggaagttcaaggtggtcaaggaaatcgccgagacgcagcacggaacgatcgtggtgcgcgtccagtacgagggcgacggcagcccctgcaagatccccttcgaaatcatggatctcgagaagcgacacgtgctgggccgcctgatcaccgtgaacccgatcgtgaccgagaaggactcccccgtgaatatcgaggcggagccgcccttcggtgacagctacgtgatcatcggcgtcgagccggggcagctcaagctgaactggttcaaaaagggcagcagcatcggtcagatgttcgagaccacgatgcgcggcgccaagcggatggccattctgggcgacaccgcctgggacttcgggtcactcggcggggtgtttaccagcataggcaaggccttacaccaggtgttcggggcgatctacggggcggccttctccggagtctcctggaccatgaagatcctgatcggggtgatcatcacgtggatcggcatgaactcccgcagcacctccctgagcgtgtccctcgtcctggtgggggtggtcaccctgtacctcggagtggtggtccaggccgacagcgggtgcgtagtgtcatggcggaacaaagagttgaagtgcggctccggcatcttcatcaccgacaacgtccacacgtggaccgagcagtacaaattccagcccgagagcccctccaagctggcgagcgccatccaaaaggcgcaccaggagggtatatgcggcatccgctccgtgacccggctggagaacctgatgtggaagcagattaccccagagctgaaccacatcctcagcgagaacgaggtgaagctgacgatcatgaccggggacatcaagggcataatgcacgccgggaagcgctccctgcggccgcagcccacggagctccgctacagctggaagacctggggcaaggccaagatactgtctactgagagccacaatcagaccttcctgatcgacgggcccgagaccgccgagtgcccgaatacaaaccgggcctggaattccctcgaggtcgaggactacgggttcggcgtgttcacgactaacatctggctgcggttacgggagaaacaggacgccttctgcgacagcaagctcatgtccgccgccatcaaggacaaccgagcggtgcacgcggacatgggatactggatcgagagcgccctgaacgacacctggaagatcgagaaggcctccttcatcgaggtcaagagctgccactggcccaagtcccacaccctgtggagcaacggcgtgctcgagtcagagatgatcatccccaagaacttcgccggcccggtgtcacagcacaactaccggccggggtaccacacccaaacggcgggcccctggcacttggggaaactggagatggacttcgatttctgcaagggcaccaccgtcgtggtgacggaagactgcgggaaccgcggccccagcttgcggacgaccaccgcctccggcaagctgatcaccgagtggtgctgccgcagctgcacgctgcccccactccggtaccgcggggaggacggatgctggtacggtatggagatccggccactgaaggagaaggaggagaacctggtctccagcctcgtaaccgccggccacgggcagatcgacaacttctccctgggcgtgctgggcatggccctcttcctagaggaaatgctgcgcacccgggtcgggaccaagcacgcgatcctcctggtggccgtgagcttcgtcacgctaatcaccggcaacatgtcattccgggacctcgggcgcgtgatggtgatggtcggcgctacgatgacagacgacatcgggatgggcgtgacgtacctggcgctgctcgcagcgttcaaggttcggcccacctttgcggccggcctgctgctccgcaagctgaccagcaaggagctgatgatgaccacgatcgggatcgtcctcctgtcccagagcaccatccccgagaccatccttgagctcacggacgccctggctctggggatgatggtgctcaagattgtgcggaaaatggagcgctaccagctggcggtaacgatcatggccatcctttgcgtgccgaacgccgtcatcctccagaacgcctggaaggtgtcctgcaccatcctggccgtggtcagcgtgagccccctgctcctgacaagctcccagcagaaggcagactggatccccttagccttgaccatcaaggggctgaaccccacggccatcttcctgaccacccttagccggacctccaagaagcgctcctggccgctgaacgaggccatcatggcggtgggcatggtcagcatcctggcctcaagcctcctgaagaacgacatccccatgacgggccccctggtggccgggggcctcctgaccgtgtgctacgtcctgaccgggcggtccgctgacctcgagctggaaaaggctgcggacgtgcgctgggaggaccaggccgagatcagcggctccagccccatactgtccatcatcatcagtgaagacgggtccatgagcatcaagaacgaggaggaggagcagaccctcacgatcctgatccggaccggcctgctcgtgatctctggcctgttcccggtcagcatccccatcaccgccgccgcctggtacctgtgggaggtgaagaagcagcgcgcaggtgtcctctgggacgtcccctcacctccgcccgtgggcaaggccgagcttgaggacggggcctaccggatcaagcagaagggaatcctggggtacagccaaatcggcgccggcgtgtacaaggaggggaccttccacaccatgtggcacgtcacgcggggcgccgtgctcatgcacaaggggaagcggatcgagccctcctgggcggacgtgaaaaaggacctgatcagctacggcgggggctggaaactggaaggtgagtggaaggagggggaggaggtccaggtgttagccctggaacccggcaagaacccccgcgccgtgcagaccaagcccgggctgtttaagaccaacgccggcaccatcggggccgtcagcctcgacttcagccccggcacgtccgggagccccatcatcgacaagaaggggaaggtggtgggcctgtacgggaacggcgtcgtgacccggaacggctcctacgtgagcgcaatcgcccagaccgagaaatccatcgaggacaaccccgagatcgaggatgacatcttccgcaagaagcggctcaccattatggaccttcacccgggggccggcaagacgaagcgctacctccccgccatcgtccgggaggcgatcaagcgcgggctgcgaaccctgatcctggccccgacccgggttgtggccgccgagatggaggaggccctgcgcggcctgcccatccggtaccagacccccgcgatccgcgccgagcatacggggcgggaaatcgtagacctgatgtgtcacgccaccttcaccatgcgcctgttatcccccatccgggtgccgaactacaacctcatcatcatggacgaggcccacttcaccgaccccgccagcattgcggcacgcggctacatctccacgcgggtggagatgggcgaggccgccgggatcttcatgaccgccacgccccccggctcacgcgacccgtttccccagtccaacgcgcccatcatggacgaggagcgggagatccccgaacgcagctggaactcgggccacgagtgggtcaccgacttcaagggcaagacagtgtggttcgtgccgagcatcaaggccgggaacgacatcgccgcctgcctgcgaaagaacggcaagaaggtcatccagttatccagaaagaccttcgacagcgagtacgttaagacccggaccaacgattgggacttcgtggttacgacagacatatccgagatgggcgcgaacttcaaggccgagcgcgtgatcgacccccggaggtgcatgaagcccgtaatcctcaccgacggggaagagcgggtcatcctggccgggcccatgccggtgacccacagctccgccgcccagcgccgcgggcggataggccgcaaccccaagaacgagaacgatcagtatatctacatgggggaacccctggagaacgacgaggactgcgcgcactggaaggaggccaaaatgctcctggacaacatcaacacgcccgagggcataatcccgagtatgtttgagcccgagcgggaaaaggtggatgctatcgacggcgagtaccgcctgcgcggggaggctcgcaagacctttgtcgacctcatgcggcgcggcgacctgcccgtgtggctagcctacaaggttgccgccgaggggatcaactacgccgaccggcgctggtgcttcgacggcatccggaacaaccagatcctcgaggagaacgttgaagtggagatctggaccaaagaaggggagcgcaagaagctcaagccgcggtggctggacgcccgcatctactccgaccccctcgccctcaaggagttcaaggaattcgcggccggtcggaagtcactgaccctcaacttgatcacagagatggggcgcctgcccaccttcatgacccagaaggcacgggatgccctcgacaacctggcagtcctgcacaccgctgaggccgggggccgcgcgtacaatcacgccctctccgaactgcccgagacgctggagatcctcctgctgctcaccctgctggcgacggtgacggggggcatcttcctattcctgatgagcggccgggggatcggcaagatgacgctggggatgtgttgcatcatcacggcctccatcctcctgtggtacgcccagatccagcctcactggatcgccgccagcatcatcctggagttcttcctcatcgtgctgctgatccccgagcccgagaagcaacgtacgccccaggacaaccagctcacctacgtcgtgatcgcgatcctgaccgtggtcgccgccaccatggccaacgagatgggctttctggagaagaccaagaaggacctcgggctgggcagcatcaccacccagcagcccgagtccaacatcctggacatcgacctccggcctgccagcgcgtggacgctatacgccgtcgccaccaccttcatcacccccatgctgcgccactccatcgagaacagctccgtgaacgtcagcttgacggccatcgccaaccaagcgaccgtgctgatgggcctggggaagggctggcccctctccaaaatggacatcggggtgccactgctggcgattggctgctacagccaggtcaaccccatcaccctaaccgccgctctgctgctcctggtggcgcactacgcgataatcgggcccggcctgcaggccaaggccacccgcgaggcccagaagcgggcggccgccggcatcatgaagaaccccaccgtggacgggatcaccgtcatcgacctcgacccgattccatacgaccccaagttcgagaagcagctgggccaggtgatgctgctcgtgctgtgcgtcactcaggtgctgatgatgcgcactacctgggccctctgcgaggccctgaccctggcgaccgggcccatctccacgttgtgggagggcaatccggggcggttctggaacaccaccatcgccgtgagcatggctaacatcttccgcggctcctacctggccggcgccgggctcctattctctatcatgaagaacaccacgaacacccggcgcggcaccggcaacataggcgagaccctgggcgagaagtggaagtcccggctcaacgcgctcggcaagagcgagttccagatctataagaagtccggcatccaagaggtcgaccgcacgctggcaaaggaggggatcaagagaggcgagaccgaccaccacgccgtgagccgcggatccgccaagctgcggtggttcgtggagcgcaacatgatcacgcccgaaggcaaagtcgtggacctcggctgcgggcgtggcgggtggagctactactgcggcgggctgaagaacgtgcgcgaggtcaagggcctgaccaagggcgggcccggccacgaggagcccatccctatgtctacgtacgggtggaacctcgtgcggctgcagagcggcgtggacgtcttcttcacaccgcccgagaagtgcgacactctgctctgcgacatcggggagagctcccccaacccgacggtggaggcgggccgaacgctgcgggtgcttaacctcgtcgagaactggctgaacaacaacacacagttctgcatcaaggtgctgaacccttacatgcccagcgtgatcgagaagatggaggccctgcagcggaagtacggcggggccctcgtccggaacccgctatcccgcaacagcacccacgagatgtactgggtatccaacgccagcggcaacattgtgtccagcgtcaacatgatctctcgcatgttaatcaaccggttcaccatgaaacataagaaggccacctacgagcccgacgtggacctcgggagtggcacgcggaacatcgggatcgagtccgaggtgcccaacctggacatcatcggcaagcggattgagaagatcaagcaggagcacgaaaccagctggcactacgaccaggaccacccctacaagacctgggcgtaccacggctcctacgagaccaagcagacggggagcgcctccagcatggtgaacggcgtggtgcgcctgctcaccaagccgtgggacgtcatccccatggtgacccagatggccatgaccgacacgacccccttcgggcagcagagggtgttcaaggaaaaggtagacacccgcacccaggagcccaaggagggcacgaagaagctgatgaagatcacggccgagtggttatggaaagagctcggcaaaaagaagaccccgcggatgtgcacccgcgaagaattcacgcggaaggtgcgctctaacgccgcgctgggggccatcttcaccgacgaaaacaagtggaagtccgcgagggaggccgtggaggactcccgcttctgggagctggtcgacaaggagcggaacctccacctggagggcaagtgcgagacctgcgtgtacaacatgatggggaagcgcgagaagaagctgggcgagttcgggaaggccaagggctcacgtgcgatttggtacatgtggctcggcgcccgcttcctggagttcgaggccctggggttcctcaacgaggaccactggttcagccgggagaactccctgagcggcgtcgagggggagggcctgcacaagttagggtacatcctgcgcgacgtttccaagaaggagggcggcgccatgtacgcggacgacaccgccgggtgggacacgcggatcaccctggaggacctcaagaacgaggagatggtgacgaaccacatggagggcgagcacaagaaactggccgaggccatcttcaagttgacataccagaacaaggtcgtgcgcgtgcagcggcccacgccccgcgggacggtcatggacatcatcagccgccgggaccagcgcggctccggccaggttggcacctacggcctcaacacattcacgaacatggaggcccagctgattagacagatggagggcgagggcgtcttcaagagcatccagcatctcaccgcgaccgaggagatcgccgtccagaactggctcgcccgcgtggggcgggaacgcctgtccagaatggccatcagcggcgacgattgcgtcgtcaaacccctggatgaccgcttcgcctccgcgctcaccgccctcaacgacatgggcaaggtgcggaaggacatccagcagtgggagccgagcaaggggtggaacgactggacccaggtgcccttctgctcccatcacttccacgagctgatcatgaaggacggccgcgtcctcgtggtgccctgcaggaaccaagacgagctgatcgggcgcgctaggattagccagggcgcagggtggtccctccgagagaccgcctgtctcggcaagagctacgcccagatgtggtccctgatgtacttccaccggcgcgacctgcggcttgccgccaacgccatctgcagcgccgtcccctcccactgggtcccgaccagccgcaccacgtggagcatccatgcgaagcacgagtggatgaccaccgaggacatgctgaccgtgtggaaccgggtttggatccaggagaatccttggatggaggataagacccccgtggaatcctgggaggagatcccatacctgggcaagcgcgaggaccagtggtgcgggagcctcatcggcctgacgtctcgcgccacctgggccaagaacatccaaacagccatcaaccaggtgcgcagcctgatcgggaacgaggagtacaccgactacatgccgtccatgaagcgcttccggcgcgaggaggaggaggcgggcgtcctctggtga

SEQ ID NO: 24822 - RNA, 9876 nt, synthetic construct
  misc_feature 1..9876: note = derived and/or modified CDS sequence (opt11) from DENV-2__KF744406__SS-prME
  source 1..9876: mol_type = other RNA
accgccgggatgatcatcatgctgatccccacggtgatggccttccacctcaccacccggaatggggaaccacacatgatcgtctcccggcaggagaaggggaagagcctgctattcaagaccgaagatggggtgaacatgtgcaccctgatggcaatggacctaggcgaattgtgcgaggataccatcacctacaagtgccccctccttcgccagaatgagcccgaggatatcgactgctggtgcaacagcactagcacatgggtgacgtatgggacctgcacaaccacgggtgagcacaggcgcgaaaagcggagcgttgcactggtaccccacgttggcatggggctcgagactcgcactgagacctggatgtcctcggagggcgcctggaagcacgcccagcggattgagacttggatcctacgccaccccgggtttaccctgatggccgcgatacttgcctacacgatcggcacaacgaacttccagcgggctctgatcttcatcctgcttaccgccgtcgcgccctccatgaccatgcgctgcatcgggatcagcaaccgggacttcgtcgagggcgtttctggcgggtcatgggtcgacatcgtactggagcacggctcctgcgtgacgacgatggcaaagaacaagcccaccctggatttcgagctcatcaagaccgaggccaagcagcccgccaccctaaggaagtattgtatagaggccaaactgacgaacacaaccaccgagagccggtgcccgacacagggggaaccgtccctgaacgaggagcaggataagcgcttcgtctgcaagcactcgatggtggacaggggttggggcaacgggtgtggcttattcgggaagggcgggatagtgacctgcgcgatgttcacgtgcaagaagaacatggagggaaaaatcgtccagcccgagaacctagaatacaccatcgtgatcacgccccactccggcgaggagcacgctgtaggcaacgacaccggcaagcacggcaaagagatcaagatcaccccgcagagctccatcaccgaggccgagctcaccggctacgggacggtgactatggagtgcagcccacgcaccggcctggactttaacgaaatggtgctgctgcagatggagaacaaagcatggctggtgcaccggcagtggttcttggacctccccctgccctggctgccgggcgccgacacccaagggagtaactggatccaaaaggagacgctcgtcaccttcaagaacccccatgcgaagaagcaggacgtggtggtactgggcagtcaggagggcgccatgcacaccgccctgaccggcgccacggagatccagatgagctccgggaatctccttttcaccggacacctgaagtgcaggctccggatggacaagctgcaactgaagggcatgagttactccatgtgtaccgggaagttcaaggtcgtgaaagagatcgccgagacccagcacggcacgatcgtggtgcgcgtccagtacgagggggacggctccccctgcaagatccccttcgagatcatggacttggagaaacgccacgttctgggccgcctcatcaccgtgaaccccatcgtcaccgaaaaggattcccccgtaaacatcgaggcggagccgcccttcggggacagctatgtaatcatcggcgtcgaaccggggcagctcaagcttaactggttcaaaaagggatccagcattgggcagatgttcgaaacaacgatgcgtggtgccaagcggatggctatcctgggcgataccgcctgggacttcgggagcctcgggggggtgttcaccagcatcggcaaggcattgcaccaggtatttggggcgatctacggcgccgcattctccggcgtgagctggaccatgaagatccttatcggggtcatcatcacgtggatcggcatgaactcccggagcacttcgctaagcgtgtcgcttgtcttggtgggggtggtcacactgtacctcggggtggtggtgcaggccgactcggggtgcgtggtgtcctggcgtaacaaagaactaaagtgcggcagcggcatctttataaccgacaacgtccacacgtggacggagcagtacaagttccagcccgagagcccctccaagctcgcgtccgccatacaaaaggcccaccaggaggggatctgtggcatccgctccgtcacccggctcgagaacctgatgtggaagcaaattacccccgagctgaaccacatcctcagcgagaatgaagtgaagctgacgatcatgaccggtgacattaagggcatcatgcacgcagggaagaggtccctccggccgcaacctaccgagctccgctacagctggaagacctggggcaaggccaagattctgtccaccgagtcgcacaaccagacctttctgattgacggacccgaaacagcagagtgccccaatactaaccgtgcttggaactcactcgaggtcgaggactacgggttcggcgtgttcacgaccaacatctggctgcgcttgcgggagaagcaggacgccttctgtgacagcaagctcatgtccgcagccatcaaggacaaccgcgccgtgcacgccgacatggggtactggatcgagagcgccctaaacgacacgtggaagatcgaaaaggcctcgttcatcgaggtcaagagctgtcactggcccaagtcccacaccctgtggagcaatggcgtacttgagtccgagatgatcatccccaagaacttcgcaggccccgtgagccagcataactatagaccggggtaccacacccagacggcggggccctggcacctggggaagctggagatggacttcgacttctgtaagggcaccactgttgtggtgactgaggactgcgggaaccgcggccccagcctccgaacgacgaccgccagcggcaagctgatcaccgagtggtgctgccgcagctgcactctgcccccactccgataccgcggggaggacgggtgctggtacgggatggagatccggcctctgaaggagaaggaggagaacctggtctccagcctcgtgacggccgggcacgggcagatcgacaacttctcccttggtgtgctgggcatggccctctttctcgaggagatgctgcgcacccgggttgggaccaagcacgcgatcctcctggtggccgtgagcttcgtcacgctgatcaccggcaatatgtccttccgagacctcgggcgtgtgatggtgatggtcggcgccaccatgaccgacgacatcgggatgggcgtcacgtacctggccctgctcgccgcattcaaagtgcggcccaccttcgccgccggacttttactgcgtaagctgacctcgaaggagctgatgatgacgacgatagggatcgttctcctgtcccagagcaccatccccgaaaccatcctggagttaaccgacgccctggccctggggatgatggtgctcaagatagtgcggaagatggagcgctaccaactcgctgtcactattatggcaatcctgtgcgtgccaaacgctgtcattctccagaacgcatggaaggtgagctgcacaatcctggcagtggtgagcgtgagccccctgctattgacctcttcgcagcagaaggcggactggattcccctagctctcacaattaaggggctgaaccccacggccatatttctgaccactctcagccggacctccaagaagcgcagctggccgctcaacgaggcaatcatggcggtcggcatggtctccatccttgccagctctcttctgaaaaacgacatccccatgacgggcccccttgtagccgggggcctcctgaccgtgtgctatgtcctaaccgggcggtccgccgatctcgagcttgagaaggccgcggacgtgcgctgggaggaccaggctgagatcagcgggtcctcccccatcctgtccataatcatcagcgaggacgggtccatgtctatcaagaatgaggaggaggagcaaaccctgacgatccttatcaggaccggcttactcgtgatatccggcctgttccccgtcagtatccccatcaccgctgccgcctggtacctgtgggaggtgaagaagcaacgcgcgggggtgctctgggacgtcccgagcccgccccccgttggcaaggccgagttagaggacggggcctaccggatcaaacagaagggcatcctggggtacagccagatcggcgctggcgtgtacaaggaggggaccttccacaccatgtggcacgtcacgcgcggcgccgttctcatgcacaaggggaagcggatcgaaccgtcctgggccgacgtgaagaaagacttgatctcttacggcgggggctggaaactggagggggagtggaaggagggtgaggaggtccaggtgctcgccctggagcccggcaagaacccccgcgccgtgcagaccaaacccgggctgttcaagaccaacgccggcaccatcggggccgtctccctcgactttagccccggcacgagcggctctcccatcatcgataagaaggggaaggtggtaggcctttacgggaacggcgtagtgactcggaacggttcctatgtgtctgcgatagcccagaccgaaaagtccatcgaggacaaccccgagatcgaggacgatatcttccgcaagaagaggctgaccatcatggacctgcaccccggggccggcaagacgaagcgctatctccccgccatcgtccgggaagcgatcaagcgggggctgaggacgctgatcctcgccccgacccgggtcgtggccgccgagatggaggaggccctgaggggcttacccatccggtaccagacccctgcgatccgcgccgaacacacagggagagagattgtcgacctcatgtgccacgccactttcaccatgcgcctgctgtcccccatccgggtgcccaactacaacctaatcatcatggacgaggcccacttcaccgaccccgccagcatcgcggcacgcggctacatctcgacgcgggtagagatgggcgaggccgcggggatcttcatgacagccacgccgccaggaagccgggacccgttccctcagtccaacgctcccatcatggacgaggagcgggaaatccccgagcgcagctggaacagtggtcatgagtgggtcaccgatttcaagggcaagacggtgtggttcgtgccgtccatcaaggccgggaatgacatcgctgcctgcctccggaagaacggcaagaaggtcatccagctgagccgtaagaccttcgactcagagtacgtcaagacccgtaccaacgactgggactttgtagtcacgaccgacatttccgagatgggcgcaaacttcaaggccgaacgcgtgatcgacccccggcgctgtatgaaacccgtgatcctcacagatggagaggagcgggtcatcctggccggacccatgccggttacacacagctccgcagcccaacgcagggggcggatcggacgcaaccccaagaatgagaacgaccagtacatttacatgggtgagccgctggaaaacgacgaggactgcgcgcactggaaggaagccaagatgctcctggacaacatcaacacgcccgagggcatcattccgagcatgttcgagcccgaacgggagaaggtcgacgctatcgacggcgaatatcgcctgcgtggggaggcccgcaagacctttgtggacctcatgcggagaggcgacctgcccgtgtggctggcctacaaggtggcggccgaggggataaactacgccgataggcgatggtgctttgacggcatccggaacaaccagatcctcgaagagaacgtcgaagtggagatctggacgaaggagggcgagcgcaagaagctgaagccgcgctggctggacgcccgcatctactccgaccccctcgcgctgaaggagtttaaggaatttgctgccggtcggaagtccctgaccctcaacctgataactgagatgggccgcttacccaccttcatgacccagaaggcccgggacgccttggacaacctggcggtgctccataccgccgaagccgggggccgtgcctacaaccacgccctctccgagctgccagagacgctggagatcagtcttctgttaaccctcctggcaaccgtgaccgggggcatctttctgttcctcatgtccggccgtggcatcggaaagatgacgctagggatgtgttgcatcatcaccgccagcatcctgctctggtacgcccagatccagccgcactggatcgcagccagcattatcctggagttcttcctgatcgtgctcctgatccccgagcccgagaagcagcgcacaccccaggacaatcagctgacctacgttgtgatcgcgatcctcactgtggtcgccgccacgatggccaacgagatgggtttcctcgagaagaccaagaaggacctggggctcggctccattaccacccagcagcctgagagcaacatcctggacatcgacttacggcccgcctccgcatggacgctctacgctgtggccaccaccttcatcacccccatgctgcgccatagcatcgagaactccagcgtgaacgttagcctgacggccatcgccaaccaagcgacggttttaatgggcctggggaagggatggcccctgagcaagatggacatcggggtgccgctcctggccataggctgctactcccaggtcaaccccatcaccctgaccgccgctctgctgctgctggtggcccactatgctatcatcggcccaggtctgcaggctaaggccacgcgcgaagcacagaagcgggctgccgccggcatcatgaagaaccccaccgtggatgggatcaccgtcatcgacctggaccccatcccttacgaccccaagttcgaaaagcaactcggccaggtcatgctgttagtcctttgcgtcacccaggtgctgatgatgcgcactacctgggccctgtgcgaggccctcaccctggcgaccgggcccatcagtacgctttgggagggcaacccggggcggttctggaacaccaccatcgccgtgtccatggctaatatcttccgcggcagctacctggccggcgccgggctgctgttcagtatcatgaaaaacaccacaaacactagacgcggcaccgggaacatcggcgaaaccttaggcgagaagtggaagtcgcggctgaacgcgctcgggaagtccgagttccagatctacaagaagtcagggatccaggaagtagaccgcacgctcgccaaagagggaattaaacggggcgagaccgaccaccatgcggtgtcccgcggtagcgccaagctgcggtggttcgtggaaaggaatatgatcacccccgagggcaaggtcgtggacctgggctgcgggcgcggtggttggtcctactactgcggcgggctcaagaacgtgcgcgaagttaagggcctgaccaagggcggtcccggccacgaggagcccattccgatgagcacttacggatggaaccttgtgcggctccaaagcggcgtggacgtcttctttacgccgcccgagaagtgcgacaccctgctgtgcgacatcggggagtccagccccaatccaaccgtggaggcgggccgcacgctccgggtgctgaacttagtcgagaactggctcaataacaacactcagttctgtataaaggtgttgaacccatacatgccctccgtgatcgaaaaaatggaagccctgcagaggaagtacggcggggcgttagtccggaacccgctctcccgaaactccacccacgagatgtactgggtgagcaacgcctccggcaacatagtgagcagtgtgaacatgatcagccgcatgctgattaaccggttcaccatgaagcacaagaaggcaacctacgagcccgacgtggacctgggctcgggcacgcgcaacatagggatcgagagcgaggtgcccaacctcgacatcatcggcaagcgtatcgagaagatcaagcaggagcacgagaccagttggcactacgatcaggaccacccgtacaagacctgggcataccacggcagctacgagaccaagcagaccgggtccgctagttccatggtcaacggtgtggttcgcctgctgacgaaaccctgggatgttatcccaatggtgacccaaatggcaatgacggacactacgcccttcgggcagcaacgggtgttcaaagagaaggtcgatacccgcacccaagagccgaaggagggcacgaagaagctcatgaagataaccgccgaatggctgtggaaggagctggggaagaagaagacaccacgcatgtgcacccgtgaagagttcacccggaaggtgcgcagcaacgccgcgctcggggcaatcttcactgacgagaataagtggaagtccgcccgggaagccgtggaggatagtcgattctgggagctggtcgacaaggaaaggaacctgcacctcgagggaaagtgcgagacctgcgtgtacaacatgatggggaagagggagaagaagctgggcgagttcggtaaggccaaggggagccgtgccatctggtacatgtggctgggcgcccgcttcctagagttcgaggcgctggggttcctgaacgaggaccactggttctcccgggagaacagcctctccggcgtcgagggtgaaggcctgcacaaactggggtacatactccgagatgtgtctaagaaagagggcggagccatgtacgcggacgacaccgccgggtgggacactaggatcaccctggaggatctgaagaacgaggagatggtgaccaaccacatggagggcgagcacaagaagctcgccgaggccatattcaagttgacttaccagaacaaggttgtgcgcgtgcagcggcccacgcctcgcgggaccgtgatggacataatctcccgccgggaccagcgcggcagcggccaagtgggcacctacggcctgaatacttttacgaatatggaggcccaactcatacggcagatggagggggaaggtgtgttcaagtccatccagcacctgaccgcgaccgaggagatcgccgtccagaactggctggcccgtgttggccgggagcggctaagtagaatggccatctccggcgacgactgcgtggtcaagccgttagacgatcgcttcgccagtgcgttgaccgccctcaacgacatggggaaggtgcgcaaagacatccagcagtgggagccgtccaagggctggaatgactggacgcaggtgccgttctgcagccaccacttccacgagctaatcatgaaggacggccgcgtcctggtggtgccttgccgcaaccaggacgagctcatcgggcgcgcccggatctcccagggcgccgggtggagcctgcgcgagacggcctgcttgggcaagtcctatgcgcagatgtggagcctcatgtactttcaccgccgcgatcttcggctagccgctaacgccatctgctccgccgtccccagccactgggtgccgaccagccgcactacatggtccatccatgcaaaacatgagtggatgaccactgaagacatgctcaccgtgtggaaccgggtctggatccaggagaatccctggatggaggacaagacacccgtggagagctgggaggagatcccctacctgggcaagcgtgaagaccagtggtgtgggtccctgatcggactcacgagccgcgccacgtgggccaagaacatccagacggctatcaatcaggtgcggtccctgatcgggaacgaggagtacaccgactacatgccaagcatgaagcgcttccggcgcgaggaggaggaggcgggagtcctgtggtga

SEQ ID NO: 24823 - RNA, 9876 nt, synthetic construct
  misc_feature 1..9876: note = derived and/or modified CDS sequence (opt11) from DENV-2__KF744404__SS-prME
  source 1..9876: mol_type = other RNA
accgccgggatgatcatcatgctgatccccactgtgatggccttccacctaaccacccgcaatggggaaccccatatgatcgttagccggcaggagaaggggaagtcactgttgttcaagaccgaggacggggtcaacatgtgcacccttatggctatggacctgggtgagctgtgcgaggacacaatcacctacaagtgccccctcctgcgccagaacgagccggaggacatcgattgttggtgcaacagcaccagcacctgggtgacctacgggacctgtacaaccacgggcgagcaccggagggagaagcgcagcgtcgcgctggtgccccatgtaggcatgggactcgaaaccagaaccgagacctggatgtcctcggagggggcctggaagcacgcccagcggatcgagacgtggatcctgcgccaccccggattcaccctcatggctgcgatcctcgcctacaccatcggcaccacgaacttccagcgggccctcatctttatcctgctcaccgcagtcgcgccctccatgacaatgcgctgcattgggatctcaaatcgggacttcgtggagggcgtttccggcgggagctgggtcgacatcgtgcttgaacacggcagctgcgtaaccacgatggccaagaacaagcccaccctggacttcgaattgatcaaaaccgaggccaagcagcccgccaccctgcgcaagtactgtatcgaggccaagctaacgaacaccaccactgagagccggtgcccgacgcagggggagccgtcgctcaacgaggagcaggacaagcgcttcgtctgcaaacacagcatggtggaccggggctggggcaacgggtgcggcctgttcggcaagggcgggatagtaacctgcgcgatgttcacgtgcaagaagaacatggagggcaagatcgtccagccggagaacttggaatacaccatcgtgatcactccccatagcggcgaggagcacgccgtggggaacgataccggtaagcatgggaaggagatcaagataacccctcagtcatcgatcactgaggccgagctcaccggctatgggaccgtcaccatggagtgcagcccccgcacaggcctggacttcaacgagatggtgctgctccagatggagaacaaggcctggctagtgcatcggcagtggttcctggacctccccctgccctggctgcccggcgccgacacccaggggtccaactggatccagaaggagacgctcgtcactttcaagaacccccacgctaagaagcaggacgtggtggtcctgggatcacaggagggtgccatgcacaccgcactgaccggcgccactgagattcagatgagcagcggcaacctgctgtttaccgggcacctgaagtgccgccttcggatggacaagctgcagctgaagggtatgagctactctatgtgcaccgggaagttcaaggtcgtcaaggagatcgctgagacccagcacggcacgatcgtagtgcgcgtccagtacgagggggatggctcaccctgcaagatccccttcgagatcatggatcttgaaaaacggcacgtgttgggccggctcatcaccgtgaacccgatcgtcaccgagaaagactcgcccgttaacatcgaagcggagccgcccttcggagacagctacgtgatcatcggcgtcgagccggggcagctcaagctgaactggtttaagaaaggctccagcatcgggcagatgtttgagaccacgatgcgcggcgccaagcgaatggcaatcctcggcgacacagcctgggacttcgggtccctcggcggggtgttcaccagcatcggcaaggccctacaccaggtgttcggggccatctacggcgctgccttctccggagtaagctggaccatgaagatcctaataggggtgatcatcacgtggatcggcatgaactcccgcagcacttccctgtctgtgagcctagtcttggtgggggtggtcaccctgtacctcggcgtagtggtccaggccgacagcgggtgcgtggtgtcctggcggaacaaggagctgaagtgcggcagcggtatcttcattaccgacaacgtccacacgtggaccgagcagtacaagttccaacccgagagcccctccaaacttgcgtcagccatccagaaggcccaccaggaagggatctgcggcatccgctccgtgacccggttggagaacctaatgtggaagcagatcaccccggagctaaaccatatcctctcggagaacgaggtgaagctgacgatcatgaccggggacataaagggcatcatgcacgctgggaagagatccctgcggccgcaacccaccgagctccgctacagctggaagacgtggggcaaggccaaaatcctgagtacggagagccataaccagaccttcctgatagacggccccgaaactgcggagtgtccgaataccaatcgggcctggaactccctcgaggtcgaggactacgggttcggcgtcttcacaactaacatttggctgcgcctgcgggaaaagcaggacgccttctgcgacagcaagctgatgtccgccgccattaaggataaccgcgcagtccacgccgatatggggtactggattgagagcgcgttaaacgacacctggaagattgagaaggcttccttcatcgaggtcaagagctgccactggccaaagtcccacaccctctggagcaacggtgtgttggaatcagaaatgatcatccctaagaatttcgccgggcccgtgagccagcacaattaccgaccggggtaccatacgcagacggcgggcccctggcacctggggaagctggagatggacttcgacttttgcaaaggcaccacggtcgtggtgaccgaggactgcggtaaccgcggccctagcttgcggacgaccaccgccagcggcaagctaatcaccgaatggtgctgccgaagctgcacgctgccacccctccggtaccgcggggaagacgggtgctggtacggaatggagatacggcccctcaaggagaaagaggaaaacctggtctccagcctcgtgaccgccggccacgggcagatcgataatttctccctgggcgtgcttggcatggccctcttcctggaggagatgctgcgcacacgcgtcgggacaaagcacgcgatcctcctggtagccgtgagcttcgtcacgctgatcaccggcaacatgtcttttcgggacctcgggcgcgtgatggtgatggtcggcgccacgatgaccgacgacatcggaatgggcgtgacgtacctggccttgctcgccgcgtttaaagtgcggcccaccttcgccgctggcctgctgctcagaaagctgacctctaaggagctgatgatgaccaccattggtatcgtcctgctgtcccagtccaccatccccgagaccatacttgagctaaccgacgccctggccttaggcatgatggtgttgaagatcgtgcggaagatggagcgctaccagctggcggtcacgatcatggccattctgtgcgtgccgaacgccgtcatccttcagaacgcgtggaaggtgtcctgcacaatcctggccgtggtgagcgtgtctcccctgctcctgaccagcagtcagcagaaagccgattggatacccctggccctcactatcaagggcctgaaccccactgccatcttcctgaccaccctcagcaggaccagcaaaaagagatcttggccgctgaacgaagcgatcatggcggtgggcatggtctccatactggccagcagcctcctaaagaacgatatccccatgacgggacctttagtggccggtggccttctaaccgtgtgctacgtactgactgggcggtccgccgacctcgagctcgagaaggcagcggacgtgcgctgggaggaccaggccgaaatcagcgggtccagccccatcctttccatcatcatcagcgaggatggttccatgagcatcaagaatgaggaggaggagcagacccttacgattctgatccgaaccggcctgctcgtgatctccggcctgttccccgtaagcatccccatcaccgcagccgcttggtacttatgggaggtgaagaagcagcgcgcgggggtgctctgggatgtccccagtcccccgcccgtgggcaaagccgagctcgaggacggggcctaccgaatcaagcagaagggaatcttagggtacagccagatcggcgccggcgtttacaaggaggggacgttccacaccatgtggcatgtcacgcgcggcgccgtgctcatgcacaaggggaagcggatcgagccctcctgggcggacgtgaagaaggacttaatctcatacggcgggggctggaagctggagggagagtggaaggagggggaggaggtccaggtactcgccctggagcccggcaaaaaccccagagcagtgcagaccaagcccggtctgttcaagacgaatgccgggaccattggcgccgtcagtctcgatttcagcccgggcacgtccggcagccccatcatcgacaagaaagggaaggtggtgggcctgtatggcaacggcgtcgtaacccggaacggctcctacgtgagtgccatcgctcagaccgagaagtccatcgaggacaacccggagatcgaggatgacatcttcaggaagaaacggttaaccattatggacctccaccccggggcaggcaagacgaagcgctacctcccagccatcgttcgggaggcgatcaagcgcggtctgcgcactctgattctcgctccgacccgggtggtggccgcggagatggaagaggccctccgtggcctgcccatccggtaccagacccccgctattcgcgcggagcacacggggcgggagatcgttgacctcatgtgtcacgccaccttcaccatgcgcttactgtcccccatacgggtgccgaactacaaccttatcatcatggacgaggcccacttcaccgacccagcgtccatcgcggcccgcggctacatctccacgcgggtggagatgggggaggcagccgggattttcatgaccgccacgccgcccggcagtcgcgaccctttcccccagtccaacgcgcccattatggacgaggagcgggagatccccgagcgcagctggaactccgggcacgagtgggtcaccgacttcaagggcaagacggtttggttcgtgccgagcatcaaggccggaaacgacatcgccgcctgccttcggaagaacggcaagaaggtcatccaattatcccgcaaaacgttcgacagcgaatacgtaaagacccggaccaacgattgggacttcgtggtcacgactgacatctccgagatgggggcgaacttcaaggccgagagagtgattgacccccgtcgctgcatgaagccggtgatccttaccgacggtgaggagcgggtcatactggccggcccaatgccagtgacccactcctccgccgcccagcgccgcgggcggatcgggcgcaaccccaagaatgagaacgaccagtacatctacatgggggagccactggagaacgacgaggactgcgcgcactggaaggaggctaaaatgctcctggacaacatcaacacgcccgagggaataatcccgagcatgttcgaacccgagagagagaaggtggacgcgatcgacggcgagtaccgcctgagaggggaggcccgcaagaccttcgtcgaccttatgcggcgcggcgaccttcccgtatggctggcctacaaagtagctgccgaggggatcaattatgccgacaggcgctggtgcttcgacggcatccggaacaaccagatcctcgaagagaacgtagaggtggagatctggaccaaggagggggagcggaagaagctgaaaccgcggtggctggacgctcgcatctactccgaccccctggccctgaaggagttcaaagagttcgcggccggacggaaatctctgaccctcaacctgatcacggagatgggccgcctacccaccttcatgacccagaaggcccgggatgccttagacaatctggcggtactgcacaccgcggaagccgggggccgcgcctacaaccacgccctgtccgaactgcccgagacgctgcagatcagcctcctgcttaccttgcttgcgaccgtgaccggcggcatcttcctgttcctcatgtccggtcgggggatcggcaagatgaccctggggatgtgttgcatcatcacggccagcatcctgctgtggtacgcccagatccagccacactggatagccgccagcatcatcctggagtttttcctgattgtgctccttatccccgagcccgagaagcagaggacgccccaggacaaccagctcacttatgtcgtgatcgcgatcctcacggtggtagccgcaacgatggccaacgaaatggggttcctggaaaagacaaagaaggacctcggactaggatccatcaccacacagcagccggagagcaatatccttgacatcgacctacgtccggcttccgcgtggacgctctatgccgtggccaccacgttcatcacccccatgctgcgccacagcatcgagaactcctctgtgaacgtatccctgacggccatcgccaaccaggcgacagtactcatgggcctggggaaaggctggcccctgagcaagatggacatcggcgtgccgctcctggccattggctgctactcccaggtcaatcccatcaccctgaccgcggcactcctgctactcgtggcgcactacgctatcatcgggcccggcttacaggccaaggcaacacgcgaggcccagaaaagagcggccgccggcatcatgaagaaccccaccgtggacgggatcaccgtcatcgatttggacccgatcccttacgatcccaagtttgaaaagcagttgggccaggtgatgctgctggtgttatgcgtcacccaggtactaatgatgcgcacgacatgggccctgtgcgaggccctcacccttgccaccgggcccatcagcacgttgtgggagggcaacccggggcggttctggaacacaacgattgccgtgtccatggccaatatctttcgcgggagctacctcgccggcgccgggctgttattctcgatcatgaaaaacacgacgaacacccggcgcggaaccgggaacatcggcgagaccctcggcgagaagtggaaatcccgactgaacgcgttggggaagtccgagttccagatctacaaaaagtccggcattcaggaggtcgacaggacgctcgccaaggaggggatcaagcggggcgagaccgaccaccacgccgtttcccgcgggagcgctaagctgcgatggttcgtggagcgcaatatgatcacccccgagggcaaggtcgtggacctgggctgcgggagaggagggtggtcctactactgcgggggcctcaagaacgtgcgcgaggtaaagggcctgacgaagggcgggccaggccacgaggagcctatcccaatgagcacgtatggatggaacctggtgcgtttgcagagcggcgttgatgtcttcttcactccgcccgagaagtgcgataccttgctctgcgacatcggggagtccagccccaaccccacggtggaggcgggtaggacgcttcgggtgctgaacctggtggagaactggctaaataataacacacagttctgcatcaaggtactaaatccatacatgcccagcgtaatcgaaaagatggaggctctgcagcggaagtacggcggggccttagtccggaatccgttaagccgcaactccacccacgagatgtattgggtaagcaacgcctccggcaacatcgtgagctcagttaacatgataagccgtatgctgatcaaccggttcactatgaagcacaagaaggccacatacgagcccgacgtcgacctggggtccggaacgcgtaacatcgggatcgaatctgaggtgcccaatctagacatcataggcaaaagaatagagaagatcaagcaggaacatgagacctcctggcactatgaccaagaccacccctacaagacttgggcatatcatggctcctacgagaccaagcagacgggatccgctagctccatggtcaacggagtggtacgcctattgaccaagccttgggatgtcatccccatggtaacccagatggccatgaccgacacgacccccttcgggcagcaacgggtatttaaggagaaggtcgacacccgcacccaagagcccaaggagggcaccaagaaactcatgaaaataaccgccgagtggctgtggaaggagctgggcaagaagaagaccccgcggatgtgcacccgcgaggagttcacgcggaaggtgcgcagcaacgccgcgctcggggccatcttcacagacgagaacaagtggaagtccgcccgggaggctgtggaggacagcaggttttgggaattggtcgacaaggagcggaacctacatctcgagggaaagtgtgagacttgtgtatacaacatgatggggaaacgagagaagaaacttggtgagttcgggaaggccaagggcagccgggcgatctggtacatgtggttgggtgctcgcttcctcgagttcgaagccttagggttcctgaacgaggaccactggttctcccgggaaaattcattgtccggcgtagagggggagggcctccacaagctagggtacatcctgcgcgatgtgagcaagaaagagggcggcgccatgtacgcagacgacaccgccgggtgggacacgcggatcaccctcgaggacctgaagaacgaggagatggtgaccaaccacatggaaggggagcacaagaagctggccgaagccatctttaagctgacctaccagaacaaagtcgtgcgcgtgcagcggcccactccacgcgggaccgttatggacataatctcccgccgggaccagaggggcagcggacaggtgggcacctacggtctgaacacctttacaaacatggaggcgcagctcatccggcagatggaaggggagggcgtgtttaagtcgatccagcaccttaccgcgaccgaagagatcgccgtccagaactggctggcccgcgtagggcgagagcgactcagccggatggcaatctccggcgacgactgcgtggtcaaacccctggacgaccgtttcgccagcgcgctgactgccctcaacgacatgggcaaggtgcggaaagacatccagcagtgggagccgtccaagggatggaacgactggacccaggtgccgttctgtagccaccacttccacgagctgatcatgaaagacgggcgcgtcctggtggtgccatgccggaaccaggacgagctcatcgggcgagcccgcatctcccagggggccgggtggagccttcgagaaacggcctgcctgggcaagagctacgcacagatgtggagtctcatgtacttccaccggcgcgacctgagactggccgccaacgccatctgctccgccgtccctagccactgggtgccgaccagccgcaccacgtggagtattcacgctaaacatgagtggatgaccaccgaggacatgctcaccgtgtggaaccgggtatggatccaggagaacccctggatggaggacaagacccccgtggagagctgggaggagattccatacctgggcaagcgcgaggaccagtggtgcgggtccctgataggcttgacgagccgcgccacctgggccaagaacatccagaccgccataaaccaggtgcggtccctgatcgggaatgaagagtacacggactacatgccgagcatgaagcgcttccggagagaggaggaggaagctggtgtcctgtggtga

SEQ ID NO: 24824 - RNA, 9876 nt, synthetic construct
  misc_feature 1..9876: note = derived and/or modified CDS sequence (opt11) from DENV-2__KF744407__SS-prME
  source 1..9876: mol_type = other RNA
accgcgggcatgatcatcatgctgatccccaccgtgatggcattccacctcaccacccggaatggggaaccccacatgatagtctcccggcaggaaaaaggcaagagcctgctgttcaaaaccgaagatggggtgaacatgtgcaccctcatggcgatggatctgggcgagctgtgcgaggacaccatcacctacaagtgtccccttctacggcagaacgagcccgaggacatcgactgctggtgcaatagcacctccacctgggtgacctacgggacctgcacgaccacgggcgagcacaggcgcgaaaagcggtcggtcgccctggtgccccatgtgggcatggggctcgagaccagaaccgagacgtggatgtccagcgagggcgcctggaagcacgcccagcggatcgagacgtggattctgcgccaccccggtttcaccctgatggccgcaatcctggcctacacgatcggcaccacgaacttccaacgggccctgatcttcatccttctcaccgccgtcgcgccttccatgaccatgcgatgtatcgggatctctaaccgggacttcgtggagggcgtgtccggcgggagctgggtcgacatagtgctggagcacggctcctgcgtgaccacgatggccaagaacaagcccactctggacttcgagctcatcaagactgaggccaaacaccctgcgaccctgcgcaagtactgcattgaagctaagctgacgaacaccaccaccgcgagtcggtgccccactcaaggggagccctccctcaacgaggaacaagacaagcgctttgtctgcaagcatagcatggtggaccggggctggggcaacgggtgcggcttgttcgggaagggcgggattgtgacctgcgccatgttcacgtgcaagaaaaacatggaaggcaaggtcgttcagcccgagaatctagagtacaccatcgtgatcactccccattccggggaggaacacgccgtagggaatgacaccggtaagcatgggaaagagataaagatcaccccgcaaagctccatcaccgaggctgagctcaccggctacggcacggtgaccatggaatgcagcccccgcaccggccttgactttaacgagatggtgctgctccaaatggagaacaaggcctggctggtacacagacaatggttcctggacctccctttaccctggctgccgggcgcggatacccaggggtccaactggatccagaaggagacgctcgtaaccttcaaaaacccccacgccaagaagcaggatgtggtcgtgctgggcagccaggagggggccatgcacaccgccctgaccggcgccaccgagatccagatgagctcagggaacctgctattcacgggccacctaaagtgccggctcaggatggacaaacttcagctgaagggcatgagctactccatgtgtaccggtaagttcaaggtcgtaaaggagatcgcggagacccagcacgggacgatcgtggtccgcgtgcagtacgagggggacggaagcccctgcaaaatccccttcgagatcatggacctcgagaagcgtcacgtactgggccgcctgattaccgtcaacccgatcgtcaccgagaaggactctcccgtgaacatagaggccgagcctcccttcggggacagctacgtcataatcggcgtggagccggggcagctcaagttaaactggttcaagaaggggtctagtatcgggcaaatgtttgagacaaccatgcgcggcgcgaagagaatggccatcttgggcgacacggcctgggatttcgggagtctgggcggggtttttaccagcatcggtaaggcgttacatcaagtcttcggagccatctacggcgccgccttcagtggcgtgtcatggaccatgaagattctcatcggagtaatcattacgtggatcggtatgaactcgcgcagcacatccttaagcgtctccctcgtgcttgttggggtcgtgacattgtaccttggcgtgatggtccaggcggatagcgggtgcgtggcctcctggaaaaacaaggagctgaagtgcggtagcggaatcttcataaccgacaacgtgcatacatggaccgagcagtacaagttccagcccgagtcacccagtaagttggccagcgccatacaaaaggcccaccaggaggggatctgcggtattcgctccgtgacccgcctggagaacctgatgtggaagcagatcacccccgagctgaaccacatcctcagcgagaacgaggtgaagctgacgataatgacaggggacataaagggcataatgcacgcggggaagcggtcccttcgacctcaacccaccgagctacggtacagctggaagacctgggggaaggccaagatcctgtccacggaatcccataaccaaaccttcctgatcgacggccctgagaccgcggagtgcccgaacaccaaccgcgcctggaactccctcgaggtggaggactacgggttcggtgtattcactaccaacatctggctgcggctgagagagaagcaagacgccttctgcgacagcaaactcatgtccgcggccattaaggacaaccgggccgtccacgccgatatgggttactggattgagagcgcgttaaacgacacctggaagatcgagaaggcttccttcatcgaggtcaaaagctgccactggcccaagtcccataccctgtggagcaacggcgtgctcgagtccgagatgataatccccaagaacttcgcgggccccgttagccagcacaactatcgcccggggtaccatacacagaccgccggtccctggcacctggggaagctggagatggacttcgacttctgcgagggcacgaccgtggttgtgaccgaagactgcgggaaccggggtcccagcctccgcacgaccacagcctccggcaagctgatcacagagtggtgctgccggtcttgcacgttgcccccgctccgctaccgcggggaggacggctgctggtacgggatggagattcgacccctgaaggagaaggaggagaacctagtttccagcctcgtcaccgcgggccacgggcagatcgacaacttctccctgggcgtgctgggcatggccctcttcctggaggagatgctgcggacccgcgtggggaccaagcacgccatcttgctggtagccgtgagcttcgtaacgctaattaccggcaacatgtccttccgcgacctcgggcgggtgatggtgatggtgggcgccactatgaccgacgacatcgggatgggcgtcacgtacctggcgttactcgccgccttcaaggtgcggcccaccttcgccgcaggtcttctgcttcggaagctgaccagcaaggagctgatgatgacaactatcggcatcgtgctattgtcacagagcaccatccccgaaaccatccttgagctcaccgacgcgctggccctcggcatgatggtcctcaagatcgtgcgcaacatggagaagtaccaactggccgtgacgatcatggccatcttgtgcgtgccgaacgccgtgatcctccagaacgcgtggaaagtctcctgcaccatcctagccgtggtgagcgttagccccctgctgctgaccagctcccagcagaaggccgactggattcccctcgcgctcaccatcaaggggcttaaccccacggcgatcttcctgaccaccctgagccggaccagcaagaagcgcagctggcccttaaacgaggccatcatggccgtcggcatggtaagcatcctggcaagcagcctcctgaagaacgacatacccatgacgggaccactggtcgccggagggctactgacggtttgctacgtgctgaccggacggtccgcggacctcgaattggagaaggccgcagacgtgcgctgggaagaacaggccgagatcagcggctccagccccatcctgtcaattatcatcagcgaggacgggtcgatgagcatcaaaaacgaggaggaggagcaaaccttgacgatcctgatcagaacaggcctgcttgtgatcagtggcctgttcccggtgagcattcctatcaccgccgcggcatggtacctgtgggaagtcaagaagcagcgcgccggggtgctctgggacgtgcccagcccaccacccgttggcaaggcagagctggaggacggggcctaccggatcaagcaaaaaggcattctggggtacagccagatcggcgcgggcgtgtacaaggaggggacctttcacaccatgtggcacgtgacacgcggtgcagtcctcatgcacaaggggaagcggatcgagccctcgtgggccgacgtgaagaaggacctgatcagctacggagggggctggaagctagaaggtgagtggaaggagggggaggaagtgcaggtcctcgccctcgaacccggcaagaacccccgcgcagtgcagactaagcccgggctgttcaagaccaacgcgggcaccatcggggccgtgagccttgacttcagccctgggacgtccggtagccctatcatcgacaagaaggggaaggtcgttggactgtacgggaacggcgtggtcacccggaacggctcctacgtgtctgctattgcccaaaccgagaagtccatcgaagacaaccccgagatcgaggacgacatcttccggaagaagcggctaaccatcatggacttacatcccggggcagggaagacgaagcgctacctccccgccatcgtgcgggaagcaatcaagagagggctgcggacactgatcctcgcaccgacccgcgtcgtggccgctgagatggaggaggcactgcgcggcctgccaatcagataccagaccccagcaattcgtgcagagcacacggggcgggagatcgtagacctcatgtgtcacgccaccttcaccatgcggctactgtcccccatccgggtcccgaactacaacctcatcatcatggacgaagcgcacttcacggaccccgccagcatcgccgcccgcggctacatctcaactcgggtggaaatgggcgaggcggcgggtatcttcatgaccgcaacccctcccggcagccgcgacccgttcccgcaatccaacgcccccatcatggatgaggagcgggagatccccgagcgctcctggaactccgggcacgagtgggtgaccgactttaaggggaagacggtctggttcgtgccgtctataaaggccggtaacgacatcgctgcctgcctgcgtaagaacggcaagaaggttatccagctgtcgcgcaaaaccttcgacagcgagtacgtcaagacccggaccaatgattgggactttgtcgtaacgactgacatatccgaaatgggtgccaacttcaaggccgagagagtcatcgatccccggcgctgcatgaagcccgtgatcctcaccgacggggaggagcgggttatcctagcaggccccatgcctgtcacccactcgtcagccgcccagcgccgggggcgcatcggccgcaaccctaagaacgagaacgatcagtacatctacatgggggaaccccttgagaatgacgaggactgcgcccactggaaagaggccaagatgcttttagacaacatcaacacgcccgaaggcatcataccgagcatgttcgagcccgagcgggagaaggtggacgccattgacggcgagtaccgcctgcgtggggaggcacgcaaaaccttcgtggaccttatgagaaggggcgacctgcccgtctggctggcctacaaggtggccgccgaggggattaactacgccgatcgccgctggtgctttgacggcatccggaataaccagattctagaggagaacgtggaggtcgagatatggaccaaagagggggagcgcaagaaactgaaaccgcgatggctcgatgcgcggatctactcagatcccctcgccctcaaggagttcaaggagttcgccgccggccgaaagtcgctgaccctcaacctgattacggagatgggcagactgcccaccttcatgacccagaaggcgcgcgacgccctcgacaacctggccgtgctgcataccgcagaggccgggggtcgcgcgtataaccacgccctcagtgagctccccgagacgctggaaacgctactgctgctcaccctgctggccacggtcaccggcgggatcttcctcttcctgatgagcgggaagggtatcggtaaaatgaccctgggcatgtgctgcatcataaccgcgtccgtgcttctttggtacgcacagatccagccgcactggatcgcggcctccataatactggagttctttctcatcgttctgctgatccccgagcccgagaagcagcggacaccccaggacaatcaactcacgtacgtcgtgatcgccatcctgacggtggtcgctgccacgatggcgaacgagatgggtttcctggagaagaccaagaaggacttcgggcttggcagtatagctacccagcagccggagagtaacatcttggacatcgaccttcgacccgccagcgcctggacgttatacgccgtggcgaccacattcatcacccccatgctccggcattccatcgagaacagctccgtaaacgtttcactgacggcaatcgcaaaccaggccaccgtgttgatggggctggggaagggctggcccctgtccaagatggacataggggtgccgctcttggcgatcggctgctacagccaggtcaaccccatcaccctgaccgccgcgctcctactgttggtggcccactacgcgatcatcgggcccggcctgcaggcgaaggccacccgtgaggcacagaagcgggccgccgcgggcatcatgaagaaccctactgtggacgggatcaccgtcatcgacctggaccccatcccatacgaccccaagttcgagaagcagctcggacaggtgatgttgttagtgctctgcgtcacccaggtcctgatgatgcgcacgacttgggcgctttgcgaggccctcaccctcgccaccggacccatatccaccctgtgggagggcaatccgggtcgcttttggaacacgaccatagccgtcagcatggcgaacatatttcggggctcctacctcgctggcgcggggttactgttcagcataatgaagaacaccacgaacacccgccggggcacaggcaacatcggcgagaccttgggcgagaagtggaagtccagactgaacgccctgggcaagagcgagttccagatctacaagaaatcggggattcaggaggtagaccgcacactcgcgaaggaggggatcaagcgcggcgagaccgaccaccacgccgtgagccgggggtccgccaagctgcgctggtttgtggagcggaacatgatcacacccgagggcaaggtcgttgatctgggctgcggccgcggcgggtggagctactattgcggcgggctcaagaatgtgcgggaggttaagggcctgacgaagggtggtcccggccacgaggagcccatcccgatgtccacgtacgggtggaatcttgtgcgcctccagagcggcgttgacgtcttcttcacgccgcccgagaagtgcgacaccctgctttgcgacataggagagagctcccccaacccgaccgtggaggccgggcgtacgttacgcgtgctcaatctggtagagaattggctcaataataacacccaattctgcataaaggtactgaacccctacatgcccagcgtgatcgagaaaatggaagccctgcagcggaagtacggaggggctctggtgaggaacccgctatcccggaacagcacccacgagatgtattgggtgtccaacgccagcggcaacatcgtctccagcgtcaacatgatctctcgcatgctgatcaaccggttcaccatgaagcacaaaaaggctacctacgaacccgacgttgacctggggagcggcacgcgcaatatagggatcgagtccgaggtccctaacttagacatcatcggcaagagaattgagaagatcaagcaagagcacgagaccagctggcactatgaccaggaccatccctataagacctgggcctaccacggctcctacgagaccaagcagacggggagtgcttccagcatggtcaacggcgtggttcggctgcttaccaagccgtgggacgtgatccctatggtgacccagatggcgatgaccgacacgaccccgttcgggcagcagcgggtcttcaaggagaaggtcgacacccggacccaagagcccaaggagggtacgaaaaagctcatgaagattaccgctgagtggctgtggaaggagctgggcaagaagaagacaccccgcatgtgcacccgggaggagttcacgcgcaaggtgcggtccaacgccgccctcggggccatcttcaccgacgagaacaagtggaagtccgcgcgcgaggccgtggaagatagccggttctgggagctggtggacaaggagcgcaacctgcatctcgagggcaagtgcgagacctgcgtgtacaacatgatgggtaagcgggagaaaaagctgggcgagttcgggaaggccaagggctctcgtgccatctggtatatgtggctgggcgcccggtttctcgagttcgaggccctggggttcctgaacgaggatcattggttcagccgcgagaactccctctcaggcgtcgagggggagggcctgcacaagctggggtacatcctccgggatgtgtccaagaaagagggcggcgccatgtacgccgatgacacagcaggctgggacacccgcattaccctggaggacctgaagaacgaggagatggtcacaaaccacatggagggcgagcataagaagctagcggaagcaatctttaagttgacctaccagaataaggtagtgcgggttcagcgacctacaccccgtgggaccgtcatggatataatcagccgccgagatcaacgaggctccggccaggtggggacatacggcctgaacaccttcacaaacatggaggcgcaactcatccgccagatggagggggagggcgtcttcaagagtatccagcacctgaccgccaccgaggagatcgctgtacagaactggctgacccgggtggggcgggaacggctctcccggatggcgatcagcggcgacgattgcgtggtcaagcccctggacgatagatttgcctcggcactgacggcccttaacgacatgggcaaggtgcgcaaggacatccagcagtgggaaccgagtaaggggtggaatgactggacccaggtgcccttctgttcccatcactttcacgagttgatcatgaaggacggcagggtcctggttgtgccgtgccgcaaccaggacgaactcatcggtcgggcacgcatctctcagggcgcgggttggtccctgcgggagaccgcgtgcctgggtaagtcatacgctcaaatgtggtccctcatgtatttccaccgccgggacctgcgtctggctgcgaacgctatatgtagcgccgttccctcccactgggtgccgacctcacggacaacctggagtatccatgccaagcatgaatggatgacaaccgaagacatgctcaccgtttggaaccgtgtctggatccaagagaacccctggatggaggacaagacgcccgtcgaatcctgggaggagatcccgtacctgggcaagcgggaggatcagtggtgcggtagcctgataggcctcacctcccgcgccacctgggcgaagaacatccagaccgccatcaaccaagtgcggagcctgatcggaaacgaggagtacaccgactatatgccgtccatgaaacgcttccgccgggaggaagaggaggcgggcgtcctgtggtga

SEQ ID NO: 24825 - RNA, 9876 nt, synthetic construct
  misc_feature 1..9876: note = derived and/or modified CDS sequence (opt11) from DENV-2__KF744399__SS-prME
  source 1..9876: mol_type = other RNA
acggctggtatgatcatcatgctcatccccaccgtcatggccttccacttaaccacccgcaatggggaaccccacatgatcgtatcacggcaggaaaagggtaagagcttgttgtttaagactgaggacggtgtgaacatgtgtaccctcatggctatggacctgggcgaactgtgcgaggacactatcacctacaaatgccccctcctgcggcaaaatgaaccggaggacatcgattgctggtgtaacagcaccagtacctgggtgacttacgggacctgcactaccacgggcgagcaccggcgcgaaaagcggagcgtcgctctagtgccccacgtcggcatgggtctggagaccaggaccgagacctggatgagctccgagggcgcctggaagcacgcccagcggatcgagacgtggattctgcgccacccgggtttcaccctgatggccgcaatccttgcgtacaccattggcaccacgaacttccagcgcgccctgatcttcatactgttgacggccgtagcccccagcatgacgatgcgctgcatagggatctcgaaccgggacttcgtcgagggcgtgtccggagggtcttgggtcgacatcgttctcgagcacggctcctgtgtgacaactatggccaagaacaagcctacgttagacttcgagctcatcaagaccgaggcgaagcaccccgccaccctgcgcaagtattgcatcgaggccaagctgactaacaccacgaccgagtctcgatgtccgacgcagggggaaccctcacttaacgaggagcaagacaagcgcttcgtgtgtaagcacagcatggtagaccggggctggggcaacgggtgcggtctgttcgggaaaggcgggatcgtgacatgcgccatgttcacgtgcaagaaaaacatggaggggaagatagtccagcccgaaaacctggagtataccatcgtgataacgccccactccggcgaggagaacgcagtcggaaatgacaccggcaagcatgggaaggagataaaggttacaccccagagctccataaccgaggcggagcttaccgggtacgggacggtgacaatggagtgcagcccccgcacagggctgggcttcaatgaaatggtgctgctccagatggagaacaaggcctggcttgtccaccggcagtggtttcttgatctcccactgccgtggctgccgggggccgacacccagggctccaactggatccagaaggagacgctcgtcaccttcaagaacccgcacgcgaagaagcaggacgtggtcgtgctagggagccaggagggagcaatgcacacagccctgaccggggcaacggagatccaaatgagctccggcaaccttctcttcaccggccacctgaagtgcaggctccggatggacaagctgcagctcaaggggatgagctactccatgtgcacaggcaagttcaaggtcgtcaaagagatcgccgaaacccagcacggtactatcgtggtccgcgtccagtacgagggcgacggcagcccatgcaaaattcccttcgagataatggatctcgagaagcggcatgtgctggggcggctgatcaccgtcaaccctatcgttaccgaaaaagactcgcccgtcaacatcgaggcggagccacccttcggggacagctacgtcatcatcggggttgagcccggccagctcaaactttcctggttcaagaagggaagctccatcggccagatgttcgagacaactatgcgtggcgccaagcgaatggccatcctgggggacaccgcctgggacttcggtagcctcgggggcgtgtttacctccatcggaaaggccttgcaccaggtctttggtgcgatctacggggcagcctttagcggggtgtcctggactatgaagatattaataggcgtggttataacgtggatcgggatgaactcgcgctccaccagcctgtccgtaagcctcgtgctggtcggcgtggtcaccctgtacctcggggtcatggtgcaggccgactctggctgtgttgtcagctggaagaacaaggagttaaagtgtggcagcgggatcttcataacggacaacgtgcacacgtggaccgaacagtacaagttccagcccgagtccccctccaagctcgccagtgccatccagaaagcgcaccaggaaggcatctgcgggattcgaagcgttacccgcctcgagaacctgatgtggaagcagatcacccccgagttgaaccacatcctctcagagaacgaggtcaagctgacgattatgaccggcgacataaaggggatcatgcacgccggcaagcggagcctccgcccgcagccaaccgagttacggtactcctggaaggcctggggtaaggccaagatactgtctaccgagctgcataatcaaacgttcctcatagacgggcccgagaccgccgagtgccccaacactaaccgcgcctggaacagcctggaggttgaagactacggctttggtgtgttcaccacgaacatctggctgaaactcagggagaagcaggacgccttctgcgatagtaaactgatgagtgccgcgatcaaggacaaccgcgccgtccatgcagatatgggctactggatcgagagcgccctaaatgatacctggaagatagagaaggcgtccttcattgaggtgaaatcatgccactggcccaagtctcacaccctttggagcaacggtgttctggagtcagaaatgatcatcccaaagaactttgcagggccagtaagccaacacaactatcgacctggttaccacactcagaccgccgggccctggcacttagggaagctcgagatggactttgacttctgcaaagggaccaccgtcgtagtaactgaggactgcgggaaccgcggccccagcctgcggaccacgaccgcctccgggaagctgatcaccgaatggtgctgccgatcttgcacactcccgcccctgcggtacagaggcgaagatgggtgctggtatggcatggagatacggccactgaaggagaaggaggagaacctcgtgaactccctggtgacagcggggcacgggcagatcgataatttcagcctgggagtgttagggatggcgctgttcctggaagaaatgctccgcacgcgggtgggcacaaagcatgccatcctgctggtcgccgtctcctttgttaccctcatcacgggcaacatgagcttcagggatttaggccgcgtgatggtcatggtgggggccaccatgaccgatgacatcggcatgggcgtgacctacctggccctactggcggccttcaaggtccggcctactttcgctgccgggctgctcctgcggaaacttacgtccaaggagctcatgatgaccaccatcggcatcgtgctcctttcgcagtcaacgatccccgagaccatcctggaactgaccgatgccctcgcgctggggatgatggtgctgaagatcgtccggaaaatggagaggtaccagctggccgtgacaattatggcgatcctctgcgtccccaacgcagtaatcctgcagaacgcatggaaggtgagctgtacgatattagcggtcgtgtccgtgtcacccttactgctgacctccagccagcagaaagccgactggattcccctagccctcaccatcaagggccttaatccgactgccatctttctcacgaccctgagtcggaccagcaaaaagcgcagttggccgcttaacgaagcgatcatggccgtggggatggtgagcattttagcatcgagtctgctgaagaacgacattcccatgaccgggcccctagtcgccgggggcctactgacggtctgctacgtgctaacaggccggagcgccgatctagaactggagaaagcggccgacgtgcgctgggaggagcaggccgagatctccgggagctcccccattctctccatcatcatctctgaggacggaagcatgagcatcaaaaacgaagaggaagaacagaccctgaccatactcatccgtaccgggctcctggttatctcgggcctgttcccggtgtcaattccgatcaccgccgccgcatggtacctctgggaggtgaagaagcagcgcgccggcgtcttatgggacgttccctcgccgcccccagtgggtaaggctgagctggaagacggcgcctacagaatcaaacaaaagggtatccttgggtactcccagatcggcgcgggggtatacaaggaaggcacctttcataccatgtggcatgtgacccgcggggcggtgcttatgcacaagggaaagcggctggaacccagctgggcagacgtcaagaaagacctcatctcctacgggggcggctggaagctggagggtgagtggaaggagggcgaggaggtccaggtgttggccctcgagcctgggaagaatccccgcgccgtccagacgaagcccggcctgttcaaaacgaataccgggaccatcggtgccgtgtccttggacttctccccaggtacgagcgggtcacccatcatcgacaaaaagggcaaagtagtcgggctttacggcaacggcgtcgtgacccggaacgggagctacgtctccgcgatcgcccagaccgagaagagtatcgaagacaaccccgagatcgaagacgacatctttcgcaagaagcggttgacaatcatggatctccatccaggcgccggaaagacgaagcgttatctgcccgccatcgttcgcgaggcgattaaacgcggcctccggaccctaatcctagccccaacccgcgtggttgccgcagaaatggaggaggccctcagaggactgccaatccggtaccagacccccgcgatccgcgccgagcacacgggccgtgagattgtggatctgatgtgccacgccacctttaccatgaggctcctgagccccatccgggtgcccaattataatttaatcattatggacgaggcccacttcaccgaccccgccagcatcgcggcccgcgggtacatctcgacgcgcgtcgagatgggggaggctgcaggaattttcatgaccgcaacgccgcccggatcccgcgacccgttcccccagagcaacgcgcccatcatggacgaggagcgggaaattcccgaacggagttggaacagcggtcacgagtgggtgaccgacttcaaagggaaaacggtatggttcgtcccatcgatcaaggccggcaatgatatagccgcctgcctccggaagaatgggaaaaaggtgatccagcttagccgcaagaccttcgactccgagtacgtgaagacgcggacaaacgattgggatttcgtcgtgacgacagatatcagcgagatgggggcgaactttaaggcagagcgcgtgatcgacccgcggaggtgcatgaagcccgtcatcctgaccgacggcgaagagagagttatcctcgcagggccaatgccggtgacccactcctccgctgcccaacgccggggccgcatcgggcgaaatccgaaaaatgaaaacgaccagtacatctacatgggcgagcccctggagaacgacgaggactgcgcgcactggaaagaggccaagatgctactcgacaacatcaacacgcccgagggcatcataccgtccatgttcgaacccgagcgggagaaggttgatgccattgatggggaataccgcctgcgaggcgaggcccgcaagaccttcgtggacctcatgcggcgcggggatctccccgtgtggctggcatacaaagtcgctgccgagggcataaactacgccgacagacgctggtgcttcgacggtattcggaacaaccagatccttgaggaaaacgtggaggtcgagatctggaccaaggagggcgagcgcaagaagctcaaaccgcggtggctagatgctcgcatctacagcgaccccctggccctgaaggagttcaaggagtttgccgcaggcaggaagtccctgactctgaatctcataacggagatggggcgcctgcccaccttcatgacccagaaggcccgggatgccctggacaacttggcggtgctgcacaccgccgaggccggcgggcgcgcctacaaccacgcactgagcgagctccccgagacgctggagacactgctcctgctgaccctcctggcgaccgtgacgggcggtattttcctgttcctaatgagtgggaaggggatcgggaagatgaccttgggtatgtgctgcatcatcaccgccagcgtcctgctctggtacgctcagatccagccgcactggatcgccgcctcaatcatcctggagttcttcttaatagtgctcctgattcccgagcccgagaagcagcggacaccccaggacaaccagctgacctacgtcgtcatcgcgatcctcacggtggtggccgccaccatggccaacgagatggggtttctggaaaagacgaaaaaggacttcggcctgggctcgatcgccactcaacagccggagagcaacatcctcgacatcgatctgcgccccgcgtccgcctggactctgtacgccgtcgccactactttcatcacccccatgctcagacacagcatcgaaaactccagcgtgaacgtgtcattgaccgccatcgcgaaccaagccaccgtactgatgggtctcgggaagggctggccactgagcaagatggacatcggcgtgccgttactcgccatcggttgctactcccaagtcaaccccataaccctgaccgcagcgctgctcttgctggttgcccactatgccattatcggccccggcctccaagctaaggccacgcgcgaggctcagaagcgggccgctgctggcatcatgaagaaccccaccgtggacggtatcacggttatcgacctggacccgatcccctacgaccccaagttcgagaagcagctggggcaagtcatgctcctggttttgtgcgtgacccaagtcctcatgatgcgcaccacctgggccctgtgcgaagccctgaccctcgcaacaggccccataagcacactatgggaagggaaccctggacgcttttggaacaccaccatcgccgtgtccatggcgaacatcttccgcggcagctacctcgctggggcgggcctcctgttctccatcatgaagaacaccacgaacacacgccgggggaccggcaacatcggcgaaaccctgggggagaaatggaagagtcgcctaaacgctctgggcaagtccgagttccagatctacaagaaaagcgggattcaggaggtggatcggacactggccaaggaaggcataaaacgcggggagaccgaccatcacgccgtctcccggggcagcgccaaactccgctggtttgtggagaggaacatggtgacccctgaaggcaaggtcgtcgacctgggatgcggccgtgggggctggtcctactactgcgggggcctgaagaacgttcgggaggtcaagggcctcaccaagggcgggccggggcacgaggagccaatcccaatgtctacctacgggtggaacctggtgcgtctgcagtcgggtgtggacgtcttctttaccccgcccgagaaatgcgacaccctcctatgcgacatcggcgagagtagccccaatccgacagtcgaggccggccggacgctgcgcgtcctcaacctggtggagaactggctgaataacaacactcaattctgtattaaggttctgaacccatacatgccctccgtcatcgagaagatggaagccctccagaggaagtacggcggcgccctggtcagaaacccgctatcgagaaattcaacccacgagatgtactgggtgagcaacgcctccgggaatatcgtgtcgagcgtcaatatgataagcagaatgctcatcaaccggttcacgatgaggcacaagaaggcgacctacgagcccgacgtggacctgggctccgggactcgcaacatcggtatagagagcgagattccgaacctggacatcataggcaagcgcatcgagaaaataaagcaggaacacgagacctcctggcactacgatcaggaccacccctacaagacttgggcctaccacggaagctacgaaaccaagcaaacgggctccgccagctccatggtgaatggtgtcgtgcgactcctgaccaagccgtgggatgttatccccatggtaacccagatggcaatgaccgacacaaccccattcgggcagcagcgggtgttcaaggaaaaggtggatacccgcacccaggagcccaaggagggcacgaaaaagctgatgaagatcaccgccgagtggctctggaaggagctaggtaagaagaagacaccccggatgtgcactcgggaagagttcacgcggaaggtcagaagcaacgcagccctgggcgccatctttaccgacgagaataagtggaagtccgcccgagaggctgtggaggattcaagattctgggagctcgtcgacaaggagcggaacctgcacctggaggggaagtgcgagacatgcgtctacaatatgatgggcaaaagggagaagaagctcggggagttcggcaaggcgaagggctcccgggcgatatggtacatgtggcttggagcccgcttcctggagttcgaggccctcggcttcctgaacgaggaccattggttctcacgggagaacagcttatccggggtggagggagaggggctccacaagttaggctacatcttacgggaggtcagcaagaaagagggcggggcgatgtacgccgacgacaccgccggctgggacacgcggatcaccctcgaggacctcaagaacgaggagatggtgaccaaccatatggagggagaacacaagaagctggccgaggccatcttcaagttgacataccaaaacaaggtggtgcgcgttcagcgcccaacgccccgcggtacggtgatggatatcatctcccggagggaccagagaggatctggccaagtgggcacctacgggctgaacacattcacgaacatggaggctcagctgatccggcagatggagggcgagggggtgttcaagtccatccaacacctgacggcaaccgaggagaacgccgtgcagaactggctagcccgtgtcggccgggagagactaagcagaatggccatatccggagatgattgcgtcgttaaacccctcgacgaccgcttcgcgagcgccctgacggccctgaacgacatggggaaggtacggaaggacatccagcagtgggaaccctcccgaggatggaatgactggactcaagtgccgttctgctcccaccactttcatgagttgattatgaaggacgggcgggtgctagtagtgccctgccgcaaccaggacgagctgattggacgtgcccgcatctcccagggggcgggttggagcctcagagagaccgcttgcttaggcaagtcctacgctcaaatgtggagcttgatgtacttccatagacgggacctccgcctggccgcgaacgccatctgctccgcggtacccagccactgggtcccgacctcccggaccacttggagcatccacgctaagaacgaatggatgacgaccgaagacatgctgacagtgtggaaccgcgtgtggatccaggaaaacccctggatggaggacaagaccccagtcgagagctgggaggagattccttacctcggcaagcgcgaggatcagtggtgcggctccctgatcgggctgacgtcgagagccacctgggccaagaacatacagaccgcgataaaccaagtacgctccctaatcggaaacgaggagtacaccgactacatgccgtctatgaaacggttcaggcgtgaggaggaggaggcgggagtgctgtggtga

SEQ ID NO: 24826 - RNA, 9876 nt, synthetic construct
  misc_feature 1..9876: note = derived and/or modified CDS sequence (opt11) from DENV-2__JX286516__SS-prME
  source 1..9876: mol_type = other RNA
accgccggcgtgatcgtcatgctgatcccgaccgccatggcgttccacctcaccacccgcaacggcgagccccatatgatcgtgggccggcaggagaagggcaagtccctactgttcaagaccgaggacggcgtgaacatgtgcaccctcatggccatagacctgggggagctatgcgaagacaccatcacctacaagtgccccctactgcgccaaaacgagcccgaggacatcgactgctggtgtaatagcaccagcacctgggtcacctacggcacctgcaccaccacgggggagcaccggcgcgagaagcgttccgtggccttagtgccccacgtagggatgggcctcgagacccgcactgaaacctggatgagctccgagggagcctggaagcacgtgcagcggatcgaaacttggatcctgcgccacccgggcttcaccatcatggccgcgatactggcctacaccatagggaccacgcacttccagcgggccctcatcttcatcctgctgacagccgtcgcgcccagcatgaccatgcgttgcatcggcatctccaaccgggacttcgtcgagggcgtgtcagggggctcctgggtggacatcgtactcgagcacgggagctgcgtgaccacgatggcaaagaacaagcccaccctggatttcgagctgatcaagaccgaggccaagcagcccgccaccctccgcaagtactgcatcgaggccaagttgacgaacacaaccaccgaatcccggtgcccaacccagggcgagccttcgctgaacgaggaacaagacaaacggttcatctgcaaacactctatggttgaccggggctggggcaacggctgcgggctgtttggcaagggaggcatcgtgacgtgcgcgatgttcacgtgcaagaagaacatggaggggaagatcgtgcaacccgagaatctggagtacaccatcgtcatcacgcctcacagcggggaggaacacgccgtcggcaacgacaccgggaagcacggcaaggagatcaagataaccccgcaatcgagcaccaccgaggccgagttaacagggtacggcatcgtgaccatggagtgtagcccccgtactggcctcgactttaacgagatggtgctgctacagatggaggataaggcctggctcgtccaccggcagtggtttctggacctgcccctcccatggctgccgggggccgacactcagggctcgaactggatccagaaggaaacgctggtgactttcaagaatccccacgcgaagaagcaggacgtggtcgtgctcgggtcccaggagggcgccatgcacaccgccctgaccggggccacggagatccagatgagcagcggcaacctcctgttcaccggccacctgaagtgccgcctacggatggacaagctccaactgaaggggatgtcctactcaatgtgcacaggcaagttcaaaatcgtcaaggagatcgcagaaacccagcacggcaccatcgtgatccgtgtccagtatgagggcgacggatccccctgcaaaatccccttcgagatcactgacctggagaagcggcacgttttggggcgcctgatcaccgtgaatccgatcgttaccgagaaggacagccccgtgaacatcgaggcggagccgcccttcggcgactcgtacatcatagtcggggtggagccgggccaactgaagctcaactggttcaagaagggcagctctatcggccagatgtttgagacgaccatgcgcggcgctaagcggatggcaatactgggggacaccgcctgggacttcggcagcctcgggggcgtcttcacctccatcgggaaggccctccaccaagtcttcggagcgatctacggcgccgccttcagcggagtgtcctggacgatgaagatcctgatcggcgtcatcatcacctggatcgggatgaactcacgctccaccagcctgtccgtgagcctagtgctcgtcggcgtcgtgaccctgtatctgggggccatggtccaggcggactccggctgcatcgtcagttggaagaataaggagctcaaatgcggcagtgggattttcatcacggacaacgtgcacacctggactgagcagtacaagtttcagcccgagtccccctctaagctggcctccgccatccagaaggcccacgaggagggcatctgcgggatccggagcgtcacccgcctggagaacctcatgtggaagcagatcacgcccgagctaaaccacatcctgtccgagaacgaggtgaagctcacaatcatgaccggcgatatcaagggtatcatgcaggctggcaagcggagcctgcgcccacaacccaccgagctgaagtactcttggaagacgtggggcaaggcgaagatgctcagtaccgagtcccacaaccagaccttcctgatcgacgggcctgaaaccgccgagtgcccgaacacgaaccgggcctggaacagcctggaagtggaggactacggcttcggggtcttcaccaccaacatctggctcaagctacgcgagaagcaggacgtattctgcgactccaagctgatgtcagccgccatcaaggacaaccgcgcggtgcacgccgacatgggctactggatcgagagcgcactcaacgatacctggaagatggaaaaggccagcttcatcgaggtcaagtcatgccactggcccaagagccacaccctgtggtccaacggcgtgttagagagcgagatgatcatccccaaaaacttcgccgggcccgtgtcccagcacaattaccgtccgggctaccacacgcagaccgcggggccctggcacctcgggaagctggagatggacttcgacttctgcgaggggaccaccgtcgtggtgacggaggactgcgggaaccggggacccagcctgcgcaccaccactgccagcgggaagctcataacggagtggtgttgccggtcctgcaccctacccccgctgcggtaccggggggaggacggatgttggtacggcatggagatccgccccctcaaagagaaggaggagaatttagtcaactccctggtgaccgccggacacggccaaatcgacaatttctctctcggcgtgttagggatggccctatttctcgaggagatgctgcggactagagtcgggacgaaacacgcgatcctcctggtggctctgagcttcgtgaccctgataaccgggaacatgtccttccgggacctcggccgcgtcatggtgatggtgggggccaccatgacggatgacattggcatgggcgtcacttaccttgcactgctcgccgcgttcaaggtgcgcccaactttcgccgccgggctgttgttacggaagctgaccagcaaagaactgatgatggccactatcggcatcgccttgctctcccagtcaaccttacccgagactatcctcgagctgaccgacgcgctggccctcgggatgatggcactgaagatcgtccgcaacatggagaagtaccaactggcggtcacgatcatggccatttcctgcgtcccgaatgcggtgatcctccagaacgcctggaaggtctcgtgcaccatcctggctgccgtgtccgtcagccccctgctcctgacctccagccagcagaaggctgactggatccccctggcgctcactatcaagggcctgaaccccacggccatcttcctgacaacactcagccgaactagcaagaagcgctcctggccgctgaacgaggcgatcatggccgtggggatggtgagcatcctggcttccagcctcctgaagaacgacatccccatgacgggccccctggtagcgggcgggctcctgactgtctgttacgtgctgaccggccggagcgccgatcttgagttggagcgcgcagccgacgtcaagtgggaggatcaggcggagatctccgggagcagtcccatcttaagcataaccatcagtgaggacggctctatgtccatcaagaacgaggaggaagagcaaactctcaccatcctgatccggactggcctgctcgtgattagcggcgtgtttccggtttcgatccccatcaccgctgccgcctggtacctatgggaagtgaagaagcagcgggccggcgtgttgtgggacgtccccagcccgccgcccgtgggtaaggcggaactcgaggacggcgcctaccggatcaagcagcgcggtatcttgggctactcccagatcggcgccggggtgtacaaggagggcactttccacacgatgtggcacgtcacccgcggggcagtgctgatgcatcgcggaaaacggatcgagcccagctgggccgacgtgaagaaggacctcatctcctacgggggcggctggaaactggagggggaatggaaggagggagaggaagtccaggtactggcactcgagcccggcaagaacccccgcgccgttcagacaaaacccggcatcttcaagaccaacacggggaccatcggcgccgtctctctggacttctcccccggcaccagcgggtcccccatcgtggaccggaagggcaaggtggtcgggttgtacggcaacggcgtggtcacccgctctggggcctacgtctccgcgatcgcccagacggagaaatcgatcgaggacaaccccgagatcgaggacgacatcttccggaagaagagacttaccatcatggacttgcaccccggcgccggtaaaaccaagcggtacttacccgcgatcgtgcgcgaggccatcaagcggggcctgcgcaccctcatcctggcgccgacgcgcgtggtcgccgccgagatggaggaggccctgcggggactcccgattcgctaccagaccccggcaatccgggcagagcacaccggccgcgagatcgtagacctcatgtgccacgcaaccttcacaatgcggctgctcagccccgtgcgcgttccgaactacaaccttatcatcatggacgaggcgcatttcaccgaccccgcctccatcgccgcgcggggctacatcagcactcgcgtggagatgggggaggccgctggcatcttcatgaccgcaacgccgcccggatcgcgcgatccttttccgcagagcaatgcgcccatcatggacgaggagcgcgagatccccgagcggtcctggaattctggccacgagtgggtcaccgattttaaggggaagacggtctggttcgttccgtccatcaaggccggcaacgacatcgcagcctgtctgcgcaagaacggcaagaaagtgatccagctcagccggaagacattcgactccgagtacgttaagacgcgcgctaacgactgggacttcgtggtgaccaccgatatcagcgagatgggagcgaacttcaaggcggagcgggtcatcgaccctcgccggtgcatgaagcccgtgatcctgaccgacggtgaggagcgcgtcatactggccggtcccatgcccgtaacgcactcctctgctgcccagcggcgcggccgcatcgggcggaatccaaagaacgagaacgaccagtatatctacatgggcgagcccttagagaacgacgaagactgtgcgcactggaaggaggcaaagatgctgctggacaacatcaacacccccgagggcatcatcccgtccatgttcgagcccgagcgggagaaggtggacgccatcgacggggagtaccgcttacgcggcgaggcccggaaaaccttcgtggacctgatgcgccgcggtgacctgcccgtctggctcgcctacaaggtggcggccgagggcatcaactacgcagaccgcaagtggtgcttcgacgggatcaagaacaaccagatcctggaggaaaacgtggaggtcgagatctggacgaaggagggagagcggaagaagctaaaaccgcgctggctagacgctcggatctacagcgaccccctggcgctgaagggattcaaggaattcgccgccgggcgcaaatccctcacactgaacctgatcaccgagatgggccggctcccgaccttcatgacccagaaggcccgtaacgccctggataacctggccgtgctccacacggcagaagtagggggcaaggcatacacccacgccctgagtgagctgcccgagaccctcgagaccctgctgctcctgacgctgctcgccgcggtcaccggcggcatcttcctgttcctgatgtccggcaaggggatcggcaagatgactctcgggatgtgctgcatcattaccgcaagcatcctgctgtggtacgcccaaattcaaccgcactggatcgccgcatccatcatcctcgagtttttcctgatcgtactactcattccggagcccgagaagcagcggacaccccaggacaaccagcttacgtacgttgtgatcgcgatcctgaccgtggtcgccgcaaccatggcgaacgagatgggcttcctggagaagaccaagaaggacctaggcttcgggagcatcacgacccaggagagcgaatccaacattctggacatagacctgcgtccggccagtgcgtggaccctgtacgcagtggccaccaccttcgtgacgcccatgcttcggcactccatcgaaaacagctccgtcaacgtgagcctcaccgccatcgcgaaccaggccaccgtgctgatgggcctggggaaaggatggcccctttccaagatggacatcggggtccccctgcttgccatcggctgctacagccaggtgaacccgattacgcttaccgccgcgctgctgctcctggtggcgcactacgctatcatcggcccggggctgcaggccaaggccacgcgcgaggcccagaagcgggcggccgccggaataatgaagaacccaaccgtcgacgggatcacggtgatcgacctcgagccgatcccgtacgaccccaagttcgagaagcagctgggccaggtgatgctgttgatcctgtgcgtcacccaggtgctgatgatgagaaccacctgggccctgtgcgaggccctgacgctggcgaccgggcccatctccaccctctgggagggcaaccccggccggttctggaacacaacgatcgccgtgagcatggccaacatcttccgcgggtcgtacctggccggcgccgggctccttttctcaatcatgaagaacaccaccaatacccgccgaggcacgggcaatgtcggtgagaccctaggcgaaaagtggaagtcccgcctgaacgccctcggcaagagcgaattccagatctacaagaagtccggcatccaggaagtagaccggaccttggcaaaggaggggatcaagcgcggcgagaccgaccaccacgccgtcagtcggggctccgccaagctgcgctggttcgttgagcggaacatggtgacaccggaaggtaaggttgtcgatctcggctgcgggcgcggcgggtggagctactactgcggaggcctaaagaatgtgcgggaggtaaaggggctaaccaagggtgggcccggccacgaggagcccatcccaatgtccacttatgggtggaatctcgtccgtctgcagagcggcgtggacgtcttcttcactccgcccgagaagtgcgacacgctgctctgcgacatcggcgagagctcccccaatcccaccatcgaggcggggcggacgctgcgcgtcctgaacctcgtcgagaactggctgaacaacaacacccagttttgcatcaaggttctgaacccgtacatgcccagcgtgatcgagaagatggagaccttgcagcggaagtacggcggggcactggttcgcaaccccctgtcccgcaacagcacgcacgagatgtactgggtttccaacgctaccggcaacatcgtcagctcggtgaacatgatcagccgcatgctgatcaatcggttcaccatgaagcacaagaaggccacctacgagcccgacgttgacttggggtccggcacgcgcaacatcggcatagagagcgagatccccaacctggatatcatcggtaagcggatcgagaagattaagcaggagcacgagacctcctggcactacgaccaggaccacccgtacaagacttgggcttaccacggtagctacgagaccaagcagacggggtccgcgagctccatggttaacggcgtggttaggctgctgaccaagccctgggacgtcgtgccgatggtgacgcagatggccatgaccgacacgacgcccttcggccagcaacgcgtcttcaaggagaaggtggatacccggacccaggaacccaaggaggggacgaagaagcttatgaagatcaccgccgaatggctgtggaaggagctcggcaaggagaagacgccccggatgtgcacccgggaggagttcacgcgcaaggtccggtcgaacgccgccctaggggcggtattcaccgacgagaacaagtggaagtccgcccgcgaagccgtggaggacggccggttttgggagctggtggaccgcgagcggaacctccacctggaagggaagtgcgagacctgcgtctacaacatgatgggcaagcgcgaaaagaagttgggcgagttcgggaaagccaagggctctcgggccatatggtacatgtggctcggggccaggttcctggagttcgaagccctgggcttcctcaacgaggaccactggttctcccgggggaacagcctgtctggcgtggagggcgagggcctgcaccgcctcggctacatcttacgggaggtcgggaagaaggagggcggggccatgtacgccgacgacacggcgggctgggacacgcgcatcaccctggaggatctgaagaacgaggagatggtgaccaaccacatgaagggcgaacacaagaagctcgccgaggcgatcttcaagctgacctaccagaataaagtggtccgggtgcagcgcccgacgccccgggggaccgtgatggacatcatctcccgcaaggatcagcggggctccggtcaggtcggaacctatggcctcaacaccttcacgaacatggaggcccaactgatccgccaaatggagggggagggcatcttcaaatcgatccagcacctgaccgccacagaagagatcgcggtgcagaactggctagcccgcgtggggcgggagcgcctgagccggatggccatatccggcgacgactgcgtcgtaaagcccatcgacgatcgtttcgccagcgccctgaccgcgctcaacgatatggggaaggtgcggaaggacatccagcagtgggaaccctctcgcggctggaatgactggacgcaggtcccgttctgcagccaccacttccacgagctggtgatgaaggacggccgggtgttggtcgtgccctgccgcaaccaggacgagctcatcgggcgggccaggatctcccagggcgcaggttggagcctgaaggaaaccgcgtgcctgggtaagtcctacgcccagatgtggaccctcatgtatttccaccgacgtgacctgcgtctggcggccaacgccatctgcagcgccgtgccatcccactgggtccccaccagccgcaccacgtggtcaatccacgcgaagcacgagtggatgacaaccgaggacatgttagccgtgtggaaccgggtgtggatccaggagaatccgtggatggaggacaagacccccgtcgagagctgggaggaggtgccctacctgggcaagcgcgaggaccagtggtgcggctccctgatcggcctcacaagccgggccacctgggccaagaacatccagaccgccatcaaccaggtgcgcagcctgatcgggaacgaggggtacaccgactacatgccctccatgaagaggttccgccgcgaagaggaggaggcaggggtcctgtggtaa

SEQ ID NO: 24827 - RNA, 9876 nt, synthetic construct
  misc_feature 1..9876: note = derived and/or modified CDS sequence (opt11) from DENV-2__JX286518__SS-prME
  source 1..9876: mol_type = other RNA
accgccggcgtgatcgtcatgctgatccccactgccatggctttccacctcaccacccgcaacggtgagccccatatgatcgttggccggcaggaaaaaggaaaatctctgctctttaagactgaggacggcgttaatatgtgcaccctgatggccattgacctcggtgagttgtgcgaggacaccatcacttacaagtgtcccctcctgcgccaaaacgaaccagaggacatcgactgctggtgcaacagcacctcgacctgggtaacctacggaacctgtaccaccacgggagagcacagacgcgagaaacgatccgtggccctggtgccccatgtcgggatggggctcgaaaccaggacggagacctggatgagttccgagggggcctggaagcatgtgcagcggattgagacctggatcctgcgccacccaggcttcacaatcatggccgcgatcctggcatacaccatagggaccacgcactttcagcgggcactcatctttatcctgctgactgccgtagcgccctccatgaccatgcggtgcatcggaatctcaaatcgcgactttgtggagggcgtgtctggggggtcctgggtggacatcgtcttagagcacggatcttgcgtgacgacgatggctaagaacaagccaaccctggacttcgagctgatcaagactgaggccaagcagcctgccacccttcgaaagtactgtatcgaggccaaactgacgaacaccactaccgagtcccggtgcccgacgcagggcgagcccagcctgaacgaggagcaggacaagcgcttcatctgcaaacacagcatggtagatcggggatgggggaacggctgcggcctgtttgggaagggggggatagtgacctgcgcgatgttcacatgcaagaagaacatggagggcaagatcgtgcagcccgagaatctggaatacaccatcgtgatcacgcctcacagcggggaggagcacgccgtcggcaatgacaccggcaaacacggaaaggagatcaagattacccctcagtccagcaccaccgaggcggagctgaccgggtacggcaccgtaaccatggagtgctctcccagaaccggcctcgacttcaacgagatggtgctgcttcagatggaggacaaggcttggcttgtccacagacagtggttcctcgacctgccccttccatggctgccgggcgctgacacacaaggcagcaactggattcagaaagaaaccctggtgacgttcaaaaacccacacgcgaagaagcaggatgtggtcgtgcttgggtcccaggagggcgccatgcacacggccttaacgggggcaacagagatccagatgagttcgggcaacctcctgtttaccggtcacctcaagtgtcgcctgagaatggacaagctccagctgaaggggatgtcctacagcatgtgcacaggcaagttcaagatcgtgaaggaaatcgccgaaacgcagcatggcacgatcgtgatacgggttcaatacgagggcgacggcagtccctgtaagatccccttcgaaatcaccgacctggagaagcggcacgtgctggggcgcttgatcaccgtgaacccgatagtgacggagaaggactcgccagtaaacatcgaggcggagccgcccttcggcgactcgtatataatagtgggagtcgagcctggccaactaaagctcaattggttcaaaaaaggtagctccatcggccagatgttcgagaccacgatgaggggagcaaagcggatggccatcctgggcgataccgcctgggacttcggatctctgggcggggtcttcacctccattgggaaggccctccatcaggtgtttggagcgatctatggcgcagccttcagcggagtgtcctggaccatgaagatcctgatcggcgttatcatcacctggatcgggatgaactctcgctccaccagcctgtcggtcagcctggtgctcgtcggcgtcgtgacgctgtacctcggggccatggtccaggcggattccggatgcatcgtgtcatggaagaacaaggagctaaaatgtggatccgggatatttatcacagacaacgtgcacacttggactgagcaatacaagttccaacccgagagcccctcaaagcttgcatctgccatacagaaggctcacgaggagggcatttgcgggatccgtagcgtgacgcgcctggagaacctcatgtggaaacagatcacccctgaactgaatcatatcctgtccgagaacgaggtgaagctgaccatcatgaccggcgacattaagggtatcatgcaggccggcaaacggagcctgcgcccacagcccacggagctgaaatactcatggaagacctggggcaaggcgaagatgctgtcgactgagtcccataaccagacctttctgatcgacggacccgaaactgccgaatgcccgaataccaaccgagcctggaactctttggaggtggaggattacggattcggggtcttcaccactaatatctggctcaaactgagagaaaagcaggatgtgttctgcgatagcaagctgatgtctgccgccatcaaggacaacagagcggttcacgccgacatggggtactggatagaaagcgccctcaacgacacctggaagatggagaaggctagcttcattgaggttaaatcctgccactggcccaagtcccatacgctctggtccaacggcgtgctggagtctgagatgatcatccccaagaactttgccgggcccgttagtcagcacaattatcgaccgggctaccacacccagactgcggggccctggcacctcggaaagctggagatggacttcgacttctgcgaggggacgacggtcgtggtgactgaggactgcggaaacagaggccccagcctgagaacgacaacggccagcggaaagctcatcaccgagtggtgctgtcggtcctgcaccctgccgcccctccgctaccgcggcgaggacggctgctggtatggcatggaaatccgccccctcaaggagaaagaggaaaacttggtcaacagcctggtgaccgcagggcacggccagatcgacaatttttccctgggcgtgttggggatggctttgttcctggaggagatgctgaggactagagtcggaactaagcacgcgatacttctcgtggctctttcgttcgtgaccctgataaccggtaacatgtcatttcgagatctgggccgcgtcatggtgatggtaggggcaacaatgaccgacgacattggcatgggcgtcacctacctggctctgctggcggcgttcaaggtacgccctaccttcgccgctggattactgctccggaaactaacatcgaaagagctgatgatggctaccatcgggatagccctcctgtcccagagcaccttacccgaaaccatcctcgagcttactgacgcgcttgccctcgggatgatggccctgaagatcgtgcgcaacatggagaagtaccagctggcagtgacgataatggccataagttgtgttcctaacgcagtaatcctgcagaacgcatggaaggtcagctgcactatcctggccgccgtgtcagttagccccctgctgctgacgtccagccaacagaaagctgattggatccccctggcactcaccatcaaaggcctgaaccccaccgccatctttctcaccaccctctcccggactagcaagaagcgttcatggccgctgaacgaagccattatggccgtcgggatggtgagcatactggcgtcctcgttattgaagaatgacatccccatgacaggcccacttgtcgccggagggctgctgactgtttgctacgtgctgacgggccggtccgcagaccttgagttagagcgagccgccgacgtcaagtgggaggaccaggcggagatcagcgggagcagccccatcctgagcatcactatctccgaggacggcagcatgtccatcaagaatgaggaggaagaacagacactcaccattctgatccggacgggcctgcttgtgatcagcggagttttcccggtatcaatccccatcaccgccgccgcttggtacctgtgggaggtaaagaagcagcgcgctggcgtgctgtgggacgtccccagccctccgccagtaggcaaggcagagctagaggacggcgcgtaccggattaagcagcgcgggatcctgggttattcccagatcggcgccggcgtgtataaggagggtacgttccataccatgtggcatgtgacccgcggggccgtgctcatgcatcgaggcaagcggatagagccgtcctgggccgacgtgaagaaggacttaatctcctatgggggcggttggaaactggagggggaatggaaggagggcgaggaggtccaggttctggcgctcgagcccggcaagaacccccgcgccgtgcaaacaaagcccggcatctttaaaactaacaccggaaccataggtgccgttagccttgacttctcccccggaacctccgggtcccccattgtggatcgcaagggcaaggtggttggtctgtacgggaacggcgtggtaacgcgcagcggcgcttacgtctccgcgatcgctcaaacagagaagtccatcgaggataaccctgagatcgaggacgacatcttcagaaagaagcgcttaaccataatggatctgcacccgggtgccggtaaaaccaagcgctacctgcccgctatcgttcgcgaggccatcaagcgaggcctgagaacgctgatattagctccgacccgcgtggtcgccgctgaaatggaggaggcattgagagggctacccatccgataccaaacccccgccatccgggcggagcacaccggcagggaaatcgtggaccttatgtgccatgccacgttcaccatgcggctcctcagccccgtccgagtcccgaactacaatctgataatcatggacgaagcgcactttacggacccggcctctatcgccgcgcgtggctacatcagcacaagagtggagatgggtgaggccgccggcatcttcatgacagccacgccgccaggctcgcgggacccgtttccccagtccaacgcgccgatcatggacgaggagcgcgagatccccgagcggtcttggaatagcggccacgagtgggtaacagattttaaggggaagaccgtctggttcgtgccgtcgataaaggccgggaacgacatcgcagcctgcctgagaaagaatgggaagaaggtgatccaactctcccggaagacgttcgactccgagtacgttaagacccgggccaatgactgggacttcgttgtaaccaccgacatatcagagatgggagcgaatttcaaggcggagcgggtcattgatccccgccgctgtatgaaacccgtgatcctgacggacggcgaggagcgggttatcctggccgggcccatgccggtaacgcattccagcgcggcacagcggcgcggacgcatcgggcgaaacccgaagaacgagaacgaccagtacatctacatgggcgagccacttgaaaacgacgaggactgtgcgcactggaaggaagccaagatgctgctcgacaacatcaacacccctgaaggcatcatcccatccatgttcgagccggagcgcgagaaggtggatgccatagatggggagtaccgactccgcggtgaagcacggaagactttcgtggacctgatgcgccgcggcgacctgcccgtctggctcgcataccgcgtggcggccgaagggatcaactacgccgaccggaaatggtgtttcgatgggattaagaacaaccagattctggaagaaaacgtggaagtcgagatttggacgaaggaaggcgagcgcaagaagcttaaacctagatggctcgacgctcgcatctacagcgaccccctggcgctgaaggagttcaaggaattcgccgccggtcggaagtccctcaccctgaacctaataaccgagatggggcgcctccccaccttcatgacgcagaaggcccggaacgccctggacaacctggcggtactccacaccgccgaggtgggggggaaggcatacacccatgccctgagcgagcttcccgaaacactcgagacactgttgctcctgaccctgctagccgcggtgaccggcggtattttcctgttcctgatgtccggtaagggcatcgggaagatgaccctcggcatgtgctgtatcatcactgcctcgatcttgctgtggtacgcccaaatccagccgcactggattgccgcctcgatcatactcgagtttttcctgatcgtgctgctcatacccgagccagagaaacaacgcacaccccaggacaaccagcttacctacgtagtcattgcgatcctgacggtggtggccgcaacaatggccaatgagatggggttccttgaaaagaccaagaaagatctgggattcggctcgataaccacccaggagtcagagtccaatatcctggacatagacctccggccagcatctgcgtggaccctgtacgccgtggcgacgaccttcgtgacccctatgctgcgccactctatcgagaactcctccgtgaacgtgagcctcacggccattgcgaaccaagccacagtgctgatggggctgggcaaagggtggccacttagcaagatggatatcggcgtccccctgctcgctattggttgctactctcaggtaaacccgatcaccctgacagcggccctgctgctcctggtggcacactacgccattatcggccctggcctgcaggccaaggccacccgtgaggcccaaaaacgcgccgcggccgggatcatgaagaacccaacggtcgacggcatcacggtaatcgatctcgaacccatcccgtacgaccctaagttcgagaagcaactagggcaggtcatgctcctcatcctgtgcgtcacgcaggtgttaatgatgcggaccacatgggccctctgcgaggccctgacccttgccacaggccccatatccaccctgtgggaggggaaccccggtcgcttctggaacacgaccatcgccgtctcaatggccaacatcttccgcggctcctacctggccggggcgggcctcctgttcagcatcatgaagaacacgaccaatacacggcgcgggacgggaaacgttggcgagaccctgggcgagaagtggaagtcgcgactgaatgccctcggcaagagcgagtttcagatttacaaaaagtccggaatccaagaggtcgatcggacgctggccaaggagggcatcaagcgcggggaaacagaccaccatgccgtcagccgcggctccgccaagctgcgatggttcgtcgagaggaacatggtgaccccggagggcaaggtggttgacctcgggtgcggacgcggtggctggtcctattactgcgggggcttaaagaacgtacgcgaggtgaagggcctgaccaagggcggcccaggtcatgaggagcctatccccatgtcgacctacggctggaacctcgtacggctgcaaagcggggtggacgtgttcttcacgccgcccgaaaaatgtgacaccctactctgcgacatcggcgagtcatccccgaacccgaccatagaggcgggccggaccctgcgtgtcctgaatctcgtggagaactggctgaataacaacacccaattttgcatcaaggtgttgaacccatacatgccaagcgtcattgagaaaatggagacgctccagcgcaagtacggcggcgccctggtgcggaaccccctgtcgcgtaactccacacatgagatgtactgggtctccaacgccaccgggaacatcgttagctccgtcaacatgattagtcgtatgcttataaaccgcttcaccatgaagcataagaaggccacgtacgagccggacgtggacctcggtagtggtacaagaaacattggcatcgaatcagagatccctaacctggacatcatcggcaagcgcatagagaagataaagcaggaacacgaaacttcctggcattacgaccaagaccacccctacaaaacatgggcctaccacgggagctacgagacgaagcagaccggctccgcgtcgtccatggtcaacggggtggtgcgcttgctcaccaagccgtgggacgtcgtgccgatggtgacccagatggccatgacggacaccacgcccttcggccagcagcgggtgtttaaggagaaggtcgacactcgcacgcaagagccgaaggagggcaccaagaagctgatgaagatcaccgcagaatggctgtggaaggaactgggtaaggagaaaacgccccggatgtgcacccgcgaagaattcacgcggaaggtaagaagcaatgctgccctgggcgcggtcttcaccgatgagaacaagtggaagtccgcccgggaggccgtagaggatgggcggttctgggagctcgttgatcgcgagaggaacttgcacctggagggcaagtgcgagacctgtgtgtataacatgatgggtaagcgtgagaagaagctgggcgagttcggcaaagccaaggggtcacgcgcgatctggtacatgtggctcggcgccaggttcctggaattcgaggccctggggttcctcaatgaggaccactggttctcccgcggcaacagcctgagtggagtggagggcgagggcctacaccggctcgggtacatcctgcgtgaggtaggcaaaaaggagggcggtgccatgtacgccgatgacacggcggggtgggacacccgtattaccctggaggacctcaagaacgaggagatggtcaccaaccacatgaaaggcgagcacaagaagctggccgaggccatcttcaagcttacgtaccagaacaaggtggtgcgcgtacaacggcctacaccacggggcaccgtgatggatatcatctcccgaaaagaccagcgcgggagcgggcaggtggggacttatggcctcaacacgttcaccaacatggaggcccaactgatccgccagatggaaggcgagggtattttcaaatccatacaacatctgacagccaccgaagagatcgctgtgcagaactggctcgcccgggttggtcgcgagagacttagtcgaatggccatctccggggacgactgtgtcgtcaagcccatcgacgaccggttcgctagcgccttgacggcgctcaacgacatgggtaaggtgcgcaaagacatccaacaatgggagccctcccgggggtggaacgactggacccaggtcccattctgcagtcaccactttcacgaactggtgatgaaggacggccgcgtcctggtcgtgccctgccggaaccaggacgagctcatcgggcgagcccggatttcccagggggccggctggtcactgaaggagaccgcctgcctggggaagagctacgcccagatgtggaccttgatgtacttccaccgccgggacctgcgcctagcggccaacgctatttgcagcgccgttccctcccactgggtcccaaccagtcggacgacctggtccatacacgcgaagcacgagtggatgaccacagaggacatgctcgccgtgtggaaccgggtgtggatacaggaaaacccgtggatggaggataagacgcccgtagagtcttgggaggaggtgccctacctgggcaagcgtgaggaccagtggtgcgggtctctgattgggcttacaagccgcgccacctgggccaagaatatccagaccgctatcaaccaggtgcggagccttatcggcaacgaggggtacaccgactacatgccgtccatgaagcgcttccgccgggaggaggaggaggcgggggtcctgtggtaa

SEQ ID NO: 24828 - RNA, 9876 nt, synthetic construct
  misc_feature 1..9876: note = derived and/or modified CDS sequence (opt11) from DENV-2__JX286519__SS-prME
  source 1..9876: mol_type = other RNA
accgcaggcgtcatcgtcatgttaatccccacggccatggcattccacctcactactaggaacggggaaccacatatgatcgtcggccggcaggaaaaggggaagtccctgctgttcaaaaccgaagacgggatcaatatgtgtacccttatggccatcgatcttggggagctttgcgaggatactattacttacaagtgccccctcttgcgccagaacgagcccgaggacatcgattgctggtgtaatagcacaagcacctgggtgacctatggaacctgcactaccacgggggaacaccgacgcgagaaaaggtccgtcgcactggtgccccacgtggggatgggtctcgagactcgcaccgagacctggatgtcgagcgagggggcctggaagcacgtacagcgcatcgagacttggatactgaggcaccccgggttcaccatcatggccgcgatcctggcgtacaccatagggacgacgcattttcaacgcgccctcatcttcatcctgctgaccgccgtggcccctagcatgacaatgcgctgcatcggcatcagcaaccgtgacttcgtggagggcgtcagcgggggctcatgggtggacatcgtgctggaacatggcagctgcgttacgacgatggccaagaacaagcctaccctcgacttcgagctgatcaagaccgaggccaagcagcccgccaccttgcgtaaatactgcattgaggccaagctgaccaataccaccacagagtcccggtgccctacacaaggcgaaccgagcctgaacgaggagcaggacaagcgcttcatttgcaagcattccatggtagaccggggctgggggaatggttgtggcctctttggtaagggcggcatagtgacttgcgcgatgttcacgtgcaagaagaacatggagggcaagatcgtccagcccgagaatctggagtacaccattgtaattacgccgcacagcggggaagaacacgctgtgggcaacgacaccgggaagcatggcaaagagataaaaatcaccccgcaatcctcgacaaccgaggccgaactcacgggatacggcaccgtaaccatggaatgcagcccccggaccggcttggacttcaacgagatggtgcttctgcaaatggaggacaaggcctggcttgtccaccggcagtggtttctggacctgccactcccgtggctgccgggggcagacacgcaaggcagcaactggatacagaaggagaccttggtcacctttaagaacccccacgcgaagaaacaggacgtagttgtcctcgggtcgcaagaaggcgcaatgcacacggcactgacgggagccaccgagattcaaatgagctccggcaacctccttttcacagggcacctgaagtgtcggctgcggatggacaagttacagctgaagggaatgtcctattcgatgtgtacgggcaagtttaagatcgttaaggagatcgccgagacgcaacatgggactatcgtcatcagggtccagtacgagggcgacggatcaccctgcaagatcccattcgagatcaccgaccttgagaaacggcacgtgttggggcgcctgatcacggtcaacccgattgttacggagaaggacagccctgtcaacatagaggcagagccgcccttcggcgactcctacatcatcgttggcgtggagccgggtcaactgaagctcaactggttcaagaaggggagctcgatcggtcagatgtttgagaccacaatgcgcggcgccaaacggatggccatactgggggataccgcgtgggacttcggctccctaggcggcgttttcacgtccatcggtaaggctttgcaccaggtcttcggagcgatttacggcgccgcttttagcggggtgagttggacgatgaagattctgatcggcgtgattatcacctggatcggtatgaacagccgaagcaccagcctgtccgtcagcctggtgctcgtgggcgtcgtgacactctatctaggagccatggtgcaggctgactccggttgcatcgtatcctggaaaaacaaggagctcaagtgtggctccggaatattcatcaccgataacgtgcatacctggaccgagcagtacaaattccagccagaaagccccagcaaactggcaagcgccattcagaaggctcatgaagaaggcatctgtggcatccggtcagtgacccgcctggagaacctcatgtggaagcagatcacgcccgaactgaatcacattttgtccgagaacgaggtcaagctcaccataatgaccggcgacataaaaggcattatgcaagccggcaaacggagcctgcggccgcagccaacggaactgaaatatagttggaagacctggggaaaggcgaagatgctcagcaccgagtcccacaatcagacattcctgatcgacgggcctgagactgccgaatgcccaaacactaaccgggcctggaacagcctggaggtagaggactacggttttggggtgttcacaaccaacatctggctgaagctgcgagagaaacaggacgtcttctgcgattcaaaactgatgtcagcagccataaaggataaccgggccgtgcacgccgatatgggctactggatcgagtcagcactgaatgacacctggaagatggagaaagccagctttatcgaggtgaagtcctgccactggcccaagagccacacgctctggtctaatggcgttttagagtctgagatgatcatcccgaagaattttgcagggcccgtttcccagcacaactatcgtccggggtaccacacccagaccgctggtccctggcacctgggcaaacttgaaatggacttcgacttctgcgagggaacgacggtcgttgtgaccgaggattgtggaaatagaggcccctctctgcgcacaaccacagccagcgggaaactgatcaccgagtggtgctgccggagctgcacccttcccccgctgaggtaccggggcgaagacgggtgctggtacgggatggaaataagacctctcaaagagaaggaggagaacctggtgaatagcctggtaacggctgggcacggtcagatcgacaacttctccctcggcgtgctgggcatggccttgttcctcgaagagatgctgcgcacacgcgtgggcaccaagcacgcaatcctgctggtcgccctgagcttcgtgaccctaatcactgggaacatgtccttccgggacctcggccgcgtgatggtaatggtgggggccacgatgactgacgacatcggcatgggcgtgacctacctggcactgttagctgcctttaaggtccgtcctacctttgctgccgggctgctgctgcgaaagctgacaagcaaagagctgatgatggccaccatcggaatcgcgctcttgtcccagagcaccctgcccgagaccatcctggagctaacggacgcgctagcactcgggatgatggccctcaagatcgtgcgcaacatggaaaaatatcagctggccgtcaccattatggccatctcgtgcgtccctaatgctgtcatcctccaaaacgcctggaaggtgtcgtgtaccatcctggcggccgtctccgtgagccccttgctcctgacttcctcccagcagaaggccgattggatcccgctcgccctcacgatcaaggggttaaaccccacggccatttttctgaccaccttgtcccgcacttctaagaaacgctcctggccgctgaacgaggccatcatggccgtgggtatggtctcgatcctggcgtcctcgttgctaaagaacgacatcccgatgaccgggcccctggtagcaggcggattgcttaccgtctgctacgtgttaaccggcaggagcgccgacctcgagctcgaacgcgcggctgacgtaaaatgggaggaccaggctgagatctccgggtcctccccaatcctgtcaatcacaatctccgaagacggcagcatgagcatcaagaacgaggaagaggagcaaacactaaccatactgatacggactggcctgcttgtcatctcgggggtgtttccagtgtctatccccatcaccgccgcagcctggtacttgtgggaggtcaagaagcagcgtgccggcgtcctgtgggacgttcccagtcccccaccagtcgggaaggccgaactcgaggacggagcctaccggataaagcagcgcgggatcctaggatactcccagatcggcgcaggggtctataaagagggcacctttcacaccatgtggcatgtaacccgcggagccgttctgatgcatcgcggaaagcgaatagaaccttcatgggcagatgtaaagaaggacctgatctcgtatgggggcggatggaagctggaaggggagtggaaggaaggcgaggaagtgcaggtcctcgccttggagcccggtaagaatcccagagcggtacagaccaagccgggcatttttaagactaacacggggacgataggcgccgtgtcgctggatttctcccccggaacctcaggctcccccattgtcgacaggaaggggaaggtggtcgggctgtacggcaatggcgtcgtcactcgctctggtgcatacgtgagtgcgatcgcccagaccgagaaaagcatcgaagataaccccgagatcgaggacgacatcttcaggaaaaagcgcctcactatcatggacctgcaccccggcgccggaaaaaccaagagataccttcccgccatcgtccgggaggcgattaaaaggggactgcgtacactcatcttagcgccaacccgggtggtcgccgccgaaatggaggaagccctgcggggtctgcctatccgctaccagaccccggctatccgggcggagcacacaggccgcgagatcgtcgacctgatgtgccacgcgacatttaccatgcggctactcagcccggtgcgagtgccgaactacaatttaattatcatggacgaggcccacttcaccgatcccgcctcgatcgcggcccgtggctacatctccactcgcgtcgaaatgggagaggccgccggcatcttcatgactgccacgccgcccggctctcgggacccgttcccccaaagcaacgcgcctatcatggacgaggagcgcgagattcctgagcgctcctggaactcaggccacgagtgggtgacagacttcaagggcaagactgtgtggttcgtcccgtccatcaaagcaggcaacgacatcgcggcttgcctgcgcaaaaatggcaagaaggtgatccagctcagcagaaagacgttcgacagtgagtacgtgaagacccgggccaacgactgggacttcgtcgtgaccaccgacatctctgagatgggggcgaacttcaaagcggagcgggtgatcgacccccgccgctgcatgaagccggttatcctgacggacggagaggagcgtgtgatcctcgcaggacctatgccggtgactcactccagcgccgctcagcggcggggtcgcatcggccggaaccccaagaatgaaaacgaccaatacatctacatgggcgagcccttagagaatgacgaggactgcgcgcactggaaagaggccaaaatgctgctcgacaacataaatacccccgagggcatcgtcccatccatgttcgagcccgagcgcgagaaggttgatgcaatcgacggtgagtataggttaagaggggaagcccgaaagaccttcgtggatctgatgcgccgcggagacttaccggtgtggctggcgtacaaagtggcggcagagggtatcaactacgccgatagaaaatggtgcttcgacgggataaagaacaaccaaatcctcgaggagaacgtagaagtggagatatggactaaagagggcgaacggaaaaagctgaagccacgatggctcgacgcgagaatctactccgatcccctggcgctgaaggaatttaaggagtttgccgcgggcaggaaatccctcacccttaacctgattacagagatggggcggctccccaccttcatgactcaaaaggcccgctctgctctggacaacctggccgtattacacaccgctgaggttggcggcaaggcgtacacacatgctttatccgagttacccgagactctcgaaacgctgctactcctgacacttctcgccgcggtaaccggcggcatattcctgttcctgatgtcagggaaaggcatcgggaagatgacgctgggcatgtgttgcataatcaccgcctccatactgctgtggtatgcccagatacaaccgcattggatcgccgcgagcatcatcctggagttcttcctgattgtattgctcatccccgaaccggagaagcaacggacgccccaggacaatcagctgacctacgttgtgatagcgatcctgaccgtggtcgccgccacgatggcaaacgagatggggttccttgagaagacgaaaaaggatctgggctttggaagcatcaccacccaggagtccgagagcaacattctggacatcgacctcaggccggcgtccgcgtggaccctatatgccgtcgccacgacctttgtgaccccaatgcttcgacacagcatcgaaaatagcagcgtcaacgtgagcctcactgcgatcgccaaccaggccacggttctcatggggttgggcaaagggtggcccctaagcaaaatggacatcggcgtccctctgctggccatagggtgctactcccaggtgaacccgatcaccctgaccgcggcgctgctactcttggtggcacattatgccatcataggccccggcctgcaggccaaggcaacccgtgaggcacaaaaacgggcggccgccgggatcatgaagaaccccaccgtcgatggcatcaccgtgatcgacctcgagcccattccctacgatccgaaattcgaaaaacagttgggacaggtgatgctgctcattctttgtgtcacccaggtgttgatgatgcgcaccacgtgggccctgtgcgaggccctgactctagcgaccggccctatcagcactctctgggaagggaaccccggccgcttttggaacacgaccatagccgtgtccatggccaatatcttccgcggatcgtacttggccggcgcgggcctcctgttctctatcatgaagaacacgaccaacacgcgccggggcaccggcaatgtcggggagacattaggggagaagtggaagtccaggctgaatgccctcggaaaatcagagttccagatatacaagaagagtgggatccaggaggttgaccggactcttgcgaaggaggggatcaaacgcggggagacagaccaccacgccgtatctcggggctcggcgaagctgcgctggttcgtcgagcgcaacatggtgaccccggagggcaaggtagtcgacttagggtgcggccgcggtggctggtcctactattgtggcggcttgaagaacgtgcgggaggtgaaaggcttgaccaagggaggccccggtcacgaggaacccatcccaatgagtacctacggctggaacctcgttcgcctgcagtctggggtggacgtattcttcacacctcccgagaaatgtgacaccctgctgtgcgacatcggcgaatccagtcccaacccgaccatcgaggcgggtcggaccctgagggtcttaaacctcgttgagaattggctgaacaacaacacgcagttctgcatcaaggtgctgaacccgtacatgccttccgttatagagaaaatggaaacactccagcggaaatacggtggggccctggtgcgcaacccgctgagccggaactcaacccacgagatgtactgggtgagcaatgccaccggcaatatcgtctctagcgtaaatatgatctcaagaatgctaatcaaccggttcactatgaaacacaagaaagcgacgtacgaacctgacgtggacctcgggagcggtacgcgcaacattggtatagagagtgagatcccgaacctggacatcatcgggaagcggattgagaagatcaagcaggagcatgagactagctggcactacgaccaggatcacccctacaagacgtgggcctatcacggatcatacgagacgaagcaaaccggctcggcgtccagcatggtcaacggggtggtgcgcctgttaacgaagccttgggatgtcgtgcccatggtcacgcagatggcgatgacggacaccacccctttcggccaacagcgagtctttaaggagaaggttgacacccggacgcaggagcccaaagagggcacaaagaagctgatgaaaataactgccgagtggctgtggaaggaactcggcaaggaaaagacgcccaggatgtgcacgcgggaagagttcacacgcaaagtgcggagcaacgccgcactgggtgcggtgttcaccgacgagaacaagtggaagtcagcacgcgaggccgtggaggacgggcggttctgggaactggttgaccgcgaacggaacctccacctggagggcaaatgcgaaacctgcgtctacaacatgatggggaaacgcgagaagaaactgggagagttcggcaaggccaaggggagccgggccatatggtacatgtggctcggcgcccgcttcctggagttcgaggccttagggtttctcaatgaggaccattggttcagtcggggtaacagcctgtccggagttgagggcgagggcttgcatcgcttggggtacatcttacgcgaggtgggcaagaaggagggcggggccatgtacgcggacgatacggcggggtgggacacccgcatcacgctggaagacctcaagaatgaggagatggttaccaaccacatgaagggagagcacaagaagctagccgaggccatcttcaagctcacgtaccagaacaaggtggtccgtgtccaacggccgacaccccgtggcaccgtgatggacatcattagcagaaaagaccaacgggggtccggccaggtcgggacgtacggactgaacacgttcaccaacatggaggcccagctgatcagacagatggagggcgaggggatctttaagagcattcagcatctcacagccacggaggagatcgcggtacagaactggctagcacgcgtggggcgggagagactctcccgcatggcgattagcggggacgactgcgttgtcaagcctatcgacgaccgctttgcctcagccctgacggctttaaacgacatgggcaaggttcggaaggacatccagcaatgggaaccaagccgtggctggaacgactggacccaggtgcccttctgcagccaccattttcacgaacttgtgatgaaggacggacgggtattggtcgtgccctgccgcaaccaggacgagctcatcggccgggcgcgcataagccagggggccggctggtcactgaaagagaccgcttgcttgggcaaatcttacgcccagatgtggaccttgatgtacttccatagacgcgacctgagactagctgcgaatgccatctgctccgccgtaccgtcgcactgggtaccgacctcgcggacgacctggtctatccacgccaagcatgagtggatgaccaccgaggacatgctggcagtgtggaaccgagtgtggatccaagagaacccatggatggaggacaagacgcctgtagagagttgggaggaagtaccgtacctaggcaaaagagaggatcagtggtgcgggagcctgataggtctcacgtcacgggcgacctgggccaagaatatccaaacagctattaaccaggtgaggtccttgatcggcaacgagggatacactgactatatgccaagtatgaagcggttccgccgcgaggaggaggaggcgggcgtcttatggtag

SEQ ID NO: 24829 - RNA, 9876 nt, synthetic construct
  misc_feature 1..9876: note = derived and/or modified CDS sequence (opt11) from DENV-2__KP188549__SS-prME
  source 1..9876: mol_type = other RNA
actgccggcgtgatcgtcatgctgattcccacagccatggcgttccacttgacgacccgcaacggggaaccccacatgatcgttgggcggcaggagaaggggaagtccctgctgttcaagaccgaggacggcgttaacatgtgtacgctcatggccatcgacctgggggagctgtgcgaggacaccatcacctacaagtgccccctcctacgacagaacgagcccgaagacatcgactgctggtgcaactctactagcacatgggtcacctacgggacctgtaccacaactggcgagcaccggcgtgagaagaggagtgtggctctggtgccccacgtcgggatgggcctcgagacgaggaccgagacctggatgagctccgagggtgcatggaagcacgtgcagcggatcgagacgtggatcctgcgccacccgggctttaccatcatggctgctatccttgcctacaccattgggactacgcactttcagcgggcactcattttcatcctgctgaccgctgtagcaccgagcatgaccatgcgctgcatcggtatatcgaaccgagactttgtcgaaggcgtgagcgggggctcctgggtggacatcgtcttagagcatggtagctgtgtgaccacaatggccaagaacaagcccacgctggacttcgagctgatcaagaccgaggctaaacaacccgccaccctacgcaagtactgcatcgaggccaaactgacgaacacaaccaccgaatcccgatgcccgacgcagggcgagcccagcctgaacgaggagcaggataaacgcttcatctgcaagcactcgatggtggatagggggtgggggaacggctgcggcctcttcgggaaaggagggatcgtgacctgcgcgatgttcacgtgcaagaagaacatggagggcaaaatcgttcagcccgagaatctcgagtataccatcgtaatcacgccccacagcggggaggagcatgccgtcggcaacgacacagggaaacacggcaaagagatcaagatcaccccgcagtctagcacaacagaagcagagctcactggctacgggacagtgaccatggagtgcagccctcggacgggcctcgacttcaacgaaatggttctgctgcagatggaggataaggcctggctcgtccaccggcagtggttcctggacctgccgctcccctggttaccgggcgccgacacgcagggcagcaattggatacaaaaggagacgctggtgaccttcaagaacccccacgcgaagaagcaggacgtggtcgtgctcgggtcacaggagggggcaatgcacaccgccctgaccggggcgactgagatacagatgagctcgggaaacctactcttcacgggccacttgaagtgccgtctgcggatggacaaacttcaactgaagggaatgagttacagcatgtgcaccggtaaatttaaaatcgtcaaggagatcgccgagacgcagcacgggaccatcgtgatccgcgtacagtatgagggagacggctccccctgcaaaatccccttcgagataaccgacctggaaaagagacatgtgctgggtcggttgatcaccgtgaacccgattgtgacggaaaaagacagccccgttaacatcgaggcggagccacccttcggcgactcctacattatcgtgggcgtcgagccggggcagctgaagctcaactggttcaagaaaggaagttccatcggccagatgttcgaaaccacaatgcgcggcgccaagcggatggccattctgggagacaccgcctgggacttcggctctctcgggggtgtattcacgtctatcgggaaggcccttcaccaggtcttcggagcgatctacggcgccgccttcagcggggtatcctggacaatgaagatactgataggcgtcatcatcacctggattggtatgaacagccgctccaccagcctatccgtgagcctggtactcgtgggagtcgtgacactgtacctgggagccatggtccaagcggacagcggctgcatcgtgagctggaagaacaaggagctcaagtgcggctccgggatcttcatcacggataacgtgcacacctggaccgagcagtataagttccagcccgagagcccctcaaagctggcctccgccatacagaaggcgcacgaggagggcatctgtgggatccgttcagtgacgcgcctggagaacctaatgtggaagcagatcacccccgaactgaatcacatcctgtccgaaaatgaggtgaagctcacaatcatgaccggagacattaaggggataatgcaggcgggaaagcggtctcttcgcccgcaacccacggagcttaagtactcctggaagacctggggcaaggcgaagatgctcagcaccgagtcccacaaccaaaccttcctgattgacggccccgagaccgccgagtgcccgaataccaaccgggcttggaatagcttggaggtggaggattacggcttcggggtttttaccaccaatatctggttaaagctgagagagaaacaggacgtgttctgcgattccaagctgatgagcgcagccatcaaagataaccgggctgtacacgctgacatgggctactggatcgaatccgcgctcaacgacacatggaagatggagaaagcctcgttcatcgaggtaaagagctgccactggcctaagtctcacacgctgtggtccaacggcgtgctggaaagcgagatggtgatccccaagaatttcgccgggcccgtctctcagcacaattatcgcccgggctaccacacccagaccgcagggccctggcatctcggcaagctagaaatggacttcgacttctgcgaggggaccacagtggtggtgaccgaggactgcgagaaacggggccccagcttgcgcacgactacggccagcggcaagctcatcactgagtggtgctgccggtcctgcaccctgcccccgctgcggtatagaggggaggacggctgctggtacgggatggagatccgcccgctgaaggagaaagaggagaacttggtgaactccctggtgaccgccggccacgggcagatcgacaacttctccctcggcgtccttggcatggcccttttcctagaggagatgctgcggacgcgcgtggggaccaagcacgcgatactgctcgtcgcactgagcttcgtcaccctcatcaccggcaacatgagtttccgggacttagggcgcgtgatggtgatggttggcgccacgatgaccgacgatattggcatgggggtgacctacttggccttgctcgccgcgttcaaggtgagaccgaccttcgccgccgggctgctgctccggaagctgacgagcaaggaactgatgatggcaaccatcgggatcgctctgctgtcccagagcaccttacccgagaccatcctagaacttacggacgccctggccctcggcatgatggctctgaagatcgtccgcaacatggagaagtaccagcttgccgtgaccatcatggccatctcctgtgtgcccaacgcggttatcctccagaacgcctggaaagtgagctgcaccatcctggccgccgtgagtgtcagccccctgctcctgacctccagccagcagaaggcggattggatccccctggcgctcacgatcaaggggctgaaccctaccgccatcttcctgaccaccctctcccgcacaagcaagaagcgctcctggcccctgaacgaggccatcatggccgtgggcatggtcagcatcttagcatccagcctcctgaaaaatgacatccccatgaccggccccctggtggccgggggcctcctgaccgtgtgctatgtcctgaccgggcggtcggccgacctggagctggagcgcgccgccgacgtgaagtgggaggaccaggcggagatctccggcagctccccaatcctgtccatcacaatctccgaggacgggagcatgagcatcaagaacgaggaggaggaacagaccttaaccattctgatccggacaggcctgctcgtgatcagcggcgtcttcccggtgtccatccccatcaccgcggccgcctggtacttgtgggaggtgaaaaagcaacgcgccggggtcctgtgggatgtgcccagcccgccgcccgtggggaaggcggagctcgaggacggtgcctaccggatcaaacagcgcgggatcctgggatactcccagattggcgcaggcgtttacaaagaggggacgttccacaccatgtggcacgtgacccgaggtgccgtgctgatgcaccgcgggaaacggatcgagcccagctgggccgacgtcaagaaggacctcatctcctacggcggaggctggaagctggagggcgaatggaaggagggggaggaagtccaggtgctcgcgctcgagcccggcaagaaccctcgcgccgttcagaccaagcccgggattttcaaaacgaacaccggcacgatcggggccgtgagcctggacttctccccgggaaccagcggatcccccatcgtggatcgcaaggggaaggtcgtgggcctgtacggaaacggtgtcgtcacccgttcaggcgcctacgtctccgcgatagcccagacggagaagtccatcgaggacaaccccgaaattgaggacgatatctttagaaagaagcgcctaaccataatggatctgcacccaggggccggcaagaccaagcggtacctgcccgccatcgtgcgcgaggccattaagcgggggttgcgcacgctcatcctggcgccgactcgcgtagtcgccgccgagatggaggaggccctccggggcctccctatacgctaccagacccccgccatccgggcggagcataccgggcgtgaaatcgtggacctgatgtgccacgccacgttcaccatgcggctgctctctcccgtccgcgtgccgaactacaatctgatcatcatggacgaggctcacttcaccgaccccgcctccatcgctgcgcggggctatataagcacccgcgtggagatgggggaggccgccgggatcttcatgacggccacgccgcctggcagtcgggatccgttcccccagagcaacgcgcctataatggatgaggaacgtgaaatcccggaacggtcatggaactccgggcatgagtgggtcaccgacttcaaggggaaaaccgtgtggttcgtgccgtccatcaaggccgggaacgacatcgctgcctgcctgcgaaagaacggcaagaaggtcatacagctcagtcggaagacgttcgactccgaatacgtcaagacccgcgccaacgactgggacttcgtggtgaccaccgacatcagcgagatgggagccaatttcaaagcagagcgggttatcgacccacgccggtgcatgaagcccgtgatacttacagacggcgaagaacgcgtcatactggccggccccatgccagtgactcactccagcgccgcccagcggcgcgggcgcatcggccgtaatcccaagaatgagaacgaccagtacatctatatgggggaacccctcgagaacgacgaggactgtgcgcactggaaggaggccaagatgctactggataacatcaacacccccgaaggcatcattccgagcatgttcgaacccgagcgcgaaaaagtggacgccatcgatggcgaataccggttacgtggagaggcccggaaaacctttgtcgacctcatgcgcaggggcgacctacccgtatggctcgcctacaaggtggccgctgagggaataaactacgccgaccgaaagtggtgctttgatggcatcaagaacaaccagatcctggaggagaacgtggaggtggaaatctggacgaaggagggagagcggaagaaactgaagccgaggtggttagacgcccggatatacagcgaccccctggcgctgaaggagttcaaggagttcgctgccggccgtaagtccttaacactgaacctgatcaccgagatgggcaggttgcctactttcatgacgcagaaggcgcgcaacgcccttgacaacctggcggtgctccacaccgctgaggttgggggcaaggcctacacccacgccctgtctgagctacccgaaactctcgagacgctgctgttattaactctgttggccgcggtgaccggagggatcttccttttcttaatgtccggaaaggggatcggcaagatgaccctggggatgtgctgcataatcaccgccagcatcctcctgtggtacgcccagatacaaccgcactggatcgccgcgtccatcatcctcgagttctttctgatcgtcctgcttattcccgagcccgagaagcaacggacgccccaggacaaccagctgacttatgtggtgatcgcaatcctgaccgtcgtggctgccacgatggccaacgagatgggctttctagagaaaacaaagaaggacctcgggttcggcagcatcactacccaggaaagcgagtccaacatccttgacatcgacctgcgcccggcctcagcgtggacgctatacgccgtggcaactaccttcgttacccctatgctgcggcattccatcgagaacagctccgtgaacgtgagcctcacggccatcgccaaccaagccacggtactgatgggcctggggaagggttggccgctcagcaagatggacataggggtaccgctgctagccatcggctgctatagccaggtgaaccctatcaccctcaccgcggccctgctcctcctggttgctcattacgcaatcataggaccgggcctgcaagccaaggccacacgcgaggcccagaaacgggcagccgctggcatcatgaagaatcccacggtggacgggatcaccgtcatcgacctcgagccaatcccgtacgaccctaagttcgagaagcagctgggccaggttatgctgttaatcttatgtgttacccaggtgttgatgatgcgcaccacttgggccctttgcgaggccctgaccctggcgaccggccctatttccaccctctgggagggaaaccccgggcggttctggaacacaactatcgccgtcagcatggccaatattttccgtggctcgtacctggccggcgctgggctcctgtttagcatcatgaagaacaccaccaacactcgccggggcacgggaaacgtgggcgagaccctgggcgagaaatggaagtcccgtctgaatgccctcggaaagagcgagttccagatctacaagaagtccggcatccaggaggttgaccggacactggctaaggaggggatcaagcgcggggagacggaccaccacgccgtcagccggggttccgccaagctgcgctggtttgtggaaagaaacatggtgacgccggaggggaaagtcgtggacctcggttgcgggagaggtggatggtcctattactgcggcgggctgaagaacgtgagagaggtcaagggcctgacgaagggcggccccggtcacgaggagcccatccccatgtccacctacggatggaacctcgttcgtcttcagtccggggtagacgtgttctttacgccgccggagaagtgcgacacgctcctctgcgacattggtgagagcagccccaaccctaccatcgaggcgggccggaccctaagagtgctgaacttagtggagaactggctgaacaacaacacccagttctgtatcaaggtcctcaacccgtacatgcccagcgtcatcgagaaaatggagaccttacaacggaagtacggaggggcactggtgcgcaaccccctgtcccggaacagcacccatgagatgtactgggtctcgaacgccacgggcaacatcgtctcgagcgtgaacatgatcagccgcatgctgatcaaccggttcaccatgaagcacaagaaggctacgtacgagcctgacgtggatctcggatcaggcacccgcaacatcgggatcgagagcgaaacacccaatctggacattatcggcaagcggatcgagaagatcaagcaggaacacgagacatcttggcactacgaccaggaccacccctataagacgtgggcctaccacggctcgtacgaaacaaagcagaccgggtccgcgagctccatggtcaacggcgtggtccgtctgctcaccaagccctgggacgtggtgccgatggtcacgcagatggccatgaccgacaccacccccttcgggcaacagcgcgtgtttaaggagaaggtggatacgcggacccaagagcctaaggaaggtaccaagaagttgatgaagatcaccgccgagtggctatggaaggagctaggcaaggagaagactcctagaatgtgtacacgggaggagttcacacgcaaagtccggagcaacgccgccctgggggcggtattcacagatgagaacaagtggaagtccgctagggaggcagttgaggacggccggttctgggagctcgtcgaccgcgagcggaacctccatttagaggggaagtgcgagacgtgcgtgtacaacatgatgggcaaacgcgagaagaagctgggggagttcggcaaagccaagggctctcgtgcgatctggtacatgtggctcggggcccgcttcttagagtttgaggcactgggcttcctaaacgaggatcactggttctcccgcgggaacagcctgtcgggcgtcgagggagagggtctgcaccgcctcggctacatcctgcgggaggtggggaaaaaggaaggaggggccatgtacgctgacgacacggcgggctgggacacccgcatcaccctggaggacctcaaaaacgaggagatggtgacgaaccatatgaagggggagcacaagaaacttgctgaggcgatcttcaagctgacctaccagaacaaggtcgtgcgggtgcagcgcccgacgcctcgggggaccgttatggacatcatcagtcgcaaagaccagcggggcagcggccaggttgggacgtacgggctcaacacattcactaacatggaggcccagctgattcggcaaatggagggcgagggcatattcaagtccatccagcacctgactgccacggaagagaccgcggtgcagaactggctcgcacgcgtagggcgggagcgcctgtcccggatggcgatcagcggtgacgattgcgttgtaaagcccatcgacgaccgtttcgcaagcgcccttacagccctcaacgacatggggaaggtccggaaggacatccagcaatgggagccctcgcgcggctggaacgactggactcaggtgccgttctgcagccaccattttcacgaattagtgatgaaggacgggcgggtgctggtggtgccctgccggaaccaggacgagctcatcggccgggcacggatttcccagggcgcggggtggagccttaaggaaaccgcctgcctgggcaagtcctacgcccagatgtggacactcatgtacttccaccggcgcgatctacggctggcagccaacgccatctgtagcgccgtcccttcccactgggtccccaccagccgcacgacctggtccatccacgcgaagcacgagtggatgacgacagaggacatgctcgccgtgtggaaccgcgtatggatccaggagaacccgtggatggaagataagacccccgttgagtcatgggaggaggtgccctacctggggaaacgcgaagaccagtggtgcggctcacttatcggccttaccagtcgggccacgtgggccaaaaacatccagactgccatcaatcaggtccgcagcttgatcgggaacgagggctacaccgactacatgccgtccatgaaacggttccgtcgcgaagaggaggaggcgggcgttctgtggtga

SEQ ID NO: 24830 - RNA, 9876 nt, synthetic construct
  misc_feature 1..9876: note = derived and/or modified CDS sequence (opt11) from DENV-2__KP188550__SS-prME
  source 1..9876: mol_type = other RNA
accgccggcgtaatcgtgatgctgatacccaccgtgatggcatttcacttgaccacccggaacggggagccccacatgattgtgggccggcaggaaaagggaaagtccctactgttcaagacagaggacggcgttaacatgtgcaccctcatggcgatcgacctgggcgagctgtgcgaggacaccatcacctataaatgccccctcctgcgccagaacgagcccgaggacatcgattgctggtgcaactcgaccagcacgtgggttacctatgggacctgcaccaccacaggcgagcatcggcgcgagaaacggtcagtggccctagtcccgcacgtgggcatgggtctagagacccggacagagacctggatgagcagcgagggggcctggaaacacgtgcagcggatcgagacatggatcctgcgccacccggggttcaccatcatggcagccattcttgcgtataccattgggaccacgcacttccagcgggctcttatattcatcctgctaacggccgtcgcccccagcatgaccatgcgatgtattggcatcagcaatcgtgactttgtggagggcgtaagcggaggctcctgggtcgacattgtcctggagcacggctcttgcgtgaccaccatggcgaaaaacaagcccactctggactttgagctgatcaagactgaggctaagcaacccgccactctccgcaagtattgcatagaggccaagctgacgaacaccaccaccgagtcccggtgcccgacgcagggtgagcccagcttgaacgaggagcaagacaaacgcttcatctgcaaacactccatggtcgaccggggatggggaaacggctgcgggctgtttggcaagggcgggatcgtgacgtgtgccatgttcacgtgcaagaagaacatggagggcaagatcgtacaacccgagaacctggagtataccattgtcatcacgccccatagcggggaggagcatgcggtgggaaacgacacaggaaagcacggcaaggaaataaagatcaccccgcagagcagcactaccgaggcagagctgacgggttacggcacggtgaccatggaatgctcgcccaggaccggccttgacttcaacgagatggtcttactacagatggaggacaaagcctggcttgtacaccggcagtggttcctggacctgccgctcccatggctgcctggggcagacacgcagggcagcaactggatccagaaggagaccctagtgacctttaagaacccccacgccaaaaagcaggacgtcgtcgtgttggggtctcaggagggcgcgatgcacacggcccttacgggtgccaccgagatccagatgtcaagcggcaacctcctctttacgggccacctgaagtgccgcctgcgcatggacaagttacagctaaaagggatgtcgtacagcatgtgcaccgggaagttcaaaatcgtcaaggagatcgccgaaacgcagcacgggaccatcgtgatccgcgtccagtacgaaggagacggctccccctgcaagatcccctttgagatcaccgacctggagaagcggcacgtcctggggcgcctgatcaccgtgaacccgattgtcacggagaaggacagcccagttaacatagaggccgagccgcccttcggcgactcctacatcatcgtgggggttgagcctggccagttaaagcttaactggttcaagaaggggagctcgatcggccagatgtttgaaacaaccatgcggggcgcgaaacgaatggccatactgggggacaccgcctgggacttcggcagcctcggaggagtgttcacgtctatcgggaaggccttgcatcaggtgttcggggccatttacggggcggcctttagcggagtctcctggaccatgaagatactgatcggggtgattatcacctggataggtatgaacagccggtccaccagcctgagcgtgtcgttggtcctcgtgggcgtagtcactctgtacctgggggccatggtgcaggccgacagcggctgcatcgtgagctggaaaaacaaagagttgaagtgcggctccggaattttcatcaccgacaacgtccacacctggactgagcagtacaagttccaaccggagagccccagcaagctggcttccgccatacagaaggcacacgaggagggcatatgcgggattcggagcgtaacgagactggagaacttgatgtggaagcaaataacccctgaactgaaccacattctgtccgagaacgaggtgaagctgacgatcatgaccggcgacataaaagggatcatgcaggcgggcaagaggagcctgcgccctcaacccacggagctgaagtacagctggaagacctggggcaaggcaaagatgttgtcgactgaatcccacaaccagacctttctcatcgacggtccagagacggcggagtgccccaacaccaaccgggcctggaatagcctcgaggtggaggactacggcttcggagttttcactaccaatatctggctcaagctacgcgagaaacaagacgtattctgcgattccaagctgatgagcgccgcaataaaggacaaccgggctgttcacgcggacatggggtattggatcgagagtgccctaaatgacacctggaagatggagaaggccagcttcatcgaagtgaaaagttgccactggcccaagagccacacgctgtggtccaatggcgtgctagagagcgaaatgatcatccccaagaacttcgccgggccggtttcacagcacaactatcgcccgggctaccatacccagacagccgggccctggcaccttggcaagctggagatggacttcgacttctgtgaggggaccacggtggttgtcaccgaggactgtggcaaccggggccccagcctgcgcacgacaacggcgagcggaaagctcatcacggagtggtgctgccggagttgcaccctgccacctctccgataccggggcgaagacgggtgctggtacggcatggagatccgaccgctcaaagagaaggaagaaaacctggtgaactcgctagtgacagctgggcatggccagattgacaacttctccctcggggtcctcgggatggccttgttcctcgaggagatgctgaggacgagagtgggcaccaagcacgccatactgctcgtggcgctgagcttcgtcaccctcatcaccgggaatatgtccttccgggacttaggccgcgtgatggtgatggtcggagccacgatgactgacgatatcggcatgggcgtaacctatctggccctcctcgccgcgttcaaggtgcgccccactttcgcggccgggttacttctccggaagctgactagcaaagagctgatgatggccaccattggcatcgccctgctgtcccaaagcacgttgcccgagaccatactcgagctgacagatgccctggcgctaggcatgatggctctgaagattgtccgcaacatggagaagtaccagctggccgtgaccataatggcaatcagctgtgtgccgaacgccgtcatactccagaacgcttggaaagtatcgtgcaccatcctggccgccgtgtccgtaagccccctgctcctgaccagcagccagcagaaggccgattggatacccctcgcgctgacgattaaaggcctgaatccaacggctatattcttgacgaccctctcccggacaagcaagaagcgctcttggccgctcaacgaggcgattatggccgtgggaatggtcagcatcctcgctagctctttattaaagaacgacatccccatgaccggcccactcgtggcgggcgggctcctgaccgtgtgctacgtgctgaccgggcggagcgcagacttagaactggagcgggccgccgacgtgaagtgggaggaccaggccgagatctccggaagctcccccatcctgagcataacgatatccgaggacggaagcatgtccattaaaaacgaggaggaggagcagaccctcacaatcctgatccggacaggcctgctggtgatctcgggtgtcttcccggtgtccatccccatcaccgcggccgcgtggtacttatgggaggtgaagaagcagagggccggcgtcctgtgggacgtgcccagcccgccgccagtggggaaggccgagttagaggatggtgcgtaccgaatcaagcagcgcggcatcctgggttactcccagatcggtgccggggtctataaggaggggacgtttcacaccatgtggcacgtgacacgcggggctgtgctgatgcaccgcggaaaacggatcgagccctcatgggccgacgttaaaaaggacctcattagctacggcggcggctggaagctggaaggggagtggaaggagggcgaggaggtgcaggtactggctctagagcccgggaagaacccgagagcggtccagaccaagcccggcatattcaagacaaataccgggaccattggcgccgtgagcttggacttctcccccggcactagcgggtccccgatcgttgacagaaaaggcaaggttgtggggctgtacggcaatggcgtggtcacgcgaagcggggcctacgtgtccgctatcgcgcagaccgaaaaatccatcgaggataaccccgaaatcgaggacgacatcttccggaagaagcgcctgaccatcatggacctgcaccccggggccggcaaaaccaagcgatatctgcccgccatcgtgcgcgaggcgatcaagcgtggcctccgcacgctcatcttggccccgactagggtagtggcggccgaaatggaagaggcactgcgggggctccccatccgataccagactccggccattcgggcggagcacaccggccgggagatagtggacctgatgtgccacgcgacgttcaccatgcggctgctcagcccagtccgcgttccgaactacaatctgatcataatggacgaggcccactttacagaccccgccagtatcgccgcaaggggatacatcagcaccagggtggagatgggtgaggcagccggaatcttcatgacggccacgccacccgggtcccgggatccgttccctcagagcaacgcccccatcatggacgaagagcgagagatccctgagcgttcctggaatagcgggcacgagtgggtgaccgatttcaaggggaagaccgtgtggttcgtgccgagtatcaaggccggaaacgacatcgccgcctgcctgcgcaagaacgggaagaaagtaatccagctcagccggaagacgttcgactccgagtacgtgaagacccgcgccaacgactgggacttcgtggtcactaccgacatatcggagatgggggccaacttcaaggcggagcgagtcatcgaccctaggcggtgcatgaaacccgtaatcctcacggatggcgaggaaagggtcatcctggcaggacccatgccggtcacccacagctccgccgcccagcggcgcggcaggatcgggcggaaccccaagaatgagaacgaccagtatatatacatgggcgagcccctcgagaacgacgaggactgcgctcactggaaggaggcgaagatgctgctggacaacatcaacacccccgagggcattatcccgtccatgttcgagccagagcgcgagaaggtggacgccatcgacggggagtaccggttacgaggcgaggcccggaagactttcgtcgacctaatgagacgcggggacctgcccgtgtggctcgcctacaaggtagccgcggagggtatcaactacgccgacagaaagtggtgctttgacgggatcaagaacaaccagatcttggaagagaacgtcgaggtggagatctggacaaaggaaggcgagcggaagaagctgaagccgcgctggctcgatgcccggatctactcggacccgctggccctgaaggaattcaaggagttcgcggccggccgcaagtcactgaccctgaacctgataaccgaaatggggcggttacccaccttcatgacacagaaagcccgcaacgccctcgataatctggctgtgctccacactgcagaggtgggcggacgggcccacacccacgccctgtcggagctgcccgagaccctcgagacgctgctgctgttaaccctgctcgctaccgtgactggcggcatcttcctgttcctgatgtccggtaaaggcatcgggaagatgacccttggcatgtgctgcatcatcacggccagcatcctgctgtggtacgcgcagatccaaccgcactggatcgcagcttccatcatcctcgagttctttctgatagtgctgttaatccccgaacccgagaagcagcgcacgccccaagacaaccagctgacctacgtggttatcgcaatcctgaccgttgtggccgcgacgatggctaatgagatgggattcctcgagaagaccaagaaggacctaggctttggcaccatcacaacccaggagagcgagagcaacattctggacatcgacctccgaccggcttccgcctggaccttatacgccgtggcgaccaccttcgtcactccgatgctgcgccacagcatcgaaaactccagcgtgaacgtgtccctaaccgccatcgccaatcaggcgaccgtcctgatgggactgggcaaggggtggcccctcagcaagatggacatcggcgtccccttactggcgatcgggtgctactcccaggtgaacccgataaccctcacggccgccctgctgctcctagtcgcgcactacgccataattggccccggcctgcaggcgaaggccacacgggaggcccagaagcgcgccgccgcgggtatcatgaagaatcctactgtggacggcatcacagtgatcgacttggaacccatcccgtacgacccaaagttcgagaagcagctgggccaggtcatgctgctaatcctgtgcgtcactcaggtgctcatgatgcggaccacctgggcattgtgcgaggccttaacccttgccacgggccccatctcaaccctctgggagggtaatcccggccgattctggaataccaccatcgccgtcagtatggcgaacatcttcaggggcagctacctagccggcgctggcctcttgttttccattatgaagaacacgaccaacacccggcgcggcaccggcaacgtgggcgaaacgctgggagagaaatggaagagccggttgaacgccttgggcaaatcggagttccagatctacaaaaagagtggtatccaagaggtggaccgcaccttagcgaaggagggaatcaagcgcggtgaaaccgatcaccacgccgtaagtcgcggcagcgccaaactgcgatggtttgtggagcgcaacatggtaactccggagggcaaagtcgtggatctcgggtgcggcagagggggttggagttactactgtgggggcctgaagaatgtccgcgaggtcaagggactgacgaagggcggccccgggcatgaggagccgatcccgatgagcacctacggctggaatctcgtgcggctgcaatcaggtgtggacgtctttttcactccacccgagaagtgtgatacccttctctgcgacatcggcgagagctcacccaacccaaccatcgaggccggcagaacgctgcgggtgctcaacctcgtggaaaactggctgaataacaacacccagttctgtatcaaagtcctgaatccgtacatgccctccgtaatcgagaagatggagaccctccagcgtaaatacgggggcgcgctggtgcggaatcccttgagcagaaactccactcacgagatgtactgggtgtccaacgcgacggggaacatcgtgtccagcgtgaacatgatctcccggatgctgattaatcgctttaccatgaagcacaagaaggctacctacgagccggacgtcgacctcggcagcgggacccgtaacatagggatcgagagcgaaatacccaatttagacataatcggcaagcgaatcgagaagattaagcaggagcacgagacgtcgtggcactacgaccaggaccacccgtacaagacatgggcctatcatggttcctacgaaactaagcaaaccggcagcgcctccagcatggtcaacggggtagtccgcctgctcacgaagccctgggacgtggtgccgatggtcacccaaatggccatgaccgacactacgcccttcggccagcagcgggtgttcaaggagaaggtggacacccggacccaagagcctaaggagggcactaagaagctgatgaagatcaccgcaaaatggttgtggaaggagctcgggaaggagaagacgcctaggatgtgcacacgggaggagttcacccggaaggtccgatccaacgccgccctgggcgccattttcacggatgagaacaagtggaaatctgcccgggaggcggtggaggacggtcggttttgggagttggtggaccgggagcgcaacctccacctggaggggaagtgcgagacatgcgtctacaacatgatggggaagagagagaagaagcttggcgagttcggcaaggcgaaggggtcccgcgcaatctggtacatgtggttgggcgcccggttcctggaattcgaggcgctgggtttcctgaacgaggaccactggtttagccgcggcaattccctgtcaggggtggagggcgagggcctacacaggctcggatatatcctgcgcgaagtcggaaagaaagaaggcggcgccatgtacgccgacgacaccgccgggtgggacacccggataacgctggaggacctcaaaaatgaggaaatggtgaccaaccacatgaagggggagcacaagaagctcgccgaggcgatcttcaagctgacctaccaaaacaaggttgtgcgcgtgcagcggccgacgccacggggcactgtgatggatatcatctctcggaaagaccagcgcgggtccggccaggtggggacctacggactcaacaccttcaccaacatggaggcccagctgattcgccaaatggagggcgaggggatttttaagaacatccagcacctgacggccaccgaggagatcgccgtgcaaaactggctcgcacgggtgggacgcgagcggctgtctcggatggccatctctggggacgactgcgtggtgaagcccatcgatgaccggttcgcctccgccctgaccgccctcaatgatatgggtaaagtgcgcaaggacattcagcagtgggaaccctccagagggtggaacgactggacccaggtcccattctgcagccaccacttccatgagctggtgatgaaggacgggagggtgctggttgtcccctgccggaaccaagacgagctcatcggcagggcccgaatctcacaaggggcgggctggagcttaaaagagactgcctgtttggggaagtcctacgcccaaatgtggacgctcatgtacttccaccgccgggacttgagactggccgccaacgcgatttgcagcgccgtgccttcccattgggtaccgaccagccggaccacgtggtccatccacgcaaaacacgagtggatgacgactgaagacatgctcgctgtgtggaatcgggtttggattcaggagaatccgtggatggaggacaagacccccgttgagagctgggaggaggtcccctacctgggcaagcgggaggaccagtggtgtgggtccctgatcggcttaaccagccgagcgacgtgggccaagaacatccaaacagcgataaatcaagtgcggtccctgattggcaacgaagggtacaccgactacatgccaagcatgaaacgcttccgccgggaggaggaggaagccggcgtactgtggtag

SEQ ID NO: 24831 - RNA, 9876 nt, synthetic construct
  misc_feature 1..9876: note = derived and/or modified CDS sequence (opt11) from DENV-2__KP188553__SS-prME
  source 1..9876: mol_type = other RNA
accgccggcgtgatcgtcatgttgatccccactgccatggccttccacctcactacccgcaacggggagccgcacatgatcgtgggccggcaggaaaaagggaagtccctgttattcaagaccgaggacggcgtgaacatgtgcactctcatggccatcgacctgggggaactatgcgaggacaccatcacctataagtgcccactgctgaggcagaacgagcccgaggacatcgactgttggtgcaacagcaccagcacctgggtcacctacggtacctgcacaacaacgggcgaacaccggagagaaaagagatccgtggccctggtgccccacgtcgggatgggcctcgagacccgcaccgagacctggatgagctccgagggtgcctggaagcacgtgcaacggattgaaacgtggatcctgcgccaccccggtttcaccataatggccgcgatcctggcgtacaccatcgggaccacgcactttcagcgagccctcatcttcatcctgctgaccgcagtggcgcccagcatgaccatgcgctgcatcggcatctctaaccgggactttgttgaaggggtcagcgggggttcctgggtggatatcgtgcttgaacacgggagctgcgtcaccaccatggccaagaataagcccaccctagacttcgagctgataaagaccgaggctaagcagcccgccacactcaggaagtactgcatcgaggccaagttaacgaacaccaccactgagtccaggtgccccacgcagggcgagccctcgctcaatgaggagcaggacaaacgcttcatttgcaagcactccatggtcgaccggggctgggggaatggctgcggtctgtttggcaagggggggattgtgacctgcgcgatgttcacatgcaaaaagaacatggagggtaaaatcgtccagcccgagaatctagagtacaccatcgtgatcaccccgcacagcggggaggagcacgccgtgggaaacgatactgggaaacacggcaaggagatcaagataaccccgcagtccagcaccaccgaggccgagctgacggggtacggtactgtgaccatggagtgtagcccccgtacaggactcgacttcaacgagatggtgttacttcagatggaggacaaggcctggctggtacataggcagtggttcctggacctgccgctgccctggctaccgggtgccgacactcagggcagcaactggatccagaaagagaccctggtgaccttcaagaacccccacgcaaagaagcaggatgtggtagtgctcgggtcccaagagggtgcgatgcacaccgcgctaacgggggccaccgagatccagatgtccagcggcaatctcctgttcaccggtcatctgaagtgtcgtctgcggatggacaagctccagttaaaggggatgtcgtatagcatgtgcaccgggaagttcaagatagtcaaggagattgccgaaacgcaacacgggacgatcgtcatacgcgttcaatacgagggcgacggcagcccctgcaagatcccctttgagatcacggacctggaaaaacggcacgtcctcgggaggctgataactgtgaatccgatagtgactgagaaggacagccccgtcaacatagaggcggagccgccattcggcgacagttatatcatcgtaggggttgagccgggccagttgaagctcaactggtttaagaagggaagctccatcggccagatgttcgagaccacgatgcgcggcgccaagagaatggccattctgggggacacggcctgggacttcggctccttgggcggcgtcttcacgtccatcggaaaggccctccatcaagttttcggggcgatatacggggccgctttcagcggggtgtcctggaccatgaagatcctgattggcgtcatcatcacctggatcgggatgaacagccgctccacctcactctccgttagcctagtgctcgtgggtgttgtgacgttatacttaggggccatggttcaggcggactcaggatgcatcgtgagctggaagaacaaggaattaaagtgcggctccggtatctttatcacagacaacgtgcacacttggaccgagcagtataagttccagccagagtcgcccagcaagctggcgagcgccatccagaaggcccatgaagaaggcatctgtgggatccgaagcgtaactcgcctggagaacctcatgtggaagcagatcactcccgagctgaaccacatcctctccgaaaacgaggttaaactcaccatcatgacaggtgacatcaaagggataatgcaagcgggcaagcgtagcctgcgccctcagcctactgagctgaagtactcctggaaaacctggggcaaggcgaaaatgctcagcaccgagtcccacaatcagacctttctgatcgacggacctgagactgccgagtgcccgaacaccaaccgggcctggaactcactggaggtggaagactacggcttcggggtatttacaactaatatctggctcaagctgcgcgaaaagcaggacgtgttttgtgactccaagttgatgagcgccgctattaaggacaaccgggcggtgcacgctgacatgggctactggatagaatccgcgctcaacgacacctggaagatggagaaagccagctttatagaggtaaagtcctgccactggcctaagagtcacacgctgtggtccaatggcgttctggagagcgaaatggtgatccccaaaaacttcgcggggcccgtctcccaacacaactaccgtccgggctaccacacccagaccgcaggaccctggcacctgggcaagctggagatggacttcgacttttgcgaggggaccacggtggtggtcaccgaggactgcgagaagcggggccccagcttaagaaccactacagccagcggcaagctcatcactgaatggtgctgtagatcctgcaccctgccaccgctgcgctaccgcggggaggacggctgctggtacgggatggagatccgccccctcaaggagaaggaggagaatctagtgaacagcctggtgaccgccggccacgggcagatcgacaacttttccctcggagttctgggcatggccctttttctcgaggagatgctacggacgcgagtggggaccaagcacgctatcctactcgtggccttatcctttgtgacgctgatcaccgggaatatgtccttccgggacctcgggcgcgttatggtgatggtcggagccaccatgaccgacgacatcgggatgggcgtgacctacctggccttactcgccgcattcaaggtgcgccctaccttcgccgccggccttctactcagaaagctgaccagcaaggagctgatgatggctaccatcgggatagccctcctgtcccagagcacattacccgaaactatcctcgagctgacggacgcgctggccttagggatgatggccctgaagatcgtccggaacatggagaagtaccagctggccgtgaccattatggcgatcagttgcgtgccgaacgccgtgattctccagaacgcctggaaggtgagctgcaccatactcgccgccgtgtccgtcagccccttattgctgacctccagccagcagaaagcggactggatacccctggctctcacgatcaaggggctgaaccccactgccattttcctgaccaccctttcccggacgagcaagaaacgctcctggccgctgaacgaggccataatggcggtgggaatggtgagcatcttggcctcctctctgctgaagaacgacattcccatgaccggacccctggtggccggaggcctgctgacggtgtgctacgtcctgaccgggcgcagcgccgatctcgagctggagcgcgcagccgacgtgaagtgggaggaccaagcggagatctccggctcctcccctattctaagcattacaatctccgaggacgggagtatgtcaatcaagaacgaggaggaggagcagaccctcaccatcctgatccggaccggattactcgtgatcagcggagtgttcccagtttccatccccattacagccgccgcctggtacctgtgggaggtgaagaagcagcgcgccggcgtcctgtgggatgtgcccagcccgccgccggtgggcaaggccgagctcgaggacggggcctaccggatcaagcagcgcggaatcctcggctactcccaaatcggcgcaggagtctacaaggaggggacgttccataccatgtggcacgtcacgcggggcgcagttctgatgcaccgcggaaagcggatcgagccctcatgggcagacgtcaagaaagaccttatctcatacggcggtgggtggaagttagagggcgaatggaaagaaggggaggaggtccaggtgctagcgcttgagcccggcaaaaaccccagggcggtccaaacaaagcccgggatcttcaagactaacaccggcaccatcggggcagtgtcactggacttctcacctggcaccagcggctctcccatcgtggaccgtaaggggaaggtcgtcggcctgtacgggaacggcgtggtcacgcgcagcggtgcctacgtgtccgcgatcgcccagaccgagaagtcgatcgaagacaaccccgagatcgaggacgacatcttccggaagaagcgcctgaccattatggacttgcaccccggagccgggaagaccaagcggtacctgcccgccatcgtgcgtgaggccatcaaacgggggctgaggacgctcatcctggctcccacgagggtcgtggccgccgagatggaggaggccctgcggggcctccccatcagataccagacccccgccattcgggcggaacacacggggcgcgagatcgtggatctgatgtgccatgccacgttcaccatgcggctactcagcccggtccgcgtgccgaactataacctgatcatcatggacgaggcacacttcacggaccccgcctcgatagctgcgcggggctacatctcgacccgcgtggagatgggcgaggcagccgggatcttcatgacggccacgccccccggatcgcgggatccattcccccagagcaatgcccctatcatggacgaggagcgcgaaatccccgagcgttcctggaacagcgggcacgaatgggtcaccgacttcaagggcaagaccgtgtggttcgtaccgagcatcaaggccgggaatgacatcgccgcttgtctacgcaagaacggcaagaaggtcatcccctacagccggaagactttcgactccgaatatgtgaagacccgcgctaacgactgggacttcgtcgtcacgacagacatcagcgagatgggtgccaacttcaaggctgagcgggtgatcgacccccgacgctgcatgaagcccgtaattctcacggacggggaagagcgcgtcatcttagccggcccgatgccagtgacccattcctcagccgcacagaggcgcgggcgcatcggccgtaaccccaaaaacgaaaacgaccagtacatctacatgggcgagccccttgaaaacgacgaggactgcgcacactggaaagaagccaaaatgctcctcgacaatatcaacactcctgagggtatcatcccatccatgttcgagcccgaacgcgaaaaagtagacgccatcgacggcgagtaccggctgcgcggggaagcccggaagacctttgtggacttgatgcgccggggcgacctgccggtgtggctggcatacaaagtggcagcggaggggatcaactacgccgaccggaaatggtgctttgacggaatcaagaacaaccagatcctcgaagaaaatgtcgaggtggaaatatggacgaaagagggggagcgaaagaagctgaagccccgctggctggacgcccggatctacagcgatcccctcgccctgaaggagttcaaggagttcgccgcgggtcgcaagtccctgacgcttaacctgatcaccgaaatgggccgcctgcctaccttcatgacgcagaaggcacgcaacgctctcgacaacctggcggtcctccacaccgccgaggtcgggggcaaggcctacacacacgccctcagcgagcttccggagaccctggagacgctattgctgttgactttactggctgcggtgaccggtggcatcttcctcttcctgatgtccggcaaggggatcggtaagatgactctgggaatgtgctgcatcatcaccgccagcatcttactatggtacgcccagattcagccccactggatcgccgcctccattatcctggagttcttcctcatcgtgctgctgatacccgagcccgagaaacaacggaccccgcaggacaaccaactcacctacgtagtgatcgcgatcctgaccgtcgtggccgccaccatggccaacgagatgggattcctggagaagacgaagaaggacctagggtttggctcaatcaccacccaggagtctgaatccaacatcctggacatcgacctgcgccccgctagtgcgtggaccctctacgcagtggccacgacattcgtcacccccatgctacggcactcaatcgaaaacagctctgtaaacgtgtcactgactgccatcgcgaatcaagccacagtcttgatgggcctggggaaaggctggccactgtccaagatggacataggggtcccgttgcttgccatcggctgttacagccaggttaatcccattaccttaaccgccgccctcctgctgctcgtcgcccactacgccatcatcgggcctggcctgcaggccaaagccacccgcgaagcccagaagcgggcagccgccggcatcatgaagaacccaaccgtggacgggatcaccgtcatcgacctggagcccatcccctacgaccccaagttcgagaaacagctgggccaggtcatgctgctgatcttatgtgtgacccaggtgctgatgatgagaaccacgtgggccctgtgcgaggccctcaccctggcgaccggccccatctccaccctatgggaaggcaacccggggcggttctggaatacgaccatagccgtaagcatggctaatatattccgcggctcctacctcgctggcgcggggctgctgttcagcatcatgaaaaacaccacaaacacgcgacgggggaccggtaatgtgggggagaccctcggcgagaagtggaagtcccgactgaacgctctcgggaagagcgagtttcagatctacaagaagtccggcatccaagaggtggaccggacactcgcgaaggaggggattaagcgcggcgagacggatcaccacgccgtcagccgggggtccgccaaactccggtggttcgtggaacggaacatggtgacccccgagggcaaggtcgtggatctaggttgtgggcgtggtggttggagctactattgtggcgggctcaaaaacgtgcgggaggtcaagggactgaccaagggcgggcccggccacgaggagcccatcccgatgtccacctatgggtggaacctggttcgcctccaatctggcgtggacgtcttcttcacgccgcccgagaaatgcgacaccttactttgtgatatcggggagagctcgcccaacccgaccattgaggcgggacggacccttcgcgtcctgaatctggtggagaactggttaaacaataacacccagttctgcatcaaggtcttgaacccctacatgcccagcgtgatagagaagatggagacgctgcagcggaagtacggcggggccctcgtgcgaaaccctctgtcccgtaacagcacgcacgagatgtactgggtatccaacgcaacgggaaacatcgtctcgtccgtgaacatgatcagccgcatgcttattaacaggttcaccatgaagcataagaaggccacgtacgagccagacgtcgacctggggtccggcacccgcaacatcggcatcgagtccgagacccccaaccttgacatcatcggaaaacgcatcgagaagatcaagcaggagcacgagacctcttggcactacgaccaggaccacccgtacaagacctgggcctaccacggcagctacgagaccaagcagaccggatccgcgagcagtatggtaaatggcgtggtccgcctgttaaccaagccgtgggacgtagtgcccatggttacgcagatggcgatgaccgatacaacccccttcgggcagcagcgcgtgttcaaggagaaagtggacacgcgaacccaggagcctaaggaaggcaccaagaagctcatgaagatcaccgccgagtggctttggaaggagctgggcaaggagaagacgccgcgcatgtgtacccgggaggaattcacccgcaaagtccggtcaaatgctgccctcggtgcggtgtttacagacgagaacaagtggaagtccgcccgcgaggccgtagaagacggacggttctgggaactggtcgaccgcgagcggaatctgcatctcgaaggcaagtgtgagacgtgcgtttataacatgatgggcaaacgcgagaagaagcttggcgaattcggaaaggccaaagggagccgagctatctggtacatgtggctgggagctcggttcctagagttcgaggccctggggttcctgaacgaggaccactggttctcccgggggaattcgctcagcggcgtcgaaggagagggcctgcaccgactgggctacatcctccgggaggtcgggaagaaagagggaggtgccatgtacgccgatgacacagctggctgggacaccagaatcacccttgaagacctgaagaacgaggagatggtgacaaaccacatgaaaggggagcacaagaaactagcagaggccatcttcaagctgacctatcagaacaaggtcgtgcgagttcagcgccccacgccccggggcactgtgatggacatcatctcacgcaaggaccagagagggtctggacaagtggggacgtacggactgaacaccttcaccaacatggaggcccagctgataagacagatggagggcgaaggaatattcaagtccatccagcacctgaccgcgacggaggagaccgcggtgcagaactggctggcccgcgtcgggcgggagagactaagccggatggccatttccggcgacgattgcgtggtcaagcctatcgatgaccggtttgccagtgccctgaccgcgctaaacgatatggggaaggtccgcaaagacatccagcaatgggagccatcccgaggctggaacgactggacacaggtgccattctgcagccaccacttccatgagctcgtgatgaaggatgggcgggtactcgttgtgccctgccgcaaccaggacgaactgatcggccgggcccgtataagtcagggcgccgggtggtcgctcaaggagaccgcctgtctgggcaaaagctacgcccagatgtggacgctaatgtacttccatcgaagggacttgcggctggctgccaatgcgatttgcagcgccgtcccctcccactgggtgccgacgtctcgaaccacctggtccatccacgcgaagcacgagtggatgaccacggaggacatgcttgccgtgtggaaccgagtctggatccaggagaacccgtggatggaggacaaaacccccgtggagagctgggaggaggtgccctatcttgggaagcgcgaggatcagtggtgcggctcgctgatcggtctgaccagcagggccacctgggcaaagaatatccagaccgccatcaaccaggtgcgcagcctcatcggcaatgagggctacaccgactacatgccatccatgaagcgattccgccgcgaggaggaggaggccggcgtgctgtggtaa

SEQ ID NO: 24832 - RNA, 9876 nt, synthetic construct
  misc_feature 1..9876: note = derived and/or modified CDS sequence (opt11) from DENV-2__KP188556__SS-prME
  source 1..9876: mol_type = other RNA
accgccggcgtgatagtcatgctgatccccacggcgatggcgttccacctcaccaccaggaacggggaaccccatatgatcgtgggccggcaagagaaagggaaatccctgctgttcaaaaccgaggacggagtgaacatgtgcaccttaatggccatagacctgggggaattgtgcgaggatacgatcacctacaaatgtcccctcctgcgtcagaacgagccggaagacatcgactgttggtgtaactcgaccagcacatgggttacatacggcacgtgcaccaccacaggggaacaccggcgcgagaaacggtccgtcgccctggttccgcacgtcggtatgggtctcgaaacccgcaccgaaacctggatgagctcggagggggcatggaagcatgtgcaacggatcgagacgtggattttacggcaccctggcttcacaatcatggccgcaattctggcctataccatcgggaccacccactttcaacgtgcactcatctttattctcctgacggcagtcgcgccgagcatgaccatgaggtgtatcggcatctcaaatcgggactttgtggagggggttagcgggggctcctgggtggacatcgtcctcgagcacgggagctgtgtgaccacaatggccaagaataagcccacccttgacttcgagctgatcaagaccgaggccaagcagcccgcaaccctccgcaagtactgcatcgaagccaagctgacgaacacgaccaccgagagccgttgcccgacgcaaggcgaacctagcttaaacgaggaacaggacaagcgatttatctgcaagcactcaatggtggaccggggttgggggaacggttgcgggctgttcgggaagggcgggatcgtgacctgcgcgatgttcacgtgcaagaagaacatggagggtaagatcgtacaacccgagaacctggagtacaccattgtcatcacgcctcacagtggggaggagcacgccgtgggcaatgatacgggtaagcacggcaaggagatcaagattaccccgcaatcctcgacgaccgaggcggagctcacgggttatggcaccgtgaccatggagtgcagccctcggaccgggctcgacttcaatgagatggtgctgctgcagatggaagacaaggcctggcttgtccaccggcaatggtttctggatctccccctcccctggttaccgggggctgacacgcagggcagcaactggatccaaaaggagaccctcgtgaccttcaaaaacccccacgccaaaaagcaggacgtggtcgtactcgggtcacaggagggagccatgcataccgccctgacgggggcgaccgagatccagatgagctcgggcaacctgctctttaccggccacctgaagtgccgcctgcggatggacaagctacagctgaaggggatgtcctattcaatgtgcactggcaagttcaagatcgtcaaagagatcgcggagacgcagcacgggaccattgtgatacgcgttcagtatgaaggggacggctccccctgcaaaatccccttcgaaatcacagacctcgaaaagcggcacgtcctcgggcgcctgataacggtgaacccgatcgtgactgagaaggactcacccgtcaacatcgaggccgaaccgccctttggggactcttacataatcgtgggggtggaaccggggcaattaaagctaaactggttcaagaagggaagctctatcggccaaatgttcgagacgacaatgcggggtgccaagcggatggccatcctgggggatacggcctgggatttcggtagtctaggtggcgtcttcacgagcatcgggaaggccctccaccaggtattcggcgcgatatacggggcggccttcagcggggtgtcctggacaatgaaaatcctgattggcgtcatcatcacctggatcggcatgaactcgagaagtaccagcctatccgtgagcttggtgctcgtaggcgtcgtaactctgtacctgggagccatggtacaggccgattccggctgcatcgtgtcgtggaaaaacaaggagctcaagtgcggctcaggaatcttcatcacagacaatgtccacacctggaccgagcagtataagttccagcccgaaagccccagcaagctggccagcgccatacagaaggcacacgaggagggcatctgcgggatccggagcgtgacgcgcctggaaaacctcatgtggaagcaaatcacccccgagctgaaccacattttatcggagaacgaggtgaaactcaccatcatgacgggcgatatcaaggggataatgcaggctggcaagcggagcctgcgcccgcagccaacggaactgaagtactcttggaagacctggggcaaggcgaagatgcttagcaccgagtcccacaaccagaccttcctgatcgacgggcccgaaaccgcggagtgccctaacacaaaccgtgcctggaacagcctggaggtggaggactatggattcggagtctttacaactaacatttggctcaaactgagagagaagcaagacgtgttctgcgactccaagctgatgagcgccgcgatcaaggacaatcgggcggtgcacgccgatatgggctactggatcgagtccgccctcaacgacacgtggaagatggagaaagccagcttcatcgaagtcaagtcctgccactggcctaagagccacacgttatggagcaacggcgtgctcgagagtgagatggttatccccaaaaacttcgccggacccgtatcgcagcacaactatcgcccgggctaccacacacagaccgccgggccctggcatctcggcaagttagagatggactttgacttctgtgagggtaccacggtggtggtaaccgaagactgcgagaagcggggcccctcgctacgaaccaccaccgccagtggcaagctcatcaccgagtggtgttgccggtcatgcaccctgccaccgctacgctaccgtggggaggacggctgctggtacgggatggaaattagaccgctaaaggagaaggaggaaaacttagtaaacagtctggtgaccgccggccacgggcagatcgacaacttctctctgggggtcctgggcatggcactgttcctcgaggagatgctgcggacacgcgtgggaacgaaacacgcgatcctgctcgtggccctgagcttcgtcaccttgataaccggcaacatgtccttcagggatctggggcgcgtcatggtaatggtgggcgccacgatgaccgacgacattgggatgggcgtgacctatctggcgttactagccgcgtttaaggtgaggcccaccttcgccgcgggcctgttactccggaagctgacgagcaaagaactgatgatggccacgatcggaatcgccctgctgtctcagagcaccttgcccgaaaccattctcgagctgacagacgcgttggcgttaggtatgatggcgcttaagatagtcaggaacatggaaaagtatcagctggcggtaacgataatggccatttcgtgtgtgcctaacgcggtcatcctccagaacgcctggaaggtgtcgtgtactatcctggccgccgtgtccgtgagtcctcttctgctgaccagtagccagcagaaggcggactggatccccctagccctgacgatcaaggggttaaaccccaccgcgatcttcctgactaccctctcccggacgtcgaagaagcgctcctggccactgaatgaggcgatcatggccgtcggcatggtcagcatcctggcgtccagcctcctgaaaaatgacattccgatgaccggccccctggtggcagggggtctcctaaccgtgtgctacgtccttaccggaagaagcgccgacctcgagttagagcgcgccgcggacgtgaagtgggaggaccaggccgagatctccgggtcgtcccccatcttaagcatcacgatttccgaagatgggagcatgtccatcaaaaacgaggaggaggagcagaccctcaccatcctgatccggacaggcctgctcgtcataagcggcgtcttcccggtgtccatccccattacagccgccgcctggtacctgtgggaagtgaagaagcagcgcgccggggtcctttgggatgtgcccagtccgccgcccgtgggaaaggcggaattagaagacggggcctacagaataaagcagcgcggcatcctggggtactcgcaaatcggtgccggcgtctacaaggaggggacgttccacaccatgtggcacgtgacccggggtgcggtgctgatgcaccgtggcaaacggatcgagcccagctgggcagatgtcaagaaggacctcatctcctacggcgggggctggaaactggagggtgaatggaaggagggggaagaagtccaggtgctagcgctcgaacccggcaagaaccctcgcgccgtccagaccaaaccagggatcttcaagacgaataccggcacgatcggtgccgtgagcctggacttctccccaggaaccagcggcagccccatcgtggaccggaaggggaaagtcgtgggcttatatgggaacggagtggtgacgcgaagcggcgcgtacgtgtccgccatcgcccaaacagagaagtccattgaggacaaccccgagatagaggacgacatcttccgaaagaagcgcctgaccattatggacttgcaccccggggcaggaaaaaccaagagatatctgcccgccattgtgcgtgaggcaatcaagcgcggtctgcgcacgctcatcctggcgccgaccagggtcgtggcggccgagatggaggaggccctgagaggcttacccatccgataccagacccccgccatccgagcggagcataccgggcgcgagatcgttgacctgatgtgccatgccacgttcaccatgcggctgttaagccccgtccgggtgccgaactacaacctgattatcatggacgaggcacacttcaccgaccccgcgtccatcgcagcccgcggatacatttctacccgcgtggaaatgggcgaggccgcgggaatcttcatgacggccacgccacccggcagccgggacccgttcccacagagcaacgcgcccatcatggatgaggagcgcgagattcccgagcggtcctggaacagcgggcacgagtgggtcaccgacttcaaaggcaagaccgtgtggttcgttccatcgatcaaggccgggaacgacattgctgcatgcttacgcaagaacggaaagaaggtcatccagctcagtcgtaaaactttcgactccgagtacgtgaagacacgcgccaacgactgggacttcgtagttactacggacatcagcgagatgggggcaaacttcaaggcggagcgggtgatcgaccccagaaggtgtatgaagcccgtcatccttacggatggggaggagcgggtcatcttagcaggccccatgccggtgacccattcctccgcggcccaaagacgtgggcgcatcggccggaaccctaagaacgagaacgatcaatacatctatatgggggaacctctagaaaacgacgaagactgcgcgcactggaaagaggccaagatgcttctggacaacattaacactcccgaaggtatcatcccgtctatgtttgagcccgagcgcgagaaggtggacgccatcgacggggagtatcggctcagaggggaagccaggaaaacgttcgtcgacctcatgcgccggggcgacttaccagtgtggctggcgtataaggtggcggccgaggggatcaactacgccgatcgcaaatggtgctttgacggtatcaaaaacaaccagatccttgaggagaacgtcgaggtggaaatctggaccaaggagggagaaaggaagaaactgaagccgcgctggctcgatgctcggatttactcagatcccctggcgttgaaggagttcaaggagttcgcagccggccgcaagtccctcaccttaaacctgatcacggagatgggccggctcccgaccttcatgactcagaaggcccgcaacgccctggacaacctggcggtcctccacactgctgaggtcgggggcaaggcctacacccacgccctcagcgagctgcccgaaaccctcgaaacgctgctgttgctgactctgctggcggcggtgaccggaggcatcttcttattcctgatgtccggcaaggggatcggtaaaatgaccctagggatgtgctgcataatcactgccagcatcttgctttggtatgcccagatacagccgcactggatcgccgcctccatcatcctcgagttcttcttaatcgttctcctcataccagaacccgaaaagcagcggacgccccaggacaatcagctgacctacgtcgtgatcgcgatcttaacggtcgtggccgccaccatggcgaacgagatgggtttccttgaaaagacgaagaaagatctggggtttggctcgattaccacccaagaatcagagtccaacatcctggacatcgacctcaggccggccagcgcgtggaccctgtacgccgtagccaccaccttcgtcacccccatgttacggcacagtatagagaacagctccgtcaacgtgagcctgaccgccatcgcgaatcaggccactgtcctcatgggactcgggaagggctggcccttgtccaagatggacatcggagtgcccctattggcaatcggctgctacagccaggtgaaccccatcaccctcaccgcagccctcctgctcctggtggcgcactatgctatcatcggtcccgggctacaggccaaagccacccgtgaggcccagaagcgggcggcagccggcatcatgaagaaccccacggtggacgggatcaccgtaatagacttggagccgatcccgcacgaccccaagttcgagaaacagctgggccaggtcatgctgctcatcttgtgcgtcacccaggtgctcatgatgcgcacaacatgggccctctgcgaggccctgaccctggcgaccgggcccatcagtaccctctgggaaggcaaccccggcaggttctggaacacgaccatcgcagtgagcatggccaacatcttccgcggctcctaccttgctggtgcgggtctcctttttagcatcatgaagaacaccaccaacacccgacgtggcaccgggaacgtgggagagaccctgggggagaagtggaagtcacggttaaacgcgctcggcaagagcgagtttcagatctataaaaagagcggtatccaagaggtggaccggactctagccaaagaggggataaaacgaggagagacggatcatcacgccgtctctcgagggtccgccaaacttcgctggttcgtggagcggaacatggtgacccccgagggcaaggtcgtggacttaggctgtgggcgcggcgggtggagttactattgcggcgggctgaaaaacgtgcgggaggtgaaggggctaaccaagggaggccccggccacgaggagcccatccctatgtccacctacgggtggaacctggtgcgcctgcagtcgggcgtggacgtcttcttcacgccgccggagaagtgcgacaccctgctctgcgacatcggggagagttccccgaaccccaccatcgaggcaggcagaaccctgcgagtgctgaacctcgtggagaactggctgaacaacaacacccagttttgtatcaaggtgctcaacccgtacatgcccagcgtgatcgaaaagatggagaccctgcagcgaaagtatggcggggccctggtccgcaaccccctgtcccgaaacagcacccacgaaatgtattgggtctccaatgcaaccggaaatatagtgagcagtgtgaacatgatctcccgcatgctgatcaaccggttcacaatgaaacacaagaaggccacatatgagccggatgtcgacttggggtccggcacccgcaacatcgggatcgaatcagagacgcccaacttagacatcatcggcaagcggatcgagaagatcaagcaagagcacgagacctcctggcactatgaccaggaccatccctacaaaacgtgggcctaccacggaagctacgagaccaaacaaaccgggtccgccagctccatggtaaacggcgtggttcgattgttaacaaagccctgggacgttgtgccgatggtcactcagatggccatgactgataccacccccttcgggcaacagcgagttttcaaggagaaagtggacacgcggactcaggaacccaaggagggcactaagaagctgatgaagatcaccgcagaatggctctggaaggagctgggcaaagagaagacgccccgcatgtgcacccgggaagagttcacccgcaaggtgcggagcaacgcggccctgggggccgtgttcaccgacgagaacaagtggaagtccgcgagggaggccgtggaagacggacggttttgggagctggtcgaccgtgagcgcaacctccatctggagggtaagtgcgagacgtgtgtgtacaacatgatgggcaaacgcgagaagaaattgggagagttcggcaaggcaaaagggtcgcgggctatctggtacatgtggctcggcgcccgattcctggagtttgaggcgttgggcttcttgaacgaagaccattggtttagtcgggggaacagcctgagcggcgtcgagggggagggcctgcaccgcctcggctacatattacgggaggtagggaagaaagaaggtggggcgatgtacgcggatgacaccgcgggttgggacacgcgcatcacactggaggacctcaaaaacgaggaaatggtgactaaccacatgaagggggagcacaagaagctagctgaggctatctttaagctgacctatcagaacaaggtagttcgggtgcagcgtccgacgcccagaggaacagtcatggacatcatctcccgcaaagaccaacgggggtcaggccaagtggggacttacggactcaacaccttcaccaacatggaagcccaattgattcgccagatggaaggcgagggaatcttcaaatccatccagcatctgacggccacagaggaaacagcggtgcagaactggttagcccgggtcgggagggaacgcctgagccgtatggctatcagtggcgacgattgtgtagtgaagcccattgatgatcgttttgcgagcgccctgacggcactcaacgatatggggaaggtcaggaaggacatccagcagtgggaaccgtctcgaggctggaacgactggacacaggtgccgttttgctcgcatcacttccacgagttggtgatgaaggacgggcgggtcctggtggtgccctgccgcaaccaggacgagttaatcggtcgggctagaatttcccagggggcagggtggagcttaaaggagaccgcttgcctcggtaagagttacgcccaaatgtggactctcatgtacttccaccggcgcgatctgcgtctggcggccaatgcaatctgctctgccgtcccctcccattgggtgcccaccagccgcactacctggagtatacacgcgaagcatgaatggatgacgaccgaggacatgctcgccgtatggaaccgggtctggatccaagagaacccatggatggaggacaagaccccagtggagagctgggaggaagtaccttacctcggtaagcgcgaggaccagtggtgcggctccctgattgggctgacctcccgcgccacgtgggccaaaaacatccagacggccatcaaccaggtccgcagcctgattggaaacgagggctataccgattacatgccgtccatgaagcggttcagacgcgaggaagaagaggcgggggtgctgtggtaa

SEQ ID NO: 24833 - RNA, 9876 nt, synthetic construct
  misc_feature 1..9876: note = derived and/or modified CDS sequence (opt11) from DENV-2__GU369819__SS-prME
  source 1..9876: mol_type = other RNA
accgccggcgtcatcgtcatgctgatccccaccgctatggcgtttcacttaaccacccggaatggggagcctcatatgatcgtggggcgccaggagaagggaaagtccctcctgttcaagaccgaagatggcgtaaacatgtgcaccctcatggccatcgacctgggggagctgtgcgaggacacaatcacctacaagtgccccctactgcgtcagaacgagcccgaggacatcgactgttggtgcaacagcaccagcacttgggtcacctacgggacatgcaccacgacgggcgaacaccggcgcgagaagcggtcggtcgccctggtgccccacgtcggtatgggcttagagacacggaccgagacctggatgtcttccgaaggggcctggaagcatgtgcaacgaatcgagacgtggatcctgcgtcacccgggtttcaccatcatggctgcgatcctagcctacaccatagggaccacgcacttccagcgggcactcatattcatcctcctgaccgccgtggctccctcaatgacaatgaggtgcatcggcatctccaaccgggacttcgtcgagggcgtgagcgggggctcctgggtggacatcgtcctcgaacacggaagctgcgtgaccaccatggctaagaacaagcccaccctggacttcgagctgatcaagaccgaggctaagcagcccgcaaccctacgcaagtactgtatcgaggccaagctgacgaacactaccaccgagtcgcggtgccccacacagggagagcccagcctgaacgaggagcaagacaaacgcttcatctgcaaacactccatggtggaccggggttgggggaacgggtgcggcctgttcggaaagggcgggatcgtgacctgcgcgatgtttacgtgcaagaagaatatggagggcaaagtggtacaacccgagaacctggaatacactatcgtcataacgcctcacagcggagaggagcacgccgtcggcaacgataccgggaagcacgggaaagagattaagatcactccgcaatcttcaatcactgaggccgagctgactgggtacggaactgtcactatggagtgcagccccaggacgggcctggacttcaacgagatggtcctgctccagatggagaacaaggcctggctcgtgcatcgtcagtggtttctggatcttccgctcccctggttgccgggtgccgatacccagggctccaactggatccaaaaggagacgctcgtgaccttcaaaaacccccacgcaaagaagcaagatgtagtagtgttagggtcccaggagggcgctatgcacaccgcgctcaccggagccactgagatccagatgagcagcggcaaccttctgttcaccggtcatctgaagtgtcgcttacggatggacaagctccagctgaagggcatgtcgtacagcatgtgcaccggcaagttcaagatcgtgaaggagatcgccgagacgcagcatggcacgatcgtgatccgcgtgcagtacgaaggcgacggctcaccttgcaaaatccccttcgaaatcaccgatctggagaagcggcacgtgttggggcgcctgatcaccgtgaacccgatcgtcaccgaaaaggacagccccgtgaacatcgaggcggaacctcccttcggtgactcctacataataatcggggtagagccaggccagctgaagctaaattggtttaaaaaggggagctccatcggacagatgttcgagacgaccatgcgtggcgccaagcggatggccatcctgggggacaccgcatgggacttcggcagcctcggaggcgtctttacctccatcgggaaggccctccaccaagtgttcggagccatctacggcgccgcgttcagtggtgtgtcctggactatgaagatcctaatcggcgtcattatcacctggatagggatgaacagcaggagcacatcgctgtccgtgagcctcgtgctcgtgggcgttgtgactttgtacctgggggctatggtcagagctgattccggctgcgtggtaagctggaagaacaaagagctcaagtgcggctccgggatcttcatcactgacaacgtccatacatggaccgagcagtataagttccagcccgaatctccctccaagttagcctccgccattcagaaggcccatgaggagggtatctgcgggatccggtcggtgacaaggctggagaacctgatgtggaagcagatcacgcccgagttaaaccacatcctgtcggagaacgaggtgaagctcacgatcatgaccggcgacatcaaagggatcatgcaggccggcaagcgcagcctccggccccagccgaccgagttaaagtactcctggaagacgtggggaaaggcgaagatgttgagcaccgagtcccataaccagacgttcttaatcgacgggccggagaccgctgagtgtccgaacacgaatcgcgcttggaacagcctcgaggtcgaagactacgggttcggggtgttcaccaccaacatatggctcaagctgagggagaagcaggacgtgttctgcgactccaagctgatgtcagccgccatcaaagacaacagggcggtacacgccgacatgggctactggatcgagtccgcactcaacgacacctggaagatggagaaggccagcttcatcgaggtgaagtcctgccactggcccaagagccacaccctttggagcaacggggtgctggagagcgagatgatcattcccaagaactttgccgggcccgtctcgcaacacaactaccggccgggctaccacacgcagacagcagggccctggcacctcggcaagttggaaatggacttcgatctatgcgaggggaccaccgtagtggtgacggaggactgcggaaatcgcggccccagcctccggaccaccaccgccagcgggaagctgatcacagagtggtgctgccgctcctgcacactaccccctctccggtaccgcggcgaggacgggtgctggtacggcatggaaattcggccactgaaagagaaggaggagaacctggttaacagtcttgtgacagccgggcatggccagatcgacaacttctccctcggcgtattagggatggccctcttcttagaggagatgctgcgcactcggatcggcaccaagcacgctattctccttgtggccgttagctttgtcaccctgatcaccggcaacatgtcgttccgagacctggggcgcgttatggtgatggtgggggctaccatgacggacgacatcggcatgggcgtgacctatctggcgctgttagcagcgttcaaagtgcggccaacctttgccgcgggtctgcttcttcgcaagctgacctctaaggaactgatgatggctacgatcggcatcgccttgctgtcgcaaagcaccatccccgagactatcctggagctcacagacgccctggcactcggaatgatggtcctcaagatcgtgcgcaacatggagaagtaccagctggccgtgacgatcatggccatatcgtgcgtcccgaacgcggtgatcctgcagaatgcgtggaaggtgagctgcacgatcctcgctgccgtctccgtgtcgcccctgttgttaacctccagccagcagaaggcagactggatccctctggcgctgaccatcaaaggcctcaaccctacggccattttcctgaccacactatcccgcaccagcaagaagagatcctggccgctcaatgaagccatcatggccgtaggcatggtgagcatcctggcctcgtcactactcaaaaacgatatcccaatgacgggtcccctggtggcgggcggtctactcactgtttgctacgtgctgaccggccgtagcgccgaccttgagctcgagcgtgccgccgacgtgaagtgggaggaccaagccgagatctccgggagctctcccatcctgagcatcacaataagtgaggacggcagcatgagcatcaagaacgaggaggaggagcagacgctgaccatcctcatccgcaccggcctgttggtcataagcggggtgtttccggtgtccatacccatcactgcggcagcctggtacctctgggaggtcaagaagcagcgggccggcgttctgtgggacgtgcccagcccgccgccagtcgggaaggctgaactggaggacggcgcgtaccgcataaaacaaaagggcatcctcggctactcccagatcggcgccggggtgtacaaagagggcactttccacacgatgtggcacgtgacccgcggggccgttctgatgcaccggggcaagcggatcgagccgagctgggcagacgtgaaaaaggatctgatctcctacgggggaggctggaagctagagggggagtggaaggagggcgaggaggtgcaggtcctggccctagagcccggcaaaaacccgcgcgcggtgcagaccaagccgggcatattcaagaccaacaccggcaccatcggcgccgtgagcctcgacttctccccaggcacaagcgggtccccgattgtcgatcggaaagggaaggtggtggggctgtacggcaacggcgtcgtgacccgcagcggggcgtacgtctccgccattgcgcaaactgagaagtccatcgaggacaaccccgagatcgaagatgatatcttccgaaagaagcgtctgaccatcatggatctgcacccgggcgccgggaagacgaagcggtacttacccgccatcgttcgcgaggctatcaagcgcggattgcgcactctgatcttagcaccgacccgcgtggttgcggccgaaatggaggaggccctgcgggggcttcccatccgctatcagaccccggccatcaagaccgagcacacgggccgggagatcgtcgacctcatgtgtcacgccacgttcactatgagactgctgtctcccgtgcgggtgccgaactacaatctcatcatcatggacgaagcgcacttcaccgaccctgcctccatcgccgcccgcggatacataagcacccgggttgaaatgggggaggccgcgggtattttcatgaccgccacgccccccgggtcccgtgacccgttcccgcagagcaacgcccccataatggacgaggaacgggagatcccagagagaagctggaactccggccacgagtgggtcaccgacttcaaggggaagactgtttggtttgtcccgtccatcaaggccgggaacgatatcgccgcctgcctgcggaagaacggcaaaaaggtgatacaactatcccgcaagacttttgattccgagtacgtgaaaacccgagcaaacgactgggacttcgtcgtgaccacggacatctcagaaatgggggccaattttaaggccgagcgcgtgatcgacccgcggcgctgtatgaagcccgtcatactcacggacggtgaagagagggtgatcctggcggggcccatgcctgtaacccatagtagcgcagcccagcgccggggacgcatcggtcgcaaccccaagaacgagaacgaccagtacatctacatgggggagcccctggagaatgatgaagactgtgcccattggaaggaagccaagatgctcctggataacatcaacacccccgaaggcatcataccctccatgttcgagcccgagagagagaaggtcgacgccatcgacggcgagtatcgcctccggggcgaggcccgcaaaaccttcgtggacctcatgagacgcggagacctgcccgtatggctggcgtacaaggtagccgccgaaggcataaattacgcagatcggaagtggtgcttcgatggcataaagaacaaccaaatcctggaagagaatatcgaggtggagatctggacgaaagagggcgagcgcaagaagctgaagccacggtggctggatgccagaatctactcggatcccctcgcgctgaaagagttcaaggagttcgccgcgggccggaagtcactgacgctcaacctgatcacggagatgggacgcttgcccacctttatgactcagaaggcccggaacgcccttgataacctggccgttctccacaccgccgaggcgggcggacgcgcctacaaccatgcactgagcgagttgcccgagaccctggaaaccctcctcttgctcactctgctggccaccgtgacggggggtatctttctctttcttatgtccgggagagggatcgggaaaatgaccctgggcatgtgctgcattatcaccgcctccatcctcctgtggtacgcgcagatccaaccgcactggatcgccgcctccatcatcttggagttctttctaatcgtgctgctgatccccgaaccagagaagcagcgtacgccccaagacaaccagctcacatacgtcgtaatcgccatcctgacggtggtggccgcgaccatggccaatgagatggggttcctggagaagacgaaaaaggacctcggtctgggcagcatcacaacccaggaaagcgagagtaacatcctggacatcgacctccgcccagcctctgcctggaccctgtacgcagtggcgacgaccttcgttacgccaatgctgcgccattccatcgagaacagctccgtcaacgtgagcctcactgcaatcgccaatcaagcgacggttctgatgggtctgggcaaggggtggccgctatccaagatggatatcggcgtccccctgctagcgatcgggtgctacagccaggtgaacccaatcacccttaccgccgccttactgctactggtggcccattacgccatcatcggcccgggcctgcaggccaaagccacccgggaggctcagaagcgcgcagccgcgggaataatgaaaaaccccacggtcgacggaatcaccgtgattgacctggagccgataccgtatgaccccaaattcgagaagcagttaggacaggtcatgctgctcatcctttgcgtcacacaagtgctgatgatgcggacaacttgggccctctgcgaggccctgaccctggccacagggcccatttccaccctctgggaggggaaccccggccgcttttggaatacgaccatcgccgtgtcaatggctaatatcttccggggctcctacctggccggggccggtctcctattctccatcatgaaaaacaccaccaacactcgacgcgggaccggtaatattggagagaccctgggggaaaagtggaagagtcgtctgaatgccctcggcaagagtgaatttcaggtctacaagaagtccgggatccaggaggtcgacagaacgctggcgaaagagggaataaagcgcggggagacggaccaccatgcggtgtcacgagggtcagccaagctgcggtggttcgtcgagcgcaacatggtgaccccggaggggaaggtggtcgacctcgggtgcggccgcggcggctggagctattactgcgggggcctgaagaatgtgcgcgaagtgaagggcctgaccaagggcggccccgggcacgaggagcccatacccatgtccacatacggctggaacctcgtccggctgcagtcgggggttgacgtgttctttacgccgcccgaaaagtgtgacacgctgctgtgcgacatcggcgagagctccccaaaccctacaatagaggctggccggaccctgcgggtcctgaacctcgtagagaattggttaaataacaacacccagttctgtataaaggtgctgaacccgtacatgcccagcgtcatcgagaagatggaagccctccagagaaagtatgggggcgcgcttgtgcggaatcccctgtcacgcaacagcacgcacgagatgtactgggtgtctaacgcaaccggtaacatcgtcagctccgttaacatgatcagccggatgctgattaaccgctttaccatgaaacacaagaaggccacctacgagcctgacgtggacctcggcagtggaactcggaatatcggcatcgagagcgagatacctaacctggatattatcggcaaacgcatcgagaagatcaaacaggagcacgaaacgtcctggcactacgatcaagaccatccctacaagacctgggcctatcacggtagctacgaaaccaagcagacaggttccgccagctccatggtaaacggggttgtgaggctgctgaccaagccttgggacgtcctgccgatggtgacccagatggcgatgaccgacacgacccctttcggccagcagcgggtcttcaaggagaaggtcgacacccgaactcaggagcccaaggagggcacgaagaagctgatgaagatcaccgccgagtggttatggaaagagctggggaagaaaaaaacgccccgtatgtgcacccgcgaggagttcacgagaaaggtgaggagcaatgccgccctcggcgccatcttcacggacgagaacaaatggaagagtgctcgggaggccgtggaggacgggcgtttctgggaactcgtcgaccgagaacgaaaccttcacctcgagggaaagtgcgagacctgcgtgtacaacatgatggggaagcgggagaagaaactcggcgagttcggaaaggccaaagggagccgcgccatctggtacatgtggctgggggcgcgtttcctggaattcgaggctctcgggttcctaaatgaggaccactggttctcacggggcaacagcttaagcggggtcgagggagagggcctccatcggctggggtacatcctgcgggacgtcggcaagaaggagggcggcgctatgtatgccgacgacaccgctgggtgggacacgcgaatcaccctcgaggatctgaagaacgaggagatggttactaaccacatgaagggtgagcataaaaaattagcagaggctatcttcaagctcacctaccaaaacaaagtcgtgcgcgtgcagcggccgacgccccgcggcactgtcatggacataatttcccggcgcgaccagcgcggtagcggccaggtgggtacctatgggctaaacaccttcacaaatatggaggcccagctgatcagacagatggagggggaggggatcttcaagtcaatccaacacttaacagccacagaggagatagcagtgcaaaattggctggcgcgggttggccgggagcgcctgtcacggatggccatctccggggatgattgcgtggtgaagccgatcgacgacagattcgcctctgcactcaccgccctcaacgacatgggcaaagtcagaaaggacatccagcagtgggaaccgtcccgcgggtggaacgactggacacaggtaccgttctgcagccaccacttccacgaactggttatgaaagacggacgggtactcgtggttccttgtcgcaaccaggacgagctgatcggcagagcacgcatctcccaaggggcgggctggagcctcaaggagaccgcgtgccttggtaagtcctacgcccaaatgtggacccttatgtacttccaccggcgcgacttgcggctcgccgcgaacgccatctgcagcgcggtgccgccccattgggtgccaacttcccggacgacgtggagcatccacgccaagcacgagtggatgaccaccgaggacatgctggcggtgtggaaccgggtgtggatacaggaaaatccctggatggaggataaaacccccgtagagtcctgggaggaggtgccctatctgggcaagcgcgaagatcagtggtgcgggagcttgatcggcctgacgtcccgcgccacctgggccaagaacatccagaccgccatcaaccaggtccgcagcctgatcggcaacgaagagtacaccgattacatgccgagtatgaagagattccgccgcgaggaggaggaagccggggttctctggtga

SEQ ID NO: 24834 - RNA, 9876 nt, synthetic construct
  misc_feature 1..9876: note = derived and/or modified CDS sequence (opt11) from DENV-2__JX649147__SS-prME
  source 1..9876: mol_type = other RNA
acggccggtgtgatcatcatgctgatcccaaccgcgatggcgtttcacctcaccacccgcaatggggagccacatatgattgtagggcggcaggagaagggcaaaagcctgctgttcaagactgaggacggcgtgaatatgtgcaccctcatggccatagaccttggggagctgtgcgaggataccatcacgtacaaatgccccctcctacgccaaagcgaacccgaggatatagactgctggtgcaatagcacctcaacctgggtgacctacgggacctgcaccaccacgggcgagcaccggcgggagaagcgcagcgtcgccctggtgccccacgtgggaatgggcctcgagacccgaactgaaacatggatgtccagcgagggggcctggaagcacgcccagcgaattgagacatggatcctgcgccaccccggcttcaccatcatggccgccattctcgcctacaccatagggaccacgcacttccaaaaagccctcatatttatcctgttaaccgcggtcgccccctccatgactatgcgatgtatcggcatcagcaaccgcgacttcgtggagggcgtctccggtgggagctgggtggacatcgtactcgagcacggttcctgcgtaactaccatggcaaagaacaaaccgactctggacttcgagcttatcaagaccgaggccaaggagcccgccaccctccggaaatactgcatcgaggcgaagctgacgaacaccaccaccgagagccgctgcccaacgcagggcgagccctccctaaacgaggagcaggacaagcggtttgtgtgtaagcactcaatggtggatcgcggctgggggaacggctgcgggctgttcggcaagggtgggatagtcacctgcgccatgttcacatgcaagaagaacatggagggcaagatcgtccagcccgaaaacctggagtacaccatcgtcatcacgccccattccggagaagagcacgcagttggaaacgacacaggcaagcacggcaaggagatcaagatcaccccgcagtcctccattaccgaggccgaactaaccgggtacggtacggtaaccatggaatgcagcccgcggaccggtctcgacttcaacgaaatggtgctgttgcagatggaggataaggcttggctcgtgcaccggcaatggttcttagacctgcccctcccctggttgcccggagcggacactcaggggtccaactggatccagaaggagacgctcgtgaccttcaagaaccctcacgccaagaagcaggacgtggtggtcctcgggtcgcaagagggcgccatgcacactgccttgaccggggccacggagatccagatgtcatccggtaatctcctgttcaccggccacctgaagtgcagactgcgaatggacaaactccaactgaaagggatgagctactccatgtgcaccggcaagtttaagattgttaaggagatcgcggagacccagcatgggacgatcgtaatccgggtgcagtacgagggcgacggatcgccctgcaagatccccttcgagatcatggacctggagaagcgtcacgtgctcggccggctgatcaccgtcaacccgatcgtaaccgagaaggattcccccgtaaacatcgaggccgagccgccgttcggcgactcctacatcatcatcggggtagagccgggtcagcttaagcttaattggttcaagaaagggagtagcatcggccaaatgttcgagaccacgatgcgcggcgccaagcgcatggccattctgggcgacacggcctgggactttggctccctgggcggagtgttcacgagcatcggtaaggcgctccaccaggtcttcggtgccatctatggcgccgccttttctggggtgagctggaccatgaaaatcctgattggcgtgatcatcacgtggatcggtatgaactcccggtcaacctccctgagtgtgtcactggtcctcgtgggcgtgatcaccctgtacctgggggcaatggtccaagctgactcaggctgtgtggtaagctggaagaacaaggagttaaagtgcggcagcggcatttttatcaccgataacgtccacacgtggaccgagcagtacaagttccaacccgagtccccatccaagctggccagcgccatccagaaggcccacgaggagggcatctgcggcatccgcagcgtgacccggctcgaaaacctcatgtggaagcagataacccccgagctcaaccacatcctttcggagaacgaagtcaagctcacgatcatgaccggggatataaaagggattatgcaggcgggtaaacgctccctgcggccgcagcccactgagttgaagtatagctggaaaacctggggcaaggccaagatgctctccacagaatcccacaaccagaccttcctgatcgacgggcccgagaccgctgagtgcccgaacaaaaatcgcgcctggaactccctggaggtagaggactacggcttcggtgtgttcacgacgaatatctggctcaaattgcgggagaagcaggacgtcttttgcgacagcaagcttatgtcggccgcgatcaaggacaaccgcgcggtccacgccgacatgggctactggatcgagagcgccctcaacgacacgtggaagatggaaaaggcctccttcatagaagtcaagagctgccactggcccaagtcccacaccctgtggtcaaacggtgtcctggagtccgagatgatcatccccaagagcttcgcggggcccgtgagccaacacaactaccgaccaggttactacacccagaccgccggaccctggcacttgggcaaactggagatggacttcgacttctgcgagggaacgacagtggtggtcaccgaggactgcggcaaccgcggcccttccctgcggaccacgaccgcgagtgggaagttaatcaccgagtggtgctgccgctcttgcaccctgcccccattacgataccgtggcgaggacggatgctggtacggcatggagatccggccccttaaagaaaaggaggagaacctggtcaacagcctggtgacggcggggcacggtcaaatcgacaacttttccctcggcgttctggggatggcgctattcttggaggaaatgctgcgcacccgggtaggaaccaagcacgcgattctcctagtggctgtgagcttcgtgaccctgatcacgggcaacatgagtttccgcgacctcggtcgggtgatggtaatggtgggggcaaccatgaccgacgacatcggcatgggagtgacttacctagccttacttgcggctttcaaggtccgccccacgtttgccgctggcctcctgctgaagaagcttaccagcaaggagctgatgatggccaccattgggatcgcactgctctcacagagtaccatcccagagacgatccttgagttaacagacgccctcgccctgggaatgatggtgctcaagatcgttaggaatatggaaaagtaccagctcgctgtcaccatcatggccatcagttgcgtgccgaacgcggtaatcctgcagaacgcctggaaggtcagctgtaccatcctggccgcggtgagcgtgagccccctcttactaacatccagccagcagaaggccgactggatccctcttgccctaaccatcaaaggcctgaatcctaccgccatcttcctcaccacgctgtcccggacgagcaagaaacgctcctggccgttgaacgaagccataatggccgtagggatggtgagcatcctcgcaagttcactgctcaagaacgacatccccatgactgggcccctagtcgccggcgggctgctgaccgtttgctatgtgctaacgggtcggagcgccgacctggagctggagcgagccactgacgtgaagtgggaggaccaagccgagatcagcggcagttcccccatcctatcgatcaccatcagtgaagatggctctatgtcaattaagaatgaggaggaggagcagacgctgacgatccttatccggacaggactactggtcatcagcgggctgttcccgatgagtatacccattaccgcggccgcctggtacctctgggaggtcaagaaacagcgcgccggggtgctttgggacgtgcccagccccccgccagtggggaaggctgaactggaagatggcgcgtaccggatcaaacagaaggggattctcggctattcccaaatcggcgctggggtctacaaagaaggaacgttccacaccatgtggcacgtgacgcgcggggccgtgcttatgcaccgggggaagcgcatcgagcccagctgggccgacgtcaagaaggacctcatctcctacgggggcggctggaagctcgaaggggagtggaaggagggcgaggaggtccaagtgcttgccctggagcccgggaagaaccccagggcagtccagacaaagccggggcttttcaaaacgaataccggtactatcggcgccgtttcactggacttctcccccggcacgagcgggtcacccatcgtagaccgcaagggcaaggtcgtggggctgtacggcaacggcgtggtgacccggagcggagcctacgtgtcagccatcgcacagaccgaaaagtccattgaggataatcccgagatcgaggacgatatcttccgcaaaaagcgcttgaccataatggacctacaccccggggccggaaagacaaagcgctacctgcccgcgattgtgcgggaagccatcaagcgcggcctgcggaccctcatcctggccccgacaagggtcgtggcagccgaaatggaggaggcactgcgaggcctgccaatccgctaccagacgcccgccatccgagcagagcacaccggtcgggagatcgtggacctgatgtgtcacgcgacctttaccatgcgtctgctcagccccgtacgggttccgaactacaacttaatcatcatggatgaggcccactttacggacccggcctccatcgcagctcgcggctacatcagcacgcgagtagaaatgggggaggcggccggcatcttcatgaccgccacgccgccaggttcgcgagaccctttcccccaaagcaacgcccctatcatggacgaggagcgggagatccccgaacgttcctggaatagcggccacgagtgggttactgacttcaaggggaagaccgtgtggttcgttccgtccatcaaggcgggcaatgacatcgcggcctgcctacggaagaacggcaagaaggtcatccagctcagccgcaagaccttcgactccgagtacgtgaagacccggactaatgactgggacttcgtggttactacggatatcagtgagatgggagccaacttcaaggccgagcgcgtcatcgacccccggcgctgcatgaagcccgtgatcctgaccgacggagaggaacgcgtcatcctggcggggcccatgcctgtgacgcactccagcgccgcgcagagacggggccgcatcgggcggaaccccaagaacgagaacgaccaatacatctatatgggcgagcccctcgagaatgacgaggactgcgcacattggaaggaggctaaaatgctgctggacaatatcaacacgccggagggcatcataccgagtatgttcgagcccgagcgcgagaaggtagacgcgatcgacggcgagtaccgcctgcgaggcgaggcccgcaaaaccttcgtcgacctgatgcggcgtggagatctgcccgtgtggctcgcctaccgggtggctgccgagggcattaattacgcggacagacggtggtgcttcgacggcgtcaagaataaccagatattagaggagaacgtggaggtggagatatggactaaagagggtgaacgcaaaaagctgaagccccgatggctcgacgcccgaatctactccgaccctctggcgctgaaggaattcaaggaattcgccgcgggcagaaagagtctcacgctgaacctaatcactgagatggggcgcctccccacttttatgacccagaaggcccgggatgccttagacaacctggccgttctccacacggccgaggcgggcgggcgcgcctacaatcacgcactgtcagagctgcctgagactctggagaccttactgttgcttaccttgcttgccacggtgaccggcgggatattcttgttcctcatgagcgggaaaggcgtgggtaagatgacactcgggatgtgctgcatcatcaccgcatccatcttgctgtggtacgctcagatccagccgcactggatagccgctagcatcatcctcgagttcttcctgatcgtcctgctcatccccgagccggaaaagcagcggacgccacaggacaatcagctgacgtatgtggtcatcgcaatcctgaccgtggtggccgctaccatggccaacgagatggggttcctcgagaagaccaaaaaggacctgggcttgggatccatcgcaacgcaagagccggaaagcaacatcttagatatcgacctccgacccgcctccgcctggaccctatacgcggtcgctaccacctttgtgacgcccatgctccggcacagcatcgagaactcaagcgtgaacgtatccttgacagccatcgcaaaccaggcgacagtcctgatgggattgggaaaggggtggccgctgagcaagatggacatcggtgtgccactgctcgcaatcgggtgctattcccaggtgaatcccattaccctgacggccgccctgctcctcctcatcgcccactacgcgatcatcgggcctggcttgcaggcgaaggctacccgcgaagcccagaaacgggccgcagccgggatcatgaagaaccccacggtggacggcatcaccgtcatcgacctggacccaataccgtacgaccccaagttcgagaaacagctgggccaggtcatgctcctgatcctgtgcgtgacacaggtgctcatgatgcgcacgacctgggccctgtgcgaggccctgaccctagccacgggccccatcagcaccctgtgggaggggaaccctggccggttctggaacaccaccatcgcggtttccatggcgaatatcttccgcgggtcctacctggctggggcgggcctgctgttctccatcatgaagaacactaccaacactaggcgggggacaggcaacatcggcgaaacacttggggagaagtggaaatcccgactgaacgcgctcggcaagagtgagttccagatctacaagaaatccgggattcaggaggtcgatagaaccctggccaaggaaggcattaagcgcggggagaccgaccaccacgccgtgagtcggggcagcgcaaagctccgctggttcgttgagcgcaacatggtgacgcccgagggcaaggtggtagacctggggtgtggccgtggaggctggtcctactattgtggaggcctgaagaacgtgcgcgaggtgaaaggattaacgaagggcggccccgggcacgaggagcccataccgatgtccacctacgggtggaacctggtacgcctgcaaagcggggtggacgtttttttcacgccgcctgaaaagtgtgacacgctcctgtgcgacatcggcgagtcctcaccaaatccgacaatcgaggccggccggaccctgagggtactatccttagtcgagaactggctaaacaacgacacccagttctgcatcaaggtcctcaacccctacatgcccagcgtcatcgagaaaatggaaaccctgcagcggaagtacgggggcgctttagtaagaaacccgctgtcccggaacagcacccacgagatgtactgggtctccaacgccactgggaacattgtttcctccgtgaacatgatcagccgcatgctgataaaccggttcaccatgaagcacaagaaagcgacctacgagcccgacgtggacctcggctccgggacgcgcaacatcggcatcgaaagcgagatcccaaacctggacatcatcgggaagcggatcgaaaagatcaaacaggagcacgaaacgtcctggcactatgaccaggaccacccctacaagacctgggcctaccacgggagctatgagacgaagcagaccggctcagcaagttccatggtcaacggggtggtgcgcctcctgacgaagccatgggacgtcgtgcccatggttacccagatggccatgaccgatacaacaccctttggccagcagcgcgtattcaaggaaaaggtggatacccggacccaggagcccaaggagggcaccaaaaaactgatgaaaatcacggcggagtggctctggaaagagctgggtaaaaagaagacgccgcgcatgtgcacccgggaggaattcacgcgcaaggtgcgaagcaacgccgccctaggcgccatcttcacggacgagaacaagtggaagtccgcgcgagaagccgtcgaggacagccggttctgggagctcgtcgacaaggagaggaatctgcacctggaggggaagtgcgagacctgcgtgtacaacatgatgggcaaacgggaaaaaaaactcggggagtttggaaaggcgaagggcagccgtgccatttggtacatgtggctgggggcgcggttcctcgagttcgaagccctcggcttcctgaacgaggatcactggttctcccgcgagaacagcttaagcggggtcgagggcgaggggctccacaagctgggctacattctccgggacgtgagcaagaaggagggaggggcaatgtatgcagacgacaccgccggatgggacacgcgcattacgctcgaagacctgaagaatgaggaaatggtgaccaaccacatggaaggggagcataagaagctggctgaggccatcttcaagctaacttaccagaacaaggttgtgcgggtccagcgcccgacgccccgaggcaccgtgatggacatcatttcccggcgggaccaacgcggcagcgggcaggttggcacctatgggctgaacaccttcaccaacatggaggcccagctcatccgacaaatggagggcgaggggatcttcaagagcatccagcacctaacagtcaccgaggagatcgccgtgcaagattggctggcccgcgtgggccgcgagcggctgtctaggatggcgatttccggggacgactgcgtcgtgaagccactagacgaccggttcgcctctgccctgaccgctttgaatgacatggggaaagtgcgcaaggacatacagcagtgggagccgtcccggggctggaacgattggacccaagtccccttttgcagccaccactttcatgagctcatcatgaaagacgggcgcgtgctggttgtcccctgccggaaccaggatgagcttatcggccgagcccgcatttcccagggggcgggttggtcgcttaaggagacggcttgccttggcaaatcctacgcccaaatgtggagcctgatgtacttccaccgccgtgacctccgccttgccgccaacgcgatatgctccgccgtaccaagccactgggtgcctacctcgcggacaacctggtccatacacgccaagcatgaatggatgaccaccgaggacatgctgactgtgtggaaccgcgtttggatccaggagaacccctggatggaagataagacccccgtggagtcttgggaggaggtcccctacctcgggaagcgggaagaccagtggtgcggctctcttatcggtctgaccagccgcgccacgtgggccaagaacatccagaccgccatcaaccaagtgcggtccctcatcggcaacgaggagtacaccgactacatgcctagcatgaaaagattccggcgcgaggaggaggaagccggagtcctgtggtaa

SEQ ID NO: 24835 - RNA, 9876 nt, synthetic construct
  misc_feature 1..9876: note = derived and/or modified CDS sequence (opt11) from DENV-2__KF704356__SS-prME
  source 1..9876: mol_type = other RNA
accgcgggcatgattatcatgctgatacccaccgttatggcgtttcacctcaccacccgaaacggggagccccacatgatcgtcagccggcaggagaagggcaaaagtctgctattcaacaccggtgacggggtgcatatgtgcaccctcatggcgatgcacctgggggagctgtgcgaggacacgatcacctacaaatgtcccctcctgcggcagaacgagcccgaggacatcgactgctggtgcaacagcacctccacctgggtgacctacggaacctgcaccaccacgggcgagcaccggcgcgagaagcggagcgtagccttagtgccccacgtggggatgggcctcgagacacgcaccgaaacttggatgagtagtgagggggcatggaagcacgcccaacggatcgaaacgtggattcttcgccaccctggtttcactatcatggctgcgattctagcctacaccatcgggacgacccacttccagcgagcgctgattttcatcctgctgacggccgtcgcgccctccatgaccatgcgctgcataggcatcagcaaccgggatttcgtggagggagtaagcggagggtcttgggtggatatcgtgctcgagcatgggtcctgcgtgacaactatggccaagaacaagcccaccctggacctggaactcatcaagaccgaagccaaacagccggccaccctgcgcaagtactgcatcgaagccaaactgacaaacactaccaccgagtcacggtgtccgacgcagggggagccctccctcaacgaggagcaggacaagaggttcgtctgcaagcacagcatggtggatcggggctgggggaacggctgcgggctgttcggcaaggggtccatcgtgacctgcgcaatgtttacctgcaagaaaatcatgaagggcaaggtcgtgcagcccgaaaacctggagtacacgatcgtcatcacgccccatagcggcgaagaacacgccgtcgggaacgacaccggcaaacacggaaaggagattaaaatcaccccgcagtccagcatcaccgaggccgagttaaccggctacgggacagtgaccatggagtgcagcccccggaccggcctggacttcaacgagatggtgctgctccagatggaggacaaggcctggctggtccaccggcagtggttcctagacttgcccctgccctggctgccgggcgccgacacccagggaagcaactggatccagaaggagacgctcgtcaccttcaagaacccccacgcgaagaagcaggacgtcgtcgtgctgggaagccaggaaggtgccatgcacaccgccctgacgggcgccaccgagatccagatgtcctctgggaatgtcttatttaccggccacctgaagtgccgcttgcggatggacaagctccaactgaagggcatgtcgtactccatgtgcactggtaaattcaaggtcgtgaaggagatcgctgaaacgcagcacggcacgatcgtcattcgcgtgcagtacgaaggggatggcagcccctgtaagatcccctttgagatcatggacttggagaaacggcacgtgctcggccgcctcataaccgtcaacccgatcgtgaccggcaaggactcgcccgtgaatatcgaggcggaaccgcccttcggggactcctacatcatcataggggtagagccggggcagctgaaactgaactggttcaagaagggcagctccatcggccagatgttcgccaccacgatgcggggagccaagcgtatggccatccttggcgataccgcatgggacttcgggagcctcgggggcgtgtttacctccatcggaaaggcgctccaccaggtgttcggggccatctacggcgcagctttctcaggggtctcgtggacgatgaagatcctgatcggtgtgataattacgtggatagggatgaacagccgctccacgagcctgtccgtgagcctggtcctcgtgggagtggtaacactgtacctgggagtgatggtacaagcggactccggctgcgtcgtgagctggaagaacaaggagcttaagtgcggctcggggatattcatcaccgacaacgtacacacgtggaccgagcagtacaagtttcagcccgagtcccctagtaagctggcctccgcgatccagaaggcccacgaagagggcatctgcgggatccggagcgtcacccgcctggagaacctcatgtggaagcagatcacccctgaactgaaccacattctatccgaaaacgaggtgaagctcacgatcatgacaggagacatcaaggggatcatgcaagctggaaagcgcagcctgcgcccgcagcccaccgaacttaagtactcctggaagacctggggcaaggcgaagatgctctctactgaatctcacaaccagaccttcttaatcgacgggcccgagaccgcggaatgcccgaacactaaccgggcctggaatagcctggaggtggaggattacggtttcggggtgttcacgaccaacatctggctcaagctgcgcgaggagcaggacgtattttgcgattccaagctgatgtcagccgccatcaaggacaatcgggcggtgcacgcggatatgggctattggatcgagtccgccctcaacgacacttggaaaatcgagaaggcatcgttcattgaagtcaagtcctgccactggcccaagtcacacaccctgtggtccaacggcgtgctcgagagcgagatgataatccccaaaaacttcgcaggacccgtgagccagcacaactaccgtccgggctaccacacccagacggcgggcccgtggcacctcggcaaactcgagatggactttgatttctgcgaagggaccactgttgtggtaaccgaggactgcggaaataggggaccgtccctgcgcacgaccaccgccagcggaaagctcatcaccgaatggtgctgccggtcctgcacgctgcctccactaaggtaccgtggcgaggacggttgctggtacggcatggaaatccgtcctctcaaggagaaggaggaaaacctggtcaacagcctggtgaccgccggtcacggccagatcgataacttctcccttggcgtgctgggcatggcgctgtttctcgaggagatgctgcggacccgcgtaggcactaagcacgctatcctattagtggccgtgagcttcgtcacgctgatcacggggaacatgtcctttcgcgacctgggccgcgtgatggtaatggttggggccaccatgacggacgacatcggtatgggtgtgacgtacttagccctgctagccgcgtttaaggtacgccccacgttcgcagccgggctcctgctgcggaaactcaccagcaaggagctgatgatgaccacgatcggtatcgtcctgctcagccagagcactatcccggagaccattctggagttaaccgacgcgctcgccctggggatgatggttctgaaaatggtgcgcaagatggagaagtaccagctcgccgtcacgatcatggccatcctgtgcgttcctaacgccgtcatcctgcaaaacacctggaaggtaagctgtaccatactcgccgtggtcagcgtgagccccctgttcctgaccagctcccaacagaaggcagactggatcccactcgcgttgacaatcaaaggccttaacccaaccgccatcttcctcaccaccctgtcgcggacgaacaagaagcgctcctggccgctgaacgaggccattatggccgtaggcatggtcagcatcctcgcgtccagcctgctgaaaaacgatatccccatgaccgggcccctcgtggccggtgggctgttaacagtgtgctacgtcctcacgggacggtctgccgatctggagctggagcgcgccgccgacgtgaagtgggaggaccaggcggagatatcagggagctccccaatacttagcatcacgatctccgaggatggcagcatgtcgatcaagaacgaggaggaagaacagaccctgaccatcttgatccggacaggcctcctggtaatctccggtctgtttcctgtgagtatccctatcaccgccgccgcctggtacttgtgggaggtgaaaaagcagcgcgccggcgtgctgtgggacgtaccctccccaccgccagtggggaaggctgagctggaggacggagcctaccggatcaaacagaaggggatcttagggtattcacagatcggcgccggtgtgtacaaggagggcacgttccataccatgtggcacgtcaccagaggggccgtgctgatgcataagggaaagcggatagagcccagctgggccgacgtaaagaaagatctgatctcctacggtggcggctggaagctcgagggggagtggaaggaaggagaggaggtacaagtgctggctctggaaccggggaagaatccgcgagccgtgcagacaaagcccggactctttaaaacgaacgccgggacaataggcgccgtcagcttagacttctcacccggcaccagcgggagccccatcatcgaccggaagggtaaggtggtggggctgtatggcaacggcgtcgtgacccgctctggggcttacgtaagtgcgatagcacagacagaaaagtccatcgaggacaatcccgagatcgaggacgacatcttccggaaacgaaagctcaccattatggacctgcaccctggcgctgggaaaaccaaacggtacctgccagccatcgttcgcgaggcgataaagcggggcctccgcaccctcatactggccccgacgagagtggtggcagccgaaatggaggaggccctgaggggcttacccattcgctaccagacccccgccatcagagccgagcacaccggccgcgagatcgtcgacttgatgtgtcacgccaccttcacaatgcgcctgctcagcccagtgcgcgtgccgaactacaacttgataatcatggacgaggcccatttcacagaccctgcttccatcgcggcccggggatacatctctacccgcgtcgaaatgggagaggcagccggcatattcatgaccgctacgccacccggatccagagacccgtttccgcagagcaacgccccgatcatggacgaggagagagagatccccgaacggtcctggagctctggtcacgagtgggtgaccgacttcaagggcaagaccgtgtggttcgttccgagcatacgcgccggcaacgacatcgctgcctgcctgcggaagaacggcaagaaagtgatccaactctctcgtaaaaccttcgatagcgagtacgtgaaaacgcggaccaacgactgggacttcgttgtgaccaccgacatctccgaaatgggggcgaactttaaggccgagcgcgtgattgaccctaggagatgcatgaagcccgttatcctgacggacggcgaggagcgggtaatattagccggacccatgccggtgacccacagctcagccgcgcagcggcggggccgcatcgggcgcaaccctaaaaatgagaacgaccagtacatctatatgggtgagcccctcgaaaacgacgaagactgcgcgcattggaaggaggcaaagatgctactggacaacattaacaccccagagggcataatcccgagcatgttcgagcccgagcgggagaaggtcgacgccatcgacggggagtaccgccttcgcggcgaggcgcgcaagaccttcgtggatctgatgcgtcgcggggacctacccgtgtggctcgcttatcgggtcgccgccgaaggcatcaactacgccgacagaaggtggtgcttcgacgggataaagaataaccagatcctggaagagaacgtggaagtcgagatctggacaaaggagggcgagaggaagaagctgaagccgcggtggctggacgcccgcatttacagcgaccccttagccctgaaggagttcaaagagttcgcggctgggcgcaaatcgctcaccttaaacctgatcaccgagatgggacgtttaccgaccttcatgacgcagaaggccagggacgccctggacaacctggcggttctccacacggccgaggcaggagggcgcgcctacaaccacgccctgtctgagcttcccgagaccttggagaccctgctgttgttgacgctgctcgcgaccgtgaccggcggcattttcttgttcttgatgagcgggcgtgggatcgggaagatgaccctcggaatgtgctgcatcatcaccgcctccatcttgttgtggtacgcccagatccagcctcattggatcgcagctagcatcatccttgagtttttcctgatcgtcttactcatccccgagccagagaagcaacgaacgcctcaggataaccagttaacctacgtggtgatcgcgatcttaaccgtcgtggccgccacaatggccaatgagatggggtttctcgagaagacgaaaaaggatttaggactcggcagcatcaccacccagcaaccggaatccaacatactagacatcgacctgcggcccgccagcgcttggaccctgtacgccgtggccaccacgttcgtcaccccaatgctccgacattctatagaaaacagctccgtgaacgtgtccctcaccgctatcgccaaccaggcgaccgtcttgatggggctcggaaaggggtggcccctgtccaagatggacatcggggtgccgttactcgctatcgggtgctacagccaggttaatccaatcacactgaccgccgccctattcctcctggtcgcacactatgccattattggacctggtctccaagcaaaggccacacgggaagcgcagaaacgcgcggctgccgggatcatgaaaaacccgaccgtggacggcatcaccgtaatcgacctcgacccgatcccctatgatcccaagttcgagaaacaactggggcaagtcatgctactcgtgctgtgcgtaacccaggttctgatgatgcgcactacttgggccctctgcgaagcccttaccctggcgaccggaccgatctctaccctctgggaagggaacccgggccggttttggaacacgaccatagccgtgtcaatggccaacatttttcgtggttcctacctggccggagccggcctcctcttctcgatcatgaagaataccaccaatacgcggcgcgggactggcaacatgggcgagaccctgggggaaaagtggaagtcccgactgaacgctctgggcaagagcgagtttcagatctacaagaaatccgggatccaggaagtggaccgcaccttggcaaaggagggcatcaaaaggggcgagacagaccaccatgccgtcagccgcggcagtgccaagttgcggtggttcgtggagcgcaacatggtgacccccgagggaaaggtcgtggacctcgggtgcggtcgcgggggatggagctactactgtgggggactgaagaacgtgcgcgaggttaagggcctcaccaagggcggccctgggcacgaggagcccatcccgatgtcaacctacggctggaacctcgtccggctgcagtccggggtggacgtgttcttcacgccgccagaaaagtgcgacacactactctgcgatattggcgagtcttccccaaatccgaccgttgaggcgggccgaactctgagggtgctaaacctcgtcgaaaactggctgaacaacaacacccagttctgtatcaaggtgctgaatccctacatgccgtctgtgatcgagaagatggaggcgttacagcgcaagtacgggggcgctctggtccggaacccgctgagccgcaacagcacccacgagatgtactgggtgagcaacgcctctgggaatattgtgtcgagcgtgaacatgatctcccggatgcttattaaccgtttcaccatgaggcacaaaaaggccaccttcgagcccgacgtggacctgggcagcggaacccgtaacatcggcatcgagagtgagatccccaacctggacatcatcggcaagcgcatcgagaaaatcaaacaggagtatgagacgagctggcactacgaccaggaccacccctacaagacctgggcgtaccacgggtcctacgagaccaaacagaccggaagcgcatcctctatggtgaacggggtggtgcgactgctcacgaagccgtgggacgtagtccccatggtgacgcagatggccatgaccgacaccacgcccttcggacagcagcgtgtgtttaaagagaaggtcgacacccgcacccaggagccgaaggagggtaccaagaagctgatgaaaatcacggccgagtggctgtggaaggaactcgggaagaagaagaccccgcgcatgtgcacgcgggaggagttcacgcgcaaggtccggtccaacgcggcgttgggcgccatcttcacggacgaaaacaagtggaagtccgcccgcgaggccgtcgaggactcccgcttctgggagctagtggacaaggagcgcaacctccacctggaggggaagtgcgagacctgcgtatacaacatgatgggcaaacgggagaagaaactgggggagttcggcaaggccaaaggcagccgcgcgatctggtacatgtggctcggggcccggttcctggagtttgaggccctcggctttctcaacgaggaccactggttcagccgtgagaactccctgtcaggggtcgaaggcgaggggttgcacaaactaggctacatccttcgggatgtgtccaaaaaggagggcggtgcgatgtatgcggacgacaccgccggctgggacacccgcatcacgctggaagacctcaagaacgaggaaatggtgaccaaccatatggagggggagcacaagaaactggccgaggccatcttcaagctgacctaccagaacaaggtcgtgcgggtacagcgcccgacgccccgggggacggttatggacatcatcagccgccgcgaccagcgggggagcggccaggtaggcacctacgggctcaacacgttcaccaacatggaagcacagctgatccgccagatggagggcgagggggtcttcaagaacatccaacaccttacggtcaccgaggagatagcggtccaaaattggctggcccgagtgggcagagagcggctgagccgcatggccatcagtggtgacgactgcgtcgtgaagcccctggatgaccggttcgccagcgccctcaccgcgctgaacgacatggggaaggtgcgcaaggatatccagcaatgggagccatcccggggctggaacgattggacccaggttccgttttgtagccaccactttcacgagctcatcatgaaggacgggcgtgtgctcgtcgtcccctgccggaaccaagacgagctgataggacgtgcgcggatctctcagggggccgggtggagcctgcgcgagacggcctgcctcggcaagtcctacgctcagatgtggagcctgatgtacttccatcgccgcgacctgcgcttggcagctaacgccatctgttccgccgtgcctagccactgggtgccgacctcacgcaccacttggtccatccacgccaagcacgaatggatgacgacggaggatatgctgaccgtgtggaaccgggtgtggatccaggagaacccctggatggaagacaaaacccccgtcgagtcctgggaggagataccctacctggggaagagggaggaccagtggtgcggctcactcatagggctgacctctcgcgcgacgtgggcaaagaacatccagactgccatcaaccaggtccggtccctgatcggcaacgaggagtacacggactacatgccttcgatgaagcgcttcagacgcgaggaggaggaagccggggtgctctggtga

SEQ ID NO: 24836 - RNA, 9876 nt, synthetic construct
  misc_feature 1..9876: note = derived and/or modified CDS sequence (opt11) from DENV-2__KF704355__SS-prME
  source 1..9876: mol_type = other RNA
acagccgggatgattattatgctaatccctaccgtgatggcgttccacctcacgacccgtaacggagagccgcacatgatagtcagtagacaagagaagggcaagagcttactcttcaagaccggcgacggcgttaacatgtgcaccttaatggcgatggatttaggggagctgtgcgaggatactattacctacaaatgtccttttctccggcagaacgaacctgaggacattgattgctggtgcaactccacgtccacgtgggtgacctatggaacctgcactacaacgggcgagcaccgcagagagaagaggagtgtcgcgctcgtgccccacgtggggatgggcctcgagacccgcactgaaacatggatgtcctccgagggagcctggaaacacgcacagcggatcgagacgtggatactgcggcacccgggcttcacgatcatggctgcgatcctcgcctacactatcggcaccactcactttcagcgggcgctgatatttatactccttaccgccgtagcgccctccatgaccatgagatgcatcggcatttcgaaccgggacttcgtggaaggggtgagcggtggctcctgggtggacatcgttttagagcacgggtcttgcgtgaccaccatggcaaagaacaagcccaccctagacctggagctgattaagactgaggcgaaacagccggcaacgttacggaaatattgcatcgaggccaagttgactaacaccacaactgagtcgcgttgcccgactcagggcgaaccttcccttaacgaggaacaggacaagcgatttgtttgcaagcatagcatggtggaccgggggtgggggaacgggtgcggcttgttcggcaaggggtccatcgtgacttgtgccatgtttacgtgcaagaaaatcatgaagggtaaggtcgtacagccggaaaacctggagtatacgatagtgatcacgccgcatagcggagaagaacatgcagtcggcaacgacaccggaaagtacggaaaggagattaagatcacacctcagagcagtattaccgaggccgagcttaccgggtacggtacggtgaccatggagtgtagcccacgtactggcttagattttaatgaaatggtcctgcttcagatggaggacaaggcgtggctcgtgcatcgacagtggtttctggacctgcccctcccctggctgccgggagcggatacccaagggtccaactggattcagaaagagacgctggtgacctttaagaaccctcacgctaagaagcaagacgtggtcgttttaggctctcaggaaggggccatgcatacggccctgaccggagccacggaaatacagatgtcctcagggaacgtcttgttcaccggccacctcaagtgtcgcttgcggatggacaaactgcagctcaaaggcatgagctattctatgtgcaccgggaagttcaaggtagttaaagagatagcggagacccaacacggaactatcgtcatccgtgttcaatatgagggggatggctccccctgcaagatccccttcgaaattatggacttagagaagagacacgtactgggcaggctcataaccgttaatcctatagttacaggtaaggacagccccgtgaatatcgaggcggagccgcccttcggtgactcgtacatcatcatcggagtggaacccggccaactgaagctaaattggttcaaaaagggaagctcaatcggccagatgttcggaaccactatgcggggtgccaaaagaatggcaatcctcggcgataccgcctgggacttcgggtcgcttggcggcgtattcacctccatcggcaaagccctacaccaagtgtttggcgcgatatacggggccgccttcagcggcgttagctggaccatgaagatactaacaggggtaattatcacgtggatcggtatgaacagccgctccacttctctgagtgtctccctggtcctagtgggtgttgtcacgctttacctgggagtgatggtccaagcggactcaggctgtgtcgtcagctggaagaataaagagctgaagtgcggttcgggcatctttattacggacaacgtccatacctggactgagcagtacaagttccaacccgagtccccctcgaaactcgcgtcggctatccagaaggcgcatgaggaagggatctgcggcatccgctcagtcacgcgcctggagaacctaatgtggaagcaaatcactcccgagcttaaccatatacttagcgagaatgaagtcaaactgactatcatgaccggggatatcaagggcatcatgcaggccggtaagagatctctccgcccacagcctacggagttaaagtattcctggaaaacttggggaaaggccaagatgctgagcaccgagtcacacaatcaaactttcctgattgacggccccgaaacagcggagtgccccaatacgaatcgtgcgtggaacagtctggaggtggaggactacgggttcggcgtctttaccaccaacatttggctgaagctccgtgagaagcaggacgtgttctgcgactccaagcttatgagcgcagccataaaggacaaccgtgctgtgcacgcggatatgggctactggattgagtcagctctgaacgacacctggaagatagagaaggcctccttcatagaggtcaagagctgccactggcctaaaagccacacgttatggtcaaatggcgtcttggaatcggaaatgataatccccaaaaacttcgccggccctgtcagccaacacaactaccgtcctgggtaccacactcagacggcaggcccctggcatctggggaagttagagatggacttcgacttctgtgaaggtaccaccgtggtggtgacagaggattgcggcaaccgcgggccctccctgcgcactaccactgcgagcggcaagctaatcacggagtggtgttgccgaagttgcaccctaccacccctccgataccgcggggaggacggctgctggtacggaatggagatccgccccctgaaggagaaggaggagaacttagtcaactctctcgtgacggcgggccacggccagatcgacaacttcagcctgggggttctcggcatggcactctttctggaggaaatgctccggacccgcgtcggcacgaagcatgcaatcctgttagtcgcagtgagcttcgtcaccctgatcaccggcaatatgtcctttagagatctggggcgagtcatggtgatggtaggagccacgatgaccgatgacataggcatgggggtcacgtacttagccctcctggccgccttcaaagtgcggccgacgttcgctgccggcttgctcctgcgcaaactaaccagcaaggagctcatgatgacaactatcggcatcgtcctgctgtcgcagagtacgatccccgaaaccatactcgagctcacggacgccctggctctcggcatgatggttctgaagatggtgcgcaaaatggagaaataccagctggcggtcaccattatggcgatcctctgcgtgccaaacgccgtcatcttacagaacgcctggaaggtgtcctgtaccatcctggctgtcgtgagcgtgagccctctcttcttaacctcctcacagcaaaaggccgactggatcccgttggcgctcacgatcaagggcctgaaccccaccgcgatctttctcacaacccttagccggaccaataaaaagcggtcatggccgctcaatgaagcgataatggccgtgggcatggtgagcatcctagcatcgtcgctcctgaagaacgatatccccatgaccggaccccttgtggccggcggtcttctgaccgtatgctacgtcctaactgggagaagtgccgacttggaacttgaaagggccgccgacgtaaagtgggaggaccaggcggagatcagcggctcaagcccgattctgagcatcaccatctcagaagacggttctatgtcaatcaaaaacgaggaagaggaacagacactcaccatactgatccggaccgggcttttagtaatctccggcctgttcccggtctccattccaatcaccgccgccgcctggtatctgtgggaggtgaagaagcaaagagctggggtgttatgggacgtcccctctccccctccagtcggcaaggcagaactggaggacggggcctaccggatcaagcagaaaggcatcctaggatactcccagataggagccggcgtctacaaggagggaaccttccacacaatgtggcacgtaacgcgcggcgccgtgctcatgcacaaggggaaacgaatcgagccctcgtgggcggatgtgaagaaggatttaatctcctatggcggcggttggaagctggagggtgaatggaaggagggggaagaagtccaggtgctcgcgctggagcccggcaaaaatcccagagccgtgcaaactaaacccgggctgttcaagacgaacgcaggcaccatcggggccgtctcgcttgacttttcccctggcacaagcggcagtcccatcatcgaccggaagggaaaggtcgtgggcctgtacggcaacggcgtagtgacaagatccggtgcctatgtgtccgcgatcgcccaaacggagaaatcaatcgaggataatcccgagattgaagacgatatattccgtaagcgaaagctgacgatcatggacctccaccccggagcagggaagaccaaacgctacctgcccgccatagtgcgggaggctattaaacggggactccgcaccctgatactggctcccacgcgggtcgtggccgccgagatggaagaggccctgcgggggctgcccatcaggtaccagacccccgcgatacgggctgagcataccggccgagaaatcgtggacctcatgtgccacgccacatttactatgcggctgctgagccccgtacgtgttcccaactacaacctcatcatcatggacgaagctcacttcaccgaccccgcctcgatcgcagcccgtgggtacatcagtactcgcgtcgagatgggcgaagccgccgggatctttatgaccgccacgccgcctgggagtcgggacccgtttccccagagtaatgccccaattatggacgaggaaagggagattcccgagagaagctggagctccgggcatgagtgggtgaccgactttaagggcaagaccgtttggttcgtgccgagcatcagagcaggaaacgatatcgcggcatgcttgcggaagaatgggaagaaagtgatccaactgtcccggaaaaccttcgacagcgaatatgtcaagacacgcaccaacgactgggacttcgtcgtaacaactgacatctcagaaatgggcgcgaatttcaaggcagagagggtgatagatccccggaggtgcatgaaacccgtcattctaacggacggggaagaacgggttatcctggccgggccgatgcctgtcacccacagtagtgctgcccagcgccggggaagaatcggtcgaaaccctaagaatgagaacgaccagtacatctacatgggcgagcccctggaaaacgacgaggactgcgcacactggaaggaagctaagatgctcctggacaacatcaatacacccgaagggatcatcccgagcatgtttgagcctgagcgggaaaaggtcgatgccatagacggagagtaccgtctccggggggaagctcgcaagaccttcgtagacctcatgagaagaggggatctacccgtgtggcttgcttatcgtgtcgcagccgagggcattaactacgccgatcggcggtggtgctttgatgggatcaagaacaaccagatcctcgaagagaacgtggaagtcgagatctggacaaaggagggagagcgcaagaaactgaagccccggtggctggacgctcgcatttattccgatcccctcgccctcaaggagtttaaagagtttgctgcggggaggaagtcgctgactttaaatttgatcacggagatgggcaggttgcccaccttcatgacacagaaggcacgggatgccctagacaacctggcggtgcttcacactgccgaggccgggggccgcgcatacaaccacgccctctccgagttaccggagaccctggagaccttactgttgctcacgttgctggcgactgtgacaggcgggatctttctgttcctaatgagcggacgggggattggcaaaatgacgctagggatgtgttgcattatcacagcctcgatcttgctgtggtacgcccagatccagccccactggatcgccgccagtatcatactggagttcttcctcatcgtcctgctgatccctgagcctgaaaagcagcgcaccccacaggacaatcagttaacctatgtagtgatcgccatccttactgtcgtagccgcaacgatggccaatgagatgggattcctagaaaaaacgaaaaaggatttaggacttgggagcataaccacgcaacagccggagtccaatatattggacatcgatctccggcccgcttcggcatggaccttatacgccgtggcaactacctttgttactcctatgctgcgtcacagcatcgagaattccagcgtgaacgtctctctaacagccattgccaaccaggcgacggttctgatgggccttggtaaaggctggcccctcagtaagatggacatcggggtaccgctgcttgccataggctgctactcacaagttaacccaataaccctcactgccgccctattcctcttggtcgcgcattacgctatcatcggcccgggcctgcaggccaaagccacacgggaggcccaaaaacgcgcggccgcaggaatcatgaaaaaccccacggtggacggcatcactgtgatagacctggacccaatcccgtatgaccccaagtttgagaagcagctcggtcaggtaatgctgctagtattatgtgtgacccaggtcctgatgatgagaaccacgtgggccctgtgcgaagccctcacactggcaaccggacccatcagtacgctgtgggaaggtaaccccggtcggttctggaacacaaccatcgccgtgagcatggccaacatcttccgcgggtcgtaccttgccggcgcggggctgctgtttagcattatgaaaaataccacaaacaccaggagaggaacgggaaacatcggggagaccctcggcgagaagtggaaaagtcggttaaacgcgctgggcaaatctgagtttcagatctacaaaaagagcgggatccaagaggtggaccgcaccctcgctaaggagggtataaagcggggcgagaccgaccaccatgctgtgtcccgcggctccgccaagctccgttggttcgtggagagaaacatggtgaccccagagggtaaggtggtagacctgggctgcgggcggggggggtggagctactattgcggaggcctaaaaaacgtgagagaggttaagggattaaccaagggcggcccgggacatgaggagcccatcccgatgtccacctacggttggaacctggttaggctccaaagcggggtggacgttttcttcaccccgcctgagaagtgcgacaccctgctgtgtgacatcggggagagttcgcccaacccgaccgtggaggccgggcgcactctccgagtgctgaacctggtggagaactggctcaacaacaatacacagttctgtatcaaggtattgaacccttatatgcccagcgtaatcgagaagatggaagcactgcaacggaagtacggaggggccctcgtacggaaccccctatccaggaacagcacgcacgagatgtactgggtgtccaatgcaagcggtaatattgtgtcaagtgtcaacatgatttcaaggatgctaataaatcgttttactatgcgtcataagaaggcaacatatgagcccgacgtagacctgggtagcggtacacggaacatcggcatcgagtcagagatccccaatctcgacatcatcggtaaacgcatcgagaaaatcaaacaggaatatgagaccagctggcactatgaccaagatcacccctacaaaacctgggcataccacggctcgtacgaaacaaagcagactgggtccgcatcctcgatggtgaacggcgtggtccggctgcttacgaaaccctgggatgtggtacccatggtaacccagatggctatgaccgatactacgccatttggccagcagcgggtttttaaggagaaggtcgacacccgaactcaggaaccgaaggaaggcaccaagaaattgatgaagataactgcagagtggctgtggaaggagctgggcaagaaaaagaccccgcgtatgtgtacgcgggaagaattcacccgcaaagtgcgctcaaatgctgctctaggagcaatattcactgacgagaataagtggaagtcggcccgcgaggccgtagaggactcgagattctgggagctggtcgataaggagcgcaacttgcaccttgaaggaaaatgcgaaacctgcgtgtacaacatgatggggaagagagagaaaaaactgggcgagttcggcaaggccaaagggtcgcgcgcgatctggtatatgtggttgggggccagattcttagagttcgaggccttggggttcctgaatgaggaccactggttctcgcgcgagaactccctaagcggggttgagggggagggactgcacaagctggggtatatcctccgagatgtatccaagaaggagggtggggctatgtatgccgatgacacggctggttgggataccaggatcacgcttgaagatcttaagaacgaagagatggtgaccaaccacatggaaggcgagcacaagaaactcgcggaggccatcttcaaactgacctatcagaacaaggtcgtgcgggtgcagcggcccacgcccagagggaccgtcatggacatcatcagccgccgcgaccagcgcggctccggtcaggtggggacctacgggttgaacacattcaccaacatggaggcgcagttgattaggcagatggagggcgagggtgtgtttaagaacatccagcacttaacggtcaccgaagaaatcgccgttcaaaactggttagcccgggtaggcagagagaggctcagcagaatggccatcagcggagacgactgtgtcgttaaaccgttagatgaccggttcgcaagcgccctgaccgccctcaatgacatgggcaaggttcggaaggacattcaacagtgggagcccagccgtggctggaacgattggacccaggtccccttctgctcacatcacttccatgagctcatcatgaaagacggccgcgttttagtggtcccctgcagaaaccaagacgaactcatcgggcgcgccaggatctcgcagggcgctggttggagcctccgcgagactgcatgcctggggaagagctatgcccagatgtggagcctgatgtacttccaccggcgcgatctgcggctagccgctaacgccatctgctccgcagtcccaagccactgggttcctacctcacgcaccacctggagcatccacgccaagcatgagtggatgacgacagaggacatgttgacagtttggaaccgggtgtggatccaagaaaacccctggatggaggacaagaccccagtggagagctgggaagagataccctacttggggaaacgcgaagaccagtggtgcgggagtctgataggtttgacaagccgcgcgacgtgggcgaagaatatacagacggcaatcaaccaagtccggtccctgattggaaacgaggagtacaccgactacatgcccagcatgaagagattccgtcgtgaagaggaagaagcgggcgtgctatggtaa

SEQ ID NO: 24837 - RNA, 9876 nt, synthetic construct
  misc_feature 1..9876: note = derived and/or modified CDS sequence (opt11) from DENV-2__KF704354__SS-prME
  source 1..9876: mol_type = other RNA
actgccgggatgataataatgctgattccaactgtaatggccttccacttaactacgcgaaacggggagccccacatgatcgttagcagacaggagaaagggaagagcctgctgttcaagacagaagacggggttaacatgtgcaccctcatggcgatggacctaggagaactgtgcgaagacaccataacttacaagtgtcccttcctccgccagaacgagcccgaggacatcgactgctggtgtaacagcacctccacctgggtgacttacgggacttgcaccaccacgggcgagcaccggagagagaagcggagcgtcgccttggtgccccacgtgggaatggggcttgagacccggaccgaaacctggatgtccagtgagggcgcgtggaagcacgctcagcggatcgaaacgtggattctgcgccaccccggattcaccatcatggccgctatcctggcctacaccatcggcaccacgcatttccagcgggccttaatctttattctattgactgccgtcgcgcctagcatgaccatgcgatgcattgggatcagcaaccgggactttgtagagggagtgtccggcgggagctgggtcgatatcgtcctggaacacggatcctgcgtcaccaccatggctaaaaacaagccgacccttgacttcgagctgatcaaaaccgaggccaagcaacccgcaacgctgcgcaaatactgcatagaagccaagttaactaatacgaccaccgaaagccggtgccctacgcagggggagccttccctgaacgaggagcaagacaagcgcttcgtctgcaagcacagcatggtggaccggggttggggcaatgggtgcgggctgttcggaaagggaggcatagtaacctgcgcgatgttcacgtgtaaaaagattatgaaggggaaagttgtgcagcccgagaatctggagtacaccatcgtgataacgccccattccggtgaggaacacgctgtcggaaacgacactggcaagcacgggaaggagatcaagatcaccccgcagagctccattaccgaggccgagctgaccggatacggcacggtgaccatggagtgcagcccccgcacaggactggacttcaacgagatggtgcttctgcaaatggagaacaaggcctggcttgtccatcggcaatggttcctcgacctgcccctgccctggctccccggagccgacactcaggggtcaaactggatccagaaggaaacattagtgacctttaaaaacccacatgccaagaagcaggacgtcgtcgtccttggcagccaggagggggccatgcacacggccttgactggagctacggaaatacagatgagcagtggcaacgtcctgttcaccggccaccttaagtgccgcctccggatggataaactgcaattgaaaggcatgagctactccatgtgcaccgggaagttcaaggtggtgaaagagatcgccgaaacccaacacgggacaatagtcatccgcgtgcagtacgagggtgacggtagcccctgcaaaatacctttcgagatcatggacctcgagaagcggcacgtgctgggcagactgatcaccgttaacccaatcgtgacagggaaggactctcccgtcaacatagaagcggagccacccttcggcgatagctacatcataatcggcgttgagccgggccagcttaaactgaactggtttaaaaagggatccagcataggccaaatgttcgcgacaacaatgcgtggcgccaaacgaatggccatcctgggggacaccgcctgggacttcggttccttgggcggcgtgttcacctcgatcgggaaggcgctgcaccaggtgttcggcgccatctatggcgccgccttctccggggtcagctggaccatgaagatcctgattggagttataataacgtggatcgggatgaattcccgctcaacgtctcttagcgtatccctggtcttagttggcgtggtcaccctgtatctaggtgtaatggtgcaggcggactccggctgcgttgtgtcctggaagaacaaggagctgaagtgcggcagcgggatctttattacagacaacgtgcacacttggacggaacagtacaaattccagccagagtcgccctccaagctggcctctgcaattcagaaggcccacgaggaaggtatctgtgggatccggagtgtaacccggctcgagaacctgatgtggaaacaaatcacgcccgagctgaaccatatcctctctgagaatgaggtgaagctgactatcatgaccggagacattaaaggcatcatgcaagccggcaagcggagtctgcggccgcagcccaccgagctcaagtatagctggaagacctggggtaaagcgaagatgctgagtacggagtcgcacaatcagaccttcctgatcgacggtcccgaaaccgccgaatgcccgaacaccaacagagcctggaactccttggaggtggaggactacggctttggggtttttacgacaaacatctggctgaagctgcgtgaggagcaagacgtcttctgcgatagcaagctcatgtccgctgcaatcaaagacaacagggcggtgcacgccgacatgggctactggattgagagcgccctgaatgacacgtggaagatcgagaaggcctccttcatcgaagtaaaaagctgtcactggccgaagtcccacacactttggagcaacggcgttttagagtctgaaatgatcatacccaaaaacttcgcgggtcccgtgagccagcacaactaccgccctggttaccacacccaaacggctgggccgtggcacctggggaagctggagatggattttgacttctgcgagggcaccaccgtcgtggtcaccgaggactgcgggaaccggggcccgagcctccgcacgaccactgcctccgggaagctgatcaccgagtggtgctgcagaagctgcacgctgcccccgctcaggtatcgaggcgaggacgggtgctggtatggcatggagatccgccccctgaaagagaaggaggagaacctggtcaacagcctcgtaaccgcgggccacggccagatcgataacttctcactcggagtgctggggatggccctctttctggaggagatgctacggacccgagtcggtaccaaacatgcgatactcttagtggccgtgtccttcgtcacgctgatcactgggaatatgagcttcagagatctcgggcgcgtcatggtgatggtcggggccacaatgaccgacgacatcgggatgggcgtgacgtacctcgccctgctcgccgcgttcaaagtgcgccccaccttcgccgcagggctgctgctgaggaagctgacatccaaagaactcatgatgaccaccatcgggatcgtgctgctgagccaatccacgatccccgaaaccatcctggaactaacagacgccctggccctaggcatgatggtgcttaagatggtgcgcaagatggaaaagtaccagttggcagtcacgatcatggccattctctgcgtcccgaacgcggtcatcctccaaaacacgtggaaggtgagctgcaccatcctggccgtggtctccgttagcccccttttcctaacctccagccagcagaaggctgattggatccctttggcgctgacgatcaagggcctcaaccccacagccatcttcctgactaccctgtctaggacgaacaagaagcgcagttggccgcttaacgaggccataatggccgtgggcatggtctcgattttagcgtcgtctctgctcaagaacgacatccccatgaccgggcccctggtcgccggaggactcttgactgtgtgttacgtcttgacaggccggagcgccgacctggagctcgagcgcgccgcagatgtcaagtgggaggaccaggcggaaatcagcgggtccagccccattctgtccattacgatcagcgaagatggatccatgagcataaaaaacgaggaggaggagcaaacgctgacgatcctcatccggaccggccttctcgtgatctccggcttatttccggtcagtatccctatcactgccgctgcctggtacctatgggaggtgaagaaacagcgcgcaggggtactgtgggacgtcccaagcccgccccctgtggggaaggcggagctcgaggacggcgcttacaggatcaagcaaaaggggatactggggtactctcagatcggcgccggggtgtataaggaggggaccttccacaccatgtggcacgtgacccgaggggccgtgctaatgcacaagggcaagcggattgagccgtcttgggccgacgtgaaaaaggacttaatcagttatggtggcggctggagacttgagggcgagtggaaggagggggaggaggttcaggtgctcgcgctcgagcccggaaagaatcccagggccgtacagaccaagcccggcctgttcaaaacgaacgctggaaccatcggcgccgtcagcctggacttttcacccggtacctccgggagccccatcatcgacaagaaggggaaggtggtcgggctctacggcaacggcgtagtgacgcgatccggggcctacgtgagcgcaattgcccagacggaaaaatccattgaggacaacccagaaatcgaggacgacatttttcgtaagcgtaagctgaccattatggatttgcaccccggcgccgggaagacgaaacggtatttgccggcgatcgtgcgcgaggcgattaagcggggcctgagaacccttatcctggcacctacgcgggtcgtcgctgccgagatggaagaggccctcagagggctgcccatacgctaccaaacgcccgcgatacgtgccgagcacaccggccgcgagatcgtcgacttgatgtgccacgccaccttcacgatgagactcctgagccccgtacgcgtgccgaactacaatttaataataatggatgaagcccacttcactgaccccgccagcattgctgcccggggctatataagtacgcgggtcgagatgggggaagccgcagggatattcatgaccgccacgccgccgggcagtcgagacccgttcccccagtctaacgcgcccatcatggacgaagagcgtgagatcccggagcggtcctggtcgtctggccacgagtgggttaccgactttaaagggaagaccgtgtggttcgtaccgagtattaaagccggcaacgacatcgccgcctgcttgaggaaaaacggcaaaaaagtgatccaactttcgcggaagaccttcgattccgagtatgtgaagacacgtacaaacgactgggacttcgtcgtgaccaccgacatctcagagatgggagcaaacttcaaggccgagagagtaatcgacccccgcaggtgcatgaaacccgtcatccttacggacggcgaagagagagtcatcctggccgggcccatgccggtaacccactcctcggcagcccagcgacgggggcggatagggcgcaaccccaagaatgaaaacgaccaatatatctatatgggtgagccactagagaacgacgaggactgcgctcactggaaagaggccaaaatgttgctcgacaacatcaacacgcccgagggcatcatcccgtctatgttcgagccagagcgcgaaaaggtcgacgcgatcgacggggagtaccgattgcgcggcgaagcccggaagaccttcgtggatctgatgaggcgcggggacctcccagtgtggttagcctaccgcgtggcggccgaaggcatcaactacgccgaccggcgctggtgcttcgatgggatcaagaacaaccagatccttgaggagaacgtggaggtggagatctggaccaaggaaggcgaacggaagaagctcaagcctcgctggctcgacgctcggatctattctgatccactggccctcaaagagttcaaggagttcgctgccggccgtaagtcccttaccctaaatctaatcaccgaaatgggacgcctgcccacgtttatgacgcagaaagcccgcgacgccctagacaatctcgcggtgctgcacacagcagaggccggaggtcgagcttacaaccatgccctttcagagctccccgagaccttggaaaccttactcttactgacgcttctggcgacagtgaccggcggcatatttctcttcttgatgtctggaaggggaatcggaaagatgaccctgggcatgtgctgcatcatcacagcctcgatcctgctctggtacgcccagatccagccgcactggatcgccgcctccatcatcctggagtttttcttgatcgtcctgctgatacccgagccggagaagcagcggacgccccaggataatcagctaacatacgtagtgatcgcgatccttaccgtcgtggctgccactatggctaacgagatggggttcctggagaagacgaagaaggacctgggctggggctcgatcaccacccagcaaccggagagcaacatcctggacattgacctgcgccctgcctctgcgtggaccctctatgccgtggccaccacctttgttacgcccatgctgcggcactcgatcgagaattcaagcgtaaatgtttccctgaccgccatcgccaaccaagccacagtcctgatggggctcggcaaagggtggcccctgagcaaaatggacatcggcgtgcccttgctcgcaatcggctgctactcccaagtgaaccccataactctgaccgccgcactgttcctcctggtcgctcactacgcgatcatcggcccaggcctccaggccaaggccacgcgcgaggcccagaaacgcgcggccgccgggatcatgaagaaccccacagtcgacggcatcaccgtcatcgacctcgaccctatcccctacgaccctaaattcgagaagcagcttggccaggtcatgttattagtgctgtgcgttacccaggtcctcatgatgaggaccacctgggccctctgcgaggcactgacactggcgaccggcccgattagcacattatgggagggtaacccgggtcgattttggaacacgaccatagccgtgtccatggccaacatcttccgcggcagctaccttgctggtgctggactcttgttcagtattatgaagaacaccaccaatacacgccgggggacagggaacatgggcgagaccttgggggaaaaatggaagagtcgcctgaatgcgctcggtaagtccgagttccagatctacaaaaagtccgggatacaggaagtggaccgtacacttgccaaggaggggatcaagcgcggggagaccgaccaccatgccgtcagccgaggctccgctaagctgcgctggttcgtagagaggaacatggtgacccccgaaggcaaggtagtcgaccttgggtgcggacgcgggggctggagttattactgtgggggattaaagaatgtgcgggaggtcaagggcctgaccaagggcggaccagggcacgaggagcccatcccgatgagcacctatggctggaatctcgtgcgcctgcaaagcggggtcgacgtctttttcaccccgccggaaaaatgcgacaccctgctctgcgacattggggagtctagccccaatccgacggtggaagcgggtcggacgctgcgcgtgttgaacctcgttgagaattggctgaacaacaacacccagttctgcataaaggtgctgaacccctacatgccctccgttatcgagaagatggaggccctccagcggaagtacggtggggcgcttgtaaggaatccgctgagccggaattcaacgcacgagatgtactgggtgtcgaacgcgtccggaaatattgtgagctcagtaaacatgatcagccgcatgctcataaaccgatttactatgaggcataagaaggcgactttcgagcccgacgtagatctgggctccggaaccaggaatatcggcatcgagtccgaaatccccaacttagacattataggcaagcggattgagaagataaagcaagaatacgagacgagctggcactacgaccaggaccacccgtacaagacatgggcgtaccacgggtcttacgagaccaagcaaaccggctccgcctcatccatggtaaatggagtcgtacggttgcttacgaaaccgtgggatgtggtccctatggtcacccagatggcaatgaccgacaccacacccttcgggcagcaacgggtattcaaagagaaggtagatactcgaacacaggagcccaaggaaggcaccaaaaagctgatgaagattacggcggagtggttgtggaaagaactaggcaagaagaagacgccacggatgtgcactcgcgaggagttcactcggaaggtgaggagcaacgccgcgctgggcgctatcttcacggatgagaacaagtggaagtcggccagggaggccgttgaggacagcagattttgggagctggtagacaaagaacgaaacttgcatctggaggggaagtgcgagacctgcgtgtacaacatgatgggcaagcgcgagaagaagctaggggaatttggcaaggccaagggctcgagggcaatatggtacatgtggctaggagcccgcttcctggagttcgaagcactgggcttccttaacgaggaccactggttcagtcgtgaaaacagcctgtccggggtggagggagaggggctgcacaagctcggttacatcctgcgcgacgtcagcaagaaggagggcggagccatgtatgcggacgacaccgccgggtgggacacacgaatcaccctggaggacctcaagaacgaggagatggtgaccaaccacatggagggtgagcacaagaagctggcggaggcgatcttcaaactaacctaccagaataaggtcgtacgtgttcagcggccgacgccacgggggaccgtcatggacataatctccaggagggatcaacgggggtcaggccaggtgggcacctacgggctaaatacgttcaccaacatggaagcccagctgattcggcagatggagggcgagggagtgtttaagaacatccagcatcttacggtaacagaggagatcgcggtgcagaactggttggcccgcgtgggtcgggagcgcctgtcccggatggcaatctcaggcgacgactgcgttgttaagcccctggacgaccggttcgcctccgccctgacagcgctgaacgacatgggtaaggtgcggaaggacatccagcaatgggagcccagccgagggtggaatgactggacccaggtcccattctgctcccatcacttccacgagctcatcatgaaggacgggcgagtgctcgttgtcccctgtcgcaaccaggacgagcttattggccgggcccgcatcagccaaggggccggctggtcactgcgggagactgcctgcctcggtaaaagttacgcgcaaatgtggagtctgatgtacttccaccggagagacctaaggctcgccgcgaacgcgatctgctcggccgtgccatcccactgggtgccgacctcaagaaccacctggtccatccacgctaaacacgaatggatgacaacggaggatatgctgactgtgtggaaccgagtatggatacaagaaaacccctggatggaagataagaccccggtggaaagttgggaggagatcccgtacctgggtaagcgggaggatcaatggtgcggaagccttatcgggctgacctccagggcaacatgggccaagaacattcagaccgccatcaaccaggtccgttcactgataggcaacgaggagtacaccgactacatgccgtctatgaaaagatttcgcagggaggaggaggaggccggggtgctctggtaa

SEQ ID NO: 24838 - RNA, 9876 nt, synthetic construct
  misc_feature 1..9876: note = derived and/or modified CDS sequence (opt11) from DENV-2__KF704357__SS-prME
  source 1..9876: mol_type = other RNA
accgccggcatgatcatcatgctgatccccaccgtgatggcctttcatctcaccactcggaatggcgagccgcacatgatcgtcagccgccaggaaaagggcaagagcctgctgttcaagaccggggatggcgtgaacatgtgcacactcatggcgatggacctgggggagctgtgcgaggacaccatcacctacaagtgtcccctcttacggcaaaatgaacccgaagacatcgactgctggtgcaacagcacgtcaacctgggtgacgtacgggacctgcaccactactggcgagcaccgacgcgaaaaacggtcagtcgccctagtgccccacgtgggtatgggcctggagacccgcaccgagacttggatgtctagcgagggggcctggaagcacgcccaacggattgagacctggatcttacgccacccaggcttcacaatcatggccgcgatcctggcgtacacgataggtaccacgcacttccaacgggccctcatcttcatccttctgaccgccgtagccccctccatgaccatgcgctgcatcggcatctctaaccgggacttcgtggagggagtgtccgggggaagctgggtcgacatcgtgttggaacacgggtcgtgcgttaccacgatggccaaaaacaagcccaccctggacctggagctcatcaagaccgaagccaagcaacccgccaccctgcgcaagtactgcatcgaggccaagttaacgaacaccaccaccgagtctcgatgcccgacgcagggcgaaccctccctaaacgaagagcaggataaacgcttcgtctgcaagcacagcatggtggatcggggctggggaaatggctgcgggctgttcggaaaggggtctatcgtaacctgcgcgatgttcacgtgcaagaagatcatgaagggcaaggtagtgcagcccgagaaccttgagtacaccatcgtgatcacgccccactctggcgaggagcacgccgtcgggaacgacactggcaagcacgggaaggagatcaagatcaccccgcagtccagcattaccgaggccgagctcaccggctacgggacggtgaccatggaatgcagccctcggacaggcctggacttcaatgagatggtactactccaaatggaggacaaggcctggctggtgcaccggcagtggttcctggatctccccttgccatggctgccgggagccgacacccaaggttcaaattggattcagaaggagaccctcgtgactttcaagaacccccatgcgaagaaacaggatgtcgtcgtgctggggagccaagagggcgcgatgcacacggccctgaccggggctacggagatccaaatgtccagcgggaacgtactcttcaccggtcacttaaagtgccgcctgcggatggacaagttgcagctgaagggtatgtcctacagcatgtgcaccgggaaattcaaggtcgtgaaggagatcgccgagacccagcacggcacaattgtcatccgcgtgcagtacgagggggacggctccccatgcaagatcccctttgagatcatggacttagagaaacggcacgtgctaggccgcctgatcaccgtcaatccgatcgtcaccgggaaggactcccccgtgaacatagaagcggagccgccattcggagactcctacataatcatcggggtggagccgggccagttaaagctcaattggttcaagaaggggagctccataggccagatgttcgcgacaacgatgaggggcgccaagcgcatggccatactgggagacaccgcctgggattttggcagtctcgggggcgtcttcacgtccatcgggaaggcgctccaccaggtcttcggcgcaatctacggcgccgccttcagtggggtcagttggaccatgaagatattaatcggcgtgatcatcacgtggatcgggatgaacagccgttccactagcctgtccgttagtctggtcctcgtgggcgtggttaccctgtacctgggggtaatggtgcaggcggactcgggctgcgtcgtgagctggaagaacaaggagctcaagtgtggcagcgggatcttcatcacagataacgtgcacacgtggacagaacagtacaaattccagcctgagtccccatcaaagctagcctccgccatccagaaggcccacgaagaggggatctgcgggatccgaagcgtcacgcgcttagaaaacctcatgtggaaacagatcacccccgagctgaaccatatcctgagtgagaacgaggtgaagctcacgatcatgaccggggacatcaaagggatcatgcaggccggcaagcggagcctgcgcccgcagcccaccgagctgaagtactcctggaagacctgggggaaggcgaagatgctcagcacggagtcccacaaccagaccttcctgatagacggacccgagacggccgagtgcccgaacaccaatcgggcctggaacagccttgaggtggaggactacggattcggggtcttcacgacaaacatctggctcaagctgcgcgaggagcaggacgtgttctgcgactccaagctaatgagcgccgctataaaggataaccgggccgtgcacgccgacatgggctactggatcgaaagcgcgctcaatgacacctggaagatcgagaaggcctctttcatcgaggtcaaatcctgccactggcccaagtctcacaccctgtggtccaacggcgttctcgagtcggaaatgatcatccccaagaactttgcagggcctgtgtctcagcacaactaccgcccgggctaccacacccagacggcggggccgtggcacctcggaaagttagagatggactttgacttctgcgaagggacgacggttgtagtgaccgaggactgtggcaaccggggcccttccctgcgcacgaccactgcgtctgggaagctaatcacagagtggtgttgtcgctcctgcacgttacccccgctgcgctaccggggcgaggacgggtgctggtacggaatggagatcagacccctcaaggaaaaggaggagaacctggtcaacagcctggtaactgccgggcacggtcagatcgacaacttctccctcggggtgctggggatggccttattcctcgaggagatgctgcggactagagtcggaaccaaacacgcaatcctgctcgtggctgtgtctttcgtcactctcatcacaggtaacatgtccttccgggacctgggccgcgttatggtcatggtcggggcaaccatgaccgatgatatcggcatgggcgtcacatacctcgccttgcttgctgcgtttaaggtgcgcccaaccttcgctgccgggctccttctgcggaagctaacctccaaggagttaatgatgaccacgatcggcatcgtcctgctgtcccagagcactataccagaaaccatccttgagctgaccgacgccttagccctagggatgatggtgctaaagatggtacgcaagatggagaaataccagttggcggtcacgatcatggccatcctgtgcgtgccaaacgccgtcatcctgcaaaacacctggaaagtgtcttgcaccatccttgcagtggtcagcgtgtcgcccctgttcctgacctcatcccagcagaaggccgactggatcccactcgcgctgacgatcaaaggcctcaaccccaccgccattttcctaacaactctgtctcggacaaacaagaagcgatcctggccgctgaacgaggctatcatggccgtcggcatggtctctatcctcgcgtcctctcttctgaagaacgacatccccatgaccgggccgctcgtggccggcggtttgctgacagtgtgttacgtcctcaccggccggtcagccgacctggaactggagcgcgccgccgacgtgaagtgggaggaccaagcggagatctccggcagctcccccatcctctctatcacgatatccgaggacggaagcatgtcaatcaagaacgaggaggaggagcagaccctgactatcctgatccggacgggtctcctggtgatcagcgggctgttcccggtctctatccccattaccgccgccgcttggtacttatgggaggtgaagaagcagcgagcaggcgtcttatgggatgtcccttcgccgccgcccgtgggcaaggcggagctcgaggatggggcctaccggataaagcagaaggggatcctcgggtacagccagatcggcgcgggggtgtataaagagggcaccttccacacgatgtggcacgtcacccgtggggccgtcctcatgcataaggggaagcgaatagaaccaagctgggccgacgttaagaaggacctgatctcctacggtggcggttggaagcttgagggcgagtggaaagagggcgaggaggtccaggtgctggccctggagccgggtaagaaccccagagcagtccagactaagccaggactattcaagacgaacgccgggaccatcggcgcagtcagtttagacttcagtcctggcacctccgggtctcccattatcgatcgaaagggcaaggtggtggggctgtacggcaacggagtcgtgacccggagcggggcctacgtctccgctatagcccagacggagaaatccatcgaggacaaccccgaaatcgaagacgacatctttcggaagcgaaagctcaccatcatggacctgcaccccggcgccgggaagaccaaacggtatctgccagccatcgtgcgcgaggctataaagcggggtctgaggaccctcatcctggcccctacgcgggtggtggccgccgagatggaggaggccttgcgcgggctcccaatccgctaccagacccccgcgatccgggccgagcacacaggccgcgagatcgtcgacctgatgtgtcacgcgaccttcaccatgcggctgctctcccccgtgcgcgtgccgaactacaatttgataatcatggacgaggcccactttaccgacccagcttccatcgcagcccggggatacatcagcacccgagtcgagatgggggaggccgccggcatcttcatgaccgccacgccacccggttcccgggacccgttcccccagtccaacgcgcccattatggacgaggagcgtgagatcccagagcggtcctggagttccggccatgagtgggtcaccgacttcaaaggaaaaaccgtatggttcgtaccgagcatccgcgccggcaacgacatcgccgcctgccttcggaagaatggcaaaaaggtgatccagctctcccgcaagactttcgactcggagtacgtgaagactcggaccaacgactgggactttgtagtgaccaccgatatctccgagatgggggcgaacttcaaggcggagcgggtgatcgacccacggcgttgcatgaagcccgtcatcctgacggacggtgaagagcgggtgatccttgcaggccccatgcccgtaacacatagctctgccgcccagcgtcggggccgcatcgggcgcaatcccaagaacgagaacgatcagtacatctacatgggggagcccctcgagaatgacgaggactgcgcgcactggaaggaggcgaagatgctgctggacaacatcaatacccccgagggcatcatcccgtcgatgttcgaacccgagcgagagaaggtcgacgccatcgacggggagtaccgcctccggggcgaggcacgcaagaccttcgtcgacctgatgagacgcggggacttacccgtgtggctcgcgtaccgggtcgcggctgaggggatcaattacgcggaccgccgctggtgcttcgacgggatcaagaacaatcagattttagaggagaacgtggaggtcgagatttggactaaagagggggagcgcaagaagcttaagccgcgctggctcgatgcccgcatctactccgaccccttagccctcaaggaattcaaggaatttgcggccggacgcaagagtctcaccctgaacctgatcaccgagatggggcgcctccccaccttcatgacgcaaaaggcccgggacgccctggacaacctggcggtgctccacaccgcagaggcaggcggaagggcctacaatcacgccctgtccgaattacccgagaccttagagaccctgctgctcctgacactgctcgcgaccgtaaccggtggcatattcttatttcttatgagcgggcgggggatcgggaagatgaccctcggcatgtgctgcatcatcacggcctctatcctgttgtggtacgcccagatccagccacactggatcgccgccagcataatcttggagttcttcctgatcgtcctgctcatccccgagcctgagaaacagcgcaccccacaggacaaccagctgacgtacgtggtgattgcgatcctcacggtcgttgccgctacaatggcgaacgagatggggttcctcgagaagacgaaaaaggacctgggcctgggcagcatcaccacccaacagccagagagcaacatcctcgatatcgatctgcggcccgcctctgcgtggaccctgtacgctgttgccacgaccttcgtcaccccgatgttgcgccactccattgagaattcctccgtgaacgtctcgctgaccgccatcgcgaatcaggcaacggtcttaatgggactaggcaaagggtggccgctgagcaagatggacatcggcgtccctctgctagcgatcgggtgctatagtcaggttaaccccatcaccctgaccgccgccctgttcttgctggtcgcgcattacgccatcatcggccccggcctgcaggccaaggccacccgggaggcccagaagcgagcggccgccgggatcatgaagaaccccacggtggacggcatcaccgtgattgacttggatcccatcccctatgaccccaagtttgagaagcagctggggcaggttatgctgctcgtcctgtgcgtaacgcaggtgctgatgatgcgcacgacgtgggccctttgcgaagccttgaccctagcgacaggccccatctccacactctgggagggcaatcctggccggttctggaatacgaccatcgccgttagcatggccaacatcttcagaggctcttatctggctggtgccggtctactgttctcaataatgaagaacacgacaaatacgcggcgcggtaccgggaacatgggcgagaccttgggagagaagtggaagtcccggctgaacgcgctgggcaagagcgaattccagatttacaagaagagcgggatccaggaggtggaccgcaccctggccaaagagggaatcaagcgcggggaaacggaccaccacgcggtcagccgtggctctgccaagctgcggtggtttgtagagcgaaatatggtaacccctgagggtaaggtcgtggacctcgggtgcggccgcgggggctggagctactattgcggggggctgaaaaacgtacgggaagtcaagggcctgactaagggcggacccggccacgaagagcccatcccgatgtccacctatggctggaacctcgttagattacagagcggcgtggacgtcttcttcacgccgcccgagaagtgcgacaccttgctatgcgacatcggcgagagctcccccaacccgaccgtggaggccggtcgcaccctgcgcgtgctgaacctcgtcgaaaattggctgaacaacaacacgcaattttgtattaaggtgctgaacccctacatgcctagcgtgatcgagaaaatggaggcccttcagcgcaagtacgggggcgcgctggtccggaacccgctgtcccgcaatagcacccacgagatgtactgggtatccaacgccagcggcaatatcgtttcctctgtcaacatgatctcccggatgctgattaaccgttttaccatgcgccataagaaggccacattcgagcccgacgttgacctcggctccgggacgcgtaacatcggcatcgaaagcgagatcccaaatctcgacatcatcggaaaacgcatcgagaaaatcaagcaggaatacgagacgagctggcactacgaccaggatcacccatataaaacctgggcctaccacgggagctacgagacgaagcagaccggtagcgcctcctcgatggtgaacggggtcgtgagacttctcacgaagccatgggacgtagtccctatggtaacccaaatggccatgactgacaccacgcccttcggccagcaacgcgtgttcaaggagaaagtcgacacccggacccaagagcccaaggagggcactaagaagctgatgaagatcacggcggagtggctatggaaagagctcggtaagaagaagactccgcgcatgtgcacgcgggaggagttcacccgcaaggtgcggtccaacgcagcgctgggagcaatttttactgatgagaacaagtggaaatccgcccgcgaggctgttgaggactcccggttctgggagctggtcgacaaagagcggaatctccacttggaggggaagtgcgagacctgcgtgtacaacatgatggggaagcgtgagaagaagctgggggagttcggcaaggccaagggaagtcgcgcgatatggtacatgtggcttggcgcccggttcctggagttcgaggccctgggcttcctcaacgaggaccactggttcagccgcgagaactccctgagcggggtcgaaggcgaggggcttcataagctcggctatatcctgcgtgacgtgtccaagaaggaaggtggggccatgtacgcggatgacactgctggctgggacacaaggatcacgttagaggacctcaagaacgaggaaatggtgaccaaccacatggaaggggagcacaaaaagctggctgaggccattttcaagctcacctaccagaacaaggtcgtgcgggtgcaacgccccaccccacggggcactgttatggacatcatctctcggcgtgaccagcggggctccggccaggttggcacctacggtctcaacaccttcacaaacatggaggcccagcttatccggcaaatggagggcgagggggtgttcaagaacatccaacacctgactgtcactgaggagatcgcggtgcagaactggctcgcccgggtaggccgcgagagactgagccgcatggccatcagtggcgacgactgtgtggtaaagcccctggatgaccggttcgccagcgcactgaccgcgctgaacgacatggggaaggtgcgcaaggacatacagcagtgggagccgtcccggggctggaacgactggacccaagtacccttctgctcgcaccacttccacgaactgattatgaaggatgggcgcgtgctcgtggtcccctgtcggaaccaggacgaactgatcggccgcgcccggatctcccagggggcaggctggtcactgcgcgaaacggcatgcctcggcaagtcctacgcccagatgtggagcttaatgtacttccatcggagagatttgcggctagcggccaatgcaatctgctccgctgtgcccagtcattgggtgccgacctcccgaaccacatggagcatccacgccaagcacgagtggatgactacggaagatatgctgactgtgtggaaccgggtgtggatccaggagaatccatggatggaggacaagacccccgtggaatcctgggaggagatcccctacctggggaagcgcgaggaccagtggtgtggctccctcatcgggctgaccagccgcgcgacttgggccaaaaacatccagaccgcaatcaaccaagtccgatccctgataggcaacgaggagtatacggactacatgccttctatgaagcgcttccggcgcgaggaggaagaagccggggtgctctggtga

SEQ ID NO: 24839 - RNA, 9876 nt, synthetic construct
  misc_feature 1..9876: note = derived and/or modified CDS sequence (opt11) from DENV-2__KF704358__SS-prME
  source 1..9876: mol_type = other RNA
accgccggcatgatcatcatgctgatccccaccgtgatggccttccacctcaccacccgaaacggggagccgcacatgatcgtcagccggcaggagaagggcaagagcctgctgttcaacaccggggacggcgtgcacatgtgcacgctcatggcgatgcacctgggggagctgtgtgaggacaccattacctataagtgccccctactgcgccagaatgagcccgaggacatcgactgttggtgcaactcgacttccacctgggtaacctacggcacctgcaccaccaccggcgagcaccggagggagaagcggtcggtcgccctggttcctcacgtggggatgggcctcgaaacccgcacggagacctggatgtccagcgagggggcttggaagcacgctcagcgtatcgagacgtggatcctgcgccatcccggcttcactatcatggccgcgatcctggcctatactatcgggacgacgcacttccagcgtgccttgatcttcatcttactgaccgccgtcgcgccctccatgaccatgaggtgcatcggcatctctaaccgggacttcgtggaaggcgtgtccgggggcagctgggtagacatcgtgctcgagcacggctcctgcgtgactacaatggccaagaacaagcccaccctggacttagagctcatcaagaccgaggccaagcaaccagccaccctacgcaagtactgcatcgaagccaagcttacgaataccaccaccgaaagccggtgccccacgcagggagagccctctttaaacgaggagcaggacaaacgcttcgtttgcaagcatagcatggtggaccggggctggggaaacggctgcgggcttttcggcaagggttcgatcgtgacatgcgcgatgttcacctgcaagaagatcatgaagggaaaggttgtgcagcccgagaacttagagtacaccatcgtaatcacccctcacagcggcgaggagcatgctgtagggaacgacaccggcaagcacggtaaggagatcaagatcaccccgcagtccagcataaccgaagccgaactcaccggctacggaacagttaccatggagtgtagcccccggaccggcttggacttcaacgagatggtgctgctccagatggaggataaggcttggctggtccaccggcagtggttcctggacctccccctgccctggcttccgggagccgatacccaggggagcaattggatccagaaggagacgctcgtgaccttcaagaacccgcacgcgaaaaaacaggatgtggtcgtgctggggagccaggagggggccatgcataccgccttaactggcgctacggagatccagatgagttcggggaatgttctcttcaccggccacctgaagtgccgcctgcggatggacaagcttcaactgaagggcatgtcctacagcatgtgtaccggcaagttcaaggtcgttaaggaaatcgccgagacccagcacgggactatcgtcatccgcgtgcagtacgagggggacggatccccctgcaagatccccttcgagattatggacctagagaagagacacgtactgggccgcttaatcaccgtcaacccgatcgtgacaggtaaggacagccccgtgaatatcgaggcggaaccgcccttcggcgactcatacatcataatcggggtcgagccggggcaactgaagttaaactggtttaagaaggggtcatccatcggccagatgttcgccaccacgatgcgcggcgccaaacggatggccatcttgggggacactgcctgggacttcggcagcctcggtggcgtattcacctccattggcaaggcgctccaccaggtgttcggcgcaatctacggcgctgccttcagcggggtctcctggactatgaaaatcctgacgggagtgatcatcacctggattggcatgaacagccgatccaccagcttatccgttagcctggtactcgtgggcgtggtcaccctgtacctgggggtgatggtgcaggcggactccggctgcgtggtgagctggaagaacaaggagctcaagtgcggcagcgggatcttcatcacggacaacgtgcacacatggaccgagcagtataagttccagcccgaatcacccagcaagctggcctccgccatccaaaaggcccacgaagagggcatctgcgggatccggagcgtcacccgcctggaaaatctcatgtggaagcagatcacgccggagctgaaccacatcctgtccgagaacgaggttaaactcacgattatgaccggcgacatcaaggggattatgcaggccggtaagcggagcctgcgcccgcagcccaccgagctgaagtacagttggaagacctggggcaaggccaagatgctctcgacagagtcccacaatcagaccttcctgatcgacgggcccgagaccgccgagtgcccgaacaccaacagagcctggaatagcctggaggtggaggactatggcttcggagtcttcaccacaaacatctggctcaagctgcgcgagaagcaggacgtgttctgcgactccaagctgatgagcgcggccatcaaggacaaccgggcggtgcacgccgacatgggctactggatcgaatccgctctcaacgacacttggaagatcgaaaaggccagcttcatcgaggtgaagtcctgccactggcccaagagccacaccctgtggtccaacggcgtgctggagagcgagatgattatacccaaaaacttcgccgggcccgtgagccagcacaactaccgcccgggctaccacacgcagaccgcagggccctggcacctcggcaagctggagatggacttcgacttctgcgaggggactaccgtcgtggtcacggaggactgcggaaaccggggcccctccctgagaaccaccaccgccagcgggaagctcatcacggagtggtgctgccggtcctgcaccctgcccccgctgcgctatcggggcgaggacgggtgctggtacggcatggagatccgccccctcaaagagaaagaggagaacctggtcaactcactggtgaccgctgggcacggccagatcgacaacttctcgctcggcgttctggggatggccttgttcttagaggagatgctgcggaccagggtcggcactaagcacgcgatcctgctcgtggccgtgagcttcgtcacactgatcaccgggaacatgtccttccgagacctgggccgcgtgatggttatggtcggggccacaatgacggacgatatcggcatgggcgtgacctaccttgcgctgctggccgcgttcaaagtgcgccccacattcgccgccgggctcctgctgcggaagctcaccagcaaggagctgatgatgacgaccataggcatcgtcctactctcccagagcaccatccccgagaccatcctggagctgacggacgccctagccctggggatgatggtgctgaagatggtgcgcaagatggaaaagtaccaactcgcggtcacgatcatggccatcttatgcgtgccgaacgctgtcatcctgcagaatacctggaaagtttcctgtaccatcttagccgtggtcagcgtgagccccctgttccttacctcctcccaacagaaggccgactggatccccctcgcgctgaccatcaagggcctgaaccccaccgccatcttcctcacgacattaagccggaccaacaagaagcgctcctggccattgaacgaggccattatggccgtgggcatggtcagcatcctcgcgtccagtctgctgaagaatgacatccctatgaccggacccctcgtggccggcgggctgcttactgtgtgctacgtcctcacgggccggagcgccgacctggagctggagcgcgccgccgacgtcaagtgggaggaccaggctgaaatatccgggagctcgcccatccttagcatcaccatctcggaggacggcagcatgtccatcaagaacgaggaggaggagcagaccctgaccatcctgatacgtaccggcctcctggtgatttcaggcctgtttcctgtctcaatccccatcacggctgccgcctggtacctctgggaggtgaagaagcagcgcgccggcgtgctgtgggacgtcccctccccgccgcccgtggggaaggcggaactggaggatggcgcctaccggatcaagcagaaggggatccttggttactcccaaatcggcgccggcgtgtacaaggaaggtaccttccacaccatgtggcacgtcacacgcggtgccgtgctgatgcacaagggcaagcgtatcgagccctcgtgggccgacgtgaagaaggacctgatctcctacggaggaggctggaagctcgaaggggaatggaaggagggcgaggaggtccaggtgctggcgctggaacctggcaaaaaccctcgcgccgtgcagacgaagcccggcctcttcaagaccaacgccgggaccatcggcgccgtcagcctggacttttcccccggcacctctgggtcccccatcatcgacaagaagggcaaggtggtggggctgtacggcaacggcgtcgtgacgcgcagcggcgcctacgtctccgcgatagcccagaccgagaagtccatcgaggacaatcccgagatcgaagatgacattttcagaaagcggaagctcacaatcatggacctgcacccgggcgccgggaagaccaagcgctacctgcctgccatcgtccgggaggcaatcaagcgcggtctgagaacactcattctggccccgacgcgcgtggtggccgccgagatggaagaggccctgcgggggctccccatccgctatcagacccccgcgatccgcgccgagcataccggccgggagatcgtcgacctgatgtgccacgccacgttcaccatgcgcctcctgagtcctgtgcgggtgccgaactacaacctaatcataatggacgaggcccacttcaccgaccccgccagcatcgcggcccgcggctacattagcacccgggtcgagatgggggaggccgccgggatcttcatgacggccacgccacctgggtcccgcgacccgttcccccaaagcaacgcgcctatcatggacgaagagcgggagatccccgagcgctcctggagctccggacacgagtgggtcaccgacttcaaggggaagactgtgtggttcgtcccgtcaattcgggccggcaacgacatagccgcctgcctgcgcaagaacggcaagaaggtgatccagctctcccggaagacgttcgacagcgagtacgtgaaaacccgcacaaacgactgggacttcgtcgttaccaccgacatctccgaaatgggggcgaacttcaaggccgagcgggtgatcgaccccagacggtgcatgaagcccgtcatcctgactgacggcgaggaacgagtgatactggccgggcccatgcctgtgacccatagctccgcggcccagcggcgcggccggatcgggcgaaacccgaagaacgagaacgaccagtacatatacatgggcgaacccctcgaaaacgacgaggattgcgcgcactggaaggaggccaagatgctgctggataacatcaacacccccgaggggatcatcccgtctatgttcgagcctgagcgggaaaaagtggacgccatcgacggggagtaccggcttcgtggcgaggcccggaagacgttcgtggacctgatgcgccgcggggacctgcccgtgtggttggcatacagggtcgcggcagagggtataaactacgcagacaggcgctggtgcttcgacgggatcaagaacaatcagatccttgaggagaatgtggaggtcgagatttggacaaaggagggcgagcggaagaagctaaagccgcgctggctcgacgcccggatctactccgacccactggccctgaaagagttcaaggagtttgcggccggccgcaagagcctcaccttgaacctgattaccgagatgggtcggttgcccacgttcatgacccagaaggcccgcgacgccctggataacctggcggtgttacacaccgccgaggccggcgggagagcctacaaccacgccctgtcggagctgcccgagaccttggagacattgctgctactgaccctgctcgcgaccgtaacgggaggcatctttctgttcctgatgtctggccgcggcataggaaaaatgaccctcggcatgtgctgcataataacggcgtccatcctactgtggtacgcacagatccaaccgcactggatcgccgccagcatcatcctcgagttcttcttaatcgtgctactcatccccgagcccgagaagcagcggaccccccaggacaaccagcttacctacgtggtgatcgctattctgaccgtcgtggccgccacgatggccaacgagatggggttcctcgagaagaccaagaaggacctgggcctgggcagtatcactacccagcagccggagtcaaacatccttgacatcgacctgcgccccgccagcgcgtggaccctgtacgccgtggccaccaccttcgtcacccccatgctccgccactccatcgagaacagctccgtgaacgtgagcctgacggccatcgccaaccaggcgaccgtcctgatggggctcggcaaggggtggccgctgtccaagatggacatcggcgtgccgctgctcgccatcgggtgctacagccaggtgaacccaatcaccctgactgccgccctgttcctcctggttgcgcactacgccattatcggccccggcttacaagccaaggccacgcgcgaggcacagaagagggcggccgccggtatcatgaagaaccccaccgtggacggcatcaccgtgatcgacctcgatccaatcccctacgaccccaagttcgagaagcaactggggcaggtcatgctgctcgtactgtgcgtgacccaggtactaatgatgcgcacgacctgggccctctgtgaggccctgacactggcgactggccccatttccacgctctgggaggggaacccgggccgcttctggaacaccaccatagccgtgagcatggctaacatcttccggggctcctacctggcgggggccggcctgttgtttagcatcatgaagaacaccaccaacacccgccgggggaccggcaacatgggcgagaccctgggtgagaagtggaagtctcgactgaacgctctcggcaaaagcgagttccaaatctacaagaagtccgggattcaggaggtggaccggaccctggccaaggagggcatcaagcgcggggaaaccgaccaccacgccgtcagccggggcagtgccaagctgcgctggttcgtggagcggaacatggtgacccccgagggaaaggtcgtggacctcgggtgcggcagagggggctggtcgtactactgtgggggcttgaagaacgtccgggaggtgaaggggctgaccaagggcggccccggccatgaggagcccatcccaatgagcacgtacggatggaacctcgtccgcctgcagagtggggtggacgtctttttcacaccgcccgagaagtgtgacaccctgctctgcgacatcggcgagagctcgcccaacccgaccgtggaggcgggccggacgcttcgcgtcctgaatctcgtcgagaactggctgaacaacaacacgcagttttgcattaaggtgctgaacccctacatgcccagcgtgatcgagaagatggaggccttgcagcgtaagtacgggggcgccctggttcgcaacccgctgtcccggaacagcacccatgagatgtactgggtctccaatgccagcgggaacatcgtgtccagcgtcaacatgatctctcgcatgctgatcaaccggtttaccatgcgccacaagaaggccaccttcgagcccgacgtggacctcggcagcggtacgcgcaacatcggcatcgagtctgagatccctaacctggacatcataggaaagcggatagagaagatcaagcaggagtacgagaccagctggcactacgaccaggaccatccgtacaagacctgggcgtaccatgggtcctatgagaccaagcagaccggaagcgcctccagcatggtaaacggggtcgtgcgcctgttaaccaagccgtgggacgtcgtccccatggtgacccagatggccatgaccgacacgacccccttcggccagcagagggtgtttaaggagaaggtcgacacccgcacccaggagcccaaggagggcacgaagaagctgatgaagatcaccgccgagtggttatggaaggaactcgggaaaaagaagaccccgcggatgtgcacccgcgaggagttcacgcggaaggttcgctccaacgccgcgctgggcgcgatcttcaccgacgagaataagtggaagtccgcccgggaagccgttgaagattcccgcttctgggagctcgtggacaaggaaaggaacctccacctggaggggaagtgcgagacctgcgtgtacaacatgatgggcaagcgcgagaagaagctgggggaattcggcaaggccaagggaagccgggcgatatggtacatgtggctcggagccaggttcctggagttcgaggccctgggcttcctcaacgaggaccactggttcagccgggagaactccctgagcggggttgagggtgagggccttcacaagctcggctacatcctgagggacgtgtccaagaaggagggaggggccatgtacgcggacgacaccgccggctgggacacgcggatcaccctggaggacctcaagaacgaggagatggtgaccaaccacatggagggggagcacaagaagctggccgaggccatcttcaagctgacctaccagaacaaggtcgttcgcgtgcagcggcccacgccacgcggcaccgtcatggacatcatcagccggcgcgaccaacgcgggtccggccaggtgggcacatatgggctcaacaccttcactaacatggaggcccagctgatccggcagatggagggcgagggcgtgttcaagaacatccagcatctcaccgtcaccgaggagattgcggtgcagaactggctcgcacgcgtgggccgggagcgcctgagccggatggccatctccggcgacgactgcgtcgtgaagcccctggacgaccgcttcgcctccgccctcaccgcgctgaacgacatggggaaggtccggaaagacatccagcagtgggagccgtcccgcggctggaacgactggacgcaggtccccttctgctctcaccacttccacgagctgattatgaaggacgggcgggtgctagtggtcccctgccgcaaccaggacgagctgattggccgggcccgcatctcccagggggccggctggagcttacgggagaccgcctgcctcggcaaatcctacgcccaaatgtggtcactgatgtacttccacaggagggacctgcgcctcgcggccaacgcaatctgctccgccgtgcccagccactgggtgccgacctcccggacgacctggagcatccacgccaagcacgagtggatgacgacggaggacatgctgaccgtctggaaccgtgtttggatccaggagaacccctggatggaggacaagacccccgtggagtcatgggaggagatcccctacctagggaagcgggaggaccagtggtgtggttccctcatcgggcttacgagccgcgcgacctgggccaagaacatccagaccgccatcaaccaggtccgctccctgatcggcaatgaggagtacaccgactacatgccgagcatgaaaagattccgccgggaggaggaggaggccggggtgctgtggtga

SEQ ID NO: 24840 - RNA, 9876 nt, synthetic construct
  misc_feature 1..9876: note = derived and/or modified CDS sequence (opt11) from DENV-2__KF041232__SS-prME
  source 1..9876: mol_type = other RNA
acggcaggagtaattatcatgctgatacccactgccatggctttccatctgaccacacgaaacggagaaccgcatatgatagtctctaaacaggaaaaagggaaatcattgctgttcaaaaccgaagacggagttaacatgtgcaccctaatggccatggatctaggagaactatgcgaagacacaataacatacaattgccccttattacgccagaacgaaccagaagacatagactgctggtgtaacgcaacaagtacatgggtgacgtacggcacatgtacggcgacaggtgaacacaggcgagagaaaaggtccgttgccctggtaccacatgttggcatgggtttagaaacccgaacagaaacctggatgtccagcgagggggcatggaaacacgcccagcgtattgagacgtggatcctaaggcatcccgggtttacaatcatggcggcgatcctcgcctacaccatcggcacaacatacttccaaagagtgcttatctttatcctactcacagcggtcgcaccatcaatgacaatgcgctgtattggaatctcgaatcgagacttcgtcgaaggcgtcagcggaggtagctgggtagacatagtcctagaacacggttcctgcgtaaccaccatggccaaaaacaaaccaaccctggattttgaactaatcaaaacagaagcaaaacaaccggccacactgagaaaatactgtattgaagccaaactcacaaacactacgacggcctccagatgcccaacccagggtgaaccatccctgaacgaagaacaggacaaaaggttcgtatgcaaacacagcatggtcgaccgagggtgggggaacgggtgtggactattcggcaaaggcggaattgtaacctgcgccatgttcacatgcaagaaaaacatggaaggtaaaatcgtccagcccgaaaacctggagtacaccatcgtagtcaccccgcacagtggtgaggaaaacgcagtaggaaatgacaccggcaaacacggaaaagaaattaaagtcactccacaatcatcaataacagaggccgaactaacaggctatggaaccgtgacaatggaatgcagcccgcgaacgggcctggattttaatgagatggtcttactgcaaatggagaataaggcttggttggtacatcgccagtggttcctagacttaccactgccctggcttccaggcgccgacatacaagggtcaaactggatacaaaaggaaacgctagtgaccttcaaaaacccacatgcaaagaagcaggacgtcgtagtcctagggagtcaagagggtgcgatgcacacggctctaactggtgctaccgaaatccaaatgtcgtcaggcaacttactattcacagggcacctcaaatgcagacttcggatggacaaactccaactaaaagggatgtcgtactccatgtgtacgggaaagtttaaagtcgtaaaagagatcgcggaaactcaacacgggaccatcgtagttagagtccagtacgaaggcgatggaagcccgtgcaagataccgttcgagataatggatctggaaaagcggcacgttctaggacggctaatcacggttaatcctatcgtcacagaaaaagacagcccggtaaacatagaagccgagcctccattcggagacagctacataataataggggttgagccgggacagctaaaattaagttggttcaagaaaggctcatcaattggccaaatgtttgaaaccacgatgcggggcgcaaaaagaatggccatcctaggagacactgcatgggacttcggctccttagggggagtattcactagcataggcaaagcgttacaccaggtgttcggcgcaatatacggcgcggcattctcgggggtttcatggacaatgaaaatcctcatcggagtggtcataacatggataggaatgaacagtcgtagtacgtcgctgtccgtctctctcgtcctcgttggagtggtcacgttgtacctcggggcaatggtgcaagcggactcgggatgtgtcgtatcatggaaaaacaaagagctaaaatgcggttcaggaatcttcatcacagacaacgtccatacatggacagaacaatacaaattccagcctgaatcaccatcaaagctcgcctctgccatacaaaaggcgcacgaagaggggatctgtggtatacgatcggtgacaagactcgaaaacctcatgtggaagcagataacccccgagctcaatcacatactgtccgaaaacgaggtcaaactgtccatcatgacaggcgacataaaaggcatcatgcaggccggcaagagaagtctaaggccgcagccaaccgagctgaaatacagctggaaaacatggggcaaagccaagatgctatccacagaaccccataaccaaacattcctaatcgacgggccggaaacggcagagtgcccgaatacaaatagagcatggaactccctcgaagtggaggactatgggtttggtgtcttcacgaccaatatatggttaaaacttaaggaaagacaagacgtattctgcgattcgaagctgatgtcggcagcaataaaggataaccgcgctgtacatgcagacatgggctattggatagagtcagcactgaacgacacatggaaaatcgaaaaagcctctttcatcgaggttaaaagctgccactggcccaagagccatacactgtggtccaacggcgtcctcgagtccgagatgattatacccaaaaattttgccgggcctgtctctcagcacaattatcgaccaggttaccacacgcagactgcgggcccttggcacttggggaaactagaaatggacttcgatttctgcgaagggacaaccgtcgtcgtaacagaagactgcggaaacaggggccctagcctcagaaccacaaccgcgtcaggcaaactcatcaccgaatggtgctgcagaagctgcactctaccaccgctacgatatcgaggggaagatggctgttggtacggaatggagatccgtcccctcaaagaaaaagaggaaaacctagtaaatagcttagtaacggctggtcatggacaaatagataacttcagcctcggggtcctcgggatggcactgttcttagaagagatgctacgcactagggtcggaaccaagcacgccgttctacttgtggcggtctcttttatgaccctcataacaggcaacatgtcatttcgcgatctagggcgcgtaatggtgatggttggagcagcaatgaccgacgatataggaatgggggtaacctatctagcgctcctggcggcatttaaggtgcgtccaacattcgccgccggactactcctgcgcaagctaacaagcaaagaattaatgatgaccacaattggaatcgtgctgctgagtcagtccacaaccccagaaacgatacttgagctaaccgatgcactcgcccttggcatgatgatactcaaaatcgtaagaaacatggaaaagtaccaactcgccgtgactataatggcaatactgtgcgtccccaacgcggtcatactacaaaatgcatggaaagtatcctgtaccatcctcgcggctgtaagcgtgagccccctcctccttacgtcgagccaacagaaagccgactggataccgctagcgttgaccataaagggactcaatcccaccgctatatttctaaccaccctttctagaacaaacaaaaagcgctcctggccgctgaatgaagcaataatggctgtgggtatggtatccattctcgcttcgagcctgctcaaaaatgacatacctatgaccggtccattagtagcagggggcttattaacagtctgttacgttctgacaggaagaagcgccgatctcgaactcgaaagagccgcggacgtacggtgggaagaccaagcagaaatatccggatcatcaccgatactcagcatcacaatttcggaggatggaagcatgtctatcaagaatgaggaagaagaacagaccctaacaatcttgattcgaaccggactcctagtgatcagtggcttattcccagtatccataccaataacggccgccgcctggtatttatgggaggtaaagaagcaaagggcaggagttttatgggacgtacccagtccaccacctgtaggcaaagcggaactagaggacggagcatatcgaatcaaacagaaggggatactcggctactcccagatcggcgcaggggtctataaggaaggcacattccacacgatgtggcacgtcacacgaggagcagttctaatgcacaaagggaagcgaatcgagccctcttgggcggatgtccgaaaggatctgataagctacggaggcggttggaaactcgaaggcgagtggaaagagggcgaagaagtgcaagtactcgccctcgaaccgggcaagaacccaagggccgtacaaacgaaacccggactattcaaaacgaacaccggcaccatcggagccgtttcactggatttcagccccggaaccagcggatcacccatcgtcgacaaaaagggaaaggtggtgggactgtatgggaacggggtagtcacaaggagcggtacgtatgtgtccgccatagcacaaacagagaaaagcatagaggacaacccagaaatcgaagacgacatattcagaaagaaaaggttaaccatcatggacctgcacccaggagcgggtaagacaaagcggtatctcccagcaatcgtcagagaagctataaaaagaggcttgcgcacactaatcctagcaccgacccgagtcgtcgcagccgaaatggaggaagcgctgagaggactgccaatacgataccaaacaccagcaattcgcgcagagcacaccggtcgtgaaatagtggacctcatgtgccacgcgacatttacaatgcgactcctgtcgccagtgcgcgtgccaaactacaacttaatcattatggacgaagcgcacttcaccgatccagcgagcatcgccgcgagagggtacatatcaaccagagtcgaaatgggcgaggcagcaggtattttcatgaccgcgacacccccggggtcgcgagacccgttcccacaaagcaacgccccgataatggacgaagaacgggagatcccggagcgcagctggaacagcggccacgaatgggtgacagatttcaagggaaaaacggtgtggtttgtcccgtcgatcaaagcagggaacgacattgcagcgtgcctccggaaaaacggcaagaaagtgatacaactttcgagaaaaaccttcgactctgaatacatcaaaacacggacaaacgactgggacttcgtagtaacaaccgacatatcggagatgggtgcaaacttcaaagcagaacgagtaatagacccccggaggtgcatgaaaccagtaatcctaacagatggtgaagaacgcgtcatcctcgcaggtcccatgccggtaacccactctagtgcggcccagaggcgggggcgaatcggcagaaaccccaaaaacgaaaatgaccagtatatctacatgggagaacccttggaaaatgatgaagactgcgcccactggaaggaagcaaaaatgctcttggataacataaacacccccgaggggatcatcccaagcatgtttgaaccagagcgcgaaaaagtagatgccatcgacggagagtaccgcttgcgaggggaggcaagaaaaacattcgtcgacttaatgcgccgaggtgatttgcccgtgtggctcgcataccgtgtcgccgccgagggtataaactacgctgatagaaggtggtgcttcgatggcatcaagaacaaccaaatcttggaagaaaacgttgaggtagaaatatggacaaaagaaggcgagcggaagaaactgaagccacgctggctcgacgcacgcatatatagcgaccccctggcgctgaaagagttcaaggagttcgcggcgggacggaagagtcttacactaaacctgatcaccgagatggggcgcctgccaacttttatgactcaaaaggccaggaacgcccttgacaatctagccgtcctacataccgctgaggcaggcggccgagcgtacaaccacgcactaagcgagttacccgagacgcttgagactttgctccttcttacgctcctagccacggtgactggagggatcttcctcttcttaatgtcaggtaaaggcataggaaaaatgacgttgggaatgtgctgtataatcaccgcttcgatacttctttggtatgcccaaattcaaccacattggatagccgccagtattatacttgagttcttcctgatcgtcctactcatacccgagccggagaagcagagaacgccacaggataaccagctcacgtacgtggtaatcgctattttaaccgtagtcgctgccaccatggctaacgagatgggcttccttgagaaaactaagaaagacttcggactggggagcattgccacacagcaaccagagagcaacatactagacatcgacctgcgaccggcaagcgcctggaccctgtacgccgtagcaaccacctttataaccccgatgctacgacactcaatagaaaacagttccgtaaacgtttcgctaacggcaatagcaaatcaggccacagtattaatgggcctaggtaagggctggccgctctcgaaaatggatataggggtaccacttttagcgatcggttgctactcgcaggtaaaccccataacactaacggccgccctccttctcttagttgcacactacgcgataatcggaccaggcctacaagcaaaagcgaccagagaagcgcagaagcgcgcggcggccggcatcatgaagaacccaaccgtagacggtataactgtaatcgacctagacccaatcccctatgaccccaagttcgaaaagcaactcggacaagtaatgctcctagtcttgtgcgtaacacaggtcctcatgatgcgaacgacctgggcattgtgcgaggcgctgacactcgccacaggaccgatatccacgctctgggaagggaacccagggaggttctggaacacgaccatcgcagtgagtatggcgaatatcttccggggttcatacctcgccggggccggactgctatttagcatcatgaagaataccacaaacacccgacgaggcacagggaacaccggggagacgctgggagagaaatggaaaaaccgcctgaatagtcttggcaaaagcgagttccagatatataagcgaagcggcatccaagaggtggaccgcaccctggccaaggaaggcatcaagcgaggagaaacagaccatcacgcggtctccagaggctcagcgaaactgcggtggtttgttgagagaaacctcgtcactccagagggcaaggtagtagacctaggatgcggcagaggcggatggtcctactactgtggaggactcaaaaacgtgagagaagtcaagggcctgacaaaagggggcccaggacacgaagaacctataccaatgtcgacctacggatggaacctagtacgtttgcaaagcggggtagatgtatttttcacaccgcccgaaaaatgcgacacgctactctgtgacatcggggaaagcagtccaaatcccaccgtcgaagcagggcgcacgttacgggtacttaacctagtggaaaactggctaaataacaacacccaattctgcataaaagtccttaacccatacatgccaagcgtcatcgagaagatggaaacactccaaagaaaatacggaggcgcactcgtacgcaacccactgtccagaaacagcacccacgagatgtattgggtctcgaatgcaagcggcaacatagtgtccagtgtaaacatgatatcgcgaatgctcattaatcggttcaccatgcgacacaagaaagcgacctacgagccagacgtggacctcggtagcggaaccagaaacatcggcattgaaagcgagacgcctaacctagacattataggcaagcgaatcgagaaaattaagcaagaacatgaaacaagctggcactacgaccaagatcacccctacaaaacgtgggcctaccacggttcctatgaaactaagcaaactgggagtgcatcgagcatggtgaacggcgtagtccgccttctaacaaaaccgtgggacgttatccccatggtgactcaaatggcgatgacggacaccacaccctttgggcaacaacgtgtattcaaggaaaaagtagatacccggacgcaagagcctaaggaaggcaccaagaaacttatgaaaatcacggcggaatggctatggaaagaactcggcaagaagaaaacgcccaggatgtgcacaagggaagaatttgcccgcaaggtacgaagcaacgcggcattgggagcaatattcaccgacgaaaacaagtggaaaagcgcccgcgaagccgtagaggactcccggttctgggaattagtggacaaggaaagaaatctgcacctggagggcaagtgcgaaacttgcgtatacaacatgatgggcaaacgtgaaaagaagataggggagttcggtaaggccaagggctcaagagccatatggtacatgtggcttggtgcccgttttctcgagtttgaggcactcgggttcctcaacgaggaccactggtttagccgagaaaattcgctaagcggtgtagaaggtgaaggactgcacaaacttggatacatcctcagggaagtaagcaagaaggagggaggagcaatgtacgcggacgacacggcgggatgggacacccggataactctcgaagacctcaaaaacgaagaaatggtcacgaaccacatggagggcgaacacaagaaactcgcagaggcaatcttcaagctaacctaccaaaacaaggtggtacgagtacagcgccccacccctcggggtacagtaatggatatcatatcaaggagagaccagcgtggaagcggccaagtcggaacatatggactcaacacctttaccaatatgggagcacaactgatcagacagatggaaggagagggggttttcaaggggattcaacacttgaccgcaaccgaagaagttgcggtccaagactggctagctagagtcggtagagagcggctgtcccgaatggcgatatccggtgacgactgcgtagtcaaaccgctcgacgatcgattcgcaaacgcacttacagccctaaacgacatgggaaaagtacggaaagacatacaacaatgggagcccagtaggggatggaacgattggacgcaggtcccattctgctcacaccactttcacgaactaataatgaaagacggtcgcgtgctagtcgtaccctgccgcaaccaagacgagctaatagggagagctcgaatctcccaaggagcgggatggagcctccgtgagaccgcatgccttggaaaatcttacgcccaaatgtggtcgctaatgtacttccataggagggacttacggttagccgcgaacgcaatatgctcagccgttccgagtcactgggtcccaacaagtcgtacaacatggagcatacacgcccgacacgagtggatgacaacagaagacatgctaacggtatggaacagagtgtggatacaggaaaatccatggatggaagacaaaactcccgtcgaatcttgggaggagattccctacctgggaaaaagggaggatcaatggtgtggaagcctcataggcctaactagccgcgctacttgggcacgcaacatccaaacggcaataaaccaggtgcgctcactgattggtagcgaagaatacacggattacatgcccagcatgaaacgctttaggcgcgaagaagaagaggcgggagtactctggtaa

SEQ ID NO: 24841 - RNA, 9876 nt, synthetic construct
  misc_feature 1..9876: note = derived and/or modified CDS sequence (opt11) from DENV-2__KF041233__SS-prME
  source 1..9876: mol_type = other RNA
accgcgggcgtgatcatcatgctaattcccaccgcaatggcgttccacctcaccacccggaatggggagccccatatgatagtcagcaagcaggagaagggtaagtctctgcttttcaagaccgaggacggggtaaacatgtgcaccctcatggcgatggatctgggcgaactgtgcgaagacaccatcacctacaactgccccctcctgcgccagaacgagcccgaagacatcgactgctggtgcaacagcacatccacatgggtgacctatgggacctgcaccgccactggcgagcaccgccgtgagaagcgcagcgtcgccttggtgcctcacgtgggcatggggctcgagacccggacagagacctggatgagtagcgagggcgcttggaagcacgcgcagcgcatcgagacctggatcctgagacaccccgggttcactatcatggccgccatccttgcgtacaccatcggcacaacctactttcaacgcgtgctcatcttcatcctgctgacggcggtggcaccctccatgacgatgcggtgcatcggaatctccaaccgggacttcgtggagggcgtctccggcgggtcgtgggtggacatcgtgctcgaacatggcagttgcgttaccaccatggccaagaataaacccacccttgacttcgaactgattaagaccgaggcaaaacagcccgccaccctccgaaagtactgcatcgaggccaagctgaccaacaccaccaccgcgtctcgctgtccgacccagggggagccttccctgaacgaggagcaggacaagcggttcgtgtgtaagcacagcatggtagaccggggctggggaaacgggtgcgggctcttcggaaagggcgggatcgtcacgtgcgccatgttcacgtgcaaaaagaacatggagggcaaaatcgtgcagccggagaacctcgagtataccattgtagtcactccccacagcggcgaggagaacgcggtggggaacgacacgggcaagcacggcaaggagatcaaggtgacccctcagtcaagcatcaccgaagccgaactgaccggctacggcacggtcacgatggagtgtagcccaaggaccggcctcgacttcaacgagatggtgctgctccagatggagaacaaagcgtggctcgtgcaccgccagtggttcctggatctgcccctcccctggctgccgggcgccgacatccaagggtccaactggattcagaaggagaccctggtcaccttcaaaaacccgcacgccaagaaacaggacgtggtggttctaggcagtcaggagggggctatgcataccgccctgaccggcgccaccgagatccaaatgagctccggaaacctcctgttcaccggacacctgaagtgccggctgcgcatggacaagcttcagctcaagggcatgtcctactccatgtgcaccggtaagttcaaggtagtcaaggagatcgctgagacacaacacggcaccatcgtggtgcgggttcagtacgagggggacggaagcccctgcaagatccctttcgagatcatggaccttgaaaagagacacgtgctcggccggctgattaccgtgaacccgatcgtgacggagaaggactccccagttaatatcgaggccgagccgcctttcggcgactcttacattatcatcggggtggagccaggtcagctcaaactttcctggttcaagaagggctcctccattggtcagatgtttgagacaaccatgcgcggggctaagcgaatggctatcctcggtgatactgcgtgggacttcgggagcttgggaggggtgttcacttccataggcaaggccctccaccaggtcttcggggccatctacggcgctgcgttcagcggagtgtcctggactatgaagatcctgatcggggtcgtgataacctggataggcatgaattcacgatccacctcgttgtccgtgagcctggttctcgtgggtgtggtaacgctgtacctgggcgtgatggttcaggccgattccgggtgcgtcgtaagctggaagaacaaggaactcaagtgcggcagcggaatcttcataaccgacaacgtccacacttggaccgagcagtacaagttccagcccgagtcccccagtaagctggccgccgccatccagaaggcccacgaggagggaatctgcggcatccgtagtgtcacacgcctggagaacctcatgtggaaacagattacccccgagctgaaccacattcttagcgaaaacgaggtgaagctctcgatcatgactggggacatcaagggaatcatgcaggccgggaagaggagcctgcggccacagccgaccgaactaaagtacagctggaaaacgtggggcaaggccaagatgctcagtaccgagccccacaatcagaccttcctgatagacggcccagagaccgccgagtgccctaacacgaaccgtgcctggaattccctggaggtcgaggactacggattcggcgtctttaccaccaacatatggctcaaactgaaggagcggcaggacgtcttctgcgactcaaagctgatgtcagcggccatcaaggacaaccgcgctgttcacgccgacatggggtactggatcgagagcgccctcaatgacacctggaagatcgagaaagcgtcgttcatcgaggtcaagagctgccactggcccaagtcccacacgctgtggagcaacggagtgctggagtccgagatgatcattcccaagaacttcgccggcccagttagccagcacaactatcggcccggttaccatacccagaccgccggcccatggcacctaggtaaattagagatggacttcgatttttgtgaaggcaccaccgtcgtagtgacggaggattgcgggaaccgcggccccagtctgcggaccacaaccgcatccgggaagctcataactgagtggtgctgccgcagctgcactctgccgcccctccggtaccgcggagaagacggctgctggtacggcatggagatccgtcccctcaaggagaaggaagagaacctggtcaactccctcgttaccgcgggccacgggcaaatcgacaacttcagcctaggggtgctggggatggcgctgtttctcgaggagatgctgcgcactcgggtcgggacgaagcacgccgtgcttctcattgcagtgtccttcatgacgctgatcaccggcaacatgagtttccgcgatctgggtcgggtcatggtgatggtaggcgccgcgatgaccgatgatattgggatgggcgttacgtacctcgccctgcttgctgcctttaaagtgcgccccaccttcgcggcgggcctcctgttaagaaagctcacctccaaggagctaatgatgaccactatagggatcgtactcctctcacagtccaccacccctgagaccattctggagctgaccgacgccctcgccctgggaatgatgatccttaagatcgtccggaacatggaaaaataccaactcgcagtgactatcatggcaatcctgtgcgtccccaacgcggtgatattgcagaacgcctggaaggttagctgcaccatcctcgccgccgtctctgtgagccctctgctgcttacaagttctcagcagaaggcggactggatccccctcgccctgacgatcaaggggttgaacccgaccgcgatcttcctgaccaccctgagtcgcacgaacaagaagcggtcgtggcccctcaacgaagccatcatggctgttggtatggtctccatcctggcatcctccttactcaaaaatgatatcccaatgacgggccctctggtggccgggggtctgctcaccgtgtgctacgttctgaccggtcggagcgccgacctggagctagagcgcgccgcggacgtaaggtgggaggaccaagcggagatcagcggctccagcccgatcctgtcaatcacgatcagcgaggacgggtcaatgagcatcaagaacgaagaggaggaacagaccctgaccatactcatacggacaggcttactggtgatctccggtctattccccgtctctatccccatcacggccgcggcctggtatctgtgggaggtgaaaaagcagcgcgccggggtgctctgggacgtgccctccccgccccccgtgggcaaggccgagctcgaggacggggcgtaccggatcaagcagaaggggatcctggggtactcccagatcggcgccggcgtgtacaaggagggaactttccatactatgtggcacgtcacccgcggtgcagtgcttatgcacaaagggaagcggatcgagccgtcctgggccgatgtgcgcaaggaccttattagctacgggggggggtggaagctggaaggagaatggaaagagggggaagaggtccaggttctggcgttagagccaggcaagaacccccgggcggtgcagacaaagcccgggctgttcaagacgaacaccggcaccatcggggccgtatccctagacttctctccgggcacctccggtagcccaatcgtggacaaaaaggggaaagtggttggcctctatgggaacggcgtcgtgacgcgctctggcacctatgtctctgcaatcgcgcaaaccgagaagtcaatcgaggacaaccccgagattgaggacgacatcttccggaagaagaaactgaccatcatggacctgcaccccggggccggcaagacgaagcgatatttgccggccatagtgcgggaggccattaagcgcgggcttcggacactgatcctggctcccacccgcgtggtcgctgccgagatggaggaggcgctccgcgggctgcccattaggtaccagacccccgccatccgtgccgagcacacgggtcgggagatcgtggacttgatgtgccatgcaaccttcacaatgcgcttgctgagcccggtacgggtccccaactacaacctgatcatcatggacgaagcccacttcaccgatcctgctagtatcgccgcccgtggctatatctccacgcgggtggagatgggcgaggcggccgggatctttatgaccgccacgccgcccggcagcagggaccccttcccgcagagcaacgcgcccatcatggacgaggagcgagagattcccgagcgctcatggaactccgggcacgagtgggtgaccgatttcaagggcaaaacggtatggtttgtgcccagcatcaaggctgggaacgatattgccgcctgcctgcgcaagaacgggaagaaagtgatccagttatcccgcaagaccttcgacagcgagtacatcaagacccggaccaacgactgggacttcgtcgtcacgaccgacatatccgagatgggcgccaactttaaggcggagcgcgttattgacccacggcgctgcatgaagcctgtcatcctcaccgacggggaggagagggtaatcctcgcgggccccatgccagtgacccacagttccgccgcacagcgccggggtcgcatcggccggaacccaaagaacgagaacgatcagtacatttatatgggggagcccctggagaacgatgaggactgcgcccactggaaggaagccaagatgctgctcgataacatcaacacgccggaaggcatcatccccagcatgttcgagcccgagcgcgagaaggtagacgcgatcgacggtgaatatcgcctgcgcggggaggcccgtaagacctttgtcgacctgatgcgccgaggcgacctcccggtgtggctagcctaccgggtagccgcggaagggatcaattacgccgaccgtcggtggtgcttcgacggcatcaagaacaaccagatcctggaagaaaacgttgaggtcgagatctggaccaaggaaggggagcgcaagaagttgaagccacggtggctggacgcacgcatctattccgatcccctggctctaaaggagttcaaggagttcgccgcgggacgcaagagcctcaccctgaacctgatcacggagatgggccggctgcccactttcatgacccagaaggcccggaacgccctggacaacctcgccgtactgcacaccgccgaggccggcgggagggcctacaaccacgccctgtcggagctcccggagacgctggagacccttctgctgctgaccctcctggccaccgttaccggtgggatcttcctgttcctcatgagcgggaaggggatcgggaagatgactctggggatgtgctgcataatcaccgcctccatcctgctctggtacgcgcagatccagccccactggatagcggcttcaatcatcctggagttctttctgatcgtcctcttaatccccgagccggagaagcagcggaccccgcaggataaccagctaacctacgtggttatagccatcttaacggtcgtagccgcaaccatggccaacgagatggggttcctcgagaaaaccaagaaggatttcggattgggtagcattgccacccaacagcccgaaagcaacatactcgacatcgatctgcgcccagccagcgcttggactctgtacgcggtggccaccacctttatcacccccatgctacggcattccatcgagaacagctccgtcaacgttagcctgacggccatcgcgaaccaggccaccgtgttaatgggcctcggtaaaggctggccgctgtcaaagatggacatcggggtgcctctgctcgcgatcggctgctacagccaggtgaaccccattaccctgaccgcagccctgctccttctggtggcccactacgcgatcatcgggcccggactccaggccaaggcaacgcgcgaagcccaaaagcgggctgcggccggcatcatgaagaacccgaccgtcgacgggatcaccgtgatcgacctggaccccattccctacgatcccaagttcgagaagcagcttggacaggtaatgctactggtcctgtgcgtgacgcaggtattaatgatgcgcacgacctgggccctatgcgaggcgctgaccctcgcgaccgggccgatctccacgttgtgggagggcaaccccggtcggttttggaacaccaccatcgccgtctcgatggccaatattttccgcggctcctacctggccggcgccgggctcctcttcagcatcatgaagaacacaacgaacacccgacggggtaccgggaacaccggtgagacacttggcgagaagtggaaaaaccggctcaattccctggggaagtctgagttccagatctacaagagatccggtatccaggaggtcgatcggacccttgcgaaggaggggataaagcgaggcgagaccgaccaccacgccgtatcccgcggttccgccaagctgcggtggttcgtcgagcgcaatctggtgacccccgagggaaaggttgttgatctgggctgcgggcggggtggttggagttactactgcggggggctcaaaaacgtccgggaggtgaagggcctgaccaagggagggcccggccatgaggagccgatacccatgtccacctacggttggaacttggtccggctccagagcggcgtggatgtgttcttcaccccgcccgaaaagtgcgacaccctgctctgcgatattggggaatcctcaccgaaccccacagtagaggcgggcaggactcttcgggtgctgaacctggtggagaactggctcaataacaacacccagttctgcatcaaggtcttaaacccctacatgccgagcgttatcgagaagatggagacactgcagcgcaaatacggcggggctctggtgcggaaccccttatctcgcaacagcacccacgagatgtactgggtctccaacgcttcaggcaacatcgtatcgagcgttaacatgatatcccgtatgctgatcaatcgattcacgatgcggcacaaaaaggctacgtacgagcccgacgtcgacctggggagcggcacccgcaacatcgggatcgaatccgaaacccccaacctcgacataattggcaaacgcattgagaaaatcaagcaggagcacgaaacgagctggcactacgatcaggaccacccttacaaaacttgggcctaccacggctcctacgagaccaagcagaccggatccgccagcagcatggtgaacggcgtggttcggctgcttacgaagccctgggacgtgattcccatggtgacacagatggctatgaccgacaccacgcccttcggacagcagcgcgtcttcaaggagaaggtggacacccgcacccaggaaccgaaggaggggaccaagaagcttatgaagatcacggcggaatggctgtggaaggagctaggcaagaagaagacgccgcggatgtgcacccgtgaagagttcgcccgcaaggtccggtccaatgccgccctcggagctatcttcaccgacgagaacaagtggaagtctgcgcgcgaggccgtcgaggactcccggttctgggaactggtggacaaagagcgcaacctgcacttagaaggcaagtgcgaaacgtgtgtctacaacatgatggggaagagagagaagaagatcggcgagttcgggaaggccaagggaagccgcgcgatatggtacatgtggctgggcgcacggtttctggagttcgaggccctcgggttccttaatgaagaccattggttctcccgcgagaacagcctgagcggcgtcgagggggaggggctccacaagctggggtacatcctgcgggaggtgtccaaaaaggagggcggggcaatgtacgcggacgacacagctgggtgggacacccgcatcaccctggaggaccttaagaacgaagaaatggttactaaccacatggagggcgagcacaagaagctagcggaggcaatcttcaagttgacctaccagaacaaggtggtgagagtccagagaccaactccccgggggaccgtaatggacatcataagccggcgggatcagcgcggctccggccaggtgggaacgtatggcctgaacacatttaccaacatgggggcccagctgatccgacagatggagggtgagggggtctttaagggcatccagcacctcacggccactgaggaggtggccgtgcaggactggctggcgcgagtcggccgcgagcgccttagcaggatggcaatatccggcgacgactgcgtagtcaagccgctcgacgacaggttcgcctcggccctgaccgcgctgaacgacatgggcaaagtgcgcaaggacatccaacagtgggagcccagccgggggtggaacgactggacccaggtgccattttgtagccatcacttccacgagctgatcatgaaagatggccgcgtgcttgtcgtgccctgccggaatcaggacgagctgatcggtagggcccggatctcacagggcgccggctggtccttgcgcgagaccgcctgcctggggaaatcttacgcccagatgtggagcctgatgtacttccacagacgcgacctcaggctggcggcgaatgccatatgttccgccgtcccgagccactgggttcccacgagccgcactacttggagcatccatgccaggcacgagtggatgactaccgaggacatgctgacagtgtggaaccgcgtgtggattcaggagaacccctggatggaagacaagaccctcgtcgagtcatgggaggagatcccctacttaggaaagagagaggaccagtggtgcgggtcattaatcggcctcacctcacgcgcaacctgggcccgcaatatacaaacggccattaaccaggtccggtccttgatcggatccgaagagtacaccgactatatgccgtcaatgaagcgtttccggcgcgaggaggaggaggccggtgtgctatggtga

SEQ ID NO: 24842 - RNA, 9876 nt, synthetic construct
  misc_feature 1..9876: note = derived and/or modified CDS sequence (opt11) from DENV-2__KF041234__SS-prME
  source 1..9876: mol_type = other RNA
accgcgggtgtgatcatcatgttgatcccaacggccatggcgttccatctgaccacgcgcaacggggagccgcacatgattgtcagcaagcaagaaaagggcaagagcctgctgttcaagaccgaggacggcgtgaacatgtgcaccctcatggccatggacctgggcgagctgtgcgaggacacgataacatataactgtccgctcctccgccagaatgagcccgaggacatcgactgctggtgcaacgccacctcaacctgggtgacctacggcacctgtacggccaccggcgagcaccgccgggagaaacgctccgtcgcgctggtgccccacgtcgggatgggcctggagacccgtaccgagacctggatgagcagcgaaggcgcgtggaagcacgcccagcgcatcgaaacctggatcctgcgccaccccgggttcaccatcatggctgcaatcctggcgtacaccatcgggacaacatacttccagcgcgtcctcatattcatcctgctgactgccgtggcacctagtatgaccatgcggtgcatcgggatctccaaccgcgatttcgtggagggcgtcagcggcgggtcctgggtggacatcgtgctcgagcacggcagctgtgtcaccaccatggccaagaacaagcccacgctggacttcgaactgatcaagaccgaggcgaagcagccagcgaccctccggaagtattgtatagaggctaagttgacaaacacgacaactgcctcccgatgccccacccaaggggagccctcgctgaatgaggaacaggacaagcgtttcgtgtgtaagcactcaatggtggatcgcggctggggcaacggatgcggcctctttgggaagggtggcattgttacctgcgccatgtttacgtgcaagaagaacatggagggcaagatagtgcagcccgaaaatctggagtacaccatcgtggtcactccacactcaggagaggagaacgccgtggggaacgacacgggcaaacacgggaaggaaatcaaggtgaccccgcagtccagcatcactgaggcagagctgacaggctatggaaccgtcacgatggaatgcagccccaggactgggctcgatttcaatgagatggtgttactgcaaatggagaacaaagcatggctagtgcatcgtcagtggttcctggacctgcccttaccctggctgccgggtgccgacatccaggggtccaactggatccaaaaggagacacttgttaccttcaagaacccgcacgccaagaagcaggacgtggtcgtgctgggctcacaagaaggggccatgcacactgcgcttaccggcgccaccgagatccagatgagcagcgggaacctcctgttcaccggccacctgaagtgccggctcagaatggataagttacaactgaagggaatgtcctacagcatgtgcacaggtaagttcaaggtgatcaaggagatcgccgagacccagcacggcaccatcgtggtgagggtgcagtacgagggggacggctccccgtgtaagatccctttcgagatcatggatctggagaagaggcacgtgctcggccgcctcatcacagtgaacccgatcgtgacagagaaggacagccccgtcaacatcgaagccgagccgcccttcggggactcctacatcatcattggcgtggaaccgggccagctgaagctcagctggttcaagaaaggctcctccattgggcagatgttcgaaacgaccatgcgcggcgccaagcgcatggcgatattgggagacaccgcctgggacttcgggtccctgggcggagtgttcacaagcatcggcaaggccctccaccaggtatttggcgccatctacggagccgcgttcagcggcgtgagctggaccatgaagatccttatcggggtggtcatcacctggatcggaatgaacagtcggagcacgtccctgagcgtgtcgctggtgctcgtgggggtggtaacgctatacctgggcgtcatggtgcaagcagattcagggtgcgtggtctcgtggaagaacaaggagctgaaatgcggaagcggcatctttattaccgacaacgtgcacacctggaccgagcagtacaagttccagcccgagtcacccagcaagcttgccagcgcaatccagaaagcgcacgaggaggggatctgtggcattcgctccgtgaccaggctggagaaccttatgtggaagcagatcacccccgagctgaaccatatcctgtcagaaaatgaggtgaagctctccatcatgactggggacatcaagggcatcatgcaggccgggaagcgcagtctgcgaccccaacccaccgagctgaagtattcctggaagacttgggggaaggccaaaatgttaagcacggagccgcacaatcagacgttcctgattgacggcccggagactgccgagtgccccaacactaatcgcgcatggaactccctggaggtggaggactacgggttcggggtgttcactaccaacatctggctcaagctgaaggagcgtcaggacgtcttctgcgacagcaagctcatgtccgcggccatcaaggacaaccgcgccgtgcacgccgacatggggtactggattgagagcgccctcaacgacacctggaagatcgaaaaggcgtctttcatcgaggtcaagtcatgccactggcccaaatcccatactctgtggagcaacggcgtgctggaaagtgagatgattatccccaagaacttcgccgggccagtcagccagcacaactaccgacccggctaccatacccagaccgccggcccgtggcacctcgggaagctggagatggacttcgacttttgcgaaggcaccaccgtggtcgtgaccgaggattgtgggaatcgaggccccagcctgcgcaccaccaccgcctcgggaaagctcatcaccgagtggtgctgccgtagctgtacgctcccgcccctacggtaccgcggggaggacggctgctggtacgggatggagatccggccgctcaaggagaaggaggagaacctggtgaactccctggtcacggcggggcacgggcagatcgataacttcagtctcggggtgctcggcatggccctgttcttggaggagatgctaaggacccgggtcgggactaagcacgctgtcctgctcgtggccgtctccttcatgaccctgatcaccgggaacatgagcttccgcgacctggggcgggtcatggtcatggtcggcgccgcgatgacggacgacatcgggatgggtgtcacgtacctcgccctcctggccgcatttaaggtgcgccccaccttcgcggcgggccttctgctgcgcaagctcacctccaaggagttaatgatgacaactatcgggatcgtcctgctcagccaatccactaccccggagaccatcctggagttaacggacgccctagccctgggtatgatgattctgaagatagtcagaaacatggaaaaataccaactcgcggtgaccatcatggcgatcctgtgcgtccccaacgcagtgatcttgcagaatgcctggaaggtgagctgtaccatcttggctgccgtctctgtgagccccctgctgctcacctctagccagcagaaggcggactggatacccctggcactgacgatcaaggggctaaacccgaccgcaattttcctgaccacgctgtctcgcacgaacaagaagcggagctggcccttaaacgaggcgatcatggccgtaggcatggtatccatactggcgagctctctcctcaagaacgatatcccgatgacgggacccctggtggccgggggcctgctcaccgtctgctatgttctgaccgggcgcagcgccgatctggagttagagcgggccgccgacgttcgctgggaagaccaggcggaaataagcggcagcagcccaatcctttccatcacgattagcgaggacgggtcgatgtcaatcaagaacgaggaagaggagcagaccctgaccatcctcatacggaccggcctgctggtgatctccggcctgttccccgtaagcatccctattactgccgccgcctggtacctgtgggaggtgaagaaacagcgcgccggcgtgctttgggacgtcccctccccaccgcccgtgggcaaggcggaattggaggacggcgcctaccgaataaagcagaagggcatcctggggtacagccagatcggcgccggggtgtacaaggaggggacgttccacacaatgtggcacgtcacccgcggggccgtgctgatgcacaagggaaagcggatcgagccgtcctgggccgacgtccgcaaagacctcataagctacggcgggggctggaagctggagggcgaatggaaagagggggaggaggtccaggtgctggcccttgagcccggcaagaaccctcgggccgttcagaccaagcccggcctgttcaagacgaacaccggcaccatcggggccgtctccctggacttctctccggggacctccggcagccccatcgtggacaagaagggcaaggtggttgggctctacgggaacggagtggtaacgcgctccggcacctacgtgagcgccatcgcccagaccgagaagtccatagaggacaaccccgagatcgaggatgacatcttccggaaaaagcgcttgacgatcatggatctgcaccctggggccggcaagacgaagcggtatctgccggctatcgtgcgcgaggccatcaagcggggattacgcacgcttatcttggcgcccacccgggtggtcgctgccgagatggaggaggccctacgcggcctgcccatccgataccaaacccccgccatccgtgcagaacacaccgggagagagatcgtggacttaatgtgccacgcgaccttcaccatgcgacttctgagccctgtgcgcgttccaaactataacctgataataatggatgaggcccacttcaccgacccggcctcgatcgccgcccggggatacatctcaacgagagtggagatgggcgaagcggcagggatattcatgaccgccaccccgccgggctcccgggacccattccctcagtccaacgcccccataatggacgaagagcgcgagatccccgagcggagctggaactccgggcacgagtgggtaaccgactttaagggcaaaaccgtatggtttgtgcccagcatcaaggcgggcaacgacatagccgcttgtctccgcaaaaacggcaagaaagtgatccagttgtcccggaaaactttcgatagcgaatacatcaagacccggaccaacgactgggacttcgtagtaacgaccgacatctcggagatgggcgcgaatttcaaggccgagcgggtgatcgacccccgcaggtgcatgaagcccgtcatcctgaccgacggggaggagcgggtgatccttgcggggccgatgcccgttacgcactcctccgccgcccagcggcgcggtcggatcggacgcaaccccaaaaacgagaacgatcagtatatctacatgggcgaacccctcgagaacgacgaggactgcgcccactggaaagaggcaaagatgctgctcgacaatataaatacgcctgaaggcatcatcccctcaatgttcgagccggaacgcgaaaaggtcgacgcgatcgatggggagtacagactgcgcggggaggcgcggaagaccttcgttgacctgatgcgccggggtgacctcccggtgtggctggcctatagggtcgcggccgaggggatcaactacgcggatcggcgctggtgcttcgacgggatcaagaataaccagatactggaggagaacgtggaggtcgaaatctggaccaaggagggggagcggaagaagctaaaaccccgatggctggatgcacggatatactccgaccccctggcactcaaggagttcaaagagttcgccgctggccgcaagagcctcaccctgaatctcataacggagatgggccggctgccaacctttatgacgcagaaagctcgaaatgccttggacaacctcgccgtgcttcacaccgccgaggccggcgggcgtgcctacaatcacgctctgtccgagctcccggaaacgctggaaacactgctcttactgacgctcctggccaccgtgaccggcgggatctttctgtttctaatgagcgggaaagggataggcaaaatgacgctggggatgtgctgcataatcaccgccagcatcctgctctggtacgcgcagatccagcctcactggatcgccgcctcaatcatactggagttcttcctgattgtccttcttattcccgagcctgagaagcagcgcacccctcaggacaaccagctgacctacgtggtgatcgccatactcactgtcgtggctgcgaccatggccaacgagatgggcttcctggagaagaccaagaaggacttcgggttaggttccatcgccacacagcagcccgagtcgaatatcctcgatatcgacttgcggcccgccagcgcctggacactgtacgcggtggccactacctttattacccccatgctccgccactcaatcgagaactcttctgtcaacgtgtctttaacggccatcgccaaccaggcaaccgttttgatgggactcgggaagggctggccgctgtccaaaatggacataggcgttcccctgctcgccatcggctgctatagtcaagtgaaccccattaccctgacagccgccttactcttacttgtggcccactatgcgattatcgggccgggcctgcaagcaaaggccacgcgggaggcccagaagcgtgccgctgccggcatcatgaaaaacccgaccgtcgatgggatcaccgttatcgacctggaccccataccctacgaccctaagttcgagaaacaattgggccaggtgatgctcctggtcctgtgcgtaacccaggtgttgatgatgcgaacgacctgggccctgtgcgaggccctgaccctcgccaccgggccgatttcgacgctgtgggaaggcaaccccgggcgattctggaacactaccatcgcagtgagcatggccaatatcttccgcggctcctacctggccggcgctgggctcctgtttagtatcatgaaaaacaccacgaacacccggcgcggcaccgggaacaccggcgagactctgggcgagaagtggaaaaaccggctcaactccctgggaaagtctgaattccaaatctataaacgatccgggatacaggaggtggatcggacactggcgaaggaggggattaagcggggcgaaactgaccaccacgccgtgagccgtgggtcggccaagttaagatggttcgtcgaacggaacctggttacccccgagggcaaagtggtcgacctgggctgcgggcgagggggatggagctactactgcggcgggctaaagaacgtgcgggaggtgaaaggcctgactaagggcgggccaggtcatgaggagccgatccccatgtcaacatatggatggaacctggtccgcctccagtccggcgtcgacgtgttctttacgccgccagagaagtgcgacaccctgttgtgcgacatcggggagtccagcccgaaccccaccgtcgaggccggtaggactctccgcgtgctgaatttagttgagaactggctcaacaacaacacccagttctgtatcaaggtcctgaacccgtacatgccgtcagtgattgagaagatggagaccctgcagcggaagtacggtggcgccttggtgcgcaatccgctttcccggaacagcacccatgaaatgtactgggtctccaatgcgagcggtaacatcgtgtcaagcgtgaatatgatctccaggatgctgatcaatcggttcacaatgcgccacaagaaggctacctatgagcccgacgtcgatctggggagcggcacccgcaacatagggatcgagtctgagacacccaacctcgacataatcggaaagcggattgagaagatcaagcaggagcacgagacgtcgtggcactatgaccaagaccacccttacaagacctgggcctaccacggctcctatgagaccaagcagacagggagcgcctccagcatggtcaacggcgtggtccgcctgctgacgaaaccctgggacgtgatccccatggtgacccagatggccatgaccgacacgacgcctttcgggcagcaacgggtcttcaaggagaaggtggacacccgcactcaggaaccgaaagagggcacgaagaaactcatgaagatcactgcagaatggctatggaaggaactgggtaagaagaaaacgccacgaatgtgcacccgcgaggaattcgcccggaaggtgcgctccaacgccgcccttggggctatcttcacggacgagaacaagtggaagtccgcgagggaggccgttgaagactcccgcttctgggagctggtggataaggagcgggaccttcacctcgagggcaagtgcgagacgtgcgtatacaacatgatgggcaagcgcgagaaaaagataggcgagttcggaaaagccaagggcagcagagccatctggtatatgtggctaggcgcgcgctttctggagttcgaagccctcgggttcctgaacgaggaccattggttttcccgtgagaactcattatcaggcgtagagggggagggcctccacaagttggggtacatcctgcgcgaggtgtccaagaaggagggcggggccatgtatgccgatgacacagccggatgggacacccggatcaccctcgaggacctgaagaatgaggagatggtcactaaccacatggaaggcgagcacaagaagctggccgaggccatcttcaagctaacgtaccagaacaaagtcgtgcgcgtccaacggcccacgccccgcgggaccgtgatggacattatcagccggcgtgaccaacgcggctccggccaggtcggcacctacggactgaacaccttcaccaacatgggagcccagctgattcggcagatggagggcgagggggtcttcaagggcatccaacatctcacagccacggaggaggtcgccgtgcaggactggcttgcgagggtcggccgggagcgcctgtctcggatggccatctccggcgatgactgcgttgtgaagccgctcgacgaccgcttcgccaacgctctcaccgccctgaacgatatgggcaaggtaagaaaggatatccagcagtgggaaccaagcagggggtggtccgactggacccaggtgcccttctgcagccaccactttcatgagctcatcatgaaggacggacgggtgctcgtcgtaccgtgccgtaatcaggacgagttaatcggacgagcgcgcatctcgcaaggcgccggctggagcctccgcgagaccgcgtgcctggggaagtcgtacgcccagatgtggagccttatgtatttccaccgccgggacctcaggctcgccgcaaacgccatctgcagcgccgtgccaagccactgggtccccacgtcccgcaccacctggtccatacacgcccgccatgagtggatgacgaccgaggacatgctgacggtgtggaaccgtgtgtggatacaggaaaacccctggatggaggacaagacccccgttgagtcttgggaagagatcccgtacctcggcaagcgcgaggaccagtggtgcggctccctgatcggcctgaccagccgcgctacttgggcccgaaacatccagacggcgatcaaccaggttcgctcccttatcggtagcgaagagtacaccgactacatgccatccatgaaacgtttccggcgagaggaggaggaagctggagtgctatggtga

SEQ ID NO: 24843 - RNA, 9876 nt, synthetic construct
  misc_feature 1..9876: note = derived and/or modified CDS sequence (opt11) from DENV-2__KF041235__SS-prME
  source 1..9876: mol_type = other RNA
acagcaggcgtgataataatgctgatccctaccgccatggcgttccaccttaccacacgcaacggggagccccacatgatcgtgagcaagcaggagaagggcaaatcgctgctattcaagaccgaggacggggtgaacatgtgtactctcatggccatggacctgggcgagctgtgcgaggataccatcacctacaattgccccctcctgaggcagaatgagcccgaggatatagactgctggtgcaacagcacatctacctgggtaacctacgggacgtgcacagccaccggcgagcataggcgggagaagcgtagcgtcgcactggtgcctcacgtgggcatgggtttggagaccaggaccgagacatggatgtccagcgagggggcctggaaacacgcccagagaatcgagacctggatcttgcggcaccccgggtttaccatcatggccgctatcttggcatacacgataggcaccacctatttccaacgcgtcctcatcttcatactgctgacggcggtggccccttccatgacaatgcggtgcatcggcatcagcaaccgcgattttgtggagggcgtttccggcgggagctgggtggacatagtactcgagcacggctcatgcgtaaccactatggcgaagaacaagccgacgttggacttcgaacttatcaaaaccgaggctaagcagcccgccaccctccggaagtactgcatcgaagcgaagctgaccaacactacgaccgccagccgctgcccgacacagggggaaccctcactaaacgaagaacaggataagcggttcgtttgcaaacacagcatggtggaccgcggctgggggaatggctgcggccttttcgggaagggcgggattgtcacgtgcgccatgttcacttgcaagaagaacatggaggggaagatcgtgcagcccgagaacctcgaatacactatagtggtcacaccccactctggcgaagaaaacgccgttgggaacgataccggcaaacacgggaaagagatcaaagtgacccctcagtcctccatcaccgaagccgagctgactggctatgggaccgtaacaatggagtgctctccccggacgggcctagactttaacgagatggtgctgctgcagatggagaataaggcgtggttagttcaccgccagtggttcctggacctgcccctcccgtggctgccgggggccgacatccaggggtccaactggatccagaaggagactttagttacgttcaagaacccccacgctaagaaacaagatgtggttgtgcttggcagccaggagggggccatgcacacggccttgaccggcgcgaccgagatccagatgagctctggtaacttattgttcaccggacacttgaagtgccggctgcgcatggacaagctccagctgaaaggcatgagctattccatgtgcactgggaagttcaaagtggtcaaggagatcgctgagacccagcacggcactatcgtagtgcgggtccagtacgagggggacgggagcccctgcaagatccccttcgagatcatggacctggagaaaagacatgtccttggccggctcatcaccgtcaacccgattgtcacagagaaggactccccagtcaacatcgaggctgagccgcccttcggggactcctacatcataatcggtgtggagccaggccaactaaagctctcctggttcaagaaggggtcctctatagggcagatgttcgagaccactatgcgcggcgccaagcgcatggccatcttgggcgacaccgcttgggactttggtagcctgggcggggtcttcacatcaatcggtaaggccctacaccaagtgttcggggccatatacggagccgcgttcagcggagtctcctggaccatgaagattttgatcggggtcgtgatcacttggatcggcatgaacagcagatccactagcctgtccgtgagcctggtcctcgtgggggtagtcacgctgtatctgggcgtgatggtgcaggccgactccgggtgcgtggttagttggaagaacaaggagctcaagtgcggcagcgggattttcatcaccgacaacgtgcacacctggaccgagcagtacaagttccagccagagtcccccagcaagctcgcctccgcaatccaaaaggcccacgaggaagggatttgcggtattcgcagcgtcacgcggctggagaacctcatgtggaagcaaatcacccccgagctgaaccacatattatccgagaacgaggtgaaacttagtattatgaccggagatataaaaggcatcatgcaagcgggtaaacgctcgcttcggccgcagcccactgagctgaagtacagctggaaaacgtggggcaaggccaagatgctctccaccgagccccacaaccaaacctttctgatcgacggcccggagaccgccgagtgtcctaacacgaatcgcgcttggaacagcctggaagtggaggattatgggttcggcgtattcaccaccaacatctggctcaagctgaaggagcggcaggacgtgttctgcgactccaagctcatgagcgcagcgataaaagacaaccgcgcagtacatgccgacatgggctactggatcgagtctgccctcaacgacacctggaaaatcgagaaggcctcgtttatcgaggttaaatcctgtcactggcccaagagccacacgctgtggtccaacggcgtgctggagtctgagatgatcatccccaagaatttcgcgggccccgtgagccagcacaattaccgccccgggtaccatacccagaccgccggcccttggcacttgggaaaactcgagatggatttcgacttttgcgaaggcaccaccgtggtggtaactgaggactgcggtaaccgcggcccctccctgcggaccaccacggcgtcaggcaagctcatcacggagtggtgttgccggtcgtgcaccctgccgcccctgcggtaccgcggcgaggatggctgctggtacgggatggagatccggccgctcaaggagaaggaggagaacctggttaatagcctcgtgaccgccggtcacgggcagattgacaacttctcgctgggcgtgttggggatggcgctgttccttgaagagatgctgcgaacccgcgtcgggacgaagcacgccgtgctactcgtggccgtctccttcatgacgctcatcaccggcaacatgtccttccgcgacctggggcgggttatggtgatggtcggtgccgccatgacggacgacatcggcatgggtgtcacatacttggcgttacttgccgcttttaaagtgcgccccacattcgccgccggactcttgctgaggaagttgaccagcaaggagctcatgatgaccacgattgggatagtcctgctctcccagagcacgaccccggaaactattctggaactgacggacgcattagccttaggaatgatgattttaaaaattgtgcggaacatggagaagtatcagctcgcggtcaccatcatggccattctgtgtgtccccaacgctgtaatactacagaacgcgtggaaggtctcctgcaccatcctcgccgccgtgtcggtgagccccctgttactgacaagcagtcagcagaaggccgactggatcccattagcgctgacgatcaaggggctcaatcccaccgcaatattcctgaccaccttgagccgcaccaacaagaagcggtcgtggcctctcaacgaggccattatggccgtcggcatggtgagcatactggccagcagcctcctaaagaacgacatcccgatgacggggcccctggttgccggcgggctactcacagtctgctacgtgctaacgggtcgcagcgccgatctggaactcgagcgggccgccgacgtgcgctgggaagatcaggccgagatctccgggtcctccccgatcctgagcattaccatctcagaagacggtagcatgtctatcaaaaacgaagaagaggagcagaccctgaccatactcatccggaccggcctgctggtcatcagcggcctctttccggtgtccatccccattacagcggcggcctggtatctgtgggaggtgaagaaacagcgcgccggggttctgtgggacgtccccagcccgccgcccgtgggcaaggccgagctcgaggacggggcgtaccgcatcaagcagaagggcatcctggggtactcccagatcggcgctggcgtctacaaggaggggaccttccacactatgtggcacgtgacgagaggggcagtgctgatgcacaagggaaagagaatcgagccgagttgggcagacgtccgcaaggaccttatctcctacggagggggctggaagctggagggcgaatggaaggagggggaggaggtacaggtgctggccctagagcccggcaagaacccgcgggcggtccagactaaacccgggctgttcaagacgaacaccggcacgattggggccgtcagcttggacttctccccgggcacaagcggctccccaatcgtagataagaaagggaaggtggtgggcttatacgggaacggagttgtcacgcgcagcggaacttacgtgtccgccatagcccagaccgagaagtccatcgaggacaaccccgaaatcgaggatgacatctttaggaagaaaaggctaaccatcatggacctgcacccgggagcgggcaaaaccaagcggtacttaccggccatcgtgcgcgaggccataaagcgggggctgcgaacccttattctggcccccacgagggtcgttgccgcggagatggaggaggctctccgaggcctgcccatccgctaccaaactcccgccattcgggcggaacacacgggtcgcgaaatcgtggacctaatgtgccatgccaccttcactatgcgcctccttagcccggtccgcgtgcccaactacaatctcattattatggacgaagcgcacttcaccgaccccgcctccattgccgcccggggctatattagcacacgcgtggagatgggagaggccgcggggatcttcatgaccgcgacgcctcctggatcccgggatcccttcccccaaagcaacgccccgattatggacgaggaacgtgagatacccgagcgttcatggaacagcgggcacgagtgggtcacagacttcaagggtaagacggtgtggttcgtgccatcgatcaaggccggcaacgacatagcggcctgtctccgcaagaatggcaagaaggtcattcagctatcgcggaaaaccttcgactctgagtacatcaagacccgcaccaacgactgggacttcgtggtgaccaccgacatcagcgagatgggggccaatttcaaggctgagcgggtcatcgacccccgccggtgcatgaagcccgtaatcttaactgacggcgaggagagggtgatcctcgccggacccatgccggtcacgcactccagcgcagcccagcggcgggggagaatcggtcgcaaccccaagaacgagaacgatcagtacatctacatgggagagcccttagagaacgacgaggattgcgcccactggaaggaggcgaagatgctcctggataatatcaacacgccggagggaatcatcccctcaatgtttgagcccgaaagggagaaggtggacgccatcgacggcgagtaccggctacgaggcgaggctagaaagacttttgtggatctgatgcgcagaggggacctaccggtctggctggcctaccgcgtggccgcggaagggatcaactatgccgacagacgctggtgtttcgatggcatcaagaataaccagatcctggaagagaacgtggaagtggaaatctggaccaaggagggggaacgcaaaaagctaaagccgcgctggctggacgcgcggatttactcggaccccctagcgctgaaggagttcaaggagttcgcggcaggccgcaagtccctgacccttaatctaatcacggaaatgggaagactgccgacgttcatgacccagaaagcgcgaaatgccctggacaatctggccgtgctacacacagccgaagccgggggtcgggcctacaaccacgccctgagcgaactcccagagacgctagagacattactcctgttgaccctcctggccaccgtcaccggagggatattcctgttcctcatgtcaggcaagggcatcggaaaaatgaccctagggatgtgctgtatcatcaccgccagcattctgctctggtatgcccagatccagccccactggatagcggcatccatcatcctcgagttcttcctgatcgtgttgctgatccccgagcccgagaagcagcgcacaccgcaggataaccagctgacctatgtagttatcgccattctgacagtggtggccgcgacgatggcgaatgagatgggcttcctggaaaagaccaagaaggactttgggctgggaagcatcgccacccagcagcccgagagtaacatcctcgatatagatctacggcccgcctccgcttggacgctttacgccgtagcgaccaccttcatcaccccaatgctccgtcacagcatcgagaactcctcggtgaacgtaagcctgacagcaatcgcaaaccaggccaccgtcctgatgggcctcgggaagggatggccgttatcaaagatggatatcggggtgcccctcctcgcgatcggctgctacagccaggtgaaccccattaccctgactgcagccctactcctgctggtcgcccactacgccatcatcgggcctggcctccaggcgaaggcaacgcgggaggcccagaagcgtgccgccgcgggaatcatgaagaatcccaccgtggacgggatcaccgtaatcgacttggaccccataccgtacgaccccaagttcgaaaagcagttaggccaggtaatgctcctggtgttatgcgtcacccaggtcttaatgatgcggactacttgggccctatgcgaggcccttactctcgctactgggcccatcagtacgctgtgggaggggaaccccgggagattctggaacaccactatagccgtgtccatggctaacattttcaggggcagctacctagccggagccgggttattattttccatcatgaagaacaccacgaacacccggaggggcactgggaatacgggcgagacgctgggcgagaaatggaagaacaggctcaattcattggggaagtctgagttccaaatatataagcgcagtggaatccaggaggtggatcgtaccctggccaaggaagggatcaagagaggtgagaccgaccaccacgcggtttcccgcggaagcgccaagctccgctggttcgtcgagcggaacctggtgacgcccgaggggaaggttgttgatctggggtgcgggcgcgggggttggtcctactactgcggcgggcttaagaatgtgagggaggtgaagggcctgacgaagggcggacctggccacgaggagccgatccccatgagcacgtacgggtggaacctggttcggttacagtccggcgtagacgtctttttcacacccccagagaagtgcgacaccttactgtgcgacatcggggagagcagccctaaccccacggtcgaggcaggccggacactgcgcgtgttaaacctggtcgaaaactggctcaacaacaacacacagttttgcatcaaagtgctaaatccgtacatgccgagtgtgatcgagaaaatggaaacgttgcagcggaagtacggcggggccttggtccgcaaccccctcagccggaactccacccacgagatgtactgggtgagcaacgcctcgggcaacatcgtgagctccgtcaatatgattagccgcatgcttatcaaccggttcacgatgcgccacaagaaggccacctacgagcccgacgtggacttagggtccggcacccggaacatcgggatcgagtccgagacgccaaacctcgatatcatcggcaagcggatcgagaagatcaagcaggagcacgagacttcatggcattatgaccaggatcacccgtacaagacctgggcctaccacggaagctacgagaccaagcaaaccgggtcagcctcgtccatggtgaacggtgtcgtgcgactgctaacgaagccctgggatgtgatccccatggtcacccagatggccatgaccgacaccacgcccttcgggcagcagcgggtgtttaaggagaaggttgacacgcgcacccaggagccgaaggagggcaccaagaagttaatgaagataacggccgagtggttatggaaagagctgggcaagaagaagacgccccgtatgtgcacccgcgaagagttcgcccggaaggtacgctcaaatgcagctctcggggcaatcttcaccgacgagaacaagtggaagtccgcccgagaagccgtggaggactctcgcttctgggagctggtcgacaaggagcggaaccttcaccttgagggaaagtgcgagacgtgcgtgtacaacatgatggggaagcgcgagaaaaagatcggcgagttcgggaaggccaagggatcccgtgctatctggtacatgtggctaggcgcccgctttctcgaatttgaggcgcttggcttcctgaacgaggaccattggttcagccgggagaacagcctttcaggcgtggagggggagggcctccataaattgggttacatcctgcgcgaggtgagcaaaaaggagggtggcgccatgtacgccgatgacaccgccgggtgggacacccggatcacactcgaggacctgaagaatgaggagatggttacaaaccacatggagggcgagcacaagaagttagcagaggcgatatttaagctgacctaccagaacaaggtggtccgcgttcaacggcccacgccccgcggaaccgtaatggacatcatcagtcggcgcgaccagcgaggcagcggtcaggtgggcacgtacggcttgaacacgttcaccaacatgggggcccagctcatccggcagatggagggcgagggagtgtttaagggcatccagcacctcaccgccactgaagaagtggccgtccaggactggctggcccgcgtaggccgggagcgcctgagccggatggcgatcagcggcgacgactgcgtggtcaagccgctcgacgaccgcttcgcttcggcccttacggcgctgaatgacatgggcaaggtgcgtaaggacatacaacagtgggagcccagccgcgggtggaacgactggacccaagtgcctttttgcagccaccactttcacgagctgatcatgaaagacggaagagtcctggttgtgccttgccgcaaccaagacgagctgatcggccgggcccgcataagccagggcgcgggttggagtctccgggagaccgcctgtttaggtaagagctatgctcagatgtggtcgttaatgtacttccaccgccgggacctccgccttgccgccaacgcaatctgcagcgccgtccctagtcattgggtacccacgagccggactacctggtccatccacgcccgccacgagtggatgaccaccgaagacatgctgacggtgtggaaccgggtctggatccaggagaatccctggatggaggataagactcccgtggagagctgggaagagatcccgtacttggggaagcgcgaggaccagtggtgtgggagcctgatcggcctgacttcacgcgccacctgggcgcggaacatccaaactgccatcaatcaagtacgcagccttatcggtagcgaggagtacaccgactacatgccctccatgaagcgtttccgacgggaggaggaggaggccggagtcctctggtag

SEQ ID NO: 24844 - RNA, 9876 nt, synthetic construct
  misc_feature 1..9876: note = derived and/or modified CDS sequence (opt11) from DENV-2__KF041237__SS-prME
  source 1..9876: mol_type = other RNA
acggcaggcgtgatcatcatgctcatccccaccgccatggccttccatctcaccacccgcaacggggagccccatatgatcgtcagcaagcaggagaaggggaagtccctgttattcaaaaccgaggacggggtgaacatgtgcactctcatggctatggacctgggcgagctttgcgaagacacaatcacatacaactgccccctcctccggcagaacgagcccgaggatattgactgctggtgcaacagcacctctacgtgggttacctatggaacctgtacggccaccggagagcaccgcagggaaaagcgcagcgttgccttagtgcctcacgtcgggatgggtctcgaaactcggaccgagacctggatgtcctcggagggtgcgtggaagcatgcgcaacgcatcgagacttggattcttcgacaccccggtttcaccataatggctgcaatactggcatacacgattggcaccacctacttccaacgagtcctcatcttcatcctactgacggctgtggccccctctatgaccatgcggtgtatagggatcagcaaccgagatttcgtcgagggcgtctcaggcgggtcatgggtggacatcgtgttggaacacggctcttgcgttaccaccatggccaaaaataagcccacgctggatttcgagttgataaaaaccgaagccaaacagcccgccaccctgcggaagtactgcattgaggcgaaactgaccaacacgaccaccgccagtcgctgccctacacaaggagagccctccctcaacgaggagcaggacaaaaggttcgtttgcaagcacagtatggtggaccgcggttggggcaatggctgcggcctcttcgggaagggcggtatcgtaacctgcgcaatgttcacgtgcaagaaaaatatggagggaaagatcgttcagcccgagaatctcgagtacaccattgttgtcacgccccactccggcgaggagaacgcggtggggaacgacacgggcaagcacgggaaggagatcaaggttacaccccagagctccatcacggaagcggagttgacgggctacgggaccgtcactatggagtgttcaccacggacaggcctcgactttaacgagatggtgctcctgcagatggaaaacaaagcgtggctcgtgcaccgccagtggttcctcgacctgcccttgccatggttaccgggggcagacattcagggatccaactggatccagaaggagaccttagtaaccttcaagaacccccacgccaagaaacaggatgtggtcgtgctcggctcgcaagaaggagccatgcatacggcgctgacgggcgcgaccgagatccagatgtcctcaggcaacctgctgttcaccggtcatttaaagtgccggttgcgcatggataagctccaactgaagggcatgagctactccatgtgtaccggtaagttcaaagtggtcaaagaaatcgccgagactcagcacggcaccatcgtagtgcgggtccaatacgagggggacgggagcccctgcaagattcctttcgagatcatggacctcgaaaagcgtcacgtactcggccgcctgatcactgtgaatcccatcgttacggagaaggactccccggtgaatatcgaggccgaaccgccattcggagactcgtacatcatcattggcgtggagccgggtcagctgaagttatcttggttcaagaaaggttcttctatcggacagatgtttgaaaccactatgcggggcgccaagcgcatggctatccttggagacacagcgtgggacttcgggtcgctgggcggggtttttacgtccatcggcaaggccctccatcaagttttcggtgctatatacggagccgcgtttagcggggtgtcctggaccatgaagatcctcatcggggtcgtgatcacatggatcggcatgaactcacggtcaactagcctgtccgtgtccctcgttttggtgggggttgtcaccctgtacctgggagtgatggttcaggccgactccggctgcgtcgtgagctggaagaacaaggagctaaagtgtggcagcggcatcttcatcaccgacaacgtgcacacgtggaccgagcagtacaagttccaacccgagtctccgagcaagctggcctccgcaattcagaaggcgcacgaagaggggatctgcggcattcgcagcgtcacgaggcttgagaacttgatgtggaaacaaatcaccccagagctgaatcacatcctatccgaaaatgaggttaagctcagcatcatgaccggggacataaagggcatcatgcaggcgggaaagagatcgctccgtccgcagcccaccgagctgaagtacagctggaagacgtggggtaaggcgaaaatgctctccaccgaaccgcacaaccaaacctttctgatcgatggcccggaaaccgccgagtgccccaacaccaatagggcctggaactcgctcgaggtggaggactacggcttcggggtcttcacaacaaacatttggctgaaacttaaggagcggcaggacgtattttgcgactccaaattaatgtctgccgcgatcaaggacaatcgcgccgtgcacgctgatatggggtactggatagagtcggctctcaatgatacctggaaaatcgagaaggccagcttcatagaagtcaagagttgtcactggcccaagagccacacgctgtggagtaacggcgttttagagagcgagatgattattccgaaaaatttcgcgggcccggtgtcacagcataactaccggcctggataccacactcagaccgccggaccctggcatctcggtaagttggagatggatttcgatttctgtgagggcaccaccgtcgtagtaacggaagactgtgggaaccgaggcccctcactgcggaccaccaccgcgagcggtaaactcattacggagtggtgctgccggtcgtgcaccctgccgcccctacggtaccgcggggaagatgggtgctggtacgggatggagatcagaccgctcaaggagaaagaggagaacctggtcaatagccttgtgactgcaggccacggccaaatcgacaacttctccctcggcgtgctgggcatggcgctgttcctcgaggagatgctacgaacccgggtcgggacgaagcacgccgtgctgttggtggcggtcagcttcatgaccctgatcaccggcaacatgagttttagagacctgggccgggtgatggtgatggtcggcgctgccatgaccgatgacatcgggatgggcgtgacgtatctcgccctgcttgccgcctttaaggtacgccccaccttcgctgccggactcctgttgaggaaactcaccagcaaggagttaatgatgaccacgatcgggatagtgctgttgtcccaatcaaccacgccggaaactatcctggaattaacggacgctttagccctgggcatgatgatactcaagattgtacggaacatggagaaataccaactcgctgtcaccatcatggcaattttatgcgtgcccaacgccgtgatcctgcagaatgcgtggaaagtctcttgcaccatactcgccgcggtgagcgtcagccccctgttactcacgtcatcccagcagaaggccgactggatccccctagctttaacgattaaggggctcaatccgactgccattttcctgacgacactgagccgaactaacaaaaagcggtcctggcccttgaacgaagccatcatggctgtcgggatggtgagcatacttgcctcgtcgctcctcaagaacgacattcccatgaccggtcccctggtggctggcggactgctcacggtttgctacgtgctgaccggacgaagcgccgatttggagctagaacgggccgccgacgtacggtgggaggaccaggccgaaatatctgggagcagtccaatcttgtccatcacgatctctgaggacggtagcatgtccatcaaaaacgaagaggaggaacagactctgaccatcctcatccgcacgggcctactggtcatcagcggtctattccccgtttcgatccccattacggcggctgcctggtacctgtgggaggtgaagaagcagcgcgcaggggtgctttgggatgtgcccagcccgccgcccgtgggcaaggccgagttggaagacggggcgtaccggatcaagcagaagggcatcctggggtactcccagataggagcgggcgtgtacaaggagggcaccttccatacaatgtggcacgttacccgcggggccgttctgatgcacaaggggaagcggattgagccgagttgggccgacgtccgcaaggacctcatttcctacggtggaggctggaaacttgaaggtgagtggaaggaaggggaggaggtgcaggtactggcccttgaacccggcaaaaatccgagagcggtccagacaaagcccggcctgtttaagactaacacaggaactataggggctgtctccttagacttttcccccggtaccagcgggagccccatcgtcgacaaaaaggggaaggtcgtgggcctgtatgggaacggcgtcgttacgcgcagcggcacgtacgtgtccgcaatcgcccagaccgaaaaatccatagaggacaacccggagatagaggatgacatcttccggaagaagagattgacaatcatggacttacaccctggagcggggaaaaccaaacgctacctgccggccattgtgcgcgaagccataaagagaggcctacgcaccttaatactggcccccacgcgggtcgtagccgcggagatggaagaggctctccgcgggctgcccatccgctatcagacccccgccatccgggcagagcacactggccgcgagattgtggacctcatgtgccacgccacattcacaatgcggctcttaagcccggttcgcgtgccaaactacaatctaataatcatggacgaggcacacttcaccgacccggccagcattgccgcccggggatacataagcacccgcgtggaaatgggagaggctgcagggattttcatgacggctacgccacccggctcacgtgacccattcccacagagcaacgccccgatcatggacgaagaacgagagatacccgaaagatcgtggaactctgggcacgagtgggtcacagacttcaaaggcaagacggtgtggttcgtgccctccatcaaagcaggaaacgacatcgcagcatgcctccgcaagaatggcaagaaggtcatccaactgagccggaagaccttcgattccgaatacattaagacccggaccaacgactgggacttcgtggtgacgacagacatctctgagatgggggcaaattttaaggccgaacgtgtaatagacccccgccggtgcatgaagcccgtaatcctaaccgacggcgaagaacgcgtgatcctcgctggcccgatgcccgttacgcactccagtgcggcccaacggcgaggacggatcggacgcaatcccaagaacgagaacgatcagtatatctacatgggggagccccttgagaacgacgaagactgtgcccactggaaggaggcaaagatgctgttagacaacatcaacacgccggaaggaatcattccctccatgttcgaaccagagcgtgagaaggttgacgcaatcgacggcgagtatcggctgcgcggggaggcccgaaaaactttcgtggacctgatgcgtcggggcgacctaccggtctggctggcttacagggtggccgcggagggaatcaactacgctgatagacgctggtgcttcgatgggatcaagaacaaccaaatcctggaggaaaatgttgaagttgagatctggaccaaggagggtgagaggaagaaactcaagccacgctggcttgacgcccggatttacagcgaccccctggccttaaaagagttcaaggaatttgcagccggacggaagtcattgaccctgaacctcataaccgaaatgggaagactacccacgttcatgacccagaaggccaggaacgccctggacaacctagccgtactgcacaccgcggaggctggcggccgggcatacaaccacgcactcagtgagctgccggaaacactagagactctactcctgctgaccctcctggccactgtcaccgggggcatcttcctgttcctcatgagtggcaagggtatcggcaagatgaccctggggatgtgttgcatcatcaccgccagcatactgctctggtacgcccagatccaaccccactggatcgcggcctccatcatcttagagttcttcctgatcgtcctcctcatacccgaacccgagaagcagcgcactccgcaggacaaccagctcacctacgtggtcatcgccatcctcacggtggtggccgccaccatggcaaacgagatgggcttcctggagaaaaccaagaaggatttcgggttgggcagcatcgccacacagcaacccgagagtaacatcttagacatcgacctccggcccgcgtcagcgtggacgctttacgccgtcgcgacgacctttatcacccccatgttgagacatagcatcgagaactcttcggtaaacgtgtccctgacagccatcgccaatcaggccacggtcctgatgggcctcgggaaaggctggccgctcagcaagatggacatcggggtgccgcttctcgccatcggatgttattctcaggtgaaccccatcaccctgactgccgccctcctgctgctagtcgcccactacgccatcatcgggccgggtctccaggcgaaggccacgcgggaagctcaaaaacgagccgcagcgggaattatgaaaaacccgacagtagacgggatcaccgtgatcgacttagaccccattccctatgatccaaagtttgaaaaacagctgggccaggttatgttactggtgctgtgtgtgacccaggtcctcatgatgcgaacgacatgggccttgtgcgaggctctgaccctcgccactggacccatctcaaccctctgggaggggaaccccgggagattctggaacaccacaattgccgtctccatggctaacatcttcagaggctcttacttggccggggccggactcttattctcgatcatgaagaacaccacgaacacccgcagaggcactggcaacactggagaaacgctcggcgagaagtggaagaaccggcttaactccctgggaaagtccgaatttcagatttacaagcgcagcgggatacaagaagtggataggactttggcaaaagaggggatcaaacggggagagacggatcatcacgcggtctcacgggggagcgccaaactaaggtggttcgtggagcggaacctggtcaccccggagggtaaggtcgtggacctgggttgcgggagaggtgggtggtcctactactgcggagggctcaagaatgtgcgtgaggtaaaaggcctgacgaagggagggcctggacacgaggagcctatccccatgtcgacctacggttggaacctcgtgcggttacaatccggcgttgacgtcttctttacgccgcctgaaaagtgcgacacgctgctgtgcgacatcggagagtcaagccccaaccccacggtggaagccggaaggacccttcgcgttttaaaccttgtcgagaactggctcaacaacaatacccagttctgtatcaaggtgctgaacccatacatgccttccgttatcgagaaaatggaaacgctgcagcggaagtacggcggagccctggttcgcaaccccttaagccgaaactcgacccacgaaatgtattgggtaagtaacgcctccggcaacatcgtgagctccgtcaacatgatcagccgcatgctgataaatcggtttacgatgcgccacaagaaggctacctacgagccagacgtggaccttgggtccggaacccgcaatattggcatcgagtcggaaacccccaacctcgacatcatcggcaagcgcatcgagaagatcaaacaagagcacgagacatcttggcactacgaccaagaccacccttacaaaacgtgggcataccacggcagctatgagaccaaacaaaccggatccgctagctccatggttaacggtgttgtgcgcctgctcactaagccctgggacgtgatccctatggtcacgcagatggccatgaccgacaccacccccttcgggcaacaacgcgtgtttaaagaaaaagttgacaccagaacccaagaaccgaaggaaggcaccaagaaactaatgaagatcacggcagagtggctgtggaaggagctaggtaagaagaagaccccaaggatgtgcacccgcgaggagttcgcgcgcaaagtccgcagcaacgctgctcttggtgccattttcaccgatgaaaataagtggaagtctgcccgggaagctgtcgaagactcgcggttctgggaactggtcgacaaggaacggaacttacatttggaaggcaagtgcgagacatgcgtatataacatgatggggaagcgtgagaagaaaataggcgagttcggcaaggccaaggggagtcgggctatatggtacatgtggctgggcgctcgctttctggagttcgaagccctcgggttcctgaatgaggaccactggttcagtagagagaatagcctcagcggcgtggagggggaggggctccacaaacttggatatatcctgcgcgaagtcagcaagaaagaagggggcgccatgtacgccgatgataccgctgggtgggatacccgcatcacactcgaggaccttaaaaacgaggagatggtgacgaaccacatggagggagagcacaagaaactagccgaggccatattcaagctcacctaccaaaacaaagtggtccgcgtccagcggccgacgccccgcgggaccgttatggatatcataagtagacgtgaccaacgcggatcagggcaggtcggcacttacggcctgaacacattcaccaatatgggggcccagttaatccgacaaatggagggtgagggtgtgttcaagggcatccagcatttgaccgccacagaagaggtggcagtccaggactggctggcgcgagtcggcagagaacgactgtccaggatggccatcagcggtgacgactgcgtggtgaaaccgctcgacgaccgctttgcctctgccttgaccgccttaaacgacatgggaaaggtgcgcaaggatattcagcagtgggaaccctcacgcgggtggaatgactggacccaggtgccgttctgcagccatcatttccacgagctcattatgaaggatggccgggtgctagtcgtgccctgccggaatcaggacgagctgatcgggcgtgccaggatcagccagggcgctggctggtccctgcgcgagaccgcctgcctgggcaagagctacgcccagatgtggagtttaatgtatttccaccgccgggacctaagacttgcagctaacgcaatatgtagtgccgtcccgtcccattgggtgcctacatctcgtaccacctggtccatacacgccggccacgagtggatgacaaccgaggacatgctcacggtgtggaacagagtctggatccaggaaaatccctggatggaggacaaaacccccgttgagagctgggaggagatcccgtatttggggaagcgagaggaccaatggtgtggcagtctgatcggactcacctccagagcgacgtgggccaggaacattcagacggccattaaccaggtgcggagcttaattggatccgaggaatacaccgactacatgcccagcatgaaacgtttcaggcgcgaggaggaggaggccggcgttctgtggtaa

SEQ ID NO: 24845 - RNA, 9876 nt, synthetic construct
  misc_feature 1..9876: note = derived and/or modified CDS sequence (opt11) from DENV-2__KM217156__SS-prME
  source 1..9876: mol_type = other RNA
acagcaggggtgatcatcatgctgatccccaccgccatggcgttccacctcacaactaggaatggggagccccacatgatcgtcagcaagcaggagaagggcaagagtctattgttcaagactgaggacggggtgaatatgtgcaccctcatggccatggacctgggcgaactgtgcgaggacaccattacctataactgccccttgctccggcagaatgagccggaggacatcgactgctggtgcaacgcgacctccacctgggtgacctacggaacctgcaccgccaccggtgagcaccgccgggagaagcggtccgtcgcccttgtaccccacgtgggcatgggtctcgagacccgtaccgagacctggatgagctccgaaggcgcgtggaagcacgcgcagcgcatcgagacctggatcctgcggcacccggggttcacaatcatggccgccatcctggcgtacaccatcggcaccacctacttccaacgcgttctcatcttcatcctgctgacggccgtggctcccagcatgaccatgcggtgtatcggaatctccaaccgcgacttcgtggaaggcgttagcggtgggtcctgggtggacatcgtgctcgagcacggtagctgtgtcaccaccatggccaagaacaagcccacgctggacttcgagctaatcaagaccgaggccaagcagcccgcgaccctccggaagtactgcatcgaggccaagctgacaaacactaccaccgcctcccgctgcccgacccagggcgagcccagcctgaacgaggagcaggacaagcggttcgtgtgcaagcacagcatggttgaccggggctggggcaacgggtgcggcctcttcgggaaagggggcatcgtcacgtgcgccatgttcacgtgcaagaagaacatggagggcaagatcgttcagcctgagaacctggagtacaccatcgtggtcacgccccacagcggcgaggagaacgcagttggcaatgacactgggaagcacgggaaggagattaaggtgaccccgcagtccagtatcaccgaggcggagctgaccggctacgggaccgtcacgatggagtgcagcccccggaccggcctggacttcaacgagatggtgctgctgcagatggagaataaggcctggctcgtgcaccgccaatggttcctggacctgcctctgccctggcttccgggcgccgacatccaggggagcaactggatccagaaggagaccctggtcaccttcaagaacccccacgcaaagaagcaggacgtggtcgtactcggcagtcaggagggcgccatgcacacggcgctgaccggcgccaccgagatccagatgagctctggaaaccccctgttcaccggccacctcaagtgccggctgcggatggacaagctgcagctgaagggcatgtcctacagcatgtgcacggggaagttcaaggtcgtcaaggagatcgccgagacccagcacggcaccatcgtcgtgaggatccagtacgaaggggacggttccccctgcaagatcccgtttgagatcatggatctggaaaagcgccacgtcctgggccgcctcatcaccgtgaaccctatcgtgacggaaaaggactctcccgttaacatcgaggccgagcctcccttcggggactcctatatcatcatcggcgtggaacccggacagctgaagctgagctggttcaagaagggctccagcatcgggcagatgttcgagaccaccatgcgcggcgccaagcgcatggcgatcctcggcgacactgcgtgggacttcgggtccctgggcggggtgttcaccagcataggcaaggctctgcaccaggtattcggtgccatatatggtgcggccttctccggcgtgagctggaccatgaagatcttaatcggggtcgtcatcacctggatcggcatgaacagcaggagcacctccttaagcgtgtccctggtcctagtgggggtggtgacgctctacctgggcgtcatggtccaggccgacagcgggtgcgtggtctcctggaagaacaaggagctgaagtgcggctctggtatctttttcactgacaacgtgcacacctggaccgagcagtacaagttccagcccgaaagcccctctaagctcgccagcgcgatccagaaggcgcacgaggaggggatctgcggcatccgctccatcaccaggctggacaacctgatgtggaagcagataacccccgaactcaaccacatcctgagcgagaacgaggtgaagctaagtatcatgaccggggacattaagggaattatgcaggccgggaagcgcagcctccggccccaacctaccgagctgaagtactcctggaagacctggggtaaggccaagatgctgagcaccgagccgcataaccagaccttcctaatcgacggccccgaaaccgcccagtgccccaacacgaaccgcgcctggaactcgctggaggtcgaggattatgggttcggcgtattcaccaccaacatctggctgaagctcaaggaacggcaggacgtgttctgcgacagcaagttaatgtcagcggccatcaaggacaaccgcgccgtccacgccgacatgggatactggatagagagcgccttaaacgacacctggaagatagagaaggcgtccttcatcgaagtcaagagctgccactggcccaagtcccacacgctctggagcaacggcgtgctggagtccgaaatgatcatcccgaagaacttcgccggccccgtgagccaacacaattacagacccgggtaccacacccagaccgccggcccctggcacctggggaagctcgagatggactttgacttttgcgaggggaccaccgttgtggtcacggaagactgcgggaatcgcggcccgagcttgcggaccaccaccgcctccggcaagctgatcacggagtggtgctgccgtagctgcaccctcccaccactccggtaccgcggagaggacggctgctggtacgggatggagatacggcccctgaaggagaaggaggagaaccttgtgaactctctggtgaccgctggacacgggcagatcgacaacttcagcctgggagtcctcggcatggccctgttcctggaggagatgctccggacccgggtggggacgaagcacgcagtgctgctggtcgccgtgtccttcatgaccctcatcacgggcaacatgagctttagggacctgggccgtgtcatggtgatggtgggcgccgcgatgaccgacgacatcgggatgggggtgacgtacctggccctactggccgccttcaaggtccgccccaccttcgccgcgggcctgctcctgagaaaacttacctccaaggagctcatgatgaccacgatcgggatcgtgctgctgagccagtccaccacccccgagaccatcttagagctgacggacgccctggccctcggtatgatgatactgaagatcgtgcggaacatggagaagtaccagctggccgtcaccatcatggccatcctctgcgtgcccaacgccgtcatcctccagaacgcctggaaagttagctgcacaatcctggccgccgtgtccgtcagccccctcctgctcacttctagccaacagaaggctgactggattccgctcgccctgacgatcaaggggctgaatccaaccgccatcttcctgaccaccctgtccagaacgaataagaaacgcagctggccgctgaacgaggccatcatggctgtgggcatggtgtccatactcgcgtcgtcccttctgaagaacgacatccccatgacgggccccctcgtcgccggtggcctgctgaccgtgtgttacgtgctcaccggacgcagcgccgacctggagttggagcgggcagccgacgttcggtgggaggaccaggccgagatcagcggctccagccccatcctctccatcacgatcagcgaggacgggtccatgagcatcaagaacgaggaggaggaacagacgctgaccatcctgatcagaacggggctcctggtgatttccggcctgttccccgtgtcaatccctatcacggccgccgcctggtacctctgggaggtcaaaaagcagagagccggtgtgctgtgggacgtgccgagcccgccgcccgtcggcaaggcggagctggaggacggggcctacagaatcaagcaaaagggcattctcgggtacagccagatcggcgcaggcgtgtacaaagaggggaccttccacaccatgtggcacgtgacccgcggcgccgtcctgatgcataaggggaagcgaatcgagccctcctgggcagatgtgcgcaaggaccttattagctacggcgggggctggaagctagagggcgagtggaaggagggggaggaggtgcaagttctggcgctggagcccggaaagaacccccgggccgtgcagacgaagcccggcctgttcaagacgaacaccggcaccatcggggccgtgtccctggacttcagccctggtacctccggcagccccatcgtcgacaagaagggaaaggtggtgggcctgtacgggaacggcgtcgtgacgcgctccggcacctacgtgagcgccatcgcgcagaccgagaagtccatcgaggacaaccccgagatcgaggacgacatcttccggaagaagcgcctcaccataatggatttacacccgggagcgggcaagacgaagcggtacctgccggccatcgttcgagaggcgatcaagcggggcctgcggaccctcatcctcgcccccacccgggttgttgcggccgagatggaggaggccctgcgcggcctccccatccggtaccagaccccggccatccgggccgagcacacggggcgcgagatcgtcgacctgatgtgccacgcgaccttcaccatgcgattactcagccccgtgagagtgcccaactataacctgatcatcatggacgaggcccactttaccgaccccgccagcatagccgcccggggctacatctccacgcgcgttgagatgggcgaggccgctgggatattcatgacagccaccccgcccggcagccgggatcctttcccgcagtccaacgccccgataatggacgaggagcgcgagatccccgagcgaagctggaactccgggcacgagtgggtaaccgactttaaaggcaagacggtgtggttcgtccctagcatcaaggcagggaacgatattgccgcctgcctgcgcaagaacggcaagaaggtgatccagctctctcggaagaccttcgacagcgagtatatcaagacgcgcaccaatgactgggacttcgtggtcacgaccgacatatccgagatgggcgccaatttcaaggccgagcgggtcatcgacccccgccggtgtatgaaaccggtgatcctgaccgacggggaggagcgcgtgatactggccggtcccatgccagtgacccactcgtccgccgcccagcggcgcgggcggatcggccgcaacccgaaaaacgaaaacgaccagtacatctacatgggggagccgctcgagaacgacgaggattgcgcacactggaaggaggccaaaatgctgctggacaacatcaacactcccgagggcatcatcccaagcatgttcgagcctgagcgcgagaaggtggacgccatcgacggtgagtaccggctccgtggggaggccagaaaaaccttcgtcgacctgatgcgccgtggcgacctgcccgtgtggctcgcctaccgcgtggccgccgaggggatcaactacgcggaccggcgctggtgcttcgacggcatcaaaaacaatcagatcctggaggagaacgtcgaggtggagatttggaccaaggagggggagcggaagaagttaaagccccgctggctcgacgcccggatctactcggaccccctggccctgaaggagtttaaggagtttgcggccgccagaaagagccttaccctgaacctgatcactgagatgggccggctcccgaccttcatgacccagaaggccagaaacgccctggacaacctggccgtcctccacacagcggaggccggcggccgggcctacaaccacgctctgtccgagttgccagagacgctcgagaccctgctgctcctgaccctgctcgccaccgtaacgggcgggattttcctgttcctgatgagcggcaaaggcatcggaaagatgacgctcggcatgtgctgcataatcaccgcgtccatcttattgtggtatgctcagatccagcctcactggatcgccgcaagcatcatcctcgagttctttctgatcgttctgctcatccccgaaccagagaaacagcgtacgccccaggacaaccagttgacctacgtcgtgatagccatcctgacggtggtcgcggctaccatggccaacgagatggggttcctcgagaagaccaagaaagacttcggtctggggtccatcgccacccagcagcccgagagcaacattctggacatcgacctccggcccgccagcgcttggaccctgtacgccgtggccaccaccttcatcacgccgatgctgcgacactccatcgagaacagctcggtgaacgtgagcttgacggccatcgcgaaccaggccaccgtgcttatgggcctgggcaaagggtggcccctctccaagatggacatcggcgtgccccttctggccatcgggtgctacagccaggtcaaccccatcacgctcaccgccgcgctgctgctattagtggcgcactacgcaattatcggcccggggctgcaagccaaggcctcccgggaggcccagaagcgcgcggccgcgggcatcatgaagaaccccacggtcgacggcatcaccgtcatcgacctcgaccccattccctatgatccgaagtttgagaaacagctgggccaggttatgctgctaatcctgtgcgtgacccaggtcctgatgatgcggactacgtgggccctctgcgaggccctgacccttgcgaccggccccatcagcaccctctgggaggggaaccccggcaggttttggaacacgaccatcgctgtgtccatggccaacatattccgcggttcgtaccttgccggcgcgggactcctcttctccatcatgaagaacaccaccaacacgcggcgcggaaccgggaacactggggagaccctgggggagaagtggaagaaccgggtgagcctgctcggtaagtccgagttccagatctacaagcgcagcggcatccaggaagtcgaccgcacgctggccaaggagggcattaaacgcggggaaaccgatcaccacgccgtgtcccgtggctcagcgaagctgcgctggttcgttgagcggaacctcgtcacgcccgaggggaaggtggtggacttgggctgcggccgcgggggctggtcctactactgcgggggcctgaagaacgtcagagaggtgaaaggactcaccaagggcggcccggggcacgaggaacccatccccatgagcacgtacggctggaacctggtgcgcctgttgaccggggccgacgtcttcttcacgccacccgagaagtgcgacaccctgctgtgcgacatcggagaatctagccccaaccccacggtcgaagcggggcgtaccctccgcgtgctgaacctggtcgagaactggctcaataacaacacccagttctgcatcaaagtgctgaacccgtacatgccctctgtgatcgagaagatggaaacgctgcagcgtaagtatggcggcgccctggtgcgcaaccccctctcccggaacagtacccacgagatgtactgggtgtccaacgccagcgggaacatcgtgtccagcgttaatatgatttccagaatgctgatcaaccggttcacgatgcgccataagaaggccacatacgaccccgatgtggatctgggcagcgggacgcgcaacatcggtatcgagtcagagaccccgaacctcgacatcatcgggaagcgtatcgagaagatcaagcaagagcacgagacgagccgccactacgaccaggaccacccgtataaaacctgggcttatcatggctcctacgagactaagcagaccggcagcgcgtcctcgacggtgaacggggtcgtgcgactcctgaccaagccctgggacgtgatcccgatggtaacacagatggccatgaccgacacgaccccgtttggccagcaacgcgtgttcaaagagaaagtagacacaagaacccaggagccgaaggaggggaccaagaagctcatgaagatcaccgcggagtggctgtggaaggaactgggcaagaagaagacaccccgcatgtgcactcgggaggagttcgcccgcaaggtccgttcgaacgccgcgctcggcgccatcttcacggacgagaacaagtggaagtcggcgcgagaggccgtggaggactcccggttctgggagctggtggacaaggaacgcaacctgcacctcgaggggaagtgcgagacctgcgtctacaacatgatgggtaaacgggaaaagaagatcggggagttcggcaaggcgaagggaagccgcgccatctggtatatgtggctgggcgcacgtttcctggagttcgaggccctcggcttcctgaacgaggaccactggttctcccgcgagaacagcctgagcggggtggagggggaggggctccacaagctgggatacatcctgcgggaggtctccaagaaggaaggcggggcgatgtacgcggatgacacggccggctgggacacccgcatcacgttggaggaccttaagaacgaggagatggtgacgaaccacatggagggagagcataagaagctggccgaggccatcttcaagctcacctatcagaacaaggtggtccgggtgcaacgccccaccccgcggggcacggtgatggacatcatcagtcgccgcgaccagcggggtagtgtacaggtgggcacttacggtttaggtaccttcactaacatgggcgcccagctgattcgccaaatggagggtgagggcgtgttcaaggggatccaacacctcacggcgaccgaggaggtcgccgtgcaggactggctcgccagagtaggccgcgagcggctgagccgaatggccatctccggcgacgactgcgtcgttaagccactcgacgaccgattcgcatccgcgctgaccgccctcaacgacatggggaaggtgcgcaaggatatccagcagtgggagccatccaggggctggaacgactggacccaggtccccttctgcagccaccacttccacgagctcataatgaaggacgggcgcgtgctggtcgtcgcctgccggaaccaggacgagctgatcggccgcgcccgcatctcccagggtgccggctggagcctccgcgagacggcgtgcctgggtaaatcctacgcgcagatgtggagcctgatgtacttccaccggcgcgacctcaggctggccgccaacgcgatctgctccgccgtgccgagccattgggttcccacatcccgcaccacctggtcaatccacgccggacacgagtggatgaccacagaggacatgctgaccgtctggaaccgggtgtggatccaggaaaacccctggatggaggacaagacccccgtggaatcctgggaagagatcccttacctcggcaagcgcgaggaccaatggtgtgggagcctgatcggcctgaccagccgcgccacgtgggcccggaacatccagacggcgatcaaccaggtaagatccctcatcgggtcggaggagtacaccgactacatgccctccatgaagcggttcggccgcgaggaggaggaagccggcgtgctatggtga

SEQ ID NO: 24846 - RNA, 9876 nt, synthetic construct
  misc_feature 1..9876: note = derived and/or modified CDS sequence (opt11) from DENV-2__KX380809__SS-prME
  source 1..9876: mol_type = other RNA
accgccggaatcatcatcatgatgatccccaccgtgatggccttccacctgaccacccgtaacggggagccacacatgatcgtgtcacgacaggagaagggcaagagcctcctgttcaagaccgagaacggggtgaatatgtgtaccctgatggcgatggatctcggcgagttatgcgaggacaccatcacctacaactgcccgctcctccgacagaacgaacccgaggacatagattgctggtgcaatagcaccagcacctgggtgacctacgggacctgcaccgccaccggcgagcaccggcgagagaagcgcagcgtcgccctggttccccacgtgggcatggggctggagaccagaactgagacgtggatgtcgagcgaaggcgcttggaagcacgctcagcgaatcgagacgtgggtcctccgccaccccggttttaccgtgatggcggccatcctggcctacaccatcggcaccacctactttcagcgagtgctgatcttcatcctcctaaccgccgtcgcgccctccatgacaatgcgctgcatcggaattagcaaccgggactttgtggagggggtgtccggtgggtcatgggtcgacatcgtgctggagcacggcagttgcgtgaccaccatggccaagaacaagccaacgcttgacttcgagctgataaagaccgaggccaaacaccccgccaccctgcgcaaatactgcatcgaggccaagctcaccaacacgaccaccgcaagccggtgcccgacccagggggagccctccctcaacgaagagcaggacaagcgcttcgtttgcaaacacagtatggtggaccggggctgggggaacgggtgcggcctgttcgggaagggcgggattgtgacttgcgccatgttcacgtgcaaaaagaacatggagggcaaaatcgtccagcccgagaacctggagtacactatcgtgatcacgccccattccggagaggaaaacgccgtggggaacgacaccggcaagcacgggaaggagatcaaggtgaccccgcaaagctccatcacagaggccgaactaaccggctacgggaccgcgactatggagtgcagcccccgcaccggcctggactttaacgagatggtgctcctgcagatggagaacaaagcgtggttggtgcaccggcaatggttcctcgacctgcccttgccctggctcccgggagccgacacccaagggtccaactggatacagaaagagacccttgtcacgttcaagaatccccacgccaagaagcaggacgtggtcgtgctcggcagccaggagggagcaatgcacaccgccctcaccggcgcgaccgagatccaaatgagctccgggaacctgctgtttaccggccacttgaagtgccgcttacgaatggacaagctgcagctcaaggggatgtcgtattccatgtgtactgggaagttcaaggtggtcaaggagatcgccgagacccagcacggcaccatcgtgatccgcgtgcagtacgagggcgatggcagcccctgcaagatccccttcgaaattatggacctggagaagcggcacgtcctgggccgtctcatcacggtgaacccgatagtcaccgagaaggattccccggtaaatatcgaggccgagccgcccttcggagatagctatatcattatcggcgtggagccggggcagctgaaactgtcctggtttaagaagggctcgtccatagggcagatgttcgagacaactatgcgcggcgccaaacggatggccatactaggggacacggcgtgggacttcggcagcctgggcggtgtgttcaccagcatcgggaaggccctgcaccaggtctttggtgccatctacggggccgcatttagcggcgtgtcctggaccatgaaaatcctgatcggggtggtcatcacctggatcggcatgaatagccgatccaccagcctgtctgtgagcctggttctagtcgggatagtcacgctctatttgggtgtgatggtccaggctgactctgggtgcgtggtgtcgtggaaaaataaagaactgaagtgcgggtcaggcatcttcatcaccgacaacgtgcacacctggactgagcagtataagttccagccggagtccccaagcaagcttgccagtgctatccaaaaagctcacgaggaaggtatatgcggtatccgttcagtgacccgcctggagaatctgatgtggaaacaaataacccccgagctcaaccacatcctgtccgagaatgaggtgaagctgaccatcatgacgggtgacatcaaggggatcatgcaggcggggaaacggagccttcgccctcaacccaccgagcttaagtactcctggaaggcgtggggaaaggccaaaatgctgagcaccgagcttcataatcacactttcctaatcgacggccccgaaacagccgagtgcccaaacacgaaccgggcctggaactcccttgaggtcgaggattacgggttcggcgtcttcaccacgaacatctggctcaagctgaaggaacgccaggacgtcttctgcgacagcaagctaatgtcagcggccataaaggacaaccgggccgtccacgccgacatggggtactggatagagtcggccctcaacgatacgtggaagatcgagaaggcgtccttcatcgaggtcaagagctgccactggcccaagtcccatacactgtggagcaacggcgtgttagagtccgagatgatcattcccaagaacttcgcaggccctgtgagccagcacaattaccgcccgggctaccatacccagactgccggcccgtggcacctcgggagactggagatggatttcgacttctgcgaggggaccactgtcgtggttaccgaggactgtgggaaccgcggtcccagcctgcggaccaccacggccagcggcaagctcatcaccgagtggtgctgtcgcagctgcaccctcccgccgctgcggtaccgcggggaggacggctgctggtacgggatggaaatcagaccactcaaagagaaggaagagaacctggtgaactccctggtgaccgcgggccatgggcagatcgacaatttcagcctcggggtcctgggcatggccttgttcctcgaggagatgctgcgcacgcgggttgggactaagcacgccatattgctggtggccgtctccttcgtgacgctgatcaccggaaacatgtcattccgcgatttgggccgcgtgatggtcatggtgggggcaacgatgaccgacgacatcgggatgggcgtgacctacctcgctctgctggccgcgttcaaggtgaggcccacctttgccgctggcctcctgctgagaaagctcacgtctaaggagctcatgatgaccacgatcgggatcgtgctgctcagtcagtcaacgatcccagagacgatcctcgagctgaccgacgcgctcgccctgggcatgatggtgctgaagatagtccggaacatggaaaagtaccagctcgccgtgacaattatggctatcctgtgtgtaccgaacgccgtgatcctgcagaacgcgtggaaggttagctgcaccatcctcgccgtagtgtccgtcagccccctgttactcacttctagccagcagaaagccgattggatccccctggccctcacaatcaaaggtctaaaccccacagcgatcttcctgaccacgctgtcccggaccagcaaaaagcggtcttggccgcttaacgaggccatcatggccgtcggcatggtgagcatcctggcctccagcctcctcaagaacgacatccccatgacaggcccccttgtggcgggcggcctgcttaccgtctgttatgtcctgactgggcgcagcgcggacctagagctcgaacgggccgcagatgtcagatgggaggagcaagccgagatcagtggaagctcccccatcctgagcatcaccatatccgaggacggtagcatgtccatcaagaacgaagaggaggagcagaccctgactatcctcatacgtacgggcctgttggtcatctccggcctcttcccagtatccatcccgatcaccgcagcggcctggtacctgtgggaagtgaagaagcaacgcgccggcgtcctgtgggacgtgccgtccccgcctcccgtgggcaaggccgagctcgaggacggggcctatcggatcaagcagaagggcatcctgggttactcccagatcggcgctggagtctataaggaagggaccttccatacaatgtggcacgtgacccggggcgccgtgctgatgcacaaggggaaacgtatcgagcccagctgggccgacgtcaagaaggacctcatctcctacggaggtggctggaagctggagggcgagtggaaagagggggaggaggtacaggtgctggccctagagcccggcaagaacccccgcgccgtccagacgaagcccgggctgttcaaaaccaacacgggcacaatcggggcggtaagcctggacttcagcccaggcacgtcgggctcccccatcgtggacaagaagggaaaggtcgtcggcttatacgggaacggcgtggtcacccggagcggcacttatgtttccgccatcgcccagactgagaagagcatcgaggacaaccccgagatcgaggacgacatattccggaagaagcggctcacgatcatggacctgcatcccggggccggaaagaccaagcgctacctgcccgcgattgtgcgggaggccatcaagcgcgggctcagaaccctgatccttgccccaacccgcgtcgtggctgccgaaatggaggaggcgctccgcggcctccctatccggtaccagacgcccgcaatccgcgccgagcataccggacgggaaatcgtagacctgatgtgccacgccaccttcacaatgcgcctattgagccctatccgggtcccgaactacaacttgatcatcatggacgaggcccacttcacggatcccgcgtccatcgccgcccgcggctacatcagcacccgggtcgagatgggtgaggccgccgggatcttcatgaccgcgacgccgcccggctcccgtgacccgttcccccagtcaaacgcccccattatggacgaggaacgggagatccctgagcgctcctggaatagtgggcacgaatgggtgacggactttaagggcaagactgtgtggtttgtgccgtcgatcaaggccgggaacgacatcgccgcgtgcttgcggaagaatgggaagaaagtgatccaactgagcaggaagaccttcgactccgagtatatcaagactaggacgaacgattgggactttgtcgtgaccaccgatataagcgagatgggagccaacttcaaggctgagcgcgtgattgacccgcggcgatgcatgaagcccgtcatcctgaccgacggggaggagcgggtgatcctcgcagggcccatgccggtgactcactccagcgccgcgcagcgcagagggcgcgtcggccgcaacccgaaaaatgagaacgaccaatacatctacatgggggagccactggaaaatgacgaggactgcgcacactggaaggaagctaagatgctgttagacaacatcaacacccccgagggcatcatcccgtccatgtttgagcccgaacgggagaaggttgacgcgatcgacggggagtaccgccttcgcggtgaggcccgcaagaccttcgtggacctgatgcggcgcggagacctccccgtatggctagcttaccgggtggccgccgaagggatcaactacgccgacagacgttggtgcttcgatggcgtcaagaacaaccagatactggaggagaacgtggaggtcgagatctggaccaaggagggggagcgcaagaaactcaagcctcgctggcttgacgcgcgaatctacagcgaccccctcgcgctcaaggaattcaaggaattcgccgccggccgcaagtccctgactctaaacctaatcaccgaaatggggcgcctccccacgttcatgacccagaaggccaggaacgctctggacaacctcgccgtcctgcacacggccgaggccggtggccgcgcctacaatcacgcgctgagcgagctacccgaaaccctggagacgctgctcctgctgaccctcctggccacagtgaccggaggcatattcttgttcctgatgtccggcaagggtataggaaagatgaccctgggcatgtgctgtataattacggcgtctatcctgctctggtacgcccaaatccagccgcattggatcgcagcatcaatcatcctggagtttttcttaatcgttctgctgatccccgagcccgagaagcagcggacgccgcaggataaccaacttacgtacgtggtgatagcgatcctaaccgtcgtcgccgccaccatggccaatgagatgggcttcctagagaagacgaagaaggacttcggacttggcagcattacaacccaacagccggacagcaatatcctcgacatcgacctacggcccgcatccgcttggaccctgtatgccgtggccacaacgttcatcacccccatgctccgtcacagtatcgagaactccagcgtcaacgtctccctgactgccatcgcgaaccaagccaccgtgctgatgggcctcgggaagggctggcccttgagcaaaatggacatcggggtgccgctacttgccattggctgctactcccaggtcaaccctatcactctcaccgctgcgctgttactgttagtggcacactacgccatcatcggaccgggcttgcaggccaaggccacccgcgaagcgcagaagcgggccgctgccggcatcatgaagatcccgaccgtggacgggatcacagtcatcgaccttgaccccatcccctacgacccgaagtttgagaagcaactcggccaggtgatgctcctagtgctgtgcgtgacccaagtgctcatgatgcgcaccacgtgggccttgtgcgaggcgctgacgttggccacggggcccataagcacactgtgggagggcaaccccggtcgcttctggaacaccacgatcgccgtgtccatggccaacatttttcggggaagctacctggccggcgcgggacttctgttctccatcatgaaaaacaccgccaacacccgacgcggcactggaaatacgggcgagaccctgggcgagaagtggaagaatcgcctcaacgccctcggcaagagtgagttccagatctacaagaagagcggcatccaggaggtggaccggaccctggccaaagaggggatcaagcgcggcgagaccgaccaccacgcggtgtctagggggtcagccaagctccgctggttcgtggagcggaacctggtcacgcccgaggggaaggtcgtggacctaggctgtggccgcgggggatggagctactactgcggcgggctcaagaacgtaaaggaggtgaagggcctaaccaagggcgggcccggccacgaggagcccatcccgatgagtacctacgggtggaacctggtgcggctccagagcggcgtcgacgttttcttcaccccgccggaaaagtgcgacacgctgctgtgcgatatcggggagtcctcacccaacccgaccgtggaggccggaaggacccttcgggtcctcaacctagtagagaattggctaaacaacaacacccagttctgcatcaaagtgcttaacccctacatgcccagcgtcattgaaaaaatggaggccctgcaacgcaagtacggcggggccctggtgcgtaacccactgtcgcggaactcgacccacgagatgtactgggtatccaacgcgtcgggcaacatagtgtccagcgtgaacatgatctcccgaatgctgataaacagattcacgatgaagcacaagaaggctacctacgagcctgacgtggacctggggagcggcacccggaacatagggatcgagtccgagacccccaacctcgacattatcggcaaaagaatcgagaagattaagcaggaacatgagacatcctggcactacgaccaggaccacccctacaaaacctgggcttaccacggctcctatgagaccaagcagactgggtccgcatccagcatggtcaacggagtggtccgcctgctgacgaagccgtgggacgttatccccatggtgacccaaatggccatgacggacactacccccttcgggcaacaacgagtgttcaaggagaaggtggacacccgcacacaggagcccaaggagggcaccaagaagctcatgaagatcacggccgaatggctgtggaaggagttaggcaagaagaagaccccgcggatgtgtacacgggaggagttcacccggaaggtgcgctccaacgccgccctcggtgccattttcacggatgagaacaagtggaagtccgcccgggaagcagtcgaggattccggcttctgggagctggtggacaaggagagaaacctgcacctagaggggaagtgcgagacctgcgtttataacatgatggggaagcgggagaagaagctgggggagttcggtaaggcgaagggttcacgagccatatggtatatgtggctaggggcccggtttctcgagttcgaggcgctgggcttccttaacgaggaccattggttctccagagagaacagcctcagcggcgtcgagggtgaggggctgcacaagctgggctacatcctccgggatgtgtccaaaaaagagggcggggccatgtacgccgacgatacagccgggtgggacacccgcatcacactggaggacctgaaaaacgaggagatggttaccaaccacatggagggggagcaccggaaactcgccgaggcgatctttcgccttacctatcagaacaaggttgtacgggtgcaacgccccactccgcgcggtacagtgatggacattatcagccgccgggaccagcgcgggagcggccaggtcgtgacctacggcctgaacacatttaccaacatggaggcacagctcatccggcagatggagggggagggcgtgttcaagagcatccagcatctgaccgtaaccgaggagatcgccgtgaagaactggctggagcgggtaggccgcgaacgcctctcccgcatggccattagtggcgatgactgcgtggtcaaacccctggacgacaggttcgcctccgcgctgaccgcactcaatgacatgggcaaggttcggaaggacatccagcagtgggagcctagccgggggtggaacgactggacccaggtacccttctgctcccaccacttccacgagctgatcatgaaagacgggcgcgtgctggtcgtaccttgtcggaaccaggacgagctcattgggagagcgaggatcagccagggggctggctggtccctgcgggagacggcctgcctgggcaaaagctatgcgcagatgtggagcttgatgtacttccaccggcgcgacctgcgactggccgccaatgccatctgtagcgccgtgccctcccactgggtcccgacgagcaggaccacctggtctattcatgcgacccacgagtggatgacgaccgaggacatgctgaccgtgtggaaccgggtgtggatccaggagaacccctggatggaggacaagaccccggtcgagagctgggaagagatcccctatttgggcaagcgcgaggaccaatggtgcgggagcctgatcggcctcacgtcccgggccacttgggcgaagaatatccaaaccgccattaaccaggtgagaagcttaatcgggaacgaggagtacacagactatatgccgtccatgaaacggttccgtcgcgaggaagaggaagctggcgtgttgtggtga

SEQ ID NO: 24847 - RNA, 9876 nt, synthetic construct
  misc_feature 1..9876: note = derived and/or modified CDS sequence (opt11) from DENV-2__KX380810__SS-prME
  source 1..9876: mol_type = other RNA
acagccggcattataatcatgatgatccccaccgtgatggcgttccacttaacaactcgcaacggcgaaccccacatgatcgtgagcaggcaggaaaagggcaagagtctcctgttcaagacggagaacggggttaatatgtgcacattaatggcgatggacctcggtgagctgtgcgaggatactatcacctacaactgccccctgctccgccagaacgagcccgaggacattgactgctggtgcaatagcaccagcacctgggtgacgtacggtacctgcaccgctaccggcgagcaccggcgcgagaagaggagcgtggccctggtgccccacgtggggatggggctggagacccgcacggagacctggatgagtagcgagggcgcctggaagcacgcccagcggattgaaacctgggtgctccgccaccctgggttcaccgtaatggccgccatcctggcctatacgatcggcactacctacttccaacgggtgctgattttcattctcctgactgccgtagccccctcgatgaccatgcgctgcatcgggatcagcaacagagacttcgtggagggggtgtcgggcggcagctgggtcgacatcgttctggaacacggctcctgcgttaccaccatggccaagaacaagccgacactggacttcgagctgataaaaaccgaggccaagcatcccgccaccctgcggaagtattgcatcgaggccaagctgacgaacacgaccaccgcttcacggtgtccgacccagggggagccctccctgaacgaggagcaggataaacgctttgtctgtaagcacagcatggtggatcggggctgggggaacgggtgtggcctgttcgggaaagggggcatcgtgacgtgcgcaatgtttacctgcaagaagaacatggaaggcaagattgtccagcccgaaaatctcgaatataccatcgtgatcacgccccactccggggaggaaaacgccgtcggaaatgacacaggcaagcacgggaaggagatcaaggtcaccccgcagtcgtccatcaccgaggctgaattgacaggctacgggactgccacgatggaatgcagccctcgcacggggctcgacttcaacgaaatggtgctgctgcagatggaaaataaggcctggctcgtgcaccggcagtggtttctcgatcttccattaccctggctgccgggcgccgacacccaagggtcgaactggattcagaaggagacgctggtaacgttcaagaatccacatgccaaaaagcaggacgtggtcgtgctaggcagccaggaaggggccatgcatacggccctcaccggagcgacagagatccaaatgagctccgggaatctgctgtttaccggccacctaaagtgccgtctacgtatggacaaattgcagctcaagggcatgtcatacagtatgtgcaccgggaaattcaaggtggtcaaggagatagccgagacccagcacggcaccatcgtgatacgcgtacagtacgagggggacggcagcccctgtaaaatccccttcgagatcatggacctcgagaagcgtcatgtcctcggccgcctcattacggtgaacccgatcgtgacagggaaggactcccccgtcaacatcgaggccgaaccgcccttcggcgatagctacatcatcattggggtggagccaggccagcttaagctgtcctggttcaagaaggggagctccatcggccaaatgttcgagaccacaatgcgcggcgccaagcggatggccatcctcggggatactgcgtgggatttcgggtccttgggaggggtcttcacttctatagggaaggccctgcatcaggtcttcggggcaatctacggagccgcgttctccggcgtgagctggaccatgaagatccttatcggcgtcgtcatcacctggatcgggatgaatagtcggtccacgagcctgtccgtgtctctggttctggtcggcatcgtaaccctctacctgggggtgatggtccaagccgactccggctgcgtggtgtcgtggaagaacaaggagctgaagtgtggctccgggatcttcatcaccgacaacgtccatacctggacggagcagtacaagttccagcccgagtccccctcgaagctcgcctcggctatccagaaagctcatgaggaaggtatctgcgggatcaggagcgttacccgcttggaaaacctgatgtggaagcagatcacacctgagctcaaccatatcctgtccgagaatgaggtgaagctcacgataatgacgggggacatcaagggaatcatgcaggcgggcaagcggagcctccgcccgcagcccaccgagctgaagtactcctggaaagcctggggcaaggcaaagatgctgagcaccgaactccataaccacaccttcctgatcgacggtccagaaacggccgagtgccctaacaccaaccgagcatggaactccctggaggtcgaagactacggcttcggggtgtttaccacaaacatatggctcaagctgaaggagcggcaggacgtgttttgcgacagtaaactgatgtcggcggccataaaggacaaccgggctgtccacgccgacatgggctactggatcgagtctgctctcaatgatacttggaagatcgagaaggcgtcctttatagaagtcaagagctgtcattggcccaagtctcacaccctgtggtctaacggcgtgctggagtccgagatgataatccccaagaacttcgccggtccagtgagccagcacaactaccggcccggctaccacacccaaaccgcagggccttggcatctcggccggctggagatggacttcgacttttgcgaggggacgacggtggtggtaactgaggactgcggtaaccgcgggccctcactgagaacaaccacggccagcgggaaacttatcaccgagtggtgctgccgctcgtgcaccctgcccccgctgcggtaccgcggcgaggacgggtgctggtacggcatggagatcagacccctcaaggagaaggaggagaacctggtaaattctctggtcaccgcggggcacggccagatcgataacttcagtctcggagttctgggaatggccctgttcctcgaggaaatgctccgcacgcgggtgggcaccaagcacgccatcctgctcgtggctgtctcctttgtgaccctgatcaccgggaacatgtccttccgcgacctcggccgtgtgatggtcatggtcggagccacaatgacggatgacattggcatgggcgtgacatacctcgcgctgctggccgctttcaaagtgcgacccacctttgccgccgggctcctgctgcgcaagctaacgagtaaggagctgatgatgacgaccatcggcatcgtgcttctcagccagtccacaatacccgagacaatattagagctgacggacgcgctggccttagggatgatggtgttgaagatagtccgaaacatggaaaagtaccaacttgccgtaactatcatggccatcttgtgtgtcccgaacgccgtgattctgcagaatgcgtggaaggtgagctgcaccatcttggcagtcgtgtccgtttcgccactgctgctcacttcctcccagcagaaggccgactggatcccgctggcactgaccatcaagggcttgaatcccacggcgatcttcctgaccacactgagccgaacctcaaagaagcgttcctggccactcaacgaagccatcatggccgtcggcatggtgtcaatcctggcctcgagcttgttaaagaacgacatccccatgactgggcctctggttgccggcgggctgctcacagtctgctacgttctgacgggccgcagcgcggatctggagcttgagcgggccgccgacgtgcgttgggaggagcaggccgagatatccgggagctcccccatcttgtcgatcaccatctccgaggatggaagcatgtccatcaagaacgaggaggaggagcagactctgaccatcttaatccggaccggcctgctggtcatctctgggttgttcccggtgtccatccccatcaccgccgcggcctggtacctgtgggaggtgaagaagcagcgcgccggcgtcctgtgggacgtaccgagcccgcctcctgtggggaaggccgagctcgaggacggcgcctaccggatcaagcagaagggcatcctcggctactcacagataggagcaggggtctacaaggagggcactttccacaccatgtggcacgtaacccgtggggcagtgctgatgcacaagggcaagcgaatcgagcccagctgggccgatgtcaagaaggatctcatctcctacggcgggggctggaagctggagggggagtggaaagagggcgaggaggtccaggtgctggccctcgaacccgggaagaacccccgcgctgtccagacgaagcccggcctgttcaagaccaacaccggaaccatcggcgcggtcagcttagacttctcccccggcacgagtggatcccccatagtggacaagaagggcaaggtcgtggggctctacggcaacggagtggtcacccggagcggcacctatgtttcggctatcgcccagaccgagaagagtatcgaggacaaccccgagatcgaggacgacatcttccgcaaaaagcggctgacgatcatggacctgcaccccggcgccgggaagacaaagcgttaccttcccgctatcgtgcgggaggccatcaagaggggcctccgaacgttaatactggccccgacccgggtcgtggcagcggaaatggaggaggccctccgcggtctgcccatacggtaccagacgcccgccatccgcgcggaacataccggccgggagatcgtggacctcatgtgtcatgccaccttcaccatgcgcctgctaagccccatacgggtccctaactacaacctcattattatggatgaggcccatttcacagacccagcgtccatcgccgcccgcggctacatcagcacccgggtcgaaatgggtgaggcagccggcatcttcatgaccgcgacgccaccagggagtcgtgatccgttcccccagtccaacgcccccattatggacgaggaacgggagatcccagagcgctcctggaacagcggccacgaatgggtgacggactttaaggggaagacggtctggtttgtacccagcatcaaggcaggaaacgacatcgccgcctgcctccggaagaatgggaagaaggtgatccagctgagccggaagaccttcgactcggagtatattaagactcggacgaacgactgggatttcgtcgttaccaccgacatcagcgagatgggggcgaacttcaaggccgagcgcgtgatcgaccccaggcgctgcatgaagcccgtcatcctgaccgacggtgaggaacgggtcatcctcgccgggcccatgccggttacgcactcctccgccgcgcaacgccgggggcgagtagggcgcaacccgaagaacgagaacgaccagtacatctacatgggcgaaccgcttgagaacgatgaagactgcgcccactggaaggaggccaagatgctgctcgataatattaacacccccgagggcatcatacctagtatgtttgagccagagcgggagaaggtggacgctatagacggggagtaccgcctccgcggcgaggcgcgcaaaaccttcgtggacctcatgcggcgaggagacctcccggtctggctggcctaccgtgtggctgccgagggcatcaactatgctgaccgccggtggtgcttcgacggggtcaagaacaaccagatccttgaggagaacgtggaggtagagatctggacaaaggagggagaacgcaagaaactcaagccgcggtggctggacgctcgcatctacagcgaccccctggcgctgaaggagttcaaggagttcgccgccggccggaagtccctgacactgaacctcatcacggagatggggcgcctgccgaccttcatgacccagaaggctcggaacgccctggacaacctcgccgtcctgcatacggcagaagccggtgggcgcgcctacaaccatgcgctgagcgaactccccgagaccttggagaccctgctcctgctgaccctcctcgccacagtgaccggcggcatctttctattcctcatgagcgggaaaggcatagggaaaatgaccctaggcatgtgctgcatcatcaccgccagcatcctgctctggtacgcccagatccagccgcactggatagccgcgagcattatcctggagtttttcctgatcgtgctcttgatccccgagcccgagaaacagcggacgccccaggacaaccagctgacgtacgtcgtgattgcgatcctcaccgtggtcgccgccaccatggcaaacgagatggggttcctggagaagaccaagaaggatttcggcttgggctccatcacgactcaacagcctgacagcaatatcctggacatagacctgcgacccgcatccgcctggaccctgtacgcggtcgccaccaccttcatcacccccatgctccggcacagcatcgagaacagttctgtcaacgtttccttgacggccatcgcgaaccaggccaccgtgctgatgggtctgggcaagggatggcccctgagtaagatggacatcggcgtgccgctgttggctatcgggtgctactcccaggtcaaccccatcactctgacagccgcgctactcctactggtggcccactacgccatcattgggcccggcctccaggccaaggccacccgcgaggcgcagaagcgggccgccgccggcataatgaagatccctgccgcggacatcggcaccgtcatcgacctggatccaatcccctacgacccaaagttcgaaaagcagttagggcaggtcatgttgctggtgctgtgcagcacccaggtgctcatgatgcgcaccacctgggcactgtgcgaggccctgaccttagccacggggcccatctccacactgtgggagggaaaccccggccgcttttggaacaccaccatcgccgtcagcatggcgaacatcttcaggggctcctacctcgccggagccggattgctgttcagcataatgaagaacacggcaaacacccgccgggggacaggcaacacgggcgaaacgctcggggagaaatggaagaaccgcttaaacgcgctcggcaagtccgagttccagatatacaagaagtccggtattcaggaagtagaccggacactggccaaggagggcatcaaacgcggagagacagaccatcacgctgtgagtcgcggcagcgccaaactaaggtggttcgtggagcggaacctggtgactcccgaaggcaaggttgtcgacctggggtgtggccgtggcggatggtcctactactgcggagggctcaagaacgtgaaggaggttaagggcctgacgaaaggcggccccggacacgaagaacccatcccgatgagcacctacggctggaacctggtccggcttcagtccggggtggatgtattcttcacgccgcccgagaagtgcgacactctgctgtgcgacatcggcgagagcagccccaacccgacggttgaggccggacggaccctgcgggtgttgaacctggtggagaactggctcaataacaatacgcagttttgcatcaaggtgctgaacccgtacatgcccagcgtaatcgagaagatggaggcgttgcagagaaagtacggaggggccctggtgcgaaacccactcagccgcaactccacccacgagatgtattgggtctcgaacgcttccgggaacatagtgagctccgtgaacatgatcagccggatgttaattaaccgcttcaccatgaagcacaagaaggccacgtacgagccagatgtcgacctcggctccggcacccggaacatcggcatcgagtctgagacgccaaacctcgacatcatcggtaagagaatcgagaagatcaagcaggagcacgagacgtcctggcactatgatcaggaccacccatataaaacgtgggcctaccacggatcgtatgagaccaaacagacgggctccgcgagctccatggttaacggggtggtaaggctacttaccaagccatgggacgtaatacctatggtgacgcagatggcgatgacagatacgacaccattcggccagcagagggtcttcaaagaaaaggttgacacacgcacccaggaacccaaggagggcacgaagaagctgatgaagataaccgcagagtggttgtggaaggagctggggaagaagaagacgcctcgcatgtgtacccgcgaggagttcacccggaaggtgcgcagcaatgccgccctgggggcgatcttcacagacgaaaacaagtggaaatccgcccgagaggccgtcgaagacagcgggttctgggagctggtggacaaggagcgaaacctgcacttagaggggaagtgcgaaacatgcgtctataacatgatggggaagcgggaaaagaagctgggcgagttcgggaaggccaagggctcccgggcgatatggtacatgtggctgggcgcccggttcctcgagttcgaagctctggggtttttgaacgaggaccactggttcagccgcgagaacagcctctccggcgtcgaaggggagggcctgcataagctgggctatatactcagggacgtgtcgaagaaagagggaggcgctatgtacgccgatgatactgcgggctgggacacgcgcattaccctggaggacctgaagaatgaggagatggtcacaaatcacatggaaggtgagcaccggaaattagccgaggctatctttcgcctgacctaccagaacaaggtggtgcgagtccagcgccccacgcccagggggacggtgatggacatcatatcccgccgggaccaacggggcagcggccaggttgtgacgtacgggcttaacaccttcaccaatatggaggcccagctaatccgccagatggagggcgagggggtgttcaagtccatccaacacttaacagtgactgaggagatcgcagtcaagaactggctggagagagtgggccgcgaacggctaagccgaatggcgatctccggcgacgactgcgtggtaaaacccctggacgaccggttcgcctctgcattaacagccctaaacgatatggggaaggtgcgcaaggacatacagcaatgggagccgtcccggggttggaacgactggacccaggtgcccttctgcagccaccactttcacgagctgatcatgaaggacgggcgcgtcctggtggtgccctgcagaaaccaggacgagctcatcggtcgcgcccggatctcccaaggagcgggttggagcctgcgcgagaccgcctgcctgggtaagtcctacgcacagatgtggagcctcatgtacttccaccggcgcgacctgcgtctcgcggccaatgcgatatgctcggccgtccccagccattgggtcccaatctcccggacgacctggagcatccacgccacgcacgagtggatgaccacagaggacatgctcacggtgtggaaccgggtctggatccaggagaatccctggatggaggacaagacccccgtggagagctgggaggagatcccctacctggggaagcgtgaggaccaatggtgcggctccttgatcgggctcaccagccgtgccacatgggcgaagaacatacagacggccatcaaccaggtgcgctccctgattggtaacgaggagtacacggactacatgccgtccatgaagcgctttcggcgcgaggaggaggaggccggcgtcttgtggtga

SEQ ID NO: 24848 - RNA, 9876 nt, synthetic construct
  misc_feature 1..9876: note = derived and/or modified CDS sequence (opt11) from DENV-2__KX380811__SS-prME
  source 1..9876: mol_type = other RNA
accgcgggaatcatcataatgatgatccccaccgtgatggccttccacctgacaactcggaacggtgaaccccacatgatcgtcagccgccaggaaaagggcaagagcctcctgttcaagaccgagaacggtgtgaacatgtgcaccttgatggcgatggaccttggcgagctatgcgaagacaccataacctataactgccccctgctccgccagaacgagcccgaggacatcgactgctggtgcaactccaccagcacctgggtgacctacgggacctgcaccgccacaggcgagcaccggcgcgagaaacggagcgtcgccctggtgccccacgtgggcatgggtctcgagacccgcacagaaacctggatgagcagcgagggcgcctggaagcacgcccagcggatcgagacctggatcctccgccatcccgggttcacgatcatggcggccatcttagcctacactatcggcaccacgtacttccagcgggtactgatcttcatactcctgacggccgtcaccccctccatggctatgcgatgcatcgggatcagcaaccgggacttcgttgagggcgtctccggcgggagctgggtggatatcgtgctggagcacggctcctgtgtcaccaccatggcaaagaacaagcccacgctcgacttcgagctgataaagaccgaggccaagcacctggccaccctccggaagtactgcgtggaggccaagctgaccaacacgaccaccgcgtcgcggtgtcccacccagggggagccctctctgaacgaggagcaggacaagcgcttcgtgtgcaagcacagcatggttgaccggggttggggcaacgggtgcggcctcttcgggaagggagggatcgtgacgtgcgccatgttcacgtgtaaaaagaacatggagggcaaggtggtccagcccgagaatctggagtacaccatcgtgattaccccccattccggcgaggagaacgcagtggggaacgacacaggcaagcacgggaaggagattaaggtcacgccccagagctccatcaccgaagccgagctgacgggatacgggaccgtgacgatggagtgctcaccgagaaccggtctcgacttcaacgagatggtcctgctgcagatggagaacaaggcctggctggttcatcgccagtggttcctggacctgcctctcccctggctgccaggcgcggacactcagggctctaactggatccagaaggagacgctggtgacgttcaagaacccgcacgccaagaagcaggacgtggtggtgctcggcagccaggaaggggcaatgcacaccgcgctcaccggcgccacggaaatccagatgagctcggggaacttactgttcactggccatctgaagtgccgcctgcgcatggataagttacagctgaaggggatgagctactccatgtgtaccggtaagttcaaagtcgtgaaggagatcgcggagacccagcacggaaccatcgtaatccgcgtccagtacgagggggacggcagcccatgtaagatccccttcgagatcatggacctggagaagcggcacgtgctcgggaggctgatcacggtgaaccctatcgtaaccgaaaaggacagccctgtgaacatagaggccgagccgccctttggggacagctacatcatcatcggcgtggagcctgggcaactcaaactttcttggttcaaaaaaggcagcagtatcgggcagatgttcgagaccactatgcgcggcgccaagcggatggcaatcctgggggacacggcgtgggacttcgggagcctggggggagtgttcacatccatcggcaaggcgctgcaccaggtgttcggggcaatatacggcgccgccttctcgggcgtgtcgtggacaatgaagatcctcatcggggtcgtcatcacgtggatcggtatgaattcgcgctccacgagcctgtccgtaagcctggtcctcgtcggggtggtcaccctgtacctgggcgtgatggtgcaagcggactcagggtgcgtcgtgagctggaaaaacaaggagctcaagtgcggcagcggcatcttcataaccgacaacgtgcacacctggacggagcagtataagttccagccggagtctcccagcaagctggcctccgccattcagaaggcccacgaggaggggatctgcggcatccggtcagtgacccgcctggagaatctcatgtggaagcagatcacccccgagttaaaccacatcttgacggagaacgaggtgaagctcactatcatgaccggggacatcaagggcatcatgcaagccggcaagcggtcccttcgcccccaaccgaccgaactgaaatacagctggaaagcgtggggcaaggccaaaatgctctccaccgagctgcacaaccacacgttcctgatcgacggccccgagaccgccgagtgtccaaacacaaaccgggcatggaacagcttggaggttgaggactacgggttcggagtcttcaccaccaacatatggctgaagctgaaggagaggcaggatgtgttctgcgatagtaacctgatgagcgcagcaatcaaggataaccgggctgtgcacgccgatatggggtattggatagagagtgcactcaacgatacctggaaaatcgagaaggccagcttcatcgaggtaaagtcctgccactggcctaagagccacaccctgtggtccaacggcgttttagagtccgagatgatcatccccaaaaacttcgcgggcccggtgtcgcagcacaactaccgccccgggtaccacacccagaccgccggcccgtggcacctgggtcggctggagatggacttcgacttctgcgaggggactaccgtcgtggtgaccgaggactgcgggaaccgcggcccatcgctgcggaccacgaccgccagcggaaagctgatcactgagtggtgctgtcgctcctgcacactgccgcccctccggtaccgcggggaggacggctgttggtacgggatggagatccggccgctgaaggagaaggaggagaacctggttaatagcctcgtgacggccggccacgggcagatcgacaacttctccctgggcgtgctgggcatggcgctcttcctggaagagatgctgcgcacccgggtagggacaaagcatgcgatcctcctggtggccgtgagtttcgtaacactgataacaggcaacatgtccttccgcgacttggggcgcgtgatggtgatggtcggtgcgaccatgaccgacgacatcggaatgggagtgacctacttagccctgctcgcggccttcaaggtccggcctacgtttgccgccggtctgctgctccgaaaactgacgtcgaaggagctgatgatgaccaccatcgggatcgtcctcctgtcccagagcacgatccccgagtccatcctggagctcaccgacgccctagcactgggtatgatggtgctcaagattgtccggaatatggagaaataccagctggcagtaaccatcatggccatcttatgcgtacccaacgccgtcatactccagaacgcatggaaggtgagctgcactacgctggccgtggtctccgtgagcccgctgctactgacctcctcgcagcagaaggccgactggatccccctggccctcactatcaaggggctgaaccccaccgctatcttccttaccaccctctcccgcacctccaaaaagcggtcctggcccctgaatgaggcgatcatggccgtgggcatggttagcatcctggcctcaagcctcctgaagaacgatatcccgatgaccgggcccctggtggcggggggcctcctgactgtgtgctatgtccttaccgggagatctgctgacctcgagctggagcgggcggcagacgtgcgctgggaggagcaagccgagatctccggcagctcccccatcctgagcatcaccatctccgaggacggcagcatgtcaatcaagaatgaggaggaggagcagaccttgacgatcctgatccgtaccggcctgctcgtaatcagcggcctattccccgtgtccataccgatcaccgccgcggcgtggtacctgtgggaagtgaagaagcagcgtgccggcgtactctgggacgtcccctcgccgccgcccgtgggcaaggccgagctggaagacggggcctaccggatcaaacagaagggcatcttgggctacagtcagataggggccggcgtgtacaaagaggggaccttccacaccatgtggcacgtcactcgcggcgcggtgctcatgcataaggggaagcgaattgagcccagttgggctgacgtgaagaaggatttaatctcttacggtgggggttggaagctggagggcgagtggaaggagggtgaggaggtccaggtgctcgcactggagccgggcaagaatccgcgcgccgtgcagacgaagcccggcctgttcaagacgaacaccggaacgatcggggccgtgagtctcgacttctcccccggcaccagcggctcccctatcgtggacaagaaggggaaggtggtcggactgtatgggaacggcgtggtgaccagaagcggcacatatgtctccgctatcgcccagacggagaagtccatcgaggataacccggagatcgaggacgacatcttcaggaagaagcggctgaccataatggacctgcacccgggcgccggcaaaaccaagcgctacctccccgccattgtgcgggaggcgatcaagcggggactgcggaccctgatcctcgcccccacgcgcgttgtcgccgccgagatggaggaggccctgcgcggcctgccgatccggtaccagaccccggcgatccgcgccgagcacaccgggcgggagatcgtggacctcatgtgccacgctaccttcacgatgcgtctgttatcacctatcagggtgccaaactacaacctcatcattatggacgaggcccactttaccgatccggccagtatcgcggcccgcggctacataagcacccgggtcgaaatgggcgaggccgccgggatcttcatgaccgccacgccgccaggctcccgagaccccttcccgcagagcaacgcgcccatcatggacgaggagcgcgagatccctgagcgcagttggaacagcgggcacgagtgggtgaccgatttcaagggcaagaccgtgtggttcgtgccctccatcaaggccggaaacgatatcgccgcatgtctgcggaagaacggcaagaaggtgatccagctgagccgcaagacgttcgactccgagtatatcaagacgcgaaccaacgactgggactttgtggtcaccaccgacatcagcgagatgggcgcgaacttcaaggccgagcgcgtgatcgatccacggcgctgcatgaagccagtgatcctcacggacggggaggagcgggtaatcctggccggccccatgccggtgactcactccagcgctgcacagcgccgtggccgcgtgggcaggaacccgaagaacgaaaacgaccagtacatctacatgggagagccccttgagaacgacgaggactgcgcccactggaaggaggccaaaatgctcctggacaacatcaacacgcccgagggcataattccctccatgttcgagccagagcgggagaaggtggacgccatcgacggagagtatcgcctacgcggggaggcccgcaagaccttcgtggacctcatgcggcgcggcgacctacccgtgtggctggcctaccgagtggcggccgagggtatcaactacgccgaccgccgatggtgcttcgacggcgtgaagaacaaccaaatcctcgaggagaatgtcgaggtggaaatctggacgaaagagggagagcgcaagaagctgaagccccggtggctagacgccagaatttacagcgacccgctcgctctgaaggagttcaaggagtttgcggctggtcggaaatcacttaccttgaacctgataaccgaaatgggccgcctgcctaccttcatgacacagaaggcgaagaacgcactcgacaacctggcggtcctgcacaccgccgaggctgggggccgggcctacaaccacgccctgagcgaactgcccgagaccctcgagaccctcctactgctcacgctgctggcaaccgtcaccgggggcatattcctcttcctgatgtcaggcaaggggataggcaagatgaccctggggatgtgctgcatcatcactgcctctatcctcctgtggtatgcgcagatccagccccactggatcgcagcctccataatcctggagttcttcctcatcgtgctgttaataccggagcccgagaagcagcgcacgccccaggataaccagttaacctacgtggtgatcgcgattcttaccgtggtggccgccaccatggcgaacgagatgggcttcctggagaagacgaagaaggacttcgggctcggcagcattaccacccaacagcccgaaagcaacatcctggacattgacctgcgcccggcctccgcgtggaccctctacgccgtagccacgaccttcatcacgcccatgctgcgccacagcatcgagaattcctcggtgaacgtatccttgaccgctatcgccaatcaggcgacggtgctgatgggcctggggaaaggctggcccctgagcaagatggacatcggtgttcccctcctggccattggctgctattcacaggtgaaccccattaccctgaccgccgccctcctgctgctcgtagcgcactatgccatcatcgggcccggcctgcaggccaaggccacccgtgaggcccagaaacgcgcggccgccgggatcatgaagatccccacggtggacgggatgaccgtgatcgatctggaccctatcccgtacgaccccaaatttgagaagcagttagggcaagtaatgctgctggtgctctgcgtgacgcaggtcctaatgatgcggacaacctgggccctttgcgaggccctaacactggctaccgggcccatcagcaccctgtgggagggcaatcccgggcgcttctggaatacaaccatcgccgtgtccatggcgaatatatttcgcggcagttacctcgccggtgcggggctgctgttctcaattatgaagaatacggcgaacacccggcgcggcacggggaacactggcgagaccctaggggagaaatggaagaaccgactgaacgccctgggcaagtcagaattccagatctataagaagtccggcattcaagaggtggatcgtaccctcgccaaggaagggatcaagcggggcgagacggaccaccacgccgtctcacgcgggtccgcgaaactgcgatggttcgtggagcgcaacctggtcacaccggagggcaaggtcgtggacctcggctgcgggcggggcgggtggagctactactgcggcgggctcaagaatgttaaggaggtcaagggcttgaccaagggcgggcccggtcacgaggagcccatacccatgtccacttacgggtggaacctggtgagactgcagagcggcgtggacgtcttcttcacgccgcccgagaagtgcgacaccctgctctgcgacataggggagtccagcccaaaccccaccgtggaggcgggacgaacgctgcgcgtgctgaacctcgttgagaactggctgaacaacaacacccagttctgcatcaaggtactgaacccgtacatgcctagcgtgatcgagaaaatggaggccctgcagcggaaatacggcggggccctcgtgcggaaccccctctcccggaactcgacgcacgagatgtactgggttagcaacgccagcggcaacatcgtgtccagcgtaaacatgatatcccgcatgctgatcaaccggttcaccatgcgccacaagaaagcgacctacgagccggatgtggacctcgggagcggtacccggaatatcgggatagagagtgagacgcccaacctggacatcatcggcaagcgaatcgaaaagatcaagcaggagcacgagaccagctggcactacgaccaggaccacccctacaaaacctgggcctaccacggctcctacgagaccaagcaaacggggagcgcctccagcatggtgaacggcgtcgtgcgcctgttaaccaaaccttgggacgtgatcccgatggttacccaaatggccatgaccgacacgacccccttcgggcagcagcgggtgttcaaagagaaggtcgacacccgcacccaggagcccaaggagggcacaaagaaattaatgaagatcacggccgagtggctgtggaaagagctcggcaagaagaagacaccccggatgtgtacccgggaggagttcacgaggaaggtgcgttccaacgccgccctgggtgccatatttaccgatgagaacaagtggaagtccgctcgggaggccgtggaagattccggtttctgggagctggtcgacaaggaacgaaacctgcacctggagggaaagtgtgagacatgcgtctacaacatgatgggcaaacgtgagaagaagctgggggagttcggcaaggcgaagggctcgcgggccatatggtatatgtggctgggcgcccggttcctggaattcgaggccctaggcttcctcaatgaggaccattggttctcccgcgagaacagcctttccggggtggagggcgaggggctgcacaagctgggctacatcctgcgggacgtgtccaagaaggaaggcggtgcaatgtacgccgacgacacagccggctgggacacgcgtatcacccttgaggacctcaagaatgaggaaatggtgaccaaccatatggaaggggagcacaagaagctggccgaggcaatcttcaagctgacgtaccagaacaaggtggtccgggtgcagcgcccgacgccccggggtaccgtgatggatatcattagccgccgggaccagcgagggtccggccaagtcgtgacctacggcctcaacaccttcacgaacatggaggcgcagctgatccggcagatggagggagaaggggtgttcaaaagcatacagcagctgactgtcaaagaagagatcgccgtgaagaattggctcatccgagtgggacgcgagcggctctcccgcatggccatcagcggcgacgactgcgtcgtaaagcccctggacgaccggtttgcctccgccctcaccgcccttaacgacatgggcaaggtgcgcaaggacatccaacaatgggagcccagccgggggtggaacgactggacccaggtcccgttttgctcccaccatttccacgagctgatcatgaaggatggcagggtcttggtcgtcccctgccggaaccaggacgagctgatcggtcgcgcccggataagccagggcgccggttggtccctgcgagagacggcttgcctcggcaagagctacgcccagatgtggtccctgatgtactttcaccggcgcgacctgcgtctcgcggctaacgcaatctgcagcgccgtgccctcccactggatcccgaccagccgcaccacctggtccatccacgccactcacgagtggatgacgaccgaggacatgctcaccgtttggaaccgggtctggatccaggagaacccgtggatggaggacaagactcctgtcgagagctgggaagagatcccgtacctgggcaagcgtgaggaccagtggtgcgggagcctcataggcctgacgtcccgggcgacctgggcgaagaacatccagaccgccatcaatcaggtgcggagcctgatcgggaacgaggagtacaccgactacatgccctccatgaaacggttccgccgcgaggaagaggaggccggcgtcttgtggtga

SEQ ID NO: 24849 - RNA, 9876 nt, synthetic construct
  misc_feature 1..9876: note = derived and/or modified CDS sequence (opt11) from DENV-2__KX380813__SS-prME
  source 1..9876: mol_type = other RNA
acggcgggcatcatcatcatgatgatccccacggtcatggccttccacctgaccacccgcaacggggagccccacatgatcgtcagccgacaggagaagggcaagagcctcctattcaagaccgagaatggggtgaacatgtgcaccctgatggccatggaccttggcgagctgtgcgaagacaccataacctacaactgccccctgctccgccaaaacgagcccgaggacatcgactgttggtgcaattcaacttccacctgggtcacctacgggacgtgcaccgcaaccggcgagcaccggcgcgagaagcgtagcgtcgccctggtcccccacgtcggcatgggtctggagacccgcaccgagacctggatgtccagcgagggcgcctggaagcacgcccagagaatcgaaacgtggatcctccgccaccccggtttcaccatcatggcggccatcctggcctacacgataggcacaacttactttcagcgggtcctgatctttatcctcctgacggcggtgaccccttcaatggcgatgcgctgtatcggcatctctaaccgggactttgtggagggcgtttccgggggttcctgggtggacatcgtgctggagcatggatcgtgtgtaaccaccatggcgaagaacaagccgacactcgatttcgagctgattaagaccgaagccaagcaccttgccaccctcaggaagtactgtgtggaggcgaagctgacgaatacgaccacagcgagcaggtgccccacccagggcgagccaagtctgaacgaggaacaagacaaacgcttcgtgtgcaagcatagcatggtggaccggggttggggcaacggatgtggcctcttcgggaagggcgggatcgtgacgtgcgccatgttcacgtgcaaaaagaacatggaaggcaaagtagttcaacccgagaatctggagtacactatcgtgataacgccccattccggcgaggagaacgccgtggggaacgacacgggcaagcacgggaaggagatcaaggtcacccctcagagctccatcactgaggcggagttaacgggttacgggaccgtgaccatggaatgcagcccgcgaaccggcctcgacttcaacgagatggtgctgctgcagatggagaacaaggcctggctcgtccaccggcagtggttcctggacctgcccttgccctggctacccggagccgacacccagggatccaactggatccagaaggagaccctggtgacgttcaaaaacccgcacgcaaagaaacaggacgtcgtggtgcttggttcccaggagggggcaatgcacacggccttgacgggcgccaccgagatccagatgtcttccggcaacctcctatttacgggccatctcaagtgtcgcttacggatggacaagttacaactgaaaggcatgtcttactcgatgtgtacggggaagttcaaggtcgtcaaggagagcgcggagacccagcacggcaccatcgttatccgcgtccagtacgaaggggacggatccccatgcaagatccctttcgaaatcatggacctggagaagagacacgtgctggggaggctgatcacggtgaaccccatcgtaaccgagaaggacagcccggtgaacattgaggccgaaccgcccttcggggactcctacatcatcattggcgtcgaacccgggcagctgaagttgagctggtttaagaagggcagcagcatcgggcagatgttcgagaccaccatgcgtggtgccaagcgcatggccatcctgggcgacacagcctgggatttcgggtcactgggtggtgtcttcaccagcatcggcaaggcgcttcatcaagtgttcggtgccatctacggcgccgcgtttagcggggtgagctggaccatgaagatcctgatcggggtcgtgatcacctggatagggatgaattcccgctccacgagcctgagcgtgtccctggtccttgtcggggtggtgaccctgtacctgggcgtgatggtgcaggcggattctgggtgcgtcgtgagctggaagaacaaggagctcaaatgcgggtccggtatattcatcaccgataacgtgcacacgtggacggagcagtacaagttccagcccgagagcccaagcaagctggcgtcggccatacagaaggcacacgaagaggggatctgcggcatccggtcagttaccagattggagaacctcatgtggaagcaaatcacccccgaattaaatcatatcctgaccgagaacgaggtgaaattgacgatcatgacgggtgacattaagggcattatgcaggccgggaagcggactttgcgcccccagccgaccgaactgaagtacagctggaaggcttggggcaaggccaaaatgctttccacggagctgcataaccacacgttccttatcgacggtcccgagacggcggagtgccccaatacaaaccgggcctggaattcactcgaagttgaggactacgggtttggcgtcttcacgaccaatatctggctgaagctaaaggagcggcaggacgtattctgcgactccaagctcatgagcgccgcgataaaggacaaccgagccgtccacgcggacatggggtactggatcgaatccgccctgaacgatacctggaagattgagaaggcctcattcattgaggtcaaatcctgccactggcctaagagccacacactgtggtccaacggcgtgctcgagagcgagatgatcatccccaagaacttcgccgggccggtgtcccaacacaactaccgccccgggtaccacacccaaacagcgggcccgtggcacctggggcgactggaaatggacttcgacttctgcgagggcaccaccgttgtagtcactgaggattgcgggaaccggggccccagcctccgtacgaccacagccagtggcaagctgatcaccgagtggtgctgtcgctcatgcacgcttcctcccctccggtaccgcggggaggacggctgctggtacgggatggaaatcaggccgctgaaggaaaaggaagagaaccttgttaatagcctcgtgaccgccggccacggacaaattgacaacttctccctaggcgtgctgggcatggccctcttcctagaagaaatgctgcgcacccgggtcggaaccaagcacgccatcctgcttgtcgccgtcagcttcgttacgctgattaccggcaacatgtccttccgtgatttagggcgcgtgatggttatggtcggcgccaccatgaccgatgacatcgggatgggggtgacttatctggcgttactcgcggcattcaagatccggcccaccttcgccgccggcctcctgctcagaaagctgaccagcaaggagctgatgatgaccactatcgggatcgtgctcttatcccagagcaccatccccgagtccatcctggagctcaccgacgcgctcgctctgggcatgatggtcctcaagatcgtgcggaatatggagaagtaccagcttgcagtcaccatcatggccatactgtgcgtgcccaatgccgtgatcctccaaaatgcttggaaggtcagctgcacgactctggccgtggtgtccgtctcaccgctcctcctaacgtccagccagcagaaggctgactggataccgctggcgctcactattaaagggctcaatccgacggccatcttcctgaccaccctcagtcggaccagcaagaaacggagctggcccttgaacgaggcgatcatggccgtgggcatggtgagcatcctggcttcctcgctcctgaagaatgacatcccaatgacgggtcccctggtcgccggtggcctcctcacagtgtgttacgtcctgaccgggcgttcggccgacctcgaactggaacgggcggccgatgtccgctgggaggagcaggccgagatcagtggcagctcacccatcctgtccatcaccatatccgaggatggtagcatgtccatcaagaacgaggaggaagagcagaccctcaccatcctgatccggaccgggctgctcgtgatttcaggcttattccccgtgtccataccgatcacggcggccgcgtggtatctatgggaggtcaagaagcaacgcgccggagtactctgggacgtgccctctccgcctcccgtaggcaaagcggaactggaagatggagcctaccgtatcaaacagaagggcatcctggggtactcgcagattggcgccggcgtgtataaggagggcaccttccacacgatgtggcacgtgaccaggggcgcggttctcatgcataaggggaagaggattgagccaagctgggccgatgtcaagaaggacctgatctcctacggcgggggctggaagctggagggtgaatggaaggagggggaagaggtccaggtccttgccctggagcccgggaagaacccgcgcgcggtgcagaccaagcccgggctgtttaagactaatacgggcaccatcggggccgtaagtctcgatttttcccccggcactagcggctcccccatagtagacaagaaggggaaggtggtgggcctgtacgggaatggcgtcgtgacccggagcgggacgtacgtatccgctatcgctcaaacggaaaagtccatcgaagataacccggagatcgaggatgacatctttaggaagaagcggctgacgatcatggacttgcaccctggggcagggaagaccaagcgctacttacccgccatcgtccgggaggcgatcaaacgcggcctgcggacgctgatcttagcccccacgcgcgttgttgccgcggagatggaggaggctctgcggggactgccgatccggtaccagacccccgcaattcgcgccgagcacacgggtagagagattgtcgatctcatgtgccacgccacgttcactatgcgacttctgagcccaattcgggtacccaactacaacctgattatcatggacgaggctcattttacagacccggcctccatcgcagcccgcggatatatcagcacgagggtggagatgggcgaggccgcggggatcttcatgactgccacgccgcccggcagcagagaccctttcccgcagagtaacgcgccaatcatggacgaggaaaaagagatccccgagcgctcctggaacagcggccacgagtgggtcacagacttcaagggcaagactgtgtggttcgttcccagtataaaagccggtaatgacatcgccgcgtgcctgcgcaagaacggcaaaaaggtcatccaactgagccggaaaacgtttgactccgagtacatcaagaccagaacaaacgattgggacttcgtggtaaccacggacatcagcgagatgggcgcgaacttcaaggccgagcgagtcatcgatccgcgccggtgcatgaagcccgtgatccttaccgacggggaggagcgcgtgatcctggcgggcccaatgccggtcacgcactcatcagccgcacagcggcgcgggcgggtgggtcgcaaccctaagaacgaaaacgatcaatacatttacatgggggagcccctggaaaacgatgaagattgcgcacactggaaggaggccaagatgctccttgacaatatcaacaccccggagggcattatcccctccatgttcgaaccggagcgggagaaagtggacgccatcgacggggagtaccgactccgcggggaggcccggaagacttttgttgacctaatgcgccggggcgatctgcccgtgtggctggcctatcgcgtcgcggccgaggggataaactacgccgacaggcgctggtgtttcgacggcgtgaagaacaaccagatcctcgaggagaacgtggaggtcgagatttggaccaaggagggggagcggaagaagctcaagcctagatggctggacgcccggatctacagcgacccgctggccctgaaagagttcaaggagttcgcagcgggccggaagagtctgactctcaacctgattaccgagatgggccggctgcccacgttcatgacccagaaggctaagaacgccctcgacaacctggcagtactgcacacggccgaggccgggggacgagcctacaaccatgccctcagtgagcttccggagaccctggaaacgctcctgctgttaaccctgctggcaaccgtgaccggtgggatcttcctcttcctgatgagtggcaaggggatcggcaagatgaccctcgggatgtgctgcatcatcaccgccagcatcttgctgtggtacgctcagattcaaccccactggatcgcggcctccatcatcctggaattcttcctcatagtactgctgatcccggagcccgaaaagcagagaacgccccaggacaaccagcttacctacgtagtcatcgctatcctaacagtcgttgccgctactatggctaacgaaatgggctttctggagaagacaaagaaggacttcggtttgggcagcatcacgacccagcagccggagagcaacattttggacatcgacctgaggcccgcctccgcttggacgctctatgccgttgccacgacatttatcaccccaatgctgcgccactcgatcgagaactcctcggtaaatgtgagcctcacagccatcgcaaaccaggctacagtcctcatgggcctggggaaggggtggcccttaagcaagatggacatcggagtgcccctcctggcgattggatgctactcccaagtaaacccgattaccctgaccgccgccctcctattactcgtggcgcactacgctataatcggtcccgggctccaggccaaggccacgcgagaggcccaaaaacgggctgccgcgggcataatgaagaaccccaccgtcgacgggatgaccgtgatcgatctggaccccattccctacgaccccaaattcgagaagcagctcggccaggtgatgttgctagtcctctgcgtcacccaagtgcttatgatgcgcacgacgtgggcgctgtgcgaagccttaaccctggcgacgggccccatctcaacgctttgggagggcaaccccggacggttctggaacaccacgatcgccgtatccatggcgaacatcttccgcggaagctacctcgccggggccggactattattctccatcatgaagaacactgcaaacacgcgccggggcaccgggaacaccggcgagaccctcggagagaagtggaagaacagacttaacgcccttggcaagagtgagttccaaatttacaagaagtccgggatacaagaggtggacagaaccctcgccaaggaggggatcaagaggggcgaaaccgatcaccacgccgtgtcaagggggagtgctaagctgcggtggttcgttgagcgcaacctggtaaccccggagggcaaagttgtcgatctgggctgcgggcgcggcgggtggagctattactgcggcgggctgaagaacgtgaaggaagtgaaaggcctgaccaaaggcgggcccggccatgaggagccgatacccatgtctacatacgggtggaacctcgtccggctgcaaagcggcgtcgacgtgttcttcacctcccccgagaagtgcgacactctgctctgcgatatcggtgagtccagcccgaacccgaccgtagaggccggcagaaccctgcgagtgctgaacctcgtggagaattggctgaacaacaacacgcagttctgcatcaaggtcttaaacccttatatgccatccgtgatcgagaagatggaggccctgcaacgcaagtacggcggcgctctcgtgcgcaatcctttgagccgcaactctacacacgagatgtattgggtatcaaatgcctccggcaacatcgtgagctccgtgaacatgatcagccggatgctgatcaaccgattcaccatgcggcacaagaaagcgacgtacgagcccgatgtcgacttggggtccggcacgcgtaacatcggtatcgaaagcgagacgccgaacctagacataatcggaaagcggatagagaagataaagcaggagcacgagaccagctggcactacgatcaggaccacccctacaaaacgtgggcctaccacgggtcttacgagacgaagcagaccgggagtgccagctctatggtaaacggcgtggtccgcttactcacgaagccgtgggacgtgattccaatggtgacccagatggccatgacggatacaaccccgttcgggcagcaacgcgttttcaaagagaaagttgacacgcgtacgcaggaacccaaggagggcaccaagaagctgatgaaaatcaccgccgaatggctgtggaaggagctcggcaaaaagaagacgccacggatgtgcacccgggaggagttcacccgcaaggttcggagcaacgcggcactgggggccattttcaccgacgaaaataagtggaagtccgcacgcgaggcggtggaagatagcggcttctgggaactggtggacaaggagcggaacctccacctggaggggaagtgcgagacctgcgtatataatatgatgggcaagcgtgaaaagaagctaggggagttcggcaaggcgaagggttcccgagcgatatggtatatgtggctcggggcgcgattcctagagttcgaggcactgggcttcctcaacgaggatcactggttttctcgggagaacagcttatccggggtggaaggcgaagggctgcataagttgggctacatcttgcgcgacgtgagcaaaaaagagggcggggcgatgtacgccgacgatacagccggatgggacacaagaattactctggaggacctcaagaacgaggagatggtcaccaaccatatggagggggagcacaaaaagctggcggaggccatcttcaagctgacgtaccagaacaaggtggtgcgcgtccaacggcctaccccgcgcggcaccgttatggacattatctcccgtcgtgaccagcggggaagcgggcaggtggtcacctacggcctcaacacgttcaccaacatggaagcgcagctgatacgccagatggagggagagggcgtgttcaagtctatacagcagttaacggttaaggaggagatagccgttaaaaattggcttatccgggtggggagagagaggctgtcacggatggccatctcgggggacgactgtgtggtcaagcccctggatgaccgctttgccagcgctctaaccgctctgaacgacatgggcaaggtgagaaaggatatccagcagtgggagcccagccgcggatggaacgattggacccaggtgcccttctgttcacatcacttccacgagctcatcatgaaggacggacgggtcctcgtcgttccttgccgtaaccaggacgagcttatcggccgcgcccgcatttcgcagggggcagggtggagcctgcgagagaccgcctgtctcggaaagtcttacgcccagatgtggagtctgatgtatttccatcgtcgggacctgcgcctcgcggctaacgcaatatgctccgcggtccccagccattggattccgacctcccggactacttggagcatccatgccacgcacgagtggatgactaccgaggacatgctgaccgtgtggaatagagtgtggatccaggagaatccctggatggaggacaagacgccggtcgagagctgggaggaaatcccttacctgggcaagagggaggaccaatggtgtggatccctgatcggtcttacgagccgagctacctgggccaagaatatccaaaccgccattaaccaggtgcggtccctgatcggcaatgaggagtacacggactacatgccgagcatgaagaggttccggagggaggaggaagaggccggcgtgctctggtga

SEQ ID NO: 24850 - RNA, 9876 nt, synthetic construct
  misc_feature 1..9876: note = derived and/or modified CDS sequence (opt11) from DENV-2__KX380814__SS-prME
  source 1..9876: mol_type = other RNA
actgcgggcataatcatcatgatgattccgaccgttatggccttccacctcaccacccgcaacggtgagcctcacatgatcgtcagccggcaggagaagggaaagagcctcctgttcaagaccgagaacggcgtgaacatgtgtaccctcatggcgatggacctcggcgagctgtgcgaggacaccatcacctacaactgtcccctgctccgccagaacgagcctgaggacatcgactgctggtgtaactcaacctccacgtgggtgacatatgggacctgtaccgcaacgggtgagcaccggcgcgagaagaggagcgtcgccttggtgccccacgtgggcatgggtctggaaaccagaaccgaaacctggatgtcctccgagggcgcctggaaacacgcccagaggatcgagacatggatcctccgccatcccgggtttacaatcatggcggccattttggcctacacaatcggcaccacctacttccagcgggtcctgatcttcatccttctgacggccgtgaccccctccatggcgatgcggtgcattggaattagcaaccgggacttcgtagaaggcgtctccggcgggagttgggtcgacatcgtgctggaacacggctcctgcgttacgacaatggccaagaacaagccgactctcgacttcgagctcatcaagaccgaggccaagcacctggcaacactccgcaagtactgcgtggaggccaagctgaccaacaccaccactgccagtcggtgccccactcagggggaaccctcgctgaacgaggagcaggacaaacgcttcgtttgcaaacacagcatggtagacaggggctggggcaacgggtgcggcttgtttgggaagggagggattgtgacgtgcgcgatgttcacgtgcaagaagaacatggagggcaaggtggtccaaccggagaacctggagtataccatcgttatcacaccccactccggtgaggagaacgccgtggggaacgacacggggaaacacgggaaggaaattaaggtcacgccacagtcctccatcaccgaggccgagttgaccgggtacgggaccgtgacgatggagtgcagcccgcgcaccggattagacttcaacgaaatggtgttgctgcagatggagaacaaagcttggttagtccaccggcagtggtttctggaccttcccctcccctggttgcccggcgcggacacccaaggaagcaactggattcagaaggaaaccctagtgacgttcaagaacccgcatgccaaaaaacaggacgtcgtggtgctaggcagccaagaaggcgctatgcataccgccttgaccggcgcaacggaaatccagatgagctccggtaacctacttttcaccggccacctgaagtgccgcctgcgtatggacaagctccagctgaagggcatgagctactcgatgtgtaccggtaagttcaaggttgtcaaggagatagcggaaacccagcacggcaccattgtgatccgcgtccaatacgagggggacggaagcccctgcaaaatacccttcgagatcatggatctggaaaagcgacacgtcctcggccgcctgataacggtgaacccaatcgtcaccgaaaaggactcccctgttaacatcgaggccgaaccgcctttcggggacagctatataatcatcggcgtagagccagggcagcttaagctctcctggtttaagaagggcagctccatcgggcaaatgtttgagaccaccatgcgaggcgccaaacggatggctattctgggcgacacggcttgggacttcggaagcttgggcggcgtcttcacctccatcggcaaagccctccaccaagtgttcggggccatctatggcgccgccttcagcggcgtgtcctggactatgaagatcttaatcggagtcgtcatcacctggatcggcatgaatagtcgctccacgagcctgagtgtgagcctggtgctcgtgggggtggtcaccctgtatctgggcgtgatggtacaggcagactccggttgtgtcgtgtcatggaagaacaaggagctaaagtgcggaagcggaatcttcatcaccgacaacgtgcacacctggaccgagcagtacaaattccagccggagtcaccctcaaagctggccagcgctatccagaaggcccacgaggaagggatctgcggaattcggagcgtcaccaggctagagaacctcatgtggaagcagatcacgcccgagctgaaccacatcctgaccgagaacgaggtgaaactcaccattatgaccggggacatcaagggcatcatgcaggcggggaaacgtaccctgcgcccccaaccaaccgagctgaaatacagctggaaggcttgggggaaggccaagatgttgagcactgagctgcacaaccataccttcctgatcgatggccccgaaacagccgagtgccccaacaccaatcgtgcctggaatagtctcgaggtggaggactacgggtttggcgtcttcacgacgaacatctggctgaagctgaaggagcgccaggatgtgttctgtgacagcaagttgatgagcgccgccataaaggacaatcgagcagttcacgcagacatggggtactggattgaaagcgccctgaacgacacctggaagattgagaaggcaagttttatcgaggtaaaatcttgccactggccgaagagtcacaccctgtggtcgaacggtgtgctcgaatctgagatgatcatcccaaagaatttcgcgggccccgtaagccagcacaactaccgccccgggtaccacacccaaacggccggcccttggcacctggggcggcttgagatggactttgacttctgcgagggcaccaccgtcgtggtaaccgaggactgcgggaaccgtgggccgtccctgcggacgactaccgccagcgggaagctgatcaccgagtggtgctgccgctcttgcacgctaccgcccctccgataccgcggggaggatggttgctggtacgggatggagatccggccgctgaaggagaaggaggaaaaccttgtcaactccctagtcaccgccggtcacggacagatcgataacttcagcctgggcgtgttaggtatggctctatttctggaggagatgctgcggacccgggtcgggactaagcatgcaatcctcctcgtggccgtgtcctttgtcacactgataactggtaatatgtctttccgcgatctcggtcgagtgatggtgatggtcggcgctaccatgaccgacgacatcgggatgggcgtgacgtacctggccctcctcgcggcttttaaaatccggcccacctttgccgcaggccttttacttcgcaagctgacttccaaggagttgatgatgaccacgatcggcatagtgctcctgtcgcaatcgacaattcccgagtctatattagaactcaccgacgccctggccttaggcatgatggttctcaaaatcgtgcggaacatggagaagtatcagttggccgttaccatcatggccatcctttgcgtgcccaacgcggtgatcctccagaacgcctggaaggtatcctgcacgacccttgcggtggtgtcagtttcccctctgctcctaaccagcagtcaacaaaaggccgactggatccctctggccctcaccatcaaggggctgaaccccacggccatcttcttgaccaccctcagccgcacctccaagaagcggagctggcccctgaacgaagcgattatggcagtgggcatggtgtccatcctggcctcctccctcctgaaaaatgatataccgatgacgggccccctggtcgccgggggcctcctgaccgtttgctacgtactgaccggacgctcagcggacctcgagctggagcgggcggccgatgtgcgatgggaggaacaggcagagatcagcggctcctccccgatcctgtccatcacgatcagcgaggacgggtccatgtcaattaagaacgaggaggaggaacagacgttaaccatcctgatccggacaggcttgctggtaatctcaggtctgttccccgtgagcatcccgatcaccgcggctgcgtggtacttgtgggaagtaaagaaacagcgcgcgggggtgttatgggatgtcccctctcccccgcccgtaggcaaggctgagctggaagacggggcctaccgtatcaagcagaaaggaatcctaggttattcccagatcggagccggcgtgtacaaggaggggacattccacaccatgtggcacgtgaccaggggcgcggtcctgatgcacaaagggaagcggatagagccctcctgggcggacgtgaagaaggacctgatcagctacggcggaggctggaagctggagggcgagtggaaggaaggggaggaggtacaggtcttagccctggagcctggcaagaatccgcgtgccgtacagaccaagcccggtctgttcaagacaaacacgggcaccatcggggccgtctcgctagacttttcacccgggacatccgggagccccatcgtcgataagaaagggaaggtggtgggcctgtacgggaacggagttgtcaccaggagtggcacttacgtgtcagcgatcgcccagacggaaaagtcaatcgaggacaacccggaaatcgaggacgacatcttccgcaagaaaagactgaccatcatggacctgcaccccggggcaggcaagaccaagcgctacctcccggccattgtccgtgaagcgatcaagcgcgggctacggacactgatcctcgcccccacccgcgttgtggccgccgagatggaggaggcactgcgcggactgccgatccggtaccagacccccgcgatccgcgccgagcacaccggacgggagattgtagacctcatgtgccacgcaacgttcaccatgcgcctgctgagtcccatccgggtgcctaattacaacctcatcatcatggacgaggcccacttcacggaccctgcctctatagcggccagaggctatatctctacccgggtcgaaatgggcgaggccgccgggatcttcatgacggccaccccgcccggcagccgcgaccctttcccgcaatccaacgcgcccatcatggatgaggaaaaggagatccccgagcggagttggaattcggggcacgaatgggtcaccgacttcaagggcaagacagtgtggttcgtgcccagcatcaaggccgggaacgacatcgcagcctgcctgcgcaagaacggcaagaaggtaatccagctatcccgtaagacgttcgactcggagtacatcaagacccgcaccaacgactgggacttcgtggtgaccacggacatatccgagatgggcgctaacttcaaggcggaacgggtaatcgacccgcgccggtgcatgaagcccgtgatcctcaccgacggggaggaacgcgtgatccttgcgggccccatgccggtcacccactcatccgccgcccagcgccgcgggcgggtaggccgaaacccgaagaacgagaacgatcagtacatctacatgggcgaaccccttgagaacgacgaggactgcgcgcattggaaggaggccaagatgctcctggacaacatcaacacacccgagggcatcatccccagcatgttcgagccggagcgcgagaaggttgacgccatcgacggcgagtaccggctgcgcggggaggcccggaagacgttcgtcgacctaatgcgacggggggacctgcccgtatggctggcctacagagttgcggccgagggaatcaattacgccgaccggcgctggtgcttcgacggcgtgaagaacaaccagatcttggaggagaacgtggaggtagagatctggaccaaggagggggagcggaagaagctcaagccccgttggctggacgcccggatctactccgacccgctcgccctgaaggagtttaaggagttcgcggccggccgcaagtcgctgaccctcaacttaatcaccgagatgggccggctgcccacattcatgacacaaaaggccaaaaacgccctcgacaatctggcggttctgcacaccgcggaggccgggggccgcgcctacaaccacgccctcagcgagctgcctgagacactagagacgctcctgttgctcaccctgctggcgaccgtcactgggggcatcttcctcttcctgatgagcggcaaagggatcggcaagatgactctggggatgtgttgcatcatcacagcatcaatactgctgtggtacgcccagatccagccccactggattgccgccagcatcatcctggagttctttctaatcgtcctgcttatcccggagcccgaaaaacagcgtacgccccaagacaaccagctcacctatgtggttatcgctatcctgactgttgtggcggccactatggccaacgaaatgggctttttagagaagacgaaaaaagactttgggctcggatctatcaccacccagcagcccgagagcaatatactggacatcgacctgagaccggccagcgcgtggacgctatacgccgttgccaccaccttcattaccccaatgctgcggcactcgatcgaaaacagttccgtcaacgtgagcctgacggccatcgccaaccaggcgaccgttttgatgggtctggggaagggctggcccctgtccaagatggacatcggggtccccctcctagccatcggttgctactcacaggtaaacccaataaccctgactgccgcgctcctgctgttggtggcgcactacgccatcatcggtcccggcctgcaggccaaggccacgcgcgaggcccagaagcgggcagcagccgggatcatgaagaacccgaccgttgatggtatgaccgtcatcgacctggaccccatcccctatgatcccaagttcgaaaagcaactcggacaggttatgctcctagtcctctgcgtgacccaggtgctgatgatgcgcacaacttgggccctgtgcgaagccctcaccctcgcaaccgggcccatctccacgctgtgggagggcaatccgggcagattctggaacaccacgatcgcggtgagcatggctaacatcttcagaggctcctacctcgccggcgccgggctgttgttcagcatcatgaagaacaccgctaacacgcgccggggcaccggtaacaccggtgagaccctcggcgaaaaatggaagaaccgcctcaacgcgcttgggaagtccgagttccagatatacaaaaagtccggcatccaagaggtggaccggacgttagcgaaggaggggatcaagcggggagagacagaccaccatgcagtaagccgggggtcagccaagctgaggtggttcgtcgagcgaaacttagtgaccccggagggaaaagtggtcgacctgggctgcggtcgcggggggtggtcgtactactgcggcgggctgaagaacgtgaaagaggtaaaggggctgaccaagggggggcccgggcatgaggagccaatcccgatgagcacgtacgggtggaacttagtgcggctgcaatccggagtggatgtcttcttcacaagtccggagaagtgcgataccctgctctgcgacatcggggagagctcgcccaaccccaccgtggaggccggccgcactctgcgggtgctcaacctcgtggaaaactggctgaacaataacacgcagttctgcattaaggtccttaacccctacatgccgtccgtgatcgagaagatggaggccctgcaacgcaagtacggcggggccctcgtgcggaaccccctgtcccgcaacagcacacacgaaatgtactgggtgtccaacgcatcgggaaatatagtgtccagcgtgaacatgatctcccggatgcttatcaaccgctttaccatgaggcacaagaaggcgacctacgagcccgacgtcgacttgggcagcggcacgcgcaacatcggaatcgaatccgagaccccgaacctggatatcatcggcaagcgaatcgagaagattaagcaggagcacgagacctcctggcattacgaccaggatcacccctacaagacctgggcgtatcatggctcctatgagacgaaacagacaggaagcgcctccagcatggtcaacggggtggtccgcctgctaacgaagccctgggatgtgatacccatggtgacacagatggccatgacggacaccacgcctttcggtcagcagcgcgtctttaaggagaaggttgatacgcggacgcaagagcccaaagaaggcacgaaaaaactcatgaagatcacagccgagtggctgtggaaggagctcggcaagaagaaaacgccccggatgtgtacgcgagaagagttcacccgcaaggtccggtccaacgcggccctgggcgccatctttaccgacgagaacaaatggaagtccgcacgcgaggccgtggaggatagcggtttctgggagctggtcgacaaggagcggaacctccatctcgaagggaagtgcgaaacctgcgtgtacaacatgatgggcaagcgcgagaagaagctgggggagttcgggaaggcgaagggaagccgggccatctggtacatgtggctcggcgcccgcttcctcgagttcgaggctttaggcttccttaacgaggaccactggttctcccgggaaaacagcctgagcggggtggaaggcgagggtcttcacaagctcggctatatcctcagagacgtgtccaagaaggagggcggagctatgtacgccgacgacacggccggctgggacaccagaatcactttggaggacctgaagaacgaggagatggtcacgaaccatatggagggagagcataagaaactggctgaggccattttcaagctgacttaccagaacaaggtagtgcgcgtccagcggcccacccctaggggcacggtcatggacatcataagcaggcgcgaccagcggggttccggacaagtggtcacctacggtctcaacacgttcactaacatggaggcccagctgatccggcagatggagggggagggcgtgttcaagtcaatacagcagctaaccgtgaaggaagagatcgccgtgaaaaattggctcatccgggtcgggcgagagcgcctgtcccggatggccatcagcggtgacgactgcgtggtcaagcccctggacgaccgcttcgcctccgctctcaccgcgcttaacgacatgggcaaggtgcgaaaggatatccagcagtgggagccctcccgcgggtggaacgattggacccaagtgcccttctgctctcaccatttccacgaacttatcatgaaagacggccgggtcctcgtagtgccctgtcgcaatcaagacgagctgatcggacgggcccggatctcccagggcgccgggtggtccctgcgtgagaccgcatgcctcggcaagagctacgcacaaatgtggtccctaatgtacttccaccgccgggacctgagactcgcagccaacgccatctgcagcgccgtcccatcccactggattcccaccagccggaccacctggtccatccatgctacccacgaatggatgaccaccgaggacatgctgaccgtatggaaccgcgtatggatccaggaaaacccctggatggaggacaagacgccagttgaatcgtgggaggagatcccgtatctgggcaagcgtgaggatcagtggtgcggatctctcatcgggcttacctcacgagcgacatgggccaagaacatccagaccgccattaaccaagtgcggagcttaatcgggaacgaggagtacacggactacatgccctccatgaaacgcttccgtcgcgaggaggaagaggccggcgtgctctggtag

SEQ ID NO: 24851 - RNA, 9876 nt, synthetic construct
  misc_feature 1..9876: note = derived and/or modified CDS sequence (opt11) from DENV-2__KX380807__SS-prME
  source 1..9876: mol_type = other RNA
actgcaggcatcattatcatgatgattccgacagtcatggcgttccatctgactacccggaacggggagcctcacatgatcgtcagccggcaggagaagggcaagagcctcctttttaagaccgagaacggggtgaacatgtgtacgttaatggccatggacctcggcgagttgtgtgaagataccatcacttacaactgtcccctgctccggcagaacgagcccgaggacattgactgctggtgcaacagcaccagcacttgggtgacgtacgggacatgcactgctaccggcgagcaccggcgggaaaagcgaagcgtagccctggcgccccacgtcggcatgggtctggagacgcggactgagacctggatgtcctcagaaggcgcctggaaacacgcgcaacggattgagatctgggtgttgcgccatcccgggttcaccatcatggctgccatactggcctacacgatcggcaccacctacttccagcgggttctgatcttcatattgctgacagcggtggctccctccatgacgatgagatgtatagggatcagcaacagagatttcgttgagggcgtgtccggcgggagctgggtggacatcgtcctggaacacggctcctgcgtcaccaccatggccaagaacaagcccaccctcgacttcgagctgatcaagacggaggcaaagcaccctgccacccttcgcaagtattgcatcgaggcaaagctcactaacaccacgactgcgagccggtgcccgacccagggcgaaccctcccttaacgaggagcaggacaagcgtttcgtgtgcaagcattccatggtggaccggggctggggcaatgggtgtggtctgttcggtaagggagggatcgtaacctgcgcgatgtttacttgcaagaaaaacatggaaggcaagatcgtgcagcccgagaacctcgaatacactatcgtcattacaccccactccggcgaagagaatgctgtcgggaacgataccggcaagcacgggaaagagatcaaggtgaccccgcaatcatccatcaccgaggcggagttaaccgggtacggcacagtcacgatggagtgcagcccccgaactggcctggactttaacgagatggttctcctgcagatggaaaacaaggcgtggctggtccacaggcagtggttcttagacctgcccctgccgtggctcccaggcgccgacacccaggggtccaattggattcaaaaggaaacgctggtgaccttcaagaacccccacgccaagaagcaggacgtagtggtcctggggagccaggagggggccatgcacacggccctcaccggagcaacagagatccagatgagctccgggaacctgctgttcaccggccacctcaagtgccgcttacggatggataagctgcagctcaaaggcatgagctattctatgtgcacggggaaattcaaggttgtgaaggaaatcgccgagacgcagcatggtaccatagtaattcgcgtacagtacgagggcgatggctcgccctgcaagatccctttcgagatcatggacctcgaaaagcgtcacgtgctgggccgactcattacggtcaatccgatcgtgacagagaaggattcacccgtgaacatcgaggcggagccgccctttggggactcatacatcatcatcggtgtcgagccggggcagctgaagttatcttggttcaagaagggctcatccatcggtcagatgttcgagacaaccatgcgcggagcaaaacgcatggcaatactcggtgacaccgcgtgggactttggtagcctcggcggggtcttcacgagcatcggtaaggccttgcaccaagtgttcggggccatatacggggccgcgttttcaggcgtatcctggaccatgaaaatcctcatcggggtcgtaatcacctggatcggaatgaacagccgcagtacctcgttgtccgtctcattagtgctggttggtgtcgtgacgttatacctgggcgtgatggtccaggccgactcggggtgcgtggtgagctggaagaacaaggagctgaaatgcggctccggcatcttcatcaccgacaacgtccacacctggaccgagcagtacaagtttcaacccgagtccccttccaagctcgcctccgcaatacaaaaggcccacgaagaggggatttgcggaatccggagcgtgacgagattggagaacctgatgtggaaacagattacccccgagctcaatcacatcctgtccgaaaacgaagtgaagttaacaatcatgacgggggatatcaagggcatcatgcaagcgggtaaacggtccctccgcccgcagcctacggagctaaagtactcctggaaagcctggggtaaggccaaaatgttgtccacagagctccacaaccacaccttcctgatagatggaccggaaaccgctgagtgtccgaacacgaaccgggcctggaactccctggaggttgaggactacgggttcggcgtgttcacaaccaacatctggctcaagttaaaggagcgccaggatgtattctgcgatagtaagctgatgagcgcggctattaaagataaccgggccgtccacgcggacatgggctactggatcgagagcgccttgaacgatacctggaaaatcgaaaaagcgtccttcatcgaggtaaagagctgccactggcccaagtcccacactctttggtctaacggcgtgctggagtcagaaatgatcatacccaaaaacttcgcaggcccagtcagtcaacataactaccgcccggggtaccacacacagaccgccggcccctggcaccttgggcggctagagatggacttcgacttctgcgaaggcaccaccgtcgtggttacggaagactgcggtaaccgcgggccctcactgcggaccactaccgcctcaggcaagctcataacggagtggtgctgccgcagctgcacgctacccccgctgagataccgcggggaggacggctgttggtacggcatggagatccggcccctcaaggagaaggaagaaaacctggtaaactccctggtgaccgcgggccacggtcagatagacaacttttcactcggcgtactgggaatggccttattcctcgaggaaatgctccgcacccgggtggggacgaagcatgccatcctgttggtagcggtctccttcgtgacccttatcaccggcaacatgagtttccgcgacctgggacgcgttatggtcatggttggcgctacgatgacggataacatcgggatgggtgtgacttacctcgcgttgcttgccgccttcaaagtccggcccaccttcgcagccgggctactgctgcgcaagttaacttccaaggagctgatgatgacgacgatcgggattgttctgctatcccagtctaccatcccagaaaccatcttagagttgacggatgcgctcgctttgggcatgatggtgctgaagatcgtcagaaatatggaaaagtatcagctcgccgtgacaataatggccatcctgtgtgtacctaatgctgtgatcctgcagaacgcgtggaaggtcagctgcactatcctagcggtcgtttctgtgagccctttgctgctgacttccagccagcagaaagccgactggatccccctggcccttactatcaaggggctcaatccaacggcgatctttctgaccaccctgagccgcacgtccaagaagcggtcgtggccgctcaacgaggccatcatggccgtcgggatggtgagtatcttggcatcctcattactaaagaacgacatcccgatgacggggcccctggtggccgggggcctgttgaccgtctgctacgtcctgacaggtagaagcgctgacctggaattagaaagggcggcggacgtgagatgggaggaacaggccgagatctccggcagctcccccatcctaagcatcacgatcagtgaggacggctcgatgtcaatcaagaacgaggaagaggagcagacactcaccatcctcatccggaccggcctcctggtcatctccggcttgttcccggtgtccattcccataacggccgcggcctggtacctgtgggaggtgaagaagcagcgagctggggttctgtgggacgtccccagcccgccgcccgtaggcaaagccgaacttgaggacggggcttaccggatcaagcagaagggcatcctcggttactcccagatcggcgctggcgtctacaaggaggggaccttccacaccatgtggcacgtaacccgcggagccgtgctgatgcacaaggggaagcgcatcgagcccagctgggcagacgtgaagaaggacctcatctcttatggcgggggctggaagctggagggcgagtggaaagagggggaagaggtccaggtattagccttggaacccggcaagaacccccgcgccgtacagaccaaaccagggctgttcaaaactaacaccggcaccatcggggccgtcagcctggacttctcccccggcaccagtggtagccccattgtggacaagaaggggaaggtcgtcggcctctacggcaacggcgtggtcacgcggagcggcacctacgtgtccgccatcgcgcagaccgaaaagtccatcgaggacaaccccgagatcgaggacgacatattccgcaaaaagcggttaaccatcatggacctgcacccaggggccggtaaaacgaagcgctacctgcccgcgattgtgcgcgaggccataaagcgcggactccggaccctgattctggcaccgacccgcgtcgtggccgccgagatggaggaggctctccgtggcctaccgattcggtaccagacccccgccatccgcgccgagcacacggggagggagatagtggacctgatgtgccacgccacattcacaatgcgcctcctcagtccgatccgggtaccaaactataacctgatcattatggatgaagcccattttaccgaccccgcgtccattgccgcccgcggctacataagcaccagggtcgagatgggcgaggcagccggtatcttcatgaccgcgacgccgcctggctcacgcgaccccttcccccaaagcaacgctccgattatggacgaagaaagagagatacccgagcgctcctggaacagcggccacgagtgggttaccgattttaagggcaagactgtgtggttcgtgccgtcaatcaaggccggtaacgacatagccgcgtgcctccggaagaacggcaagaaggttatccaactaagccgcaagacattcgactccgagtacatcaaaacccgtaccaatgactgggattttgtcgtgacaacggacatcagcgagatgggcgccaacttcaaagcagaaagagtcattgaccctcggcgctgcatgaagcccgtcatcctgactgacggggaagaacgggtgatactggccggccccatgcccgtgacccactccagcgcagctcaacgccgggggcgcgtcggccgcaaccccaaaaatgaaaacgaccagtacatctacatgggggagcccttagagaacgacgaggactgcgcccactggaaggaggctaagatgctgctcgataacatcaacacgcccgaggggatcatcccttccatgttcgagcccgagcgcgagaaggtggacgcggttgacggcgagtaccgcctgcggggcgaggcccgcaaaacattcgtcgacctcatgaggcggggcgacctcccggtgtggctggcgtacaaggtcgccgccgaagggataaactacgccgaccggcgctggtgcttcgacggcgtgaagaacaaccagatattagaggaaaatgtcgaggtagagatctggaccaaagagggcgagaggaagaagctcaaacctaggtggcttgatgcccgaatctatagtgaccccttagctctcaaggagttcaaagagttcgccgcggggcgcaagtccctgacccttaacctcatcacggagatgggccgcttgcctaccttcatgacccagaaggcccgaaacgcgctggacaacctcgcagtgctgcacaccgccgaagccgggggccgggcgtacaaccacgcgctgagcgagcttccggagacgctggaaaccctactcctgttaactctcctggccaccgtgacaggcggtatttttctgtttcttatgtccggaaaggggatcggaaagatgaccctggggatgtgctgcatcatcacggcaagcattctgttatggtacgcccagatccagccgcactggatcgccgcatcaatcatactggagttcttcctgatcgtactcctgatacccgagcccgagaagcagcgcacgccccaggataaccagctgacgtacgtggttatcgccatcctgacggtcgtggctgcaactatggccaacgagatgggctttctggagaagaccaagaaggacttcgggttgggcagtatcaccactcagcagccggagtcaaacatcctcgacatcgacctgcggccggcttcggcctggaccctatacgccgtggcaaccaccttcatcacacccatgctccgccactccattgagaactccagcgtcaacgtgtcactgaccgcaatcgcgaatcaggccaccgtgctcatgggcctcggaaagggctggcccctcagcaagatggacatcggtgtccccctgttagccatcggctgctactcccaggtgaaccccattaccctgacggctgctctactcttattagtggcccactacgcgatcattgggccgggactccaggctaaggccacgcgggaggcgcagaagcgcaccgccgccggaatcatgaaaatcccggccgctctaatcgtcaccgtgatcgacctggacccgatcccctacgaccccaaattcgagaagcaattgggccaggtgatgctgctggtgctctgtagcacccaggtgcttatgatgaggaccacctgggcgttatgcgaagccttgaccctggccacggggcccatcagtaccctctgggaggggaacccgggccgcttctggaacaccaccatcgccgtgagcatggccaacatcttccgggggtcatacctcgcgggcgcgggcctactcttctcaatcatgaagaacacggccaataccaggcgtggtaccggcaacaccggggagacgctcggggagaaatggaagaaccgactgaacgcgctgggcaagtcggagttccagatctataagaaatcagggatacaggaggttgatcgcaccctcgcaaaggagggcataaagcgcggggagactgatcaccacgccgtatccagaggctcggccaagctgagatggttcgtggagcgcaacctggtcaccccagaggggaaggttgtggacctaggctgcggccgcggcgggtggtcctactactgcggcgggctcaagaacgtcaaagaagtaaaggggttaacgaaaggagggcccgggcacgaggagcccattccgatgagcacctatggatggaacctcgtgcggttgcagtccggggtcgacgtgttcttcacgccgcctgagaaatgcgacaccctgctctgcgacattggcgagagcagccccaacccgacggtggaggcggggcggaccctgcgcgtcctaactctcgttgagaactggctgaacaacaacacccagttctgtataaaggttctcaacccctacatgccctccgtcattgagaagatggaagccctgcagcggaagtatgggggcgctctcgtgcgtaacccgctcagccggaactccacgcatgagatgtactgggtgagcaacgcctccgggaacatcgtgagcagtgtgaatatgatatcacgcatgctgatcaaccggttcacgatgaggcacaagaaggcgacctacgagcccgacgtggacttaggctcggggacccggaatatcggtatcgagagcgagacccccaatctcgatattatcgggaagcgcatcgagaagattaagcaggagcacgaaacgtcttggcactatgaccaggatcacccctataagacctgggcctaccacggcagctatgagaccaaacagaccggttctgccagctctatggtcaatggggttgtgcgcttactcacaaagccatgggacgtcatccccatggtcactcagatggcgatgacggacactacgcctttcggacaacaacgagtgttcaaggaaaaggtcgacacccgcacccaggagcccaaggaggggaccaagaaactgatgaaaatcacggccgagtggctatggaaggagctaggcaagaagaagactcctcgcatgtgcaccagagaagagttcacccggaaggtgcgatcaaatgccgcactgggcgcgatctttactgacgagaataagtggaaaagcgcacgggaggctgtcgaagacagcgggttctgggagctggtcgacaaggaacgcaacctccacctggagggcaagtgcgagacatgcgtatacaacatgatggggaagcgggagaagaagttgggcgagtttggtaaggccaagggctcccgcgccatctggtatatgtggctgggtgcacggttcctggagttcgaggccctcgggttcttaaacgaggaccactggttctcccgcgagaactccctttccggcgtcgagggagaaggcctgcacaaattagggtacatcctgcgggacgtgtcgaagaaggagggcggagccatgtacgccgacgacaccgctggatgggacacacggatcacgttggaggacctcaaaaacgaggagatggtcactaaccacatggagggcgagcataagaaacttgcggaggccatcttcaaactgacttatcagaacaaagtagttagagtccagcgacccacgccccgagggacagtcatggacatcatctctcggcgggaccagcgtggaagcggccaagttgtgacgtacggcctcaacacgttcaccaacatggaggcccagctgatccggcagatggaaggagagggagtcttcaagtcgatacagcaactgaccgccaccgaggagatcgccgtgaagaactggttagtacgcgtcggccgcgagcgtctgagcaggatggcgatctccggtgacgactgcgtcgtgaagcccctggacgacaggtttgccagcgcgctcaccgcattgaacgatatgggcaaggtacgcaaggacattcagcaatgggagccgtcccggggttggaacgactggacccaggtgccattctgctcccaccacttccatgagcttatcatgaaggatggccgcgtgctcgtcgtgccctgcagaaaccaggatgagctgatcggccgcgcccggatctcccagggggcgggatggagcctgcgagagacggcctgtctcggtaaaagctatgcccagatgtggtcattgatgtacttccaccggagagacctccggctcgccgccaacgctatttgctccgctgtaccgagccactgggtacctaccagtcgcactacttggtcaattcatgccacacacgaatggatgaccaccgaggacatgctgaccgtctggaatcgggtgtggatacaagagaacccctggatggaggataaaaccccggtcgagagctgggaggagatcccgtacctgggcaagcgcgaggaccagtggtgcggctccctcatcgggctaactagccgtgctacttgggcgaaaaacatacagactgccattaaccaggtgcgttccctgatcggcaacgaggaatacaccgactacatgccgagcatgaagcggttcaggcgggaagaggaggaggcaggggtcctctggtaa

SEQ ID NO: 24852 - RNA, 9876 nt, synthetic construct
  misc_feature 1..9876: note = derived and/or modified CDS sequence (opt11) from DENV-2__KX380815__SS-prME
  source 1..9876: mol_type = other RNA
actgccgggatcatcatcatgatgatacccaccgtgatggccttccacctaactaccaggaacggggaacctcacatgatcgtcagccggcaggaaaagggcaagagtctcctatttaaaactgagaatggcgtcaacatgtgcacccttatggcgatggacctcggggagctttgcgaggacaccattacctacaactgccccctgctccggcagaacgagccggaggacatcgactgctggtgcaatagcacgtccacatgggtgacctatggcacctgcaccgcaaccggagagcaccggcgggagaagcggagcgtcgccctggtgccccacgtgggcatggggttagagactaggaccgaaacctggatgtccagcgagggcgcctggaagcacgcccagcggatcgagacctgggtcctgcgccacccgggattcacgatcatggccgccatcctggcctacacaatcggcaccacctactttcaacgggtgctgatattcatattgttaacggcggtggcgccgtccatgaccatgagatgcatcgggataagcaaccgggacttcgtagaaggcgtgagcggcggctcttgggtggacatcgtccttgagcacgggtcttgcgtgacaaccatggccaagaacaaaccaactctagacttcgaactgatcaaaaccgaagccaagcaccccgccaccctgcgcaagtactgcatcgaggcaaagcttaccaacaccaccaccgcgagccgctgcccgacacagggagaaccctccctgaacgaggagcaggacaagcgcttcgtgtgcaaacactcaatggtcgacaggggctggggaaacgggtgcgggctgttcgggaagggcgggattgtaacgtgcgccatgttcacgtgcaagaagaacatggaggggaaaatcgtgcagcccgagaacctcgagtataccatcgtcataactccccactccggcgaggaaaacgccgtggggaacgacacgggcaagcatgggaaggagatcaaggtaaccccgcagagctccatcaccgaagccgagctaacgggctacgggacggtcaccatggagtgcagcccccgcaccggcctggactttaacgagatggtactcctccagatggaaaacaaggcctggcttgtgcatagacagtggttcctcgacctgccactgccctggttaccgggcgcggacacccaggggtccaactggatccaaaaggagaccctggtcacgttcaaaaacccccacgccaagaagcaagacgttgtagtattaggctcacaggaaggcgccatgcacactgctcttaccggcgcgaccgagatccagatgtccagcgggaacctgcttttcacgggtcacctcaagtgccgactgcgaatggacaagctccagttaaaaggcatgtcgtactccatgtgcaccgggaaattcaaagtggtgaaagagatcgcggagacccagcacggcacaattgtgatccgggtacagtacgaaggggacggcagcccctgcaagattcccttcgagatcatggatctggagaagcggcacgtcctgggccgcctcatcacggtaaacccaatcgtgaccgaaaaggactcccccgtcaacatcgaggcagagccgcccttcggtgacagctacattatcattggcgtcgagccggggcagctgaagctgtcctggttcaagaagggcagctccatcgggcaaatgttcgaaaccaccatgcgcggcgccaaacggatggccattctcggagacacagcctgggacttcggtagcctcggcggagtgttcacctccatcggaaaggcgctgcaccaggtcttcggggccatctacggtgccgccttcagcggcgtctcatggaccatgaagatcctgataggtgtggtcataacctggatcggcatgaacagtcggtcgacgagcctgtccgtcagcttggtgctggtcggggtggtgacgctttacctgggtgttatggtgcaggcggactccgggtgcgtggtcagctggaagaataaggagctgaagtgcggcagcgggatcttcatcaccgataacgtgcatacctggaccgaacagtacaaattccagccagagtctccctcgaagcttgcatccgccatccagaaggcacacgaagaggggatctgcgggatccggtcggtgaccagattggaaaatctgatgtggaagcagatcacgcccgagttgaaccacatattgaccgagaacgaagttaagctgacgataatgaccggggacatcaagggcatcatgcaggctggaaaacggtccctccgccctcagccaaccgagttgaagtacagctggaaggcgtggggaaaggcaaaaatgctgtctaccgagctccacaatcatacgtttctgatcgatggcccggaaaccgctgagtgcccgaacaccaacagagcctggaactcactggaggtagaggactacggtttcggagtgttcaccacgaacatctggcttaagctcaaggagcgtcaggacgtctcctgtgacagcaagctaatgtccgcggcgatcaaggacaaccgggccgtgcacgctgacatgggctactggatcgaaagcgccctgaatgacacatggaagatcgagaaggccagtttcatagaggtcaagtcgtgccattggcctaagtcccacaccctgtggagcaacggcgtcctggagtccgagatgatcatccctaagaatttcgcgggacccgtgagccagcacaactaccgcccggggtatcacacccagaccgcaggcccctggcatctcggacggctggagatggactttgacttctgtgagggcacgaccgtcgtcgtgacggaggactgcggaaaccgcggccccagcctgagaaccacgaccgcttccgggaaactcatcaccgagtggtgctgtcgcagctgtaccctccccccgctgcggtaccgaggggaagacggttgctggtacgggatggaaatcagacccctcaaggagaaggaggagaatcttgtgaattcccttgtcacggccggccatggccagatcgacaatttctcactcggggtcctaggcatggcgctgtttctcgaagagatgctgaggacccgggtggggaccaagcacgccatcttgcttgtcgccgtatcttttgtcaccctgatcacaggtaatatgagcttccgcgatctgggacgcgtcatggtaatggtgggcgccaccatgaccgacgacattgggatgggcgtcacttacctcgccctgctggcggccttcaaggttcggcccacattcgcggcaggcttactgctgcgcaagctcacgagcaaggaactgatgatgacaaccatcgggatagtgttgctcagccagagtaccataccggagaccatccttgaactgaccgacgccttagcgctgggcatgatggtcctgaaaatcgtgcgtaacatggagaagtaccaactcgcagtcaccataatggcaattctgtgcgtgccgaacgctgtgatcctgcagaacgcctggaaagtcagctgcacgaccctggccgtggtgtccgtctcgcccttactcctaacctcgagtcaacaaaagacggactggatacccctggccctgacgatcaaagggcttaaccccaccgccatcttcttaaccactctttcccgaaccagcaagaagcggtcctggcccttgaacgaggcgatcatggcagtgggtatggtcagcatcctggcttcctctttcctgaaaaacgacatccccatgacaggccccctcgtagctggggggctgctgacggtgtgctacgtgctcaccgggcggagcgccgacttagagctggagcgggccgccgacattcggtgggaagagcaggccgaaatctcgggcagttccccgatcctctccatcacgatctccgaggatgggagcatgtccattaagaacgaggaggaggagcagacattaaccatccttatccggaccgggctcctggtcattagcggcctgtttcctgtgagcatccccatcaccgccgccgcctggtacttatgggaggtgaagaagcagcgtgcgggggtcttgtgggacgtccccagcccgcctcccgtcggcaaggccgagctggaagacggggcctaccggataaagcagaagggcatcctcggttactcccagatcggcgccggagtctacaaggaggggacgtttcacactatgtggcacgtgactcgcggcgccgtgctgatgcacaagggcaagcgtatcgagcccagctgggcggacgtcaagaaagacctgatctcctacggtgggggctggaagctcgagggcgagtggaaggagggtgaggaagtccaggtgctagctcttgagccgggcaagaacccccgcgccgttcagaccaaacccggcctctttaagacgaacaccggcaccatcggggccgtgtctctggacttctcccccggcaccagcggatcccccatcgtggacaagaaggggaaggtagtgggcttatatgggaacggcgttgtcacgagaagcggcacgtacgtgtccgccatcgcgcagaccgagaagaacatcgaggacaaccccgagatcgaggatgacatcttccgtaagaagcggctcactatcatggatcttcacccaggggcaggcaagacgaagcgttatctgcccgcgatagtccgagaggccatcaagcgcgggctccggaccctgatcctcgcgccgacccgcgtcgtggccgccgagatggaggaggccttgcgcggcctcccaatcaggtaccaaacgcccgctatccgcgcggagcacacggggagagagatcgtggatctgatgtgccacgccaccttcaccatgcgcctgctcagcccgatccgagtcccgaactacaacctgatcatcatggacgaggcccacttcaccgatccagcgagcatcgccgcgcgcggttacatctccacgcgggtagaaatgggcgaggccgccggtatcttcatgaccgccactccgcccggctccagagacccgttcccccagtccaatgccccgatcatggacgaggagcgggagatccccgagcgctcgtggaattccgggcacgagtgggtaaccgacttcaagggcaaaacggtctggttcgtaccgtccatcaaagcggggaatgacatagccgcctgcctgcggaaaaacggcaagaaggtgattcagctctcccgcaagaccttcgacagcgagtacgtcaagacccggaccaatgactgggatttcgtggtgactaccgacatttccgagatgggcgccaacttcaaagcggagcgcgtaatagacccccggcggtgtatgaagcccgtgatcctgaccgacggcgaggagcgggtgattctggctggccccatgccggtcacccactcctcggccgctcagcgccgagggcgcgtgggcaggaaccccaagaacgagaacgatcagtatatctacatgggggagccgctcgaaaatgacgaggactgcgcacactggaaggaggcgaagatgctgctggacaacatcaacacgcccgagggcatcatcccaagcatgttcgagcccgaacgggagaaggtggatgctatcgatggcgaataccgcctccgcggtgaggcccgcaaaacgttcgtcgacctgatgcggcgcggcgacctgccagtatggctcgcctaccgggtcgccgccgagggcataaattacgcagaccgcaggtggtgttttgacggcgtcaagaataaccagatcctggaggagaatgtggaggttgagatctggaccaaggagggggaacgtaaaaagctgaaaccgcggtggctcgacgcccgcatctactccgaccccctagccctcaaagagttcaaggaattcgccgcggggcgcaagagcctcactctgaacctgatcacggagatggggcgtctccccacctttatgactcagaaagcccggaacgccctggacaaccttgccgtgctccatactgcggaggccgggggccgtgcctacaaccacgcattatccgagctgcccgagacgctcgagaccctgctgctcctgaccctgctcgccactgtaaccggaggcatctttctcttcctgatgagcggcaaggggatcggcaaaatgacgctagggatgtgctgcatcgtcaccgcgtccattctgctgtggtacgcccagattcagccacattggattgccgcaagcatcattctcgaattctttctgatcgtactgctcatcccagaacccgagaagcagcggacgccacaagataaccaactaacctacgtggtcatcgcaatcctaacggtggtagcggcgaccatggccaacgaaatggggttcctcgagaagaccaagaaggacttcgggctgggctcaatcaccacacagcagccggagagcaacatcctggacattgacctccgccccgccagcgcatggaccctgtacgcagtcgccaccaccttcataacgcccatgctgcggcactctatcgagaactcatcggtgaacgtgagcctcactgccattgccaaccaagctaccgttctaatgggcttggggaaggggtggcccttgtccaagatggacatcggagttccgctgctggcgatcggctgctatagtcaggtgaaccccatcactctcactgctgcactgctgctcctggtcgcccattacgcaattatcggtcccggcctgcaggccaaggcgacccgcgaagcacagaagagagccgcggccggcatcatgaagatccccgcggcgttgattatgaccgtcatcgacctggacccgatcccttacgaccccaagttcgagaaacaactcggccaggtgatgctacttgtcctttgttccacacaggttctcatgatgcgcacgacctgggctctgtgcgaggccctgaccctggctaccggtcccatcagcactctgtgggaggggaacccgggccgcttctggaacaccaccatcgcagtgtccatggccaacatcttcagagggtcctacctggccggcgcgggcttactgtttagtatcatgaagaacacggccaacactcgccggggaaccggtaacactggggagaccctgggagagaaatggaagaaccagctcaacgcgctaggcaagtctgaattccaaatctacaagaagagtgggatccaggaggtcgaccgcacgctggcaaaggagggcatcaaacgcggggagactgaccaccacgcagtgtcgcgtgggtctgccaagctccggtggtttgtggagcgcaacctcgtcaccccggaggggaaggtggtggacctaggttgcggccgcggaggttggagctactattgcggcgggctcaagaacgtcaaggaggttaaggggctgacaaagggcgggcccgggcacgaggagcccatcccgatgtccacctatggctggaacctggttagattacagagcggggtggacgtctttttcacgccgcccgagaagtgcgacaccctgctgtgcgatattggcgagtcgagccccaacccgacggtggaagcggggagaaccctccgcgtcctgaacctggtggagaactggcttaacaacaacacccagttctgcatcaaggtgctgaacccctacatgcccagcgttatcgagaagatggaggccctgcagaggaagtacggaggcgccctggtgcggaaccctctctcccggaactcaacccacgaaatgtactgggtgtccaacgcaagcggtaatatagtctccagcgtgaacatgatcagtcgcatgctgatcaaccgattcacgatgcgccacaagaaggcaacctacgaacccgacgtggacctgggaagcgggactcggaacatcggcatcgagtcagaagtccccaacctcgacattatcgggaagcgtatcgaaaagattaagcaggaacacgaaaccagctggcactacgaccaagaccacccctacaagacctgggcctaccatggctcctacgagaccaagcagacgggcagcgcctccagcatggtgaacggggtggtccgtctcctaaccaagccgtgggacgtgatccccatggttacccagatggccatgaccgacacgacccccttcggacaacagcgggtattcaaagagaaggtggacacacgcacccaggagcctaaagaggggacgaagaagttgatgaagataaccgcggagtggctgtggaaggaactgggcaagaagaagacccccagaatgtgcacccgcgaggagttcacacggaaggtccgatcgaacgcagcactcggggccatcttcacggacgagaacaaatggaagtccgctcgggaagcggtggaggacagcggattctgggagctggtggacaaagagcgtaatctgcacctcgagggaaagtgcgaaacctgtgtctataacatgatggggaagcgagagaagaaactgggcgagttcggtaaggcgaagggcagccgtgcaatctggtacatgtggttaggagcccggttcctggagttcgaagcgctcgggttccttaacgaggatcactggttctcccgcgagaacagtctcagcggtgtcgagggggaggggctgcacaagttggggtacatcctccgggacgtgtctaagaaagagggcggtgccatgtacgccgacgataccgcaggttgggacacgcgcatcaccttagaggacctgaagaacgaggagatggtcactaatcacatggagggcgagcacaaaaagctcgccgaagcgatttttcggctcacctatcaaaacaaggtcgttagggttcaacggccaacgccccgtgggaccgtgatggatatcatctctcggcgcgatcagagggggagcggccaggtggtcacctacggtttaaacacgtttacgaacatggaggcccagctcatccgccagatggagggagagggtgtcttcaaaagtatccagcacctgacagccaccgaggagatagccgtgaagaactggctggtcagggtaggcagggagagactgtcccggatggccatcagcggggatgactgcgtagtcaagcccctcgacgaccgcttcgcgaacgcccttacggccctcaatgacatggggaaggtacggaaggatattcaacagtgggagccgtcccgcggctggaacgactggacccaggtgcccttctgcagccaccacttccacgaactgatcatgaaggacggccgggtcctggtggtaccctgccgcaaccaggacgagctcatcggccgggctcggatctcccagggggcagggtggtccctgcgggagaccgcgtgcctgggcaagtcctatgcccaaatgtggagcctcatgtacttccacaggcgggatcttcgcctagccgccaacgccatttgctccgccgtaccctcacactgggtgccgacatccagaaccacctggagcatccacgctactcacgagtggatgaccaccgaagacatgctgaccgtatggaatcgcgtctggatccaggagaacccctggatggaagacaagacacccgtggagagctgggaggaaataccctacctgggtaagcgggaggaccaatggtgcgggagcctgatcgggctcacaagccgcgccacctgggccaagaatatccagaccgcgatcaaccaggtgcgctccttaatcggcaacgaggagtacacggactacatgccgtcaatgaagcgctttcgccgtgaggaggaggaggccggggtcctgtggtga

SEQ ID NO: 24853 - RNA, 9876 nt, synthetic construct
  misc_feature 1..9876: note = derived and/or modified CDS sequence (opt11) from DENV-2__KX380816__SS-prME
  source 1..9876: mol_type = other RNA
accgcaggcatcataatcatgatgatccccaccgtgatggcctttcatctgaccacgcgcaacggggagccccatatgatcgtcagccggcaggaaaagggcaaatccctccttttcaagaccgagaacggggtgaatatgtgcaccctgatggcgatggacctcggcgagttatgcgaagataccatcacctacaactgccctctgctccgccagaatgaacccgaggacattgactgttggtgcaactccacctccacctgggtgacctacgggacttgcacagccacaggcgaacaccggcgagaaaaacgcagcgtcgccctggtgccccacgtgggcatggggctggagacccgcaccgagacctggatgtccagcgagggcgcctggaaacacgcccagcggatcgagacatggatcctccgccacccagggttcaccatcatggcggccattctagcctacaccatcggaacaacctacttccagcgggtcctgatcttcattcttttaacggccgtgactccttccatggcgatgcgctgcatcggaatcagcaaccgggacttcgtggagggcgtctccggcggctcttgggttgacattgtgctggagcacggctcctgtgtcaccactatggccaagaataagcccacgttggacttcgagctgatcaagaccgaggccaagcacctggcaacgctccggaagtactgtgtggaagccaagctgacaaacaccacgaccgcgagccggtgccccacccaaggggagccttccctgaacgaagagcaagacaagcgcttcgtttgcaagcactcgatggtcgaccgaggctggggcaacgggtgcggactcttcgggaagggagggatcgtgacgtgtgccatgttcacgtgcaagaagaacatggagggcaaggtggtacagccggagaacctggagtacaccatcgtgatcacccctcactccggggaggaaaacgcggtagggaacgacacgggtaagcacggcaaggagatcaaggtcacgccccagtcttcaatcaccgaggccgagctgaccggctatggaaccgtgacaatggagtgctcaccgcgcaccggcctcgacttcaatgagatggtgctgttacaaatggagaataaggcctggctggtccaccggcagtggttcctggacctccccctcccctggctgcccggcgcggatacccaagggtccaactggatccagaaggagaccttagtgacgttcaaaaacccgcacgcgaagaagcaggacgtcgtggtgctcggcagtcaggaaggggccatgcacaccgccctgaccggcgccaccgagatccagatgagctccgggaacctcctgttcacgggccatctaaagtgcaggctgcggatggataagctccagttgaagggcatgagctactccatgtgcacggggaagttcaaggtagtgaaggagatcgcggagacccagcacggcactatcgtgatccgagtccagtacgagggtgacggatcaccctgcaaaatccccttcgaaatcatggacttagagaagcggcacgtgctcggtcgcctgatcaccgtgaaccccatcgtcacggagaaagacagccccgtgaacatcgaggccgagccaccattcggggacagctacattatcattggagtggaaccgggtcagctgaaactatcttggttcaagaaaggcagctccatcgggcagatgttcgaaaccaccatgcgcggcgccaagcggatggctatcctgggggacacggcttgggacttcgggagcctgggcggggtctttacgtccatcggcaaggcactccaccaggtgttcggggccatctacggcgccgccttcagcggtgtgtcctggaccatgaagatcctgatcggggtcgtgatcacatggatcgggatgaacagccgctcgacgagcttgtcagtgagcctggtcctggtgggagttgtcaccctttacctgggcgtgatggttcaggcggactccgggtgcgttgtgagctggaagaataaggagttgaagtgcggcagcgggatcttcatcaccgacaacgtgcacacctggacggagcagtacaagttccagccggagtctccctcaaagctggccagcgccatccagaaagcccacgaggaaggtatctgcggcatccggagcgtcacccgcctggagaacctgatgtggaagcagatcacacccgagctgaatcatatattgactgagaatgaggtgaagctcacgatcatgaccggggacatcaagggcatcatgcaggccgggaagagaacgctgcgaccccagccgacagagcttaagtattcctggaaagcgtggggcaaggccaagatgctaagcactgagctgcacaaccataccttcctgatcgacggccccgagaccgccgagtgccctaacaccaaccgggcgtggaattccctcgaggtggaggactatggcttcggcgttttcacgactaacatctggctgaagctgaaagagcgccaagacgtgttctgcgacagcaaactgatgtccgccgcgatcaaagacaatcgggccgtgcacgccgacatggggtactggatcgagtccgccctgaacgacacgtggaagatcgaaaaggcgtccttcatcgaggtcaagtcttgccactggcctaagtcccataccctgtggagcaacggcgtactagagtccgagatgatcatccccaagaacttcgcgggccccgtgagccaacacaactaccggccaggataccacacccagacggccggcccttggcacctggggcggctggagatggatttcgacttctgcgaaggcacgacagtcgtggtgaccgaagactgtggcaaccgcggtccctccctccggacgacaaccgcctccggcaaattgatcaccgagtggtgttgccgcagttgtaccctgccgcccctccggtaccgcggggaagacggctgctggtacgggatggagatccggccgctgaaagagaaggaggagaacctggtcaacagtctcgtgacggccggccacgggcagattgacaatttcagtctgggtgtgctgggcatggccctcttcttagaggagatgctgcgcacccgggtcggcaccaaacacgcaatcctcctggtggctgtgtcttttgtcacgctgatcaccggcaacatgagcttccgcgacctcgggcgcgtgatggtgatggtcggcgccacgatgaccgacgatattgggatgggcgtgacgtacctggccctgctcgcggccttcaaaatccggccaaccttcgccgccgggctgctgttacgcaagcttacctccaaggagctgatgatgaccacgatcgggatcgtgctgctgagccagtccaccatccccgagagcatcctggagctcaccgacgctctggcgctgggaatgatggtcctcaaaatcgtgcggaacatggagaagtaccagctggcggtcaccataatggccatcctgtgtgtgcccaacgccgtgatcttacagaatgcgtggaaagtcagctgcacgaccctggcagtggtgagcgtctccccgctgctcctgacctcctcgcagcagaaggccgattggatcccactggccctcaccatcaagggtctgaaccccacggccatcttcctgaccaccctcagccgcacctccaagaagcggagctggcccctgaacgaagcgatcatggccgtgggaatggtatccatcctggccagctccctcctgaaaaatgatatcccgatgacgggccccctggtcgccgggggcctcctgaccgtgtgctatgtgctcaccggccgcagcgccgaccttgagctggagcgggcggccgacgtacgctgggaagagcaggccgagatcagcgggtccagccccatcctgtccatcaccatcagcgaggacgggtccatgagcatcaagaatgaggaggaggagcagacgctcaccatcctgatccggaccggcctgttggtgatctcaggcctgttccccgtgtcaatcccgatcaccgcggccgcttggtacctgtgggaagtaaagaagcagcgcgccggggtgctctgggacgtgcccagtcctccgcccgtcggcaaggcagagctagaggatggggcgtatcggatcaagcagaagggcattctgggttactcccagatcggcgccggagtgtacaaggaggggaccttccacaccatgtggcacgtaacccgcggcgcggtactcatgcacaaggggaagcggatcgagccctcctgggccgacgtgaagaaagacctgatcagctacggcgggggctggaaactagaaggcgagtggaaggagggagaggaagtgcaggtcctcgcccttgagcccggcaagaacccccgcgccgtgcagaccaagcccgggctgttcaaaacgaacacgggcaccattggggccgtgtccctcgactttagccctggaacatccggtagccccatcgtcgacaaaaagggtaaggtggtgggcctgtacgggaacggcgttgtaacccgctccggcacgtacgtgagcgcgatcgcccaaaccgagaagtccatcgaggacaacccggagatcgaggacgacatcttccgcaagaagaggctgaccatcatggacctgcaccccggagctggaaagactaaacgctatctccccgccatcgtccgggaggcgatcaagcgcgggctgcggacgctgatcctcgcccccacccgcgtggtggcggccgagatggaggaagccctgcgcggcctgccgatacggtaccagaccccagcgatccgcgctgagcacaccgggcgggagatcgtcgacctcatgtgccatgccacgttcactatgagactgcttagccccataagggtgccaaactacaacctcatcatcatggacgaggcccatttcaccgacccggccagcatcgcggcccgcggctacatctccaccagagtggagatgggcgaggccgccgggatctttatgaccgccaccccgcccggctcccgcgaccccttcccgcagtccaatgcgcccatcatggatgaggagaaggagatcccagagcggtcatggaactccgggcacgaatgggtcacggacttcaaagggaaaaccgtatggttcgtccccagcatcaaggcggggaacgacatcgccgcatgtctgcggaaaaacggcaagaaagtcatccagctgtcccggaagacgttcgactcagaatacatcaaaacacgtacgaacgattgggacttcgtggtgaccacggacatctccgaaatgggcgcgaatttcaaggccgagagggtgatcgacccgcgccggtgcatgaaacccgtgatcttgaccgacggggaggagagggtgatcctggccggccccatgcccgttacccattcatccgccgcccagcggcgcgggagggtcggccgtaatccgaagaacgaaaacgatcaatatatctacatgggggagcccttggagaacgacgaggattgcgcgcactggaaggaggccaagatgcttttggacaacatcaacacccccgagggcatcatccccagtatgttcgagccagagcgcgagaaggtggatgctatcgacggcgagtaccggttacgcggggaagcccgtaagacgttcgtggacctcatgcgccggggcgacctgcccgtgtggctggcctatagagtcgcagccgaggggatcaactacgccgaccggcgctggtgcttcgacggcgtgaagaacaaccagatcctcgaggagaacgtcgaggtcgagatctggactaaagagggggagcggaagaagttaaagccccgctggctggacgcccggatatactccgacccgctggccctgaaggagttcaaggagtttgcggccgggagaaagagcctaaccctcaacctgatcacggaaatgggccggctgcctacgttcatgacccagaaggccaagaacgccctagacaacctcgcggtgctgcacacagccgaggccggaggtcgcgcgtacaaccacgccctctcagagctacccgagaccctggagacgctccttctgcttaccctgctggcgaccgtgaccggaggcatcttcctcttcctgatgtctggcaaggggatcggcaagatgacgttggggatgtgctgcataatcacggcctccatcctgctgtggcacgcccagatccagccccactggatcgctgcaagcatcatcctggagttctttctcatcgtcctgttaatccctgagcccgaaaagcagcggacgccccaggacaaccagctaacgtacgtggtgatagcgatcctgaccgtcgtagcggccacgatggccaacgagatgggcttcctggagaagaccaagaaggactttgggctagggagtatcaccacccagcaaccggagagtaacatcctagacatcgacctgcgccccgccagcgcgtggacgctctacgccgtggccaccacgttcatcaccccaatgctgcggcacagcatcgagaacagttctgtcaacgtgagcctgaccgccatcgcgaaccaggcgaccgtgctgatgggtctggggaagggctggcccctgtccaagatggacataggagtcccgctcctagccatcggctgctacagccaggtgaacccgatcaccctaaccgccgccctcctgctgctcgtggcgcattacgcaatcatcgggcccggcctgcaggcaaaggctacgagggaagcccagaagcgggcggccgctggcatcatgaagaatcccaccgtcgacgggatgaccgtgatcgacctggaccctatcccgtacgatcccaagtttgagaagcagttaggccaggtgatgctgctggtcctctgtgtgactcaggtgctgatgatgcgcacgacatgggccctgtgcgaggcgctcacactggcgaccggacccatctccacactgtgggagggcaaccccgggcggttctggaacaccaccatcgccgtcagcatggccaacatcttccgcggcagttatctcgctggcgccgggctgctgttcagcataatgaagaacaccgcgaacacgcgccggggcaccgggaacaccggcgagaccctcggggagaagtggaagaacagactgaatgccctggggaagtccgagttccagatctacaagaagtccggcatccaagaggtggaccgtactctcgccaaagaggggatcaagagaggggaaaccgaccaccacgccgtgagccggggatcggcgaagctgcgctggttcgtcgagcgcaacctagtgactccggagggcaaggtggtcgaccttgggtgtgggcgcggcggttggtcctactactgcggagggttgaagaacgttaaggaggtgaagggccttaccaagggcgggcccggccacgaggagcccatccccatgagcacttatggttggaacctcgtcagactgcagtccggtgtggacgtgttcttcaccagtccggagaagtgcgacactctgctctgcgatatcggggaatccagccccaaccccaccgtcgaggcaggacgcacccttcgggtgctgaaccttgtggagaactggctgaacaataacactcaattctgcatcaaggtcctgaacccctacatgccgagcgtgatagagaagatggaggccctccagcgcaagtacggcggggccctcgtgcggaatccattaagtcgtaactcgacacacgagatgtactgggtctcgaacgccagcggcaacatcgtgtcaagcgtgaacatgatctcccggatgctgatcaaccgcttcaccatgcggcataagaaggccacctacgaacccgacgtcgatcttggtagcggcacgcgcaacatcgggattgagtccgagacccccaacctggacatcatcggcaagcggatcgagaagatcaagcaagagcacgagacctcatggcactatgaccaggaccacccctataagacttgggcctaccatggctcctacgagacgaagcaaactgggagcgcctccagcatggtaaatggcgtggtccgcctgctcaccaaaccctgggacgtgatacccatggtgactcagatggccatgacggacaccacccccttcgggcagcagcgagttttcaaggagaaggtggacaccagaacccaggagccaaaggagggcaccaagaaactgatgaagatcaccgccgagtggttatggaaagagttgggcaagaagaaaacacccagaatgtgtacgagagaggagttcacccgcaaagtcaggtcgaacgcggccctgggtgcaatattcacggacgagaacaagtggaagtccgcccgcgaggccgtggaagacagtggattctgggagctcgtggataaggagcggaacctccacctggaggggaagtgcgagacctgcgtctataacatgatgggcaagagggagaagaagctgggggagttcgggaaggcgaaaggtagccgggccatctggtacatgtggctcggtgctcgattcctggagttcgaggccctgggctttctcaacgaggaccactggttctcccgcgagaactcactgagcggggtggagggagagggcctgcacaagctcggctatatcctgcgcgacgtgagcaagaaggaggggggggcgatgtacgccgacgacactgccgggtgggacacgcgtatcaccctggaggacctgaagaacgaggagatggtcaccaaccatatggagggggagcacaagaagctggccgaggccatcttcaagctgacgtaccaaaacaaggtggtgcgggtccagagacccaccccgcgcggcaccgtgatggacattatcagcagacgcgaccagcgggggtccggccaagtggtcacctacggtctcaacaccttcactaacatggaggcgcagctgatccgccagatggagggcgagggagttttcaagagcatacagcagcttaccgtcaaagaagagatcgcagttaagaactggcttatccgcgtggggcgcgaacgcctgtccaggatggccataagcggcgacgactgcgtggtcaaacctctggacgaccgcttcgccagtgccctcaccgccctgaacgacatgggcaaggtgcggaaggacatccagcagtgggagcccagcagggggtggaacgactggactcaggtgccgttctgctcccaccacttccacgagctgatcatgaaagacggccgggtcctcgtggtgccgtgccgcaaccaggacgaactgatcggtagggcaaggatctcacagggcgcagggtggtcgctgcgagagaccgcctgcctcggcaaatcttatgcgcaaatgtggtcgctgatgtactttcatcgccgggacctgagactcgcggccaacgcgatctgctcggccgtcccatcccactggatacccaccagccgcaccacttggtcaatccacgccacccacgaatggatgaccaccgaggacatgctgaccgtgtggaatcgtgtgtggatacaggagaatccctggatggaggacaaaacgccggttgaaagttgggaggagatcccctacctgggcaagcgggaggatcagtggtgcgggtccctaatagggctaacatcccgagcgacctgggccaagaacatacagaccgcgatcaatcaggtgaggagcctgatagggaacgaagaatacacggactacatgccctccatgaagcgcttcaggagagaggaggaggaggcgggcgtgctatggtga

SEQ ID NO: 24854 - RNA, 9876 nt, synthetic construct
  misc_feature 1..9876: note = derived and/or modified CDS sequence (opt11) from DENV-2__KX380817__SS-prME
  source 1..9876: mol_type = other RNA
acggcgggaataattatcatgatgatccccactgtgatggccttccacctgaccacacgaaacggtgagccccacatgatcgtcagtcggcaggagaagggcaaaagcctcctcttcaagaccgagaacggggtgaatatgtgtacactgatggcaatggacttaggcgagttatgcgaagacaccattacctacaactgccccctgctccgccagaatgagcccgaggacatcgactgctggtgcaacagcaccagtacctgggtgacctatgggacctgtaccgccaccggcgagcacagacgcgagaagcggagcgtggccctggttccccacgtcggcatggggttagagaccaggacggagacctggatgtccagcgagggggcctggaagcacgcccagcggatcgagacgtggatcttgcgccacccggggtttacgatcatggcggccatcctggcctacaccatcggcaccacctactttcagcgggtcctgatcttcatcctcctgacggccgtgaccccctccatggcgatgcgctgtatcgggatctccaaccgggatttcgtggagggggtatccggcgggtcatgggtggacatcgtgctggaacacggcagttgtgtaaccaccatggccaagaacaagcccactctcgacttcgagcttatcaagaccgaggctaagcacctggctacactacgcaagtactgtgtggaggccaagctcaccaacacgaccactgctagccggtgcccgacccagggggagcccagtctgaacgaggagcaggacaagcgcttcgtgtgcaagcacagcatggtcgaccgtggctgggggaacgggtgcggcctcttcggaaagggcgggatcgtgacgtgcgcgatgtttacatgtaaaaaaaatatggagggcaaggtggtccagcccgagaacctggagtacaccatcgtaatcacgccgcacagtggtgaagagaacgccgtcgggaacgacactggcaagcacgggaaggagatcaagattactccccagagcagtatcaccgaggccgagctgaccggatatgggactgtaactatggagtgctcgccgcgcaccggcctcgacttcaatgaaatggtgctgctgcaaatggagaacaaggcctggctcgtgcatcggcagtggttcttagacctgcccctcccctggctaccaggcgcggacacacaggggtccaactggatccaaaaggagaccctggtcactttcaagaacccgcacgctaaaaagcaagacgttgtcgtccttggcagccaagagggggccatgcacacggccctgactggcgccaccgagatccaaatgagctctgggaatctcctgttcacgggccacctgaagtgccgcctgcggatggacaagctccaactgaaaggcatgagctactctatgtgtaccggtaagttcaaggtggtcaaggaaatcgcggagacccaacacggcaccatcgtgatccgcgtgcaatacgagggagacggctctccttgtaaaatccccttcgagatcatggatctggagaagaggcacgtactcggccgcctgataactgtaaatccgatcgtgaccgagaaagactccccggtcaatatcgaggcggagccgccctttggggactcatacatcattatcggagtagagcccgggcagctgaagctctcatggttcaagaagggcagctccattgggcagatgttcgagaccactatgagaggcgcaaagaggatggccatcctgggagacacggcctgggacttcggcagcttgggcggggtgttcacctccatcggtaaggcgctccaccaggtcttcggggccatctacggcgccgccttcagcggcgtgtcctggacgatgaagatcctcatcggggtggtgatcacctggatcgggatgaatagccggtccacgagcctgtcggtatctctggtgctcgtcggcgtagtcaccttatacctgggcgtcatggtgcaggcggactccgggtgcgtggttagctggaagaacaaggagctcaagtgtggctccggcattttcatcacagacaatgtgcacacgtggacggagcagtataagttccaaccggaatccccaagcaagttagcttcagccatccagaaggcccacgaggagggaatctgcggcattaggagcgtgacccgcctagagaacctgatgtggaaacagatcacccccgagctgaaccacatcctcaccgagaacgaggttaagctcacgatcatgactggggacatcaagggcatcatgcaggccggtaagcggtccctgcgcccccaaccgaccgagttgaaatatagctggaaggcttggggcaaggccaagatgctctccacggagctacacaaccacacgttcctgatcgacggccccgagaccgccgaatgccccaacaccaaccgtgcatggaacagcctcgaggtcgaggactatggcttcggcgtgttcaccacgaacatctggctgaagctgaaggagcgccaggacgtcttctgtgacagtaagctcatgagcgcagcaatcaaggacaaccgggccgtacatgccgatatgggatactggatagagtccgccctgaacgacacctggaagatcgagaaggccagcttcatcgaggtgaagtcctgccattggcccaaaagccacaccctgtggtctaacggagtactcgagagcgagatgatcatccctaagaacttcgccggcccagtgtcccagcacaattaccgccccgggtatcatacccagaccgccggcccgtggcacctggggcggctggagatggactttgacttttgcgagggcacgactgtggtcgtgacggaagactgcgggaaccgcggccccagcctccggaccacgacagcgtccggcaagcttatcaccgagtggtgctgcaggagttgtaccctgccgcccttacggtacaggggggaggatggctgctggtatgggatggagatccgtcccctaaaggagaaggaagaaaacctagtgaatagcctcgtcacggccggccacgggcagatcgacaacttcagcctgggtgtgctgggaatggccctcttcttggaggaaatgctgcgcaccagagtggggaccaaacacgccatcctcctggtcgcagtgtccttcgtgacccttataactggcaacatgtcattccgcgacctcgggcgggtgatggtaatggtcggtgcgaccatgacggacgatatcggcatgggcgtcacctacctggccctgctcgcggccttcaaggtgaggcctactttcgccgccggactgctgctccgaaagttgaccagcaaggaactgatgatgaccaccatagggatagtgctcctgtctcagagtacgatccccgagagcatcctggagttgaccgacgccctagccttggggatgatggtcctcaaaatcgtgcgaaatatggagaagtaccagttggccgtcaccatcatggcaatcagctgtgtccccaacgccgtgatcctacagaacgcctggaaggtcagttgcacgacgctagccgttgtgagcgtgtccccgctgctgctcacctcttcccagcagaaggcagattggatccccctggccctgaccatcaaagggctcaacccgaccgccatcttcttaacgacactgagccgcacctccaagaaacggagctggcccttgaacgaggcgatcatggccgtaggcatggtctccatcctggccagcagcctccttaagaacgatataccgatgaccggccccctggtggccgggggcctgctcacagtgtgctacgtgttaaccgggcgatccgctgacctggaactcgagcgggcagccgacgtccgctgggaggagcaggccgagatcagcggttcctcccccatcctaagtatcaccatctctgaggacgggtccatgtccataaagaatgaggaagaagagcagacgctgacaattttgatccgcaccggcctgctggtcatctccgggcttttccccgtgagcataccgatcaccgccgccgcgtggtacctgtgggaagtcaagaaacagcgcgcaggggtactgtgggacgtgccctctccgccgccggtgggcaaggccgagctcgaggacggggcctaccggatcaagcagaagggcatcctggggtacagccagatcggcgccggcgtgtacaaggagggcactttccataccatgtggcacgtgacgcgcggtgcggtcctgatgcacaaggggaagcggatcgagccttcctgggccgacgttaagaaggacctcatcagctacggcgggggctggaagctggagggtgagtggaaggagggggaggaggtccaggtcctggccttagagcctggcaagaacccgcgcgccgtacagacaaagcctgggctgttcaaaaccaataccggcacgattggcgccgtgtccctcgatttcagccccggcacctccggcagccccatagtcgacaaaaaggggaaggtggtgggcctctacgggaacggagtcgtgacgagatccggcacgtacgtgagcgcgatcgcccagacagagaagtccatcgaggacaatccggagatagaggacgatatcttcaggaagaaacggttgaccataatggacctgcatcccggggctggcaaaaccaagcgctacctgccagccatagttcgggaggcgataaagcgcggactccggacccttatcttggccccaacgcgcgtggtggccgcagagatggaggaggccctcagaggcttaccgatccggtaccagacacctgcgatccgcgccgagcacaccggtcgggagatcgtcgacctgatgtgccacgcgaccttcacgatgagattgttgtcgcccatccgggtgcccaactacaatctgatcatcatggacgaagctcacttcaccgacccggccagcatagcggcccgcggctacatctctacgcgggtggaaatgggagaggccgccggcatcttcatgaccgccacgccgcccggatctagagacccctttccccagtccaacgcgcccatcatggacgaggagcgggagatacccgaacgcagctggaactccgggcacgagtgggtgaccgacttcaaagggaagaccgtgtggtttgtgcccagcatcaaagccggtaacgacattgccgcctgccttcggaaaaacggaaagaaggtcatccagctgtcccggaagaccttcgacagcgaatacatcaagacacggaccaacgactgggactttgtggttactacagatataagtgagatgggtgcgaatttcaaagccgagcgcgtcatcgacccgcggcgatgcatgaaacccgtgattttaacggacggtgaggagcgggtgatcctcgccggcccgatgcccgtgacccacagctcagctgcccaacgccggggccgcgtggggcgcaacccgaagaacgaaaacgaccagtacatctacatgggggagcccctggagaacgacgaggactgtgctcattggaaggaggccaaaatgctgctcgacaacatcaacacccctgagggtattattcccagcatgttcgaacccgagcgggagaaggtagacgccatcgacggcgagtaccgtcttcggggagaggcccgcaagaccttcgtcgacttaatgagacgcggtgatctccccgtgtggctggcctaccgggtcgcggcagaggggatcaactatgccgacagacggtggtgcttcgacggggttaaaaacaatcaaatcctggaagaaaacgtggaggtcgagatctggacgaaggagggtgagcgcaagaagctcaagcctcggtggctcgatgcccgcatctactccgatccgctagccctcaaggagttcaaggagttcgcggcaggcagaaagtccctgactctgaacctcattaccgagatgggccgccttcccacctttatgacgcagaaggcgaagaatgcgctggacaacctcgcggtactgcacaccgccgaagccggcggccgagcttacaaccatgccctgtctgagctgcccgaaaccctggagacgctgctcttgcttacactactggctaccgttaccggaggcattttcttattcctcatgagcggcaaggggattggcaagatgactctgggaatgtgttgcatcattaccgcctctatcctgttgtggtatgcccaaattcagccccactggatcgccgccagcatcatcttggagtttttcctaatcgtcctcttgatcccggagcccgagaagcagcgcacgccccaggacaaccagctgacctacgtggtgatcgcaatcctcaccgtcgtggccgccaccatggccaacgagatgggtttcttggagaaaacgaagaaggatttcggactgggcagcatcactacccagcagccggagtccaatatcctcgatatcgacctgcggccggccagcgcgtggactctgtatgcagtggccacgacattcataacccccatgcttcggcactctattgagaacagctccgtcaacgtgagcctgaccgccattgccaaccaagcgacggtgttgatgggcctcgggaagggctggcccctgtctaagatggacatcggcgtccccctgctcgccatcggctgttacagccaggtgaaccccatcactctgacggccgccctactcctgttagtcgcccactacgccataatcgggcctgggttgcaggccaaggcaacccgggaagcccaaaagcgcgcggcggccggcattatgaagaaccccacggtcgacgggatgaccgtgatcgacttggaccctatcccgtacgacccaaagttcgaaaagcagttaggccaagtaatgctcctcgtcctatgcgtgacccaggtgcttatgatgcggaccacttgggccctgtgtgaagcactaaccctcgctacggggcccatatccaccctctgggaggggaacccagggcggttctggaacacgactattgcggttagcatggccaacatctttcgcggatcatacctggctggcgccggtttactgttctcgataatgaagaacacagcaaacaccagacgcggcacggggaacaccggcgagacgctgggtgagaagtggaaaaaccggctcaacgccctggggaagtcagaattccaaatctacaaaaaatccggcatccaagaggttgatcgcaccctggcgaaggaggggatcaagcggggcgaaactgatcaccatgccgtgtccagaggcagcgccaaactccgttggttcgtcgagcgcaacctggtgaccccggaggggaaggtggtcgacctggggtgcgggcggggagggtggtcttattactgcggcgggctcaagaacgtaaaggaagtgaaagggctgaccaagggcggtccgggccacgaggagcccatcccgatgagcacctacggctggaacctggtccgcctgcaatctggcgtggacgtgttcttcacgcctcccgaaaagtgtgacaccctgctgtgtgacatcggggaaagctcgcccaaccccacggtcgaggcgggccggaccctgcgcgtgctaaacctggttgagaactggttgaacaataacacgcagttctgtataaaagttctgaatccgtacatgccctcagtgatcgagaagatggaggccctgcaaagaaagtatggcggcgccctggtgcgcaatcctctcagccggaactcgactcatgaaatgtattgggtctcgaacgcctccggcaacatagtgagctcggtgaacatgatcagccgcatgctgataaaccggttcactatgcgccacaagaaggcgacctacgagccggacgtcgacctggggtctggcacgcggaacatcgggatcgagagcgagacgcccaacctcgacatcattgggaagcgcatcgagaagatcaaacaggaacacgaaacctcctggcactatgaccaggaccatccttacaagacctgggcctaccacggtagctacgagaccaagcaaacggggtctgctagctccatggtgaacggcgtggtccgcctgctgaccaagccatgggacgtcatcccgatggtgacccagatggcgatgactgacacgaccccctttgggcagcagcgggtgttcaaggagaaggtggacacccgcacccaagagcccaaggagggcaccaagaagctaatgaaaattaccgccgagtggctgtggaaggagctgggcaagaagaagacgcccagaatgtgcacgcgcgaggaatttacgcggaaggtccgcagcaacgcggcgttgggggccatcttcaccgacgaaaacaaatggaagtccgcccgggaggcggtggaggacagcggcttctgggagttggtggatcgcgagcggaacctacacctcgaggggaagtgcgagacatgcgtctataacatgatggggaagcgcgagaagaagctgggggaattcgggaaggcgaagggctcccgggctatctggtatatgtggctaggggcccgctttttagagttcgaggcactgggcttcctgaacgaggaccactggttttcaagagagaacagcctctcaggggtggagggcgagggcctgcacaagctgggctacattctccgcgatgtcagcaaaaaggagggaggggcgatgtacgctgacgacaccgccggctgggacacaagaatcacactggaggacctgaagaacgaggagatggtcaccaaccacatggagggggagcacaagaagctcgccgaggccattttcaagttgacctatcagaacaaggtggtgagggtccaacgacctacgccccgcggcaccgtgatggacatcatatcccggcgcgaccagcgggggagcggccaggtagtcacctacggcctcaacaccttcactaacatggaggcacagctcatcagacagatggaaggggagggtgtgttcaagtcgattcagcagctgaccgtgaaggaggagatcgcggtaaagaattggctgatcagagtgggtcgggagcgcttgagccggatggccatatccggggacgattgcgttgttaagcccctggatgacaggttcgccagcgcccttaccgcgttgaatgacatgggaaaggtgcgtaaggacatccagcaatgggaacccagccgcgggtggaacgactggacccaagtgccgttctgtagccatcatttccatgagctgatcatgaaggacggccgtgtcctcgtcgtgccctgccgcaaccaggacgagctcatcggccgggcgcggatctcccagggcgccgggtggagcctcagagagaccgcctgcctgggaaagagctacgcccagatgtggagcctaatgtacttccaccgccgcgacctgcgcctggcggccaacgccatctgctccgccgtccccagccattggatccccacctcccggacgacatggagcatccatgccacccacgagtggatgacgaccgaagacatgctcacagtgtggaaccgcgtctggatccaagagaacccgtggatggaggacaaaacccccgtcgagagttgggaggagatcccctacctgggcaagcgggaggaccagtggtgcgggtccctaatcggcctcacgagccgcgcaacctgggcaaagaacatccagacggccatcaaccaagtgcgctccctgatcgggaacgaggagtacaccgactacatgcccagcatgaagcggttccggcgggaggaggaagaggccggggtgctgtggtaa

SEQ ID NO: 24855 - RNA, 9876 nt, synthetic construct
  misc_feature 1..9876: note = derived and/or modified CDS sequence (opt11) from DENV-2__KX380818__SS-prME
  source 1..9876: mol_type = other RNA
accgccgggatcatcataatgatgatccccactgtgatggccttccacctgaccacccggaatggggagccccacatgatagtgagccgtcaggagaagggtaagagcctcctgttcaagacggagaacggtgtgaacatgtgcaccctcatggcgatggacctaggcgagctgtgcgaggacaccatcacctataactgcccactgctccggcagaatgagcccgaggacatcgactgctggtgcaacagcacctctacctgggtgacctacggcacctgcacggccaccggcgagcaccggagggagaagcggagcgtcgccctagtgccccacgtgggaatggggctggagacccgcactgagacctggatgagcagcgaaggcgcctggaagcacgcccaaagaatcgaaacgtgggtcctccgccatcctgggtttaccatcatggcggccatactggcatacaccataggaaccacctacttccagcgggtgttgatcttcatcctactgacagccgtggcgccctccatgaccatgcgctgcattgggatcagcaatcgggatttcgtcgagggtgtgtccggcgggagctgggtggatatcgtcctggaacacggctcctgtgtaaccaccatggcgaagaacaagcccacgctcgacttcgagctgatcaaaaccgaggccaaacaccccgccaccctgcgcaagtactgtatcgaggccaaactcaccaatacgaccaccgcgagccggtgcccaacccagggggagccctccttaaacgaggagcaggacaagcgcttcgtgtgtaagcacagcatggtcgatcgcggctggggcaacgggtgcgggctgttcgggaagggcgggatagtgacctgcgccatgttcacgtgcaagaagaacatggaaggcaagattgtgcaacccgagaacttggaatataccatcgtcatcaccccgcactccggagaggaaaacgccgtggggaacgacacgggcaagcacgggaaggagatcaaggtaacgccgcagagctctataactgaggccgagctgacggggtacgggaccgtcacgatggagtgctccccccgcaccggcctggatttcaacgagatggtactactgcaaatggagaataaggcctggctggtgcaccggcagtggttcctagacctccccctgccctggctcccgggcgcggacacccaaggatcaaactggattcagaaggagaccctggtcacgttcaagaacccccacgctaagaagcaggacgtggtcgtactgggcagccaggaaggggccatgcacaccgcccttaccggcgccaccgagatccagatgagctcggggaacctcctgttcacgggccaccttaagtgccgcttgcggatggacaagctgcagctcaaaggcatgagttactcgatgtgcaccggcaagttcaaagtggtcaaggagatcgccgagacccagcacggcaccatcgtgatccgcgtgcagtacgagggggacggcagcccctgcaagatccccttcgagatcatggatctggagaagcggcacgtcctgggtcggctgatcacggtgaacccgatcgtgacggaaaaggactcccccgtcaacatcgaggccgagccgcctttcggagacagctacatcatcatcggcgtggagccggggcagctaaagctgtcttggttcaagaagggaagttccatcgggcagatgttcgagaccaccatgcgcggtgccaagcggatggccatcctcggcgacacggcctgggacttcgggagcctgggcggagtgttcacctcgatcggcaaagcgctgcaccaggtcttcggggccatctacggcgccgccttcagcggcgtgtcctggaccatgaagatcctcatcggggtcgtaatcacgtggatcggcatgaacagccgctccacgtctctgtccgtgagcctggtgctggtgggggtcgtgaccctctatctgggcgtaatggtgcaagcggactccggatgcgtggtcagctggaaaaataaggagctgaaatgcggctcaggcatcttcataaccgacaacgtgcatacctggacggagcagtacaaattccagcccgagtccccctctaagctcgcctcggccattcagaaagcccacgaggaagggatctgcggcatccggagcgtgacccgactggagaacctgatgtggaagcagatcacccccgagctcaaccacatcctgaccgagaacgaggtgaagctgacgatcatgacgggggacatcaagggcatcatgcaggccgggaagcggtccctccgcccccagcccaccgagctgaagtacagctggaaggcgtggggcaaggccaaaatgctgtccactgagctccacaaccacacgttcctgatcgacggccccgagaccgccgaatgccccaatactaaccgggcgtggaacagcctggaagtggaagactacgggttcggagtgtttaccacgaacatctggctcaagctgaaggagcgccaggacgtgtcctgcgacagcaagctgatgtccgccgcgattaaggacaaccgggccgtgcacgctgatatggggtactggatcgagagcgcgctcaacgacacctggaaaatcgagaaggcctccttcatcgaggttaaatcctgccactggcccaagtcccacaccctgtggagcaacggcgtgttggagtccgagatgattattcccaagaacttcgccggccccgtgagccagcataactacaggcccggctatcacacccagaccgctggcccctggcacctcggccggctggagatggacttcgacttctgcgagggcacgaccgtggtcgtgaccgaggactgcggcaaccgaggccccagcctgcggacaactacggcctccggcaagctcatcaccgagtggtgttgccgcagctgtaccctgccaccgttgcggtaccgcggggaggacggctgctggtatgggatggagatccggcccctcaaggagaaggaggagaacctggtgaactccctggtcacggccggccatggtcagatcgacaacttcagcctcggcgttctgggcatggcgctctttctcgaggagatgctacggaccagagtggggaccaaacacgccatcctgctcgtcgcggtttcctttgtgacgctgatcaccggcaatatgagcttccgcgacctgggccgcgtcatggtgatggtgggagcgactatgacagatgacatcgggatgggggtcacctacctcgccctgctggcggcctttaaggtgcggcccaccttcgcagccggtctcctgctgcgcaagctcacctccaaggagctaatgatgaccaccatcgggatcgtgttgctcagccagtccaccattcccgaaaccattttggaattaaccgatgccctcgcgttaggtatgatggtcctgaagatcgtgcggaacatggaaaagtaccagctcgccgtaaccataatggctatcctgtgtgtgccgaacgcggtgatcctgcagaatgcatggaaagtctcctgcaccaccctcgcggtggtgtccgtcagccccctgcttctcacctccagccagcagaagaccgattggatccccctggccctgacgatcaaggggctcaaccccaccgccatcttcctgaccaccctgagccgcacgagcaaaaagcggtcgtggccgctcaacgaggccatcatggcggttggcatggtgagcatactggcctccagcttcttgaagaacgacatccccatgaccgggccgctcgtcgccgggggcctgctgaccgtttgttacgtgctcaccgggcgcagcgccgacctggagttagaaagagccgcagacatccgatgggaagagcaggccgagatcagcggcagctcccccatacttagcatcacaatctccgaagacggtagcatgtccatcaagaacgaggaggaggaacagaccctgacaatcctgatccggacgggcctcctggtgattagcggcttattcccggtgtccatcccgatcactgccgccgcctggtacctctgggaggtcaagaagcaacgcgcgggggtcttatgggacgtccccagcccgccgcccgtgggcaaggccgaattagaggacggtgcctaccgaatcaagcagaagggcatcctcggatacagccagatcggcgccggggtctacaaagaggggacgttccacaccatgtggcacgtgacccgcggagccgtgctcatgcataagggtaagcggatcgagcccagctgggcggacgtcaagaaggacctgatctcctacgggggcggctggaagctcgagggcgagtggaaggagggggaggaggtccaggtgctcgccctagagcccgggaagaaccccagagccgtccagacgaagcccggcctgttcaagacgaacacaggaaccatcggggcagtgagcctggacttttcccctggcacctcagggtccccaatcgtggacaagaaagggaaagtcgtgggcctgtacgggaacggcgttgtcacgcggagcggaacctatgtgtcggccattgcgcagactgagaagaacatcgaggacaatccggaaatcgaggacgatatcttccgcaagaagcggctcaccatcatggacctgcaccccggggccggcaagacgaagcgctacctgccggccatcgtgagagaggccatcaagcgcgggctgaggaccctcatcctggcgccgacccgcgtcgtggcagccgagatggaagaggcactgcgcggcctacccatccgttaccagacccccgcgatccgcgctgaacacaccgggcgggaaatcgtcgacctgatgtgtcatgccacattcaccatgcgtctgctatcccccatccgggttccgaactataacctgatcatcatggatgaagcgcatttcaccgaccctgccagcattgccgctcgcggctacatctccacgcgggtcgagatgggcgaggctgccgggatctttatgaccgccacgccacccggcagccgcgacccgtttccgcagtccaacgcccccatcatggatgaggaacgggagatccccgaacgcagctggaactccggtcacgagtgggtgaccgacttcaagggcaagactgtatggttcgtgcccagcatcaaggcggggaacgacattgctgcatgcctgcggaagaatggcaagaaggtgatccagctctcccgcaagaccttcgacagcgagtacgtcaaaacccgcaccaacgactgggacttcgtcgtgacgaccgacatctccgagatgggcgccaacttcaaggcggagcgcgtcatcgacccacggaggtgcatgaagcccgtcatcctgacagacggggaggagcgggtgatcttggccggccccatgccggtcacccacagctccgccgcccagcggagaggacgagtcggcagaaacccaaaaaatgagaacgaccagtatatctacatgggagagcccctcgagaacgacgaggattgcgcacattggaaggaagcgaagatgctgctggacaacattaacacgcccgaaggcatcatcccgagcatgttcgagccagagcgggagaaggtggacgccatcgacggcgagtaccgactccgtggggaggcccgcaagacattcgtcgacctgatgcggcgcggcgacctgcccgtgtggctcgcctaccgggtcgccgcggaagggatcaattacgccgatcgacgctggtgcttcgacggtgtgaagaacaaccagatcctggaggagaacgtggaggttgagatctggactaaggagggggagcgcaaaaaactgaagccgcggtggctcgacgctcgcatctacagtgaccccctggccctgaaggagttcaaagagtttgccgcggggcgcaagagcttaaccctgaacctcataacggagatggggcgccttcccaccttcatgacccagaaggcccggaacgccctggacaatttggcggtgctccatacagcggaggccggggggcgcgcctacaaccacgccctgagtgagttgcccgagacgctcgagaccctgctgttgctgacactgctcgctaccgtgaccgggggcatcttcctcttcctgatgagcggcaagggcatcggcaaaatgacgctcggtatgtgctgcatagttaccgcgtccattctgctgtggtacgcccagatccaaccgcactggatcgctgccagcatcatactcgaatttttcctgatcgtgctgctcatccccgagcccgagaagcagcggacgccgcaagacaaccagctgacatacgtggtcatcgccatcctgacggtggtggcggccaccatggccaacgagatgggcttcctcgagaaaacgaaaaaggactttgggctgggctccatcaccacgcagcagccggagagcaacatcctcgacatcgacctccgccctgccagcgcctggaccttatacgcggtcgccaccaccttcatcactcccatgcttcggcactccatcgagaacagctccgtgaacgtgagcctgacggccatcgccaaccaggccacagtcctgatgggcttgggtaagggatggcccctatccaagatggacatcggggtgccgctgttagcgatcggctgttacagccaggtgaaccccataacgctgacggccgccctgctgctcctcgtggcccactacgcgatcattgggccgggcctgcaggcgaaggctacccgggaggcccagaagcgggccgcggccggaatcatgaagattcccgccgccgatattgggcgcgtgatcgacctcgacccgatcccttacgaccccaagttcgagaagcagctaggccaggtgatgctgctcgtcctgtgtgtgacccaggtgctgatgatgcgcaccacgtgggcactctgtgaggcgctcaccctggccaccggaccaatttccactctctgggagggcaacccggggcggttttggaacaccaccattgccgttagcatggccaacatcttccgcggctcctatctggccggtgctgggctcctcttcagcatcatgaagaacacggccaacacccgcaggggcacggggaacaccggcgagaccctgggcgagaagtggaagaaccagctgaacgccctcgggaagtccgagtttcaaatctacaagaagagtggaatccaggaggtggaccggaccttggccaaagaaggcatcaagcgcggcgagacggaccatcacgcggtgtcccggggaagcgcaaagctgagatggttcgtcgagcggaacctcgtcacccccgagggcaaggtggtcgacctgggctgcgggcgcggcgggtggtcatactactgtggcggcctgaagaatgtaaaggaggtgaagggcttaaccaagggcggtcccggccacgaagagcccatccccatgagcacctacgggtggaacctggtccggcttcaatccggcgtggacgtgttctttacgccgcccgagaaatgtgacaccttgctgtgcgacataggggaaagctccccaaacccgacggtggaggctggacgcactctgcgggtgctcaacctggtggagaactggctgaacaataacactcagttctgcattaaggtccttaacccctatatgcccagcgtgatcgaaaagatggaagccctgcaacgcaagtatggcggggccttggtgcggaacccgctctcacgcaattccacgcatgagatgtattgggttagcaacgccagcgggaacatcgtgagctccgtgaatatgatcagccggatgctcatcaaccggtttaccatgcggcacaagaaggccacctacgagcccgatgtcgacctggggagcggcacccgcaacatcggcatcgagagcgaggtgcccaacctagacatcattggcaagcgcatcgagaaaatcaaacaagagcatgagacgagttggcattatgaccaagaccacccctataagacctgggcttaccacggcagttacgagacaaagcagaccgggtcggcctcctccatggtgaacggcgtcgtgaggctcctcacgaagccgtgggacgttatccccatggtcacccagatggctatgaccgacaccacgcccttcgggcagcagcgcgtgttcaaggagaaggtcgacacccggacccaggagcccaaagagggcaccaagaagctgatgaagatcacggcggagtggctctggaaagagctgggcaagaagaagacccctcgcatgtgcacccgggaggaattcaccagaaaggtgcggagcaacgccgccctgggggccatttttactgacgaaaataagtggaaatccgcccgcgaggcggtcgaggacagcggcttctgggaactcgtcgacaaggagaggaacctgcacctggagggaaagtgcgagacatgcgtgtataacatgatgggcaaaagggagaagaagctcggggagttcggcaaagcaaagggttcccgggctatctggtatatgtggctgggggcccgcttcctggagttcgaagcgctcggcttcctgaacgaggaccactggttcagccgagagaactccctgagcggggtggaaggagaggggctccacaagctgggctacatactccgcgacgtcagcaagaaggagggcggcgccatgtacgccgacgacaccgcgggctgggacactaggatcacgcttgaggacttgaagaacgaggagatggtgacgaaccacatggagggggagcacaaaaagctggccgaggcgattttccgcctcacttaccagaacaaggtcgtccgggtgcagcgccccacgccccggggaacggtgatggatattatctcccgccgggaccagcgcggcagcggccaggttgtgacgtacggcctgaataccttcaccaacatggaggcccagctgatccgacagatggagggagagggcgtgttcaagtccatccagcatttaacggccactgaggagatcgccgtcaagaactggctggtgcgggtcggccgcgagcggctgagccgcatggccatctccggcgacgactgcgtagtgaagcctctcgacgaccggttcgcgaatgccctgacagccctgaacgacatgggcaaggtgaggaaagacatccagcaatgggagccgagccgggggtggaacgactggactcaggtacccttctgcagccaccacttccatgagctcatcatgaaggatggtcgcgtgctcgtggtcccctgccggaaccaggacgagctgatcgggcgcgcccgaatcagccagggcgccgggtggtccctccgcgagacggcgtgcctgggcaagtcatacgcccagatgtggtcccttatgtatttccaccgccgcgacctccggctggctgccaacgccatttgcagcgcggtgccgtcccactgggtgccgacaagccgcaccacctggtcaatccacgcaacccacgagtggatgacgaccgaggatatgctgacggtctggaaccgggtgtggatccaggagaacccttggatggaggacaagacccccgtggagagctgggaggagatcccctacttaggcaagcgcgaggaccaatggtgcgggtccctgatcggcctgacgagcagggccacttgggctaaaaacatccaaactgcaatcaaccaggtccgcagccttatcgggaatgaggagtacacggactatatgccgtccatgaagcgcttccggcgcgaggaggaagaggccggcgttctgtggtga

SEQ ID NO: 24856 - RNA, 9876 nt, synthetic construct
  misc_feature 1..9876: note = derived and/or modified CDS sequence (opt11) from DENV-2__KX380819__SS-prME
  source 1..9876: mol_type = other RNA
accgccgggatcatcataatgatgattccaaccgtgatggccttccacctgacgacccgtaatggcgaaccccacatgatcgtcagtcgtcaggagaagggcaagagcttactgttcaagaccgagaacggggtgaatatgtgcaccctgatggccatggacctcggtgagttgtgcgaggataccatcacctacaactgtcctctgctgaggcagaacgaacccgaagatatcgactgctggtgcaacagcaccagtacatgggtcacctacgggacgtgcaccgccaccggcgagcatcgtcgtgaaaagagaagtgtcgcattagtcccccacgttgggatggggctggaaacacggacggagacgtggatgtccagcgaaggtgcctggaaacacgctcagcgcatcgaaacctgggttctacgccacccagggttcaccgtgatggcggcgatactggcctacacgataggcactacgtacttccagcgtgttctgatatttatcctcttaaccgctgtcgcgccctccatgaccatgcgatgcatcgggatcagcaaccgggacttcgtggagggtatctccggcggctcttgggtcgacatcgtcctggagcacggctcgtgcgtcaccaccatggccaaaaataaacccacgctagacttcgagctgatcaagacggaggccaaacacccagcgacgctgcgcaaatactgtatcgaggctaagctaactaatactaccaccgcgtcccggtgcccgacccaaggagagccatccctgaatgaggagcaagacaagcgcttcgtttgcaagcacagcatggtggaccggggctggggcaacgggtgcggcctattcgggaagggcgggatcgttacgtgtgccatgttcacgtgtaagaagaatatggaggggaaaattgttcagccagaaaacctcgagtacacaatagtcataacaccccactccggagaggagaacgccgtggggaatgacacgggaaagcacggtaaggagataaaagtaaccccgcagtcgagtattaccgaggcggagcttaccgggtacgggaccgcaacgatggagtgctctcccaggaccgggctagacttcaacgagatggtgctcctgcagatggagaacaaggcgtggctggtgcatcggcaatggttcctcgaccttccattaccctggctcccaggggcagacactcaggggtccaactggatacagaaagagacgctcgtaacattcaagaacccccacgccaagaaacaggatgtcgtcgttttaggatcacaggagggggccatgcacaccgccctcactggcgcgaccgagatccagatgagttccggaaatctgctgtttacaggtcacctcaagtgccgactaaggatggacaagttacagctaaagggcatgagctactccatgtgcacagggaagttcaaagtagttaaggagatagctgagactcagcacggcacgatcgtaatccgggtgcaatacgagggggacggctctccatgtaagatccccttcgagatcatggacctcgagaagaggcacgtgcttggcaggctcatcacagttaatccgattgttaccgaaaaggactcccccgtgaatatcgaagccgaaccacccttcggggattcatacatcatcatcggagtcgagccggggcaactcaaactttcctggttcaagaagggctcgtccatagggcagatgttcgaaacgacgatgcgcggcgccaagcggatggccatcctaggcgacacggcgtgggacttcggaagcctgggcggcgtgttcaccagcattggcaaggcgctgcatcaagtcttcggggccatctatggcgcggcgttcagcggcgtctcctggactatgaagatcctcatcggggtcgtgatcacctggatcgggatgaacagccggtccacgagcctgtccgtcagcctggttctggtgggcattgttaccttatacctaggcgtaatggtgcaggcagattcgggttgtgtcgtaagctggaaaaacaaggaactgaagtgcggcagcgggatattcatcacggacaacgtccacacttggacggaacaatacaaattccagcccgaatcccccagcaaactagcctccgccattcaaaaggcccatgaggaaggaatctgtggcatccggtccgtaacccgcctggagaatctaatgtggaagcagatcacccccgagctaaatcacatcctgtctgagaacgaggtgaaacttacgatcatgacgggcgacatcaagggtatcatgcaggcgggcaagcgttcgctccgccctcaacccaccgagctgaagtacagctggaaggcctggggtaaggcaaagatgttgagcaccgagctgcacaaccacaccttcctcatcgacggccccgagacagccgaatgcccgaacaccaaccgagcctggaatagcctcgaggtggaagactatgggttcggagtattcaccacaaacatctggctcaaactgaaggaacgccaggacgtattttgcgacagcaagctgatgtcggctgccatcaaggataaccgggcggtgcacgccgacatggggtattggatagagagcgcattaaacgacacgtggaagatcgagaaggcgtccttcatcgaggtgaagtcatgtcactggcctaagtcccacaccttatggagtaacggtgtgctggagagtgaaatgattatccctaagaacttcgcagggccggttagccagcacaactaccgcccagggtaccacacccagaccgcgggcccctggcacctcggacgtctggaaatggacttcgatttctgcgaaggaactacggtagtggtgaccgaagactgtgggaaccgtgggccatctctgcggaccaccacggcctccggaaaactgatcaccgagtggtgctgtcgcagctgcacgctgcccccattacggtaccgcggggaggacgggtgttggtacggtatggagatccggccgctcaaggaaaaggaggagaatttggtcaattccctggttacggccggccacgggcagatcgataacttcagtctcggggtactaggcatggccctgttcctcgaggaaatgctgcggacccgggtcgggaccaaacacgccattctattagtggccgtgtctttcgttaccttaatcacgggtaacatgagcttccgcgacttggggagggtgatggtgatggtcggcgccacgatgacagatgacatcgggatgggtgttacatacctagccctgctggccgcctttaaggtgcgacctacctttgctgccgggctactcttgcgtaaactcacctctaaggagttaatgatgaccaccattggaatcgtactgctaagccagtcaaccatccctgagaccatcctagagttaaccgatgcgctcgccctgggcatgatggtgctgaagattgttcgtaacatggaaaaataccagctcgcggtgacgataatggccatcctgtgcgtgcccaatgctgttattctacagaacgcatggaaggtgagctgtaccatcctcgccgtcgtctcggtaagcccgctgttacttacgtcgtctcagcagaaagccgactggataccgctcgctttaacgatcaaggggctaaatcccaccgccatattcctgaccactctaagccgcaccagcaagaagcgatcctggccgctaaacgaggcgattatggctgtgggaatggtctcgatcctggcctccagcttactcaagaacgacatacccatgacaggacccctggtggcagggggtctcctgaccgtatgttatgtcctgactggtcgcagcgcggacctggagctggagcgggcggccgacgtccggtgggaggagcaagccgagatcagtggcagctcccctatcctaagcatcaccatctccgaggacgggagcatgtccatcaagaacgaggaggaggagcagaccctaaccattctcatacgaacgggcctacttgtcataagcggtctcttcccggtgagcattccgatcacggctgctgcttggtacctgtgggaggtgaaaaagcaacgcgccggagtgttgtgggacgtcccctccccaccacccgttggcaaggccgaactcgaggacggggcttacaggatcaagcagaagggcatcttaggatactcccagataggcgcgggagtgtacaaagaggggacgttccacaccatgtggcacgtcacccgcggggcggtgctgatgcacaagggtaagcggatagagcccagctgggccgatgtgaagaaggacctaatctcttacggcggagggtggaaactggagggggaatggaaggagggggaagaggtacaggtgttagcactcgagcccggcaagaaccctcgcgccgttcagaccaagccgggactgttcaaaaccaacaccggcacaatcggggcggttagccttgatttttcccccggtacgagcggttcacccattgtggacaagaagggcaaggtggtcgggctttacgggaacggcgtggtgacccgatccggcacctacgtctctgccatcgcacagaccgagaaaagtattgaggacaaccccgaaatcgaggacgacatatttcgtaagaaacggctaacgatcatggatctgcatcccggggcaggcaaaaccaagcgctacctgcctgcgatcgtacgagaggccataaaacgcggcctccgcaccttaatactggcccccaccagagtggtagccgccgagatggaggaggccttgcgcggactccccattcggtaccagacgcccgccatccgcgcggaacacacggggcgagagatagtagacctgatgtgccacgcaaccttcaccatgagactcttgagccccatccgggttccgaattacaacctgatcatcatggacgaagcccattttacggatcccgcgagtatcgccgcccggggttacatcagcacacgggtcgagatgggagaggctgctgggatctttatgaccgccacgccgcccgggtcccgcgatccattcccccagagcaacgcgcccattatggacgaggaacgcgagatccccgagcgttcgtggaactccgggcacgaatgggtgacggacttcaagggcaaaaccgtgtggtttgttccatccatcaaggccgggaacgacatcgcagcctgtctgcggaaaaacggcaagaaagtgattcagttgagccgcaaaactttcgatagtgagtacataaagactcgaaccaacgattgggactttgtggtaactacggatatcagcgaaatgggcgctaatttcaaggccgagcgcgtgatcgaccctcggcgctgcatgaagcctgtgatactgaccgatggagaggagagagtcatccttgccggtcccatgccggttacgcacagtagcgccgcgcagagacgagggagggtgggacgcaaccccaaaaacgagaacgaccagtatatctacatgggggagcccctggagaacgacgaagactgcgcacactggaaggaggccaaaatgctgctggataacataaatacccccgaagggattataccgtccatgtttgagcctgagagggagaaggtggacgctatcgacggcgagtacagactgcgtggggaagcccgcaaaaccttcgtggatctgatgcggcgcggtgacctccccgtgtggctagcgtatcgtgtcgccgccgagggtatcaactatgccgaccgccggtggtgcttcgacggcgtcaagaacaaccagatcctcgaagagaatgtggaggtggagatctggaccaaggagggcgagcgcaagaagctcaagccccggtggctggacgctcgcatatacagcgaccccttagcccttaaagagttcaaggagtttgcggccggccggaagtcgctgaccctgaatttgatcaccgaaatgggccgcctgccgacctttatgacccagaaggcccggaacgcgttggacaacctcgcggtcctgcacacggccgaagcgggaggcagggcctacaaccacgcactatcggagctccccgaaaccctggagaccctgctcctgcttaccctcctggccaccgtcaccggaggcatcttcttattcctcatgtccggcaaagggatcggcaagatgaccctggggatgtgctgcattatcacggccagcatcttgctttggtacgcgcaaatccagccgcactggattgcagcatccataatccttgagttcttcctaattgtcctcctgatcccagagcccgagaagcagcgaacgccgcaggacaatcagctgacttatgtggtcatcgccatcctcaccgtggtcgccgccaccatggccaacgagatgggcttcttagaaaagaccaagaaggacttcgggctaggaagcatcacgacccagcagccagatagcaacattttggacatcgatctgcgccctgcgagtgcgtggaccctgtatgcggtcgccacgacgttcatcacacccatgctcagacactccatagagaactcgagcgtgaacgtgtccctgactgcaatcgctaatcaggccaccgttttaatgggcctcgggaagggatggccccttagcaaaatggacattggtgtccccctcctggccatcggttgctattcccaggtgaaccccataacgctaacagccgcactgctcttgctggtcgcccactacgccatcatcggacccgggctacaggccaaggccacccgcgaggcgcagaagcgggcagccgcaggaataatgaaaatacctgcagcgctgatcggccgcgtaatcgaccttgaccctatcccctatgaccccaagttcgagaagcagctcggccaggttatgctgctggtcctctgtgtgacccaggtgctgatgatgcgtacgacctgggccctgtgcgaggccctcaccctggcgaccgggcccatcagtaccctgtgggaaggcaacccgggccgcttttggaacaccaccatcgcagtctccatggccaatatcttccgcgggagctacctcgcgggcgcgggtttactattctccatcatgaaaaataccgccaatacgcggagaggtaccgggaatacaggagaaactctcggtgagaagtggaaaaaccggctaaatgcgctgggtaagagcgagttccagatctataagaaaagcggtatccaggaggtagaccgcacgctcgccaaggagggtatcaaacgaggtgagacagaccaccatgccgtttcgcgcggcagtgcgaaacttcggtggttcgtagagaggaacctcgtgactccagaggggaaggtggtcgacctcggctgtggaagaggagggtggtcctactactgcggcgggctaaagaacgtgaaggaagtgaagggactgacgaagggcgggcctggccacgaagaacccataccgatgtcaacgtacgggtggaacctcgtccgcctgcagagcggcgtggacgtcttcttcacaccgcccgaaaagtgtgacacacttctctgcgacattggcgaatcaagccccaacccgaccgtcgaggccggccgaacgctgcgcgtccttaacctcgtcgagaactggctgaacaacaacacccagttctgcatcaaggtgctgaacccctatatgccatctgtaatcgagaagatggaggcacttcaacgtaaatacggcggagccctcgtgcgcaatccgctgtcccggaacagcacccacgaaatgtactgggtctccaacgccagcgggaacatcgtgtcctcagtgaacatgatctcccgcatgctgatcaacaggttcaccatgaagcacaaaaaggctacgtacgagcccgatgttgatttagggtcaggcacaaggaacatcggaatcgagtcagagacccccaacctggacattatcggcaaacgaatagagaaaatcaagcaggaacacgagaccagttggcactatgatcaggaccacccctacaaaacctgggcctatcacggctcatatgaaactaagcagacggggtcagcgtctagtatggttaacggtgtggtccggctgctcacaaagccatgggacgtgatccccatggtgacgcaaatggccatgacggatacgactccctttggtcaacaacgcgtttttaaggaaaaggtggacacacggacgcaggagcctaaggagggcaccaagaaacttatgaagatcaccgcggagtggctctggaaagaactgggtaagaagaaaaccccgcggatgtgcacgcgggaggagttcacccgcaaggtgcgctcaaacgccgcgctgggcgccatctttaccgacgagaacaagtggaagtctgcacgcgaggcggtcgaagacagcggcttctgggaactggtggacaaggagcgaaacctgcatctggaggggaaatgcgagacttgcgtatacaacatgatgggcaagcgcgagaagaagctaggtgagttcgggaaagccaagggctcacgggcgatatggtacatgtggttgggcgcccgcttcctcgagttcgaggccttgggctttctcaacgaagaccactggttcagcagagagaactcgcttagcggggtcgagggggaggggctacacaaattgggctacatacttcgagatgtgtctaagaaggagggcggagccatgtatgccgacgacacggcaggctgggacaccagaatcactctggaggacctaaagaacgaagagatggtcaccaaccacatggaaggggagcaccgcaaattagcagaagccatcttcaggctgacttaccagaacaaagtggtgagagtccagcggcccacacctcggggcaccgtcatggatataatttcccgaagagatcaaagagggagcggccaggtggtaacttacggcctcaacacgttcaccaacatggaggcccagctaatccgacagatggaaggggaaggcgtgttcaagagcattcaacatctgaccgtgaccgaggagatcgctgtcaagaactggctcgagcgggtggggcgggaaaggctgtcccgaatggcgatcagcggagatgactgtgttgtcaagccccttgacgatagattcgcctccgccctcactgcgctgaacgacatggggaaggtgcggaaggacattcagcagtgggagccaagccgaggctggaacgactggacgcaggtcccgttttgctcccatcacttccacgagcttataatgaaggacggcagagtgttggtggtgccctgccgcaaccaagacgaactaatcggtcgggcgcgcataagccagggagcgggatggtccctgcgggaaaccgcctgcctcggcaagtcgtacgcccagatgtggtcacttatgtactttcaccgccgggacttgcggctcgcagctaacgcgatctgcagcgccgtccccagtcactgggttcccattagccggacgacctggagcattcatgctacccacgagtggatgaccaccgaggacatgttaactgcgtggaacagagtatggatacaggagaacccgtggatggaggacaagactcccgtcgagtcgtgggaagagataccttacctgggaaaacgtgaagatcaatggtgcgggagccttattggcctgaccagcagggctacctgggccaaaaatattcaaaccgccatcaatcaggtgcgctcgctgatcgggaacgaggaatacaccgactacatgccgtccatgaaaagattccgccgggaagaagaggaagctggggtgctatggtga

SEQ ID NO: 24857 - RNA, 9876 nt, synthetic construct
  misc_feature 1..9876: note = derived and/or modified CDS sequence (opt11) from DENV-2__KX380821__SS-prME
  source 1..9876: mol_type = other RNA
acagccggcataatcattatgatgatccccaccgtaatggcattccaccttaccacgcgcaatggggaaccccatatgattgtatcccggcaagaaaaggggaaatccctcctgttcaagaccgaaaacggggtgaacatgtgtaccctgatggcgatggacctcggtgagctgtgcgaggacaccatcacctacaactgcccacttttacgccaaaacgagcccgaagacatcgactgctggtgtaacagcacctccacctgggtgacctacgggacttgtaccgcgaccggcgagcacaggcgcgagaaacggagcgttgccctggtgccccacgttggcatggggctggagactcggacggaaacctggatgagcagcgaaggcgcctggaagcacgcgcagcgtatagagacttgggtactccggcaccccggcttcaccgtcatggccgccatcctggcctacacgatcgggaccacctatttccagcgggtgctgatcttcatcctcctgacggccgtcgcgccctccatgactatgcgctgtatcgggatcagcaaccgggacttcgtcgagggcgtgtccggagggagttgggtcgacattgtgctggaacacggctcgtgcgtgaccaccatggccaagaacaaacctacgctcgatttcgagctgatcaagacggaggccaagcaccccgccaccctgcgtaaatattgcattgaggccaagctcaccaacacgaccacagcgagcagatgcccgacgcagggggagccctccttgaacgaggagcaggacaaacgcttcgtatgcaagcatagcatggttgaccgtggttgggggaacggctgtggcctgttcggcaagggcgggatcgtgacgtgtgcgatgtttacctgcaagaagaacatggaggggaagatcgtgcagcccgagaatctcgaatacacaatcgtgatcacgcctcactccggggaggaaaatgccgtggggaatgacaccgggaaacatgggaaggaaatcaaggttacaccacagagcagcatcaccgaggcagagctgaccggttacgggaccgccactatggagtgttcaccccggaccggcctggactttaatgaaatggtgctcctgcagatggagaataaggcttggctggtgcaccggcaatggttcctcgatctgcccttaccatggctcccgggcgcggacactcaaggctccaactggatccagaaggagacactggtaacgtttaagaaccctcacgcgaagaagcaggacgtggttgtgctgggcagtcaggagggggcgatgcacaccgccttaaccggcgcgaccgagatccagatgagctccgggaacttactgtttactgggcacctcaagtgtcgcttaagaatggacaagctccagctcaagggcatgtcgtattccatgtgcaccggcaagttcaaggttgttaaggagatcgccgagacgcagcatggtacgatcgtgatacgggtgcagtacgagggcgacgggagcccttgcaaaatcccctttgagatcatggatttggaaaagcggcatgtcctgggccgcctcatcacggtaaacccgatcgtcaccgagaaggacagccctgtcaacatagaggcggagccgccctttggggacagctacataatcatcggggtggagccagggcaactgaaattgtcctggttcaaaaagggatcttcgattgggcagatgttcgagaccaccatgcgcggcgccaagaggatggccatcttgggggacacggcgtgggactttgggagcctaggaggggtgttcacctccatcggaaaggccttacatcaggtgttcggcgccatctacggcgccgctttcagcggtgtgtcctggaccatgaagatcctcatcggcgtggtaatcacgtggatcggcatgaacagccgttccacgtccttgtccgtctccctggtgcttgtcggggtggtcacactctaccttggcgtcatggttcaggccgacagcgggtgcgtggtcagttggaagaacaaggagttgaagtgcgggagcgggatattcatcaccgacaacgtgcacacctggacggaacaatacaaattccaacccgagtccccctccaagctcgcatccgccatccaaaaagcccatgaggaggggatatgcgggatccggagcgtcacccggctcgagaacctgatgtggaagcagatcacccccgagctcaaccacatcttgacggaaaacgaggtaaaactcaccatcatgaccggggacataaagggcatcatgcaagcggggaaacggaccctccgcccgcaaccgaccgagctgaagtactcctggaaggcctggggcaaggccaagatgctgagcacggagttacataatcacacgttcctgatcgacggccctgagaccgccgagtgcccgaacaccaatcgtgcgtggaactccctggaggtggaggactacgggtttggcgtgttcacgactaacatctggttaaagctgaaggagcgccaagacgtcttctgcgatagcaagctgatgtccgcggccattaaagacaacagggccgtgcacgctgatatggggtattggatcgagagcgccctcaacgatacctggaagatcgaaaaggcgtcgttcatcgaggtcaagagttgccactggcctaagtcccacaccctgtggtcgaatggagtgctggagagtgaaatgatcattcccaagaatttcgcgggtcccgtgagccaacataactaccgcccggggtaccacacccagactgcgggcccctggcacttggggcgactggagatggatttcgacttctgtgaaggcacgaccgtggtagttaccgaggactgcggtaaccgaggacccagcttgcggacgaccactgcctctggaaaactcatcaccgagtggtgctgtcgcagctgcacgctgcccccgctgcgctaccgaggagaggacggctgctggtacgggatggaaatccggcccctcaaggagaaggaggagaacctggttaattccctggtcactgcgggccatgggcagatagacaacttctctctaggcgtactgggcatggccctatttttagaggagatgctgcgtactcgggtaggaaccaagcatgccatcctattggtcgccgtgtcctttgtcacgctgataactggcaacatgagcttccgcgatcttgggcgcgtcatggtcatggtcggcgccactatgacagacgatatcgggatgggagtcacgtacctggccttattggctgcgttcaagatccggccgactttcgcagccggcctgctactgcggaagctcacgagcaaggagctcatgatgacaacgatcggaatcgtgctgttgagccaatcgacaatcccggagagcatcttagagctgaccgacgcgcttgccctaggcatgatggtgctgaaaatagtgcggaatatggagaagtaccagctcgctgtgaccatcatggccatcttgtgtgtcccgaacgcagtgatcttgcagaacgcgtggaaggtatcctgtacgaccctcgcagttgtgagcgttagccccctactgctcacaagctcccagcaaaaggccgactggatcccgctagccctgacaataaaaggtctgaaccccacagcgatctttctgacaaccttgagccggaccagcaagaagcgttcctggccacttaatgaggcgatcatggcagtcgggatggtgtctatcctggccagctccttgctgaagaacgacattccaatgactggccccctggtggcagggggcctgttgaccgtatgttacgttctgaccgggcgctcagcggacctggagctcgagagggccgccgacgtgcgctgggaggaacaggccgaaatcagtgggagcagcccaatcctctccattaccatatcggaggacgggtccatgagtatcaaaaacgaagaagaggaacaaacccttaccatcctcattcgtaccggtcttctggtgatctccggactcttcccggtgagtatccccatcaccgccgcggcctggtacctgtgggaggtgaagaaacagcgcgccggtgtcctgtgggacgtgccatcaccgccgccggttggcaaagcagagcttgaggatggggcttaccggatcaaacaaaagggaatcctggggtattcacaaatcggcgcgggtgtctacaaggaggggaccttccacacgatgtggcatgtgacccgcggcgccgtgttgatgcacaaaggtaaacgcatcgaaccatcgtgggccgacgtcaagaaggacctcatatcatacggcggcgggtggaagttagaaggcgagtggaaggagggggaggaggtccaggtgttggccctcgagcccgggaagaatccccgtgccgtgcagaccaagcccggactcttcaagacgaacacggggaccataggggcggtaagtctagacttctcccctgggacctccggctcacccatcgtagacaaaaagggcaaggttgtaggcctctacgggaacggagttgtgacgcggtccgggacctacgtgagcgccatcgcccagacagagaagtccatcgaggacaaccccgagatcgaggatgacatctttagaaagaaacggctaactatcatggaccttcacccaggggccggaaaaactaagcgctacctgcccgccatcgtacgggaggctatcaagcgcggactccggacgctgatcttggctccgacacgcgtcgtggccgcggagatggaggaggcgctccgcggactacctattcggtaccaaacccccgcaataagagccgaacacaccgggcgggagatcgtggacctgatgtgccatgccacgttcactatgcgccttctaagcccaatcagggtcccgaattataatctgatcattatggacgaggcccacttcacagatcccgcatccattgccgcccgtggctacatctctaccagagtggaaatgggggaggccgcggggattttcatgacggcgacaccccctggcagccgcgacccgtttccacagagtaatgcccccatcatggacgaggagaaagagatccccgaacgatcgtggaactccgggcatgagtgggtgaccgatttcaagggcaaaactgtctggttcgtgccgtcgatcaaggcgggtaacgacatcgccgcctgccttcgcaagaacggtaagaaggtgatacagttgtcccggaagacgttcgacagcgagtacataaagacgcgcaccaacgactgggatttcgtcgtgaccacagacatatccgagatgggcgccaacttcaaggctgaacgcgttatcgatccccgccgttgtatgaagccagtcatacttaccgacggggaggagcgggtaatcctcgccggccccatgcccgtgacccactcgtccgccgcgcagcgacgaggtcgggtcggtcgcaaccccaagaacgagaatgaccaatacatctatatgggcgagcccctagagaacgacgaagactgtgcccactggaaggaggccaagatgctgttggacaacatcaacaccccggagggcataatcccgtcaatgtttgagccggaacgcgagaaagtggacgccatcgacggcgagtaccggctgcgcggagaggcccgtaaaacgttcgtggacctgatgcgcagaggcgacctcccggtttggctcgcgtaccgcgtcgccgcagaaggtataaactacgctgatcggaggtggtgttttgacggcgtcaaaaacaaccaaatcctggaagagaacgtcgaggttgaaatctggaccaaagagggggaacggaagaagctaaagccgagatggctggatgcccggatctacagtgaccccttggcgctcaaggagttcaaggagttcgccgctggccgcaagtcactgactctgaacctcatcactgagatgggacgtctgcctaccttcatgacacagaaagccaaaaacgcgcttgacaacctcgccgtcctgcacaccgcggaagctgggggccgcgcctataaccatgcgctctccgagcttccggaaaccctggagacactgctcctgctgaccctccttgcaaccgtaaccggtggcatctttctgttcttaatgagtggcaaagggattggcaagatgacccttgggatgtgttgcattataacggcctccatactactctggtatgcccagatccaaccacactggatcgccgcgagcatcatcctggagttcttcctgatcgtgttactcattccggaacctgagaaacagagaactccccaggataaccagctgacctacgtagtgatagccatcctcaccgtggtcgcggccacgatggccaacgagatgggtttcctcgagaagactaagaaagacttcggactagggagcataacgacccagcagccggaaagcaatatcctcgacatcgacctgcgaccagcgtcggcttggacgctctatgccgtagccacaaccttcattacccccatgttgcggcactccatcgagaacagctccgtcaacgtcagcttgacggccatcgcgaaccaggccaccgtgctgatgggcttaggaaaaggctggccactgagcaagatggacatcggagtgccgctgctcgccattggctgctattcccaggtcaacccaatcaccctgacagcagctctgcttctgctggtggcccactacgccatcataggtcctggtctgcaagccaaggccacgcgagaagcacagaaacgcgcggctgccggtatcatgaagaacccaactgtcgatggaatgacagtcatcgacctggacccgatcccctatgaccccaaatttgagaagcagctgggacaagtcatgttattagtactgtgcgtcacccaggtgcttatgatgcgcacgacctgggccctgtgcgaggcgctgacgttggctacagggcccatctcaacgctgtgggagggcaacccgggccgcttctggaacacgaccatcgccgtgagcatggcaaacatcttccgtgggtcctacttagcgggggcgggtctactgttcagcattatgaagaacaccgccaacactcgccggggcactgggaacacaggcgagaccttaggcgagaagtggaaaaaccgactaaacgccctggggaagtccgagttccagatctacaagaagtccggcatccaggaagtcgaccggacgctagcgaaggaagggatcaagcgcggcgaaaccgaccaccacgcggtgtccagagggagtgcaaagctccgctggtttgtggaacggaacctggtcacccccgagggcaaagtagtggatcttggctgcgggcgcggcgggtggtcctactactgcggtggactcaagaacgtgaaagaagtgaagggcctgacaaaaggcgggcctggccacgaggagcctatccccatgtctacgtatgggtggaacctggtgcgactccaaagtggtgtcgacgtgttcttcacgccgccggaaaaatgcgataccctgctatgtgacattggcgagtcgtcccccaacccgaccgttgaggcggggcgcaccctgagggtcttaaaccttgtggagaactggctcaacaacaacacacagttttgcatcaaagtgctgaacccctacatgcccagcgtcatcgagaagatggaggccttacagaggaagtatggtggggctctggttcggaatcctctctcaagaaattccacccatgagatgtactgggtgtcgaacgcgtccggcaacatcgtcagctccgttaacatgattagcaggatgcttataaaccgcttcaccatgcgtcacaagaaggccacctacgagcccgacgtggatctggggtcaggcacgcgcaacattggaatagagagcgagacaccgaacctagacataatcggcaaacggatagagaaaatcaagcaggagcacgaaacctcatggcactacgatcaggaccacccctacaagacctgggcctaccatggtagttacgaaacgaagcaaaccgggtccgccagctccatggttaacggcgttgtccgcctgctgactaagccgtgggatgtcatacccatggtgacccaaatggccatgacggacaccacccccttcgggcagcaacgcgtcttcaaggagaaggtcgatacccggacgcaggagcccaaggagggcacaaagaagctgatgaagataaccgcggaatggctctggaaggagctgggcaaaaagaaaaccccgcgcatgtgtacgcgggaggagttcacccgcaaggtgcggtcaaatgccgcgctaggggccatattcaccgacgagaataaatggaagtccgccagggaggcggtcgaagacagcggcttctgggagctcgttgacaaggagcggaacctgcacttggaggggaagtgcgagacctgcgtgtacaacatgatgggcaaacgggagaagaagctgggtgagttcggcaaggccaagggatcgcgtgctatctggtatatgtggctgggtgcccgcttcctcgagtttgaagcgcttggctttctgaacgaggaccactggtttagccgggagaacagcctctccggagtcgagggagaagggctgcacaagctcgggtacatcctacgcgacgtaagcaagaaagaaggaggggcaatgtatgccgacgatacggccggttgggacacccggattacgctggaggacctcaagaatgaggaaatggtgaccaaccacatggaaggggagcacaaaaagctggctgaggcgatatttaagctgacgtatcagaacaaggtcgtgcgcgtgcagcggcccacgccccgcggcactgtcatggacatcatctcccggcgcgaccagcggggtagcggccaagtggtaacctacggcctgaacacgttcacgaacatggaggcccagttgattcgccagatggaaggggagggcgttttcaaatcaatccagcagcttacagtaaaagaggagatcgccgtgaagaactggttgatccgggtcgggagagaacgcctcagcagaatggccatttccggcgacgactgcgttgtaaagccgctggatgatcgcttcgcgagcgcactgactgctctcaatgacatgggcaaggttcggaaggacatacagcagtgggagccttcccgtgggtggaacgactggacacaggttcccttctgtagccaccacttccacgaactaattatgaaggacggccgggtgctggtagtgccctgtcgcaaccaggacgagttaatcgggcgggcacgtatctcccagggcgccgggtggagtctgcgggagaccgcctgtctgggaaaatcctacgcgcagatgtggagcctcatgtacttccacaggcgcgacctgcgccttgccgccaatgctatttgttccgccgtgcctagccattggatcccaacctctaggaccacctggagcatccacgcgacgcatgagtggatgacgaccgaggacatgctcacggtctggaaccgcgtgtggatccaagaaaacccctggatggaggacaagacgcctgtcgagagctgggaggagattccctatctgggcaagagggaagatcagtggtgcgggtccctgatcggcctcaccagccgtgcaacctgggccaagaacatccaaaccgctatcaaccaagtgaggtccctgatcgggaacgaggagtacacggactacatgcccagcatgaagcgcttccggcgcgaggaggaggaggcaggcgtattatggtga

SEQ ID NO: 24858 - RNA, 9876 nt, synthetic construct
  misc_feature 1..9876: note = derived and/or modified CDS sequence (opt11) from DENV-2__KX380822__SS-prME
  source 1..9876: mol_type = other RNA
acagcggggatcatcatcatgatgatccccaccgtgatggctttccatctgaccacccggaacggtgagccccacatgatcgttagccggcaagagaaaggtaaaagcctcctgttcaaaacggaaaacggggtcaacatgtgcacccttatggcgatggaccttggggagctgtgcgaggacacgatcacctacaactgccccctgttgcgccagaacgaaccggaggatatagactgttggtgcaacagcaccagcacatgggtgacctatggcacatgcaccgcgacgggcgagcaccggcgcgagaaaaggtcggtcgcacttgtgccccacgtgggtatggggctagagacgcgcaccgagacgtggatgtccagcgagggcgcttggaaacatgcccaacggatcgaaacctgggtcctcagacaccctgggttcacggtaatggcagccatcctggcttataccataggcaccacgtactttcaacgggtcctaatctttatactcttgacggccgtcgcgccctccatgaccatgcgctgcatcgggataagcaaccgagacttcgttgaaggcgtgtccggagggagctgggtcgacatagtgctggagcacggttcctgcgtgaccaccatggctaaaaacaagccgacgctagacttcgagttgatcaagaccgaggccaagcaccccgccaccttacgcaagtactgcatcgaggccaagctcaccaacacgaccacggcgagccggtgtccgacccagggggagccctccctgaacgaggagcaagacaaacgtttcgtctgcaaacacagcatggtggaccggggctggggcaacgggtgtggcctgttcgggaagggagggatcgtgacgtgcgcgatgtttacgtgcaagaaaaacatggagggaaagattgtccagcccgagaacctcgagtatactatcgtgataacaccccactccggggaggagaatgccgtggggaacgatacgggcaagcacggtaaggagatcaaagttactccgcagagctccatcacagaggcagagctgaccggctacgggacggccacaatggaatgcagcccccgaacaggcctggattttaacgaaatggtccttctgcaaatggaaaacaaggcgtggttagtgcatcggcagtggttcttagacctgcccctgccatggctcccgggcgcagacacccagggttccaattggatccagaaggagactttagtcacgttcaaaaacccacacgccaagaagcaagacgtggttgtgttaggcagccaggagggggccatgcacaccgctctcaccggcgcgaccgagattcagatgagctcagggaatctgctgttcacgggccacctcaagtgccgcctgcggatggacaagttacaattgaaagggatgagctactccatgtgcaccgggaagtttaaggtggtcaaggagatcgcggagacccagcatggcaccatagtgattcgcgtccagtacgagggggacggctcaccctgtaaaatccctttcgagatcatggaccttgagaagcggcacgttctggggcgcctcatcaccgtgaacccgatcgtgacagagaaagatagtccagttaacatcgaggccgagcctcccttcggagacagctacataattatcggcgtggagccgggccagctaaagctgtcctggttcaagaagggctcctctatcgggcaaatgttcgagaccaccatgcgtggcgcaaagcgtatggccattctaggcgacacggcgtgggacttcgggagcctaggaggcgtgttcacctcgatcggcaaggcattgcaccaagtcttcggggccatttacggcgccgcgttttctggcgtctcctggaccatgaagatactcataggcgtcgtcatcacctggatcggcatgaatagccgctccacgtccctatccgtgagcctggtgctcgtcggaatcgtgaccctatatctaggagtgatggtccaggccgactcggggtgtgtagtaagttggaagaacaaggagctgaagtgcggctcagggatcttcatcacggacaacgtccacacctggacggagcagtacaagttccagccggagtccccgtctaagctcgcctccgccatccagaaagcgcacgaggaggggatttgcgggatacggagcgtgacccgcctggagaaccttatgtggaagcagattacccccgaactcaaccatattctgtcggagaacgaggttaagctgaccatcatgacgggggacatcaaggggatcatgcaggcagggaagcggagcttacgccctcagcctactgagcttaaatactcatggaaggcgtggggcaaggccaagatgctgagcaccgagctccacaaccacaccttcctcatcgatggccccgagaccgccgagtgccccaacacaaaccgagcctggaacagccttgaggtcgaggactacggtttcggcgtgttcactaccaacatctggctcaagttgaaggagcgccaagacgtgttctgtgattcaaagttgatgtccgcggccattaaagataaccgggccgtgcacgccgatatggggtattggatcgagagcgccctcaacgacacgtggaaaatagagaaggcgtcctttatagaggtcaagagctgccactggcccaagtcccacaccctgtggagcaacggcgtcctcgagtccgagatgatcatacccaagaatttcgccggccccgtgagccagcacaactaccgcccggggtaccacacacagaccgccggtccctggcatctcgggcggctggagatggacttcgacttttgtgaggggaccacggtggtagtcaccgaagactgcggaaaccgtggccccagtttgcggaccaccacggcctccggtaagttgatcaccgagtggtgttgcagatcatgcaccttaccgccactccgttaccgcggggaggacggctgctggtacgggatggagattcggcccctcaaggagaaggaggagaatctggttaactccctggtgacagcgggccatggccaaatagacaacttcagcttgggcgtcctgggcatggctttattcctggaggagatgctgcgcacgcgagtggggaccaagcatgccatcctgctcgtggccgtcagtttcgtgaccctgatcaccgggaacatgagcttccgcgatctggggcgcgtgatggtgatggtgggcgccacgatgaccgacgacatcgggatgggcgtgacctacctggcgctgttggctgcgttcaaggtgcggcccacgttcgccgcaggcctcctgctgcgcaaacttacgtccaaggaactgatgatgaccaccatcgggatcgtgctgctcagccaatctaccatccccgagacgatcttggagctgaccgatgccctggcactgggcatgatggtgctgaagatcgtccggaacatggaaaagtaccagctcgccgttaccattatgacgatactatgcgtccctaatgccgtgatcctccaaaacgcctggaaggtaagctgcactatcctcgccgtcgtgagcgtgagccccctgctgctcacctcctcgcagcagaaggccgactggatccccctcgccctgacaatcaaggggctcaaccccacggccatcttcctcacaaccctgtcccgcacgtccaagaaacggtcgtggccgctcaacgaggcgattatggccgtcggcatggtgagcattctggcctcatctctgctcaagaatgacatacctatgaccggtcctctggtagccgggggcctgctaacggtgtgctacgtgctgacggggcgcagcgccgacctggagctcgagcgtgcggcggacgtgcgctgggaggagcaggccgagatctccgggagctcgccaatcctgtcgatcaccatctccgaggacgggagcatgtccatcaagaacgaggaagaagaacagaccctgacgattctcatccggaccggtcttctagttatcagcggcctatttccggtgtccattcccatcaccgcagcggcatggtacctatgggaggtgaagaaacagcgcgctggggtcctgtgggacgtgcctagtcccccgcccgtggggaaggcagagctcgaagatggggcctaccggattaagcaaaaggggatcctcggctactcccagatcggtgccggtgtgtacaaggaagggacgtttcacaccatgtggcatgtaactcgcggtgccgtgctcatgcacaaagggaagcgcatagagcccagctgggccgacgtgaaaaaggacttaatttcgtacggcgggggatggaagctggaaggggagtggaaagagggggaggaagttcaggtgctagccctcgagcccggcaagaacccccgcgccgtccagactaagccagggctattcaagacgaacaccggcacgatcggggccgtcagcctggatttctcccccggaacctcaggatccccgatagtggacaaaaaggggaaggtcgtgggactctacgggaacggcgtggtcactcggtctggcacctatgtgtctgcgatcgcccagacggaaaagtccattgaggacaaccctgagatagaggacgacatcttccgcaagaaacggctgacgatcatggacctgcaccccggtgccggcaagacaaagcgctacctgccggccatagtgcgggaggccataaaacgcgggctacggacccttatcctggccccgactcgcgtcgtagccgccgaaatggaggaggccctgcgcggccttcctatacggtaccagacccccgcgatacgcgccgaacacaccggtcgggaaatagttgatctgatgtgccacgcaacctttacgatgcgcctcctaagcccgatacgggtgcctaattacaatttaatcatcatggacgaggcacacttcaccgacccggcgagtatcgcggcccgcggctacataagcacccgcgtggagatgggcgaggcagcaggaatcttcatgacagccacgccacccggctccagagatccattcccccagagcaacgcgccgataatggacgaggaacgggaaatcccagaacgctcgtggaacagcggtcacgagtgggtgaccgacttcaagggtaagactgtatggttcgttccgtccataaaggccgggaacgatatcaccgcgtgcctacggaaaaacggcaagaaagtgattcagctgagccggaagaccttcgacagcgagtatatcaagaccagaacaaacgactgggatttcgttgtcaccacggatataagcgagatgggcgccaatttcaaggcggagcgcgtgatcgaccctcggcgctgcatgaagcccgtcatcctgaccgatggggaggagcgggtgatactcgccggccctatgccggtgacacatagtagtgctgcccagcgccggggacgggtaggtcgcaaccctaagaatgagaacgatcaatacatatatatgggggagcccctggagaacgacgaagactgcgcgcactggaaggaggctaaaatgctgctcgacaatatcaataccccagaaggtatcatcccctccatgtttgagcccgaacgggagaaagtggatgcaatcgatggcgagtacagactacggggcgaggcgaggaaaacgttcgtggacctgatgcggcgaggcgatctccccgtatggctggcctaccgggtggccgctgaagggatcaattacgccgaccggaggtggtgttttgacggcgtcaagaacaaccagattctggaggagaacgtagaggtggagatctggaccaaggaaggggagcgtaagaagctgaagccgcgctggctggatgcccgcatttacagcgacccccttgccctcaaggagtttaaagagttcgccgccggccggaagtccctgacactgaacttaatcaccgagatgggccgcctccccacatttatgactcagaaggcccggaacgccctggacaacctggccgtcctacacaccgcggaagccgggggacgcgcgtacaaccacgcactaagcgagctccctgagacccttgagacgctgctcctcttaaccctactggccacggtcacgggcggcatattcctgttcctcatgtccggcaaagggatcggcaagatgaccctggggatgtgctgcattatcaccgccagcatcctgttgtggtacgcccagatccagccacactggatcgctgcctcaatcatcctggagttcttcttaatcgttctcctaatccccgagcccgagaaacagcgcacgccccaggacaatcagctgacatacgtcgtaatagccatcctaaccgtggtcgcggcgaccatggcgaacgaaatgggcttcctggaaaagaccaaaaaggatttcgggctgggcagcatcaccacgcagcagccagatagcaacatcctcgatatcgacctccgccccgcatcggcatggaccctgtacgcggttgccacaactttcatcacccccatgctccggcatagcatcgaaaactccagcgtaaacgtctccctgacggccatcgcaaaccaggcgacggtactgatgggcctggggaaaggctggcccctttctaagatggacatcggggtgccgctgctagcgatcggctgctactctcaggtcaaccccatcaccctcaccgccgccctgctcctgctggtggcccactacgctatcattgggccgggcctccaggccaaggcgacgcgagaggcccagaagcgggcggctgccggcatcatgaaaatccccgcagccgacggtatgaccgtaatagacctggacccgattccctacgacccaaagttcgagaagcagctgggtcaggtcatgctcctggtgctgtgcgtgacccaagtattaatgatgcgcaccacctgggccctgtgcgaggcactgaccttagccaccgggccaatcagcactctgtgggagggcaaccctgggagattctggaatacgaccatagcggtgtccatggccaacattttccggggcagctacctggccggcgcgggactcctatttagcatcatgaagaacacggccaatacgcgacggggcacggggaacaccggcgagaccctgggagagaaatggaagaaccgcctgaacgctctggggaagtcggagttccagatctacaagaagtccgggattcaggaggtggatcgtaccctggccaaggaggggatcaagcgcggcgagacagatcaccacgcggtgagccgggggagcgccaagctccgctggttcgtagagcggaacctggtgacccccgaggggaaagtcgttgacctgggctgcggacgcggcgggtggagctactactgcggcgggcttaagaacgtgaaggaagtaaagggcctgaccaagggcgggccgggccacgaggaacccatcccaatgtccacctacggctggaacctggtgcggctccaaagcggcgtggacgtcttcttcacgccgcccgagaagtgcgacacgctgctgtgcgacatcggggagtcctcacccaacccgaccgttgaagccggcagaacactccgagtgctgaaccttgttgagaactggctcaacaacaacactcagttctgtatcaaggtgctcaatccctacatgccgtctgtgatcgagaaaatggaagccctgcagcgcaagtacggcggggccctggttcggaaccctctctcgcgcaacagtacgcacgagatgtactgggtatcaaacgcctccgggaacatagtgtcaagcgtcaacatgatctcgcgtatgctgatcaatcgcttcaccatgaaacataagaaggcaacctatgaacctgacgtagacctgggaagcggcacccggaacatcggcatcgagtcagagacgcccaatttagacatcattggaaagcgcatagaaaagatcaagcaggaacatgagaccagctggcactacgaccaagatcacccctacaagacgtgggcctaccacggctcctacgagaccaagcaaactggatcggcctctagcatggttaacggagtcgtccgcttgctgacgaaaccttgggacgtgatccccatggtaacccagatggcaatgacggacacgacccccttcgggcagcaacgggtctttaaggagaaagtggatactcgcacccaagaacccaaggaagggacgaagaaattaatgaagattaccgcggaatggctgtggaaagagctgggcaagaagaagaccccgcggatgtgtacccgtgaggagttcacgagaaaggtccgctcaaacgccgcgctcggggccatcttcactgacgagaacaaatggaagtccgcccgggaggctgtggaggactccggcttctgggagctggtcgacaaggagcgcaacttacacctcgagggaaaatgcgaaacatgcgtgtacaacatgatgggtaagcgggagaagaagctcggggagttcggaaaggcgaaaggatcgcgcgccatctggtacatgtggctgggagcccggttcttggagttcgaggcgttgggattcctgaacgaggaccactggttcagtcgggagaacagcttgagcggggtggaaggcgaagggctgcacaagttgggctacatcctccgggacgtgtccaagaaggagggaggggccatgtatgccgacgacaccgccggctgggacacccgcatcaccctggaggacctgaagaacgaggagatggtgaccaaccacatggaaggggagcatcggaagctggccgaggcgatcttccgcctgacctaccagaacaaggttgtccgtgtgcagcgcccgacaccgcgggggactgtgatggacatcatcagccgacgggaccagagagggtccggccaggtcgtgacctacggcctgaataccttcacaaacatggaggcccagctcatacggcaaatggagggggagggcgtgtttaaaagcatccagcatctgaccgttaccgaggagatcgccgtgaagaactggctggagcgtgtagggagggagcggttaagccgcatggccatctctggcgatgactgcgtagtgaaacccctggatgatcggtttgcctccgccctgacggccctaaatgacatgggaaaggtgcgcaaggatatccagcagtgggaaccaagccgtgggtggaacgactggacgcaggttcccttctgctcccaccacttccacgaactaatcatgaaggacggccgcgtgctagtcgtgccctgccggaaccaggacgagctaattgggagagcccgaatcagccagggcgccgggtggtcgttgcgcgagaccgcatgccttggtaaaagctacgcacagatgtggtccctcatgtacttccaccggcgcgacttacggctggccgcaaacgccatctgctccgcggtgccctcccactgggtgcccaccagccgcacgacttggtcgatacacgccacgcacgagtggatgaccaccgaggacatgctcaccgtatggaaccgggtgtggatccaggagaacccctggatggaggacaaaacgccagttgagtcctgggaggagatcccttatttaggcaagcgcgaggaccagtggtgtgggtcccttatcggcctcacgtccagagcaacctgggccaagaacatccagaccgccatcaatcaagttcggagcctgatcggtaacgaggagtacacggactatatgccgtccatgaagcgattccgacgcgaagaggaagaggcgggagtgctgtggtga

SEQ ID NO: 24859 - RNA, 9876 nt, synthetic construct
  misc_feature 1..9876: note = derived and/or modified CDS sequence (opt11) from DENV-2__KX380828__SS-prME
  source 1..9876: mol_type = other RNA
accgcgggcgttatcatcatgctgatccccaccgccatggcattccacctcacaacccgcaacggggagccccacatgatcgttagccggcaagagaagggcaagagcctgctgttcaaaaccgaggacggggtcaacatgtgcaccctcatggcaatggacctgggcgagctgtgcgaggacaccatcacctacaactgcccactactacgccagaatgaacccgaggacatcgactgttggtgcaatagcacatcgacctgggtgacatacgggacgtgcaccgctaccggcgagcaccggcgagagaagcggagcgtcgccctggttccccacgtgggcatgggtctcgagacccgcaccgagacttggatgagtagcgagggcgcctggaagcatgcacagcggatcgagacctggatcctgcgccaccccgggttcacgatcatggctgccatcttggcctacaccattggtaccacctactttcagcgggtcttaatcttcatcctgctgacggcggtggcgcccagtatgaccatgagatgcatcgggatcagcaaccgagacttcgtggagggcgtctccggcgggagctgggttgacatcgtgctcgagcatgggtcttgcgtcacgaccatggccaagaataagcccacgttggacttcgaactgatcaagacggaggccaagcagcccgccaccttgcgcaagtactgtatcgaagctaagttgaccaacaccaccaccgctagccggtgcccgacccagggagaaccgtccctgaacgaagagcaggacaagcgcttcgtgtgcaagcatagcatggtggaccggggctggggcaatggatgcggcctctttggaaagggcgggatcgtcacgtgcgccatgttcacgtgcaagaaaaatatggagggcaagatcgtgcagcccgagaatctggaatacacaatagtggtcacaccccattccggcgaggagaacgccgtgggtaatgacacagggaagcacgggaaggagatcaaggtgaccccgcagagctccataaccgaggccgagctgactggatacgggaccgtgaccatggagtgcagcccccgcaccggattagacttcaacgagatggtgctactgcagatggagaataaagcgtggctcgtccatcggcaatggttcctggacctgcccctcccctggctgccgggcgccgacactcagggttccaattggattcagaaggagatgctggtcaccttcaagaacccacacgctaagaagcaagacgtggtcgttctcggcagccaggagggggccatgcacacagccctcaccggggctactgaaatccagatgtcgtccgggaatctcctgttcaccggacacctgaaatgccgcctgcggatggacaagctacagcttaagggcatgagctactccatgtgcacgggaaagttcaaggttgtcaaggaaatcgccgagacccagcacggcaccattgttgtgagagtccagtatgagggggatggcagcccctgcaagataccctttgagatcatggacctggagaagcggcacgtgctcggccgcctgatcaccgtgaaccccatcgtcacggagaaggactccccagtgaacatcgaagcggagccgcccttcggggacagctatataatcatcggcgtagagccggggcaactgaagctctcctggttcaagaagggcagcagtatcgggcagatgttcgagaccaccatgcgcggcgccaagcggatggccatcctgggagacaccgcgtgggacttcggaagcctgggcggggtcttcacgtccatcggtaaggccctccaccaggtatttggggccatttacggggccgcgttcagcggcgtttcctggaccatgaagatcctgatcggcgtcgtcatcacctggattggcatgaacagccgctccaccagcctgtccgtgtcactcgtcctcgtgggcgtggtcacgttatacctgggcgtaatggtgcaggccgactcggggtgcgtcgtgagctggaagaataaggagctcaagtgcggcagcggaatcttcatcaccgataacgttcacacatggaccgagcagtataaattccagcccgagtcacccagcaaactggcgagtgccatccagaaggcccacgaggagggaatctgtggaatccggagcgtaacccgactggagaatctcatgtggaagcagatcacccccgagctcaaccatattctgtcggagaacgaagtgaagctcaccatcatgaccggagacatcaaagggatcatgcaggcggggaagcgtagcctgcgcccgcaacccacggagctgaagtattcctggaagacctggggcaaggccaaaatgttatccaccgaaccccacaaccagaccttcctaatcgacggcccggagacagccgaatgccccaataccaacagagcctggaactccctggaggtggaggactatgggttcggcgtcttcaccaccaacatctggctcaaactgaaggagcgacaggacgtgttctgcgacagcaagttaatgtccgccgcgatcaaagacaacagggccgttcatgccgatatggggtactggattgagagcgccttaaacgacacgtggaagatagagaaggcctccttcatcgaggtcaaaagctgccactggcccaagtcccacaccctgtggagcaacggcgtgctggagtccgagatgatcatccccaagaacttcgccggcccggtcagccagcataactaccgccccgggtaccacacccaaaccgcaggcccttggcacctcgggaagctggaaatggactttgacttctgcgagggcaccacggtcgttgtgacagaggactgcgggaatcggggccccagcctgaggaccaccacggcttcgggcaagcttatcaccgaatggtgttgccggagctgcaccctcccgcccttgcgctacaagggggaagacgggtgctggtacgggatggaaatccggcccctcaaggagaaggaggagaacctggtcaactccctggttaccgctggtcatgggcagattgataacttctctttgggcgtcctgggcatggcgctgttcctcgaggagatgctgcgcacgagagtcgggacgaagcacgccgtgctgctagtggccgtctccttcatgaccctcatcacgggcaacatgagcttccgcgacctggggagagtgatggtcatggtcggtgccgcgatgacggacgacatcgggatgggcgtgacttacctcgccctgcttgccgctttcaaggttcgcccaacgttcgctgccggcctcctgctgcgcaagctcacctccaaggaactgatgatgaccaccatcggtatagtcctgctcagccagtccaccatcccggagaccatactggagctgacggacgcgctcgccctgggcatgatgatcctcaagatcgttcggaacatggagaagtaccaactcgcagtcaccataatggccatcctatgcgcccccaacgcagttattctccagaacgcctggaaggtgagctgtaccatcctcgccgtcgtgtccgtaagccccttactgctcacctccagccagcaaaaggcagactggatccccctggctctgacgatcaaagggctcaacccgaccgcgatcttcctgaccaccctgtcccgcaccaacaagaagcggtcgtggcccctcaacgaggccataatggccgtcggcatggtgtccatcctcgcgagctccctgttaaagaacgacatccccatgaccggccccttagttgccggcgggctgctcacagtctgctacgtgttaaccgggcgcagcgcagacctggagctcgagcgggccgccgacgtgcgctgggaggaccaagccgaaatctcggggtcgagccctatcttatcgatcacgatctctgaggacgggtcgatgagcattaagaacgaagaggaggagcagaccctgaccatcttaatccggaccggcctgctggtaatttccggcctcttcccagtgagcatccctatcacggccgctgcctggtacctgtgggaggttaaaaagcagcgcgccggggtcctttgggacgtgccctccccgccaccggtgggcaaggctgagctcgaggacggggcgtaccggataaagcagaagggcatccttgggtacagccaaatcggcgccggcgtctacaaggaggggaccttccacacaatgtggcacgtgacccgcggcgccgtgctgatgcataaggggaaacgtatcgagccgtcctgggccgacgtccgcaaggacctaatcagctacgggggtggctggaagctggaaggcgagtggaaggagggggaggaagtgcaggtgctggccctcgagcccgggaaaaacccgcgggcagtccagaccaagcccgggctgttcaagacgaacactggcaccatcggggccgtctccctggacttcagcccgggaacctccggcagccccatcgtggacaaaaaggggaaggtcgtgggcctctacgggaacggcgtggtcacgcgctccggcacctacgtgagcgccatcgcccagaccgagaagtccatcgaggacaaccccgagatcgaggacgacatcttccggaagaagcgcctgaccatcatggatctgcaccccggggcgggcaaaacgaagcggtacttgccggctatcgtgcgcgaggcgatcaagcgggggcttcgcaccctgatccttgctcccacacgtgtcgtagccgccgaaatggaagaggccctccgtggcctgcccatacgctaccagacacccgccatcagagccgagcatacagggcgcgagatcgtggacctgatgtgccatgccaccttcacaatgcggctccttagcccggtcagggtgccgaactacaacctgatcatcatggacgaagcgcactttactgaccccgcgagcatcgccgcccggggctacatctccacgcgcgtggagatgggcgaagccgctgggatcttcatgaccgccactccgcccgggagccgcgaccccttcccccagtccaatgcccccattatggacgaggagcgggaaatccccgagcggagctggaactccggacacgaatgggtcaccgacttcaagggcaagacggtgtggttcgtacccagcatcaaagcgggaaacgacatcgcggcctgcctcagaaaaaatggcaaaaaggtcatccagttatcacggaaaaccttcgattccgagtacatcaagacccgcaccaatgattgggacttcgtggtgacgaccgacatcagtgagatgggcgccaacttcaaagccgagcgcgtcatcgacccccgccggtgcatgaagcccgtgatactgacagacggggaggagcgcgtgatcttggccggcccgatgcccgtcacccacagctcagccgctcagcggcgcggccggataggccgtaatcccaagaacgagaacgatcaatacatttacatgggagagcccctcgagaacgacgaagactgcgcccactggaaggaggccaagatgctactcgacaacatcaacacgccggaggggatcatccccagtatgtttgagcccgagcgcgaaaaggtggacgccatcgacggggagtaccggctgcgcggggaggcgcgtaagacattcgtagagttgatgcgccggggtgacctcccggtttggctggcctaccgggtggccgccgaggggatcaactacgccgaccggcgctggtgcttcgacggcattaagaacaaccagatcttggaggaaaacgttgaggtggagatctggaccaaggagggggagaaaaagaaactcaagccccggtggctggatgcgcgcatctactccgaccccttagccttgaaggagttcaaggagttcgccgccggcaggaagagccttaccatgaacctgataacggagatgggacgcctcccaaccttcatgactcaaaaggctaggaacgccctggacaacctggccgtgctccacactgccgaggccgggggccgcgcgtacaaccacgcccttagcgagctgccggagactctagagactctgcttctcctaaccctgctcgccaccgtcaccgggggcatctttctgtttctcatgtcaggcaaggggatcggcaagatgaccttagggatgtgctgtataatcactgcctccattctgctgtggtacgcacagattcagccccactggatcgcggccagtatcatactcgagttcttcctgatcgtgctgctcatccccgaacccgagaagcagcggaccccacaggacaaccagctgacttacgtggtcatcgccatcctgacggttgtggccgccaccatggcgaacgagatgggctttctcgaaaagaccaagaaggacttcggattaggctccattgtcgcccagcagccagagtcaaacatcttagacatcgacctccgccctgccagcgcctggacactgtacgccgtggcgacaacctttatcacccccatgctgaggcactccatagagaacagcagtgtgaacgtcagcctcactgccattgccaaccaggccacggtgctgatgggcctggggaaggggtggccgctctccaagatggacatcggagtacccctgctggcgatcggctgctacagccaggtcaaccccatcacacttactgccgccctgctgctcctggtggcacactacgccataatcgggccaggcctgcaagctaaggcaacccgcgaggcccagaagcgggccgccgccggcatcatgaagatcccgacggtagacgggattaccgttatagacctcgaccccatcccgtacgacccaaagttcgaaaagcagctgggccaggtgatgctgctggtgctgtgcgtcacccaggtgctgatgatgcgcaccacttgggccctgtgcgaggccctgaccctggccactggcccgatctcaaccctatgggagggtaaccccggccgcttctggaatacgaccatcgccgtgtccatggcgaacatcttccgtggctcatacttagctggagccgggctcctgttcagcatcatgaaaaacaccaccaacacgcgccggggcacggggaacacgggcgagaccctgggcgagaagtggaaaaaccgcctaaactcccttggcaagtccgagttccagatctacaagagatccggaatccaggaggtcgaccgaacgctggccaaagaaggaatcaagcggggcgagaccgaccaccacgccgtgagccgcgggtcagccaagcttcggtggttcgtggagcgcaacctcgtcacgcccgagggcaaggtgatggacctgggttgcgggcggggcggatggagctactactgtggcgggctgaagaacgtacgcgaggtcaagggcctcaccaagggtgggcccggccacgaggagccgatcccgatgtccacatacgggtggaacctggtgcggttacagagcggcgtggatgtcttttttacgccccccgagaagtgtgacaccctcttatgcgacatcggcgagtcctcaccgaaccccaccgtagaggcaggccgcaccctgcgggtgctcaacctggtcgagaactggctgaacaacaacacccagttctgcatcaaagttcttaacccttacatgccgagcgtgatcgagaagatggagactctgcagcgcaagtacggtggggccctggtccggaaccccctgtcccgcaacagcacacacgaaatgtattgggtttcaaacgcaagcggaaacatcgtgtccagcgtaaacatgatctcccggatgctcatcaaccgcttcaccatgagacacaaaaaggcgacgtacgagccggacgtggacctgggttcgggcacccgcaacatcggtatcgagtccgagacccccaacctagacatcatcggcaagcgcatcgagaagatcaagcaggagcacgaaacctcctggcactacgaccaagaccacccgtacaagacatgggcctaccacggctcctacgagaccaagcagaccgggagcgcctccagtatggtgaacggcgtcgtgaggctcctgacgaagccctgggatgtgatccccatggtcacgcagatggcgatgaccgacaccacccccttcgggcagcagcgcgtcttcaaggagaaggtagacacgcggacccaggagccgaaagagggaaccaagaagctgatgaagatcaccgctgagtggctctggaaggaactgggcaagaagaagacgccccgcatgtgcactcgggaggagttcacacgcaaagttcggagcaacgcggccctgggggccatattcaccgacgagaacaagtggaagtccgccagagaggcggtggaggactccaggttctgggagctagtcgacaaggagcgcaacctgcacctggagggcaagtgcgagacgtgcgtgtacaacatgatggggaagcgggagaagaagatcggcgagttcgggcgcgccaagggcagccgggccatctggtacatgtggctgggcgccagattcctggagttcgaggcgctggggttcttaaacgaggaccactggttctcacgggagaactcattgagcggcgtggagggggaaggcctgcacaagctcgggtacatcctgcgcgaggtatccaagaaggagggcggcgctatgtacgcggatgacaccgccggatgggatacccggatcaccttagaggacctcaagaacgaggagatggtaacgaaccacatggagggggaacacaaaaagctggccgaggccatcttcaagctgacgtatcagaataaagtggtccgcgtacagcggcccacgccacgggggaccgtgatggacatcatcagccggcgcgaccaacgcggctccgggcaggttggcacatatgggctgaacaccttcaccaacatgggggcgcagctgatccggcagatggagggcgagggggtgttcaagagcatccagcacctgacgactaccgaggaggtggccgtccaggactggctcgcgcgcgtgggcagagaacgcctgagtcggatggccatcagcggcgacgactgcgtggtcaagccccttgacgaccgcttcgccagtgcgttgaccgccctgaacgacatgggcaaggtgcgtaaggatatccagcagtgggagcccagcaaggggtggaacgattggacccaggtgcccttttgctcccaccacttccacgaactgatcatgaaggacggtcgcgtcttagtcgtgccctgccggaaccaggacgagctgatcggccgcgcccggatcagccagggggccggctggtccctgcgcgaaacggcgtgcctcggcaagtcctacgctcagatgtggagtctgatgtactttcaccgccgcgacctgcgtctcgccgccaatgccatttgtagtgccgtcccgtcccactgggtccccaccagccgcacgacatggtccatccacgcgcggcacgagtggatgaccacggaggacatgctgaccgtgtggaaccgcgtctggatccaggagaacccgtggatggaggacaagacccccgtggaaagctgggaggaaatcccgtacctggggaagcgggaggaccaatggtgcggcagcctcattgggctgaccagccgcgccacgtgggccaagaacatccagaccgccatcaatcaagtgaggagcctgatcgggtccgaggagtacaccgactacatgcccagcatgaaacggttccggcgggaagaggaggaagcgggggtgctctggtga

SEQ ID NO: 24860 - RNA, 9876 nt, synthetic construct
  misc_feature 1..9876: note = derived and/or modified CDS sequence (opt11) from DENV-2__KX380829__SS-prME
  source 1..9876: mol_type = other RNA
accgcgggcgtcataatcatgctgatcccgacggccatggcgttccacctcaccacccgcaacggggagccccacatgatcgttagccggcaggaaaagggcaaaagcctcctgttcaagacagaggacggggtgaacatgtgcaccctaatggcaatggacctgggcgagctgtgcgaggataccatcacctacaactgtcccctcctccgccaaaacgaacccgaagatatcgactgctggtgcaacagtacctcaacctgggtcacctatggcacctgtacggccaccggcgagcaccggagggagaagaggagcgtggccctggtgcctcacgtgggcatggggctcgagacccgcaccgagacctggatgtccagcgaaggcgcctggaagcacgcgcagcggatcgagacgtggatcctgcgccaccccgggttcacgatcatggccgccatcctggcctacaccataggcaccacctatttccagagggtgctcatctttatcctgctgacggcggtcgcaccctccatgacaatgcgctgcatcggaatctcgaaccgcgacttcgtggagggtgtctcgggcgggagctgggtagacatcgtgctcgaacacggaagctgcgtcaccaccatggcaaagaacaaacccactctggacttcgagctgatcaagaccgaggccaagcagcccgccaccttacgcaagtactgcattgaggcgaagctgaccaacaccacaaccgcctccaggtgcccgacccaaggagagccttcccttaacgaggagcaggacaaacggttcgtgtgcaagcacagcatggttgaccggggctggggcaacgggtgcggcctcttcggtaagggcgggatcgtcacgtgtgccatgtttacgtgtaagaagaacatggagggcaaaatcgtgcagcccgaaaacctggagtacaccatcgtggtcacaccccactccggcgaggaaaacgccgttgggaacgacacgggcaaacacggaaaggagataaaggtgactccgcaaagctccatcaccgaggcagagcttaccgggtacgggaccgtgacaatggagtgcagcccccgcactggtctcgacttcaacgagatggttctgctgcagatggagaacaaagcgtggctcgtgcaccggcagtggttcctggaccttcctctcccctggctgcccggcgctgacacgcaagggtcaaattggatccagaaggagatgctagtcacctttaaaaacccacatgccaagaaacaggacgttgtagtgctcggaagccaggagggtgccatgcacacggccctgaccggcgccacggagatccagatgtcaagcggtaacctcctgttcaccggacacctgaagtgcaggctgcggatggacaagctccagttaaaggggatgagctactccatgtgcacggggaaattcaaagttgtcaaggagatcgccgagacccagcacggcaccatagtggtgcgcgttcagtacgagggggacggaagcccctgcaagattcccttcgagatcatggatttagaaaagcgtcacgtgctcggccgcctgattactgtgaatccgatagtcactgagaaggactcccccgtgaacatcgaggcagagccacccttcggcgactcctacattatcataggtgtggaaccggggcaactgaaactctcctggttcaagaagggcagctccatcgggcaaatgtttgaaaccaccatgagaggcgccaagcggatggccattctcggcgacaccgcgtgggacttcggctcactcggtggcgtcttcacttccatcggaaaggcactccaccaggtgttcggggcgatctacggtgccgctttcagcggtgtgtcctggaccatgaagatcctgatcggggttgtgatcacgtggatcggcatgaacagccgctccaccagcctgtccgtgtcactggtcctcgtgggggtggtcacgctgtacctaggcgtgatggtgcaggccgattccgggtgcgtcgtgtcctggaagaacaaggagctcaagtgcggcagcggcatcttcatcaccgataacgtgcacacctggacagagcagtacaagttccagcctgaatcccccagcaagctggcctccgcaatacaaaaggcccatgaggaggggatctgcgggatccggtccgtcacgcgcctggagaacctcatgtggaaacagatcacccccgagctgaaccacatcctgtccgagaacgaggtcaaactcaccattatgaccggggacatcaagggcatcatgcaggcgggaaaacggtcactgaggccgcagccgacggagctgaagtactcctggaagacctggggcaaggccaagatgctgagcaccgagccccacaaccagaccttcctgatcgacggccctgagacggccgaatgccccaacaccaaccgtgcctggaactccctagaggtagaggattacgggttcggcgtcttcaccaccaacatatggcttaagctcaaggagcgccaggacgttttctgcgacagcaagctgatgtcggccgcgatcaaggacaatcgggccgtgcacgccgacatggggtactggatcgaaagcgccctcaatgatacgtggaaaatcgagaaggcctccttcatcgaggttaagagctgccactggcccaagtcccacaccctgtggagcaatggcgtgctggagtccgagatgatcatccccaagaacttcgcgggcccggtgagccagcataactaccgccccggatatcacacccagaccgccggcccctggcacctcggaaagctggagatggacttcgacttctgcgagggcaccactgtcgtggtgaccgaggactgcgggaatcggggccccagcctgcggaccaccacggcttccggaaaactcatcaccgagtggtgttgccggagctgcaccctaccgcccctgcgttacaagggggaggatggctgctggtacgggatggaaatccgacccctcaaggagaaggaggagaacctggtcaactccctggtgaccgccggccacgggcagatcgacaacttcagcctcggggtgctgggcatggctttattcctcgaggagatgctgcgcacgcgggtcgggacgaagcacgccgtgctactcgtggcagtgtccttcatgacactgatcaccggcaacatgagcttccgcgatctggggcgggtgatggttatggtcggcgccgctatgaccgacgacatcgggatgggggtgacctacctcgcgctcctagccgccttcaaagtgaggcccacattcgccgccggcctcctgctgcgcaagctcacgtccaaggagctgatgatgacgacaatagggatcgtcttgctctctcagtcgaccatcccggagaccatcctggagctcacggacgctctcgccctgggcatgatgatcttaaagatcgtacggaacatggagaagtaccaactcgccgtcactatcatggccatactgtgcgcccccaatgcggtgatcctgcagaacgcctggaaggtgtcgtgtacaatcctcgctgttgtgtccgtgtcgcccttgctgctaacctccagccagcagaaagcagactggatcccccttgcgctgacgattaagggcctcaacccgaccgccatcttcctgaccaccctgtcccgaactaacaagaaacggagctggccactcaacgaagccatcatggccgtcggaatggtgtccatactggcctcctccttactcaagaacgacatacccatgaccggtccccttgtggccggcgggctgctgaccgtctgctacgtgctgaccgggcgctcggccgacttggagctagagcgggccgccgacgttcgctgggaggaccaggccgaaatctcagggtccagcccgatcctgtctataacgatcagcgaggatgggtccatgagcatcaagaacgaggaggaggagcagactctgaccatcttgatccggaccggcctgctggtcatttccggcctcttccccgtgagcatacccatcacggcggcggcatggtacctctgggaggtgaagaaacagcgcgccggggtcttgtgggacgtgcccagcccgccgcccgtgggcaaggcagagctcgaggatggggcgtaccgaatcaagcagaagggaatcctcggatactctcagatcggcgccggcgtgtataaggaggggaccttccataccatgtggcatgtgacaagaggcgcagtgctaatgcacaaggggaaacggattgagccttcctgggctgatgtccgcaaggacctcatcagctacggcggcggctggaagctcgagggtgagtggaaggagggggaggaggtccaggtgctggcgctcgagcctgggaagaaccccagggcggtccaaaccaaacccgggctgttcaagacgaacacgggcaccatcggggccgtatccctggacttcagcccgggaacctccggcagcccgatcgtggacaagaaggggaaggtcgttggcctctacggaaacggcgtggttacgcgcagcggcacatacgtgagcgcgatcgcccagaccgagaagtccatcgaggacaaccccgagattgaagacgacatctttcggaagaaacgcttaaccataatggacttacaccccggcgcgggcaagacgaagcggtacctgccggcaatcgtgcgcgaggctatcaagcgaggactccgcaccttaatcctggcacccacacgtgtagttgccgcggagatggaggaggccctccgcggcctgcccatacgctatcagacccccgccatccgggccgagcatacgggcagggagatcgtggacctgatgtgccacgccaccttcaccatgaggctcctgagtccggtccgagtgccgaactacaacctgatcattatggacgaggcgcacttcaccgaccccgccagcatcgccgcacggggctacatctccacccgcgtggagatgggcgaggcggcagggatcttcatgaccgccacaccgcccggaagccgggaccccttcccacaatccaacgcccccataatggacgaagaacgcgagatccctgagcggtcctggaactccgggcacgagtgggtgaccgacttcaagggcaagacggtgtggttcgttccctctatcaaggccggaaacgacatcgccgcctgcctccgcaagaacggcaagaaagtaatccagctgtctcgtaagacgttcgacagcgagtacatcaagaccaggaccaacgactgggacttcgttgtgacgaccgacatctccgagatgggcgctaacttcaaggccgagcgggtgattgatccccgccggtgcatgaagcccgtgatcctgaccgacggtgaggagcgcgtgatcctcgccggcccgatgccggtcactcacagctcagccgctcaacggcgcggacggataggccgcaaccccaaaaacgagaacgaccagtacatctacatgggcgagcccttagaaaacgacgaggactgcgcccactggaaggaggcaaagatgctgctcgacaacatcaacacgccggagggcatcatcccaagcatgttcgagcccgagcgcgaaaaggtggacgccattgacggcgagtatcggctgcgcggggaggcgcggaaaacgtttgtggaactgatgcgccgaggcgacttgccggtctggctagcctaccgggtggcagccgaggggatcaactacgccgatcggcgctggtgcttcgacggtatcaagaacaatcagatcctggaggagaacgtcgaggtggagatatggacaaaagagggcgaaaagaaaaagctcaagccgcgctggctggacgcgcggatctactccgaccccctggccctgaaggagttcaaggagttcgccgccggccgcaagagcctgaccatgaacttaataacggagatgggccgcctccccaccttcatgacccagaaagcgcggaacgccctggacaacctggcggtgctccacaccgccgaggccgggggccgtgcgtacaaccacgccctgtccgagctgcccgagacgctcgagaccctgcttctcctgaccctgctcgccacagtaaccgggggcatcttcctgttcctgatgagcggcaaggggatcggcaagatgaccctcgggatgtgctgcatcataaccgcgtccatactgctgtggtacgcccagatccagcctcattggatcgcggccagtatcattctcgagtttttcctgatcgtgctgctgatcccagagcccgagaagcagcggaccccgcaggataaccagctcacctacgtggtgatcgccatcttaacggtggtggctgctaccatggcgaacgagatgggcttcctagagaagaccaagaaggactttggtctgggctccatcgtcgcccagcagcccgagagcaacatcctggatattgacttacgtcccgccagtgcttggaccctgtacgccgttgcgacgacctttatcacccccatgctgcggcactccatcgagaacagctccgtgaacgtcagcctcaccgctattgccaatcaggcgacggtgctgatgggccttggtaagggatggcccctttccaagatggacatcggtgtgcccctattggcgatcggctgctacagccaggtcaatcccatcaccttgaccgccgctctgctgctactggtggcccactacgccattatcgggccaggcctccaggcgaaggccacccgcgaggcccagaaacgggccgcggctggtatcatgaaaaacccgacggtggatggtatgaccgtcatcgatctcgaccccatcccctacgaccctaaattcgagaagcagctgggccaggtgatgctgctcgtactgtgcgtcacccaggtgctgatgatgcgcaccacgtgggccctatgcgaggccctcaccctggccaccgggccgatctccaccctttgggagggcaaccccgggagattctggaatacgaccatcgcagtgagcatggccaacatctttcgcggctcctacctggcgggcgccgggctcctgttctccatcatgaagaacacgaccaacacgcgccggggcaccggtaacaccggtgagaccctgggcgaaaagtggaagaaccgcctgaactcccttggcaagagcgagtttcagatatacaagcggtccgggatccaggaggtcgacaggacgctggccaaggagggtatcaagagaggcgagaccgaccaccacgcggtcagccgcggatccgctaaactgcgatggttcgtggagcgcaacctcgtcacccccgagggcaaggtgatggacttgggctgcgggcggggtgggtggagctattactgcggcgggctgaaaaacgtgcgagaagtgaagggcctcaccaagggcgggcccggccacgaggagccaatccccatgtccacttacgggtggaacctggtgcggctgcagagcggcgtagacgtcttcttcacgccgcccgagaagtgcgacaccctcctgtgcgatatcggggagtcctccccgaacccgaccgtggaggccggcagaacgctgcgggtgctcaacctggtcgagaattggcttaacaataacactcagttttgcatcaaggttctcaacccgtacatgccgagcgtgatcgagaaaatggagacgctgcagcgcaagtatggcggggctctggtccggaaccccctgtcccgcaatagcactcacgagatgtattgggtgtccaacgcttcaggcaatatcgtgagcagtgtcaacatgatctcccggatgctcatcaaccgcttcaccatgcggcacaaaaaggccacctatgagcccgacgtagacctcgggtccggcacccgcaacatcgggatcgagtccgagacccccaacttagacatcatcgggaagcgcatcgagaaaatcaagcaggagcacgagaccagctggcactacgaccaggaccacccctacaagacgtgggcctaccacggctcctacgagaccaagcagaccgggagcgcaagcagcatggtgaacggcgtcgtacggctcctgaccaagccatgggatgtgatccccatggtcacacagatggccatgaccgataccactcccttcgggcagcaacgcgtattcaaagaaaaggtggacacgcggacccaggagccgaaggaaggcaccaagaagctgatgaagatcacagccgagtggctctggaaggagctgggcaagaagaaaacgccccgtatgtgcacccgggaggaatttacgcgcaaagtccggtccaacgcggccctgggggccatcttcaccgatgagaacaagtggaagtccgcccgcgaggccgtcgaggattcccggttctgggaactcgtcgacaaggagcgcaatctgcacctagagggcaaatgcgagacctgcgtgtataacatgatggggaagcgggagaagaagatcggggagttcgggcgcgcgaagggcagccgggccatctggtacatgtggctcggcgcacgcttcctggagttcgaggccctggggttcctcaacgaggaccactggttctcgcgggagaacagcctgtcgggtgtagaaggcgagggcctgcacaagctcgggtacatcctacgtgaggtctctaagaaggagggcggcgccatgtacgccgacgacaccgccggttgggacactcggatcaccttggaagacttgaagaatgaggagatggtgacgaatcacatggagggcgagcacaagaagctagcagaagccatctttaagctgacttaccagaacaaggttgtgcgcgtgcagcgacccacgccccgggggaccgtgatggacatcataagccggcgggaccaacggggctcagggcaggtcggcacgtacggcctcaacacttttaccaacatgggggcgcagctgatacggcagatggagggcgagggggtgttcaagagtatccagcacctgaccacgacagaggaggtggcggtgcaggactggctcgcacgagtgggcagggaacgcctgtcccgcatggccatctctggcgacgactgcgtggtcaagccgctggacgaccgcttcgcctccgcgctcaccgccctgaatgacatgggcaaggtgcgcaaggatatccagcaatgggagccgtcaaagggctggaatgactggacccaggtgcccttctgctcccatcacttccatgagctgatcatgaaggacgggcgcgtcctcgtggtgccctgccggaaccaggacgagcttatcggacgcgcccgaatttcacagggagccggctggtccctgcgcgaaacggcctgccttggcaagagttacgcgcagatgtggtccctcatgtacttccacagacgtgacctgaggctcgccgccaacgccatctgctccgccgtcccgtcccactgggtgccaacaagccgtaccacctggtccatccacgcgcggcacgagtggatgaccaccgaggacatgctgaccgtatggaaccgcgtctggatccaggagaatccctggatggaggataagactcccgtggagagctgggaggaaatcccgtacctgggtaaaagggaggaccagtggtgcggctctctcatcgggctgacctcccgcgccacatgggccaagaacatccagaccgctatcaaccaggtgcgtagtcttatcggaagtgaggagtacaccgactacatgccaagcatgaaacggttccgccgcgaggaggaggaggcgggggtgctctggtaa

SEQ ID NO: 24861 - RNA, 9876 nt, synthetic construct
  misc_feature 1..9876: note = derived and/or modified CDS sequence (opt11) from DENV-2__KX380830__SS-prME
  source 1..9876: mol_type = other RNA
accgcagggatcatcatcatgatgatccccaccgtcatggccttccacctgactacaagaaacggggagccccacatgatcgtgagccggcaggagaagggcaagagcctcctgttcaagacagagaacggggtgaacatgtgcacactgatggctatggacctcggcgaattgtgcgaggataccatcacctacaactgtcccctgctccgccagaacgagccggaggacatagactgctggtgcaacagcaccagcacctgggtgacctacgggacctgcacggccaccggcgagcaccggcgcgaaaagcgaagcgtcgccctcgtgccccacgtgggaatggggctggagacccgcaccgagacctggatgtccagtgagggcgcctggaagcacgcccagcggatcgagacctgggtcctacgccaccccgggttcaccgtgatggcggccatcctcgcctacactatcggcaccacctacttccagcgggtactgatcttcatcctcctgaccgccgtcgcgccctccatgaccatgcgctgcatcgggatcagcaaccgggatttcgtggagggcgtgtccggcggaagctgggtggacatcgtgctggagcacggctcctgcgtgaccactatggccaagaacaaacccacgctcgatttcgagctgatcaagaccgaggccaagcaccccgcaaccctgcgcaagtactgtatcgaggccaagctcaccaacacgactaccgcgagccggtgcccgacccagggggagccctccctgaacgaggagcaagacaagcgcttcgtctgtaagcacagcatggtggaccggggatggggcaacgggtgtgggctgtttgggaagggcggtatcgtgacgtgcgcgatgtttacgtgtaagaagaacatggagggcaagatcgtccagccagagaacttagagtacaccatcgtgatcacgccccactccggcgaggagaatgccgtggggaacgacacgggcaagcacgggaaggagatcaaagtcaccccgcagtcctccatcaccgaggccgagctcaccggttacgggaccgccacgatggagtgcagcccccgtactggcctcgacttcaacgagatggtgctcctgcagatggagaacaaggcgtggctggtgcaccggcagtggttcctcgatctgcccctgccctggctcccgggcgccgacacacaggggtccaactggatccagaaggagacgctggtcacgttcaagaatccccacgccaagaagcaggacgtggtcgtgctgggcagccaggagggggccatgcacaccgccctaaccggcgcgaccgaaatccaaatgagcagcgggaacctcctgttcacgggtcacctcaagtgccgattgcggatggacaagctgcaactcaagggcatgagctactccatgtgcaccgggaagttcaaggtggtcaaggaaatcgccgagacccagcacggcaccatcgtgatccgcgtgcagtacgagggggatgggagcccctgtaagatccccttcgagatcatggacctggagaagcggcacgtcttaggccgtcttattacggtgaatccgattgtgaccgagaaggactcccccgtcaacatcgaggccgagccgcccttcggggacagctacatcatcatcggagtggagccagggcagctgaagctctcctggttcaagaaaggcagttccatcgggcagatgttcgagacgaccatgcgcggcgccaagcggatggccattcttggcgacacggcgtgggacttcgggagcctgggcggggtgtttacctccatcggcaaggccctgcaccaggtcttcggggctatctacggagccgcattcagcggcgtgtcctggacaatgaagatcctcatcggggtggttatcacctggatcggcatgaatagccgctccacgagcctgagcgtgagcctggtcctggtcgggatcgtgactctctacctgggcgtaatggtccaggccgactccggttgcgtggtgtcgtggaagaacaaggagctgaagtgcggcagtggtatcttcatcaccgataacgtccacacctggacggagcagtataagttccagccggagtcccccagcaagctcgccagcgccatccagaaggcccacgaagaggggatctgcggaatcaggagcgtgacccgtctggagaacctcatgtggaagcagatcacccccgagctaaatcacatcctgtccgagaacgaggtgaagctgaccatcatgacgggggacatcaagggcatcatgcaggcggggaagcggagcctccgcccgcagcccaccgagctgaaatactcctggaaggcttggggcaaggccaagatgctgagcaccgaactacataaccacaccttcctaatcgacggccccgaaacagccgagtgcccgaacaccaaccgggcctggaactccctagaggtcgaggactatgggttcggagtattcactaccaacatctggctcaagctgaaggagcgtcaggacgtgttctgcgacagcaagctgatgtccgcagcaattaaggacaaccgggccgtccatgccgacatgggatactggatcgagagcgccctcaacgacacgtggaaaatcgagaaggcgtccttcatcgaggtaaagtcgtgccactggcccaagtcccacaccctctggagcaatggcgtgctggagtccgagatgatcatccctaagaatttcgccggccccgtcagccagcacaactacaggcccgggtatcacacccaaaccgccggcccctggcacctaggtcgcctggaaatggacttcgacttctgcgaaggaaccacggtggtggtcaccgaggattgcgggaaccgcggccccagcctgcggaccaccacggcttccggcaagctcatcaccgagtggtgctgccgcagctgcaccctgcccccgctgcggtaccgcggggaagacggctgttggtacgggatggagattcggccactcaaggagaaggaggagaacctggtgaattccctggtgactgctggccacgggcagatcgataacttttccctcggcgtcctgggcatggcactgttcctcgaggagatgttgcgcacgcgggtggggacgaagcacgccatcctgctcgtggccgtgtcattcgtgaccctgatcaccgggaacatgagctttcgcgacctgggccgtgtgatggtcatggtgggggcaacgatgaccgacgacatcgggatgggcgtgacctacctggcgctgctggccgccttcaaggtccggcccaccttcgcggcaggcctgctgctgcgaaagctcacgagcaaggaactgatgatgaccaccatcgggattgtgctgcttagccagtccaccatccccgaaacgatcctggagcttaccgacgcgctcgcccttggcatgatggtgctgaagatcgtccggaacatggagaagtaccagctcgccgtgacgatcatggccatcctttgcgtcccgaacgccgtgatcttacagaacgcgtggaaggtgagctgcaccatcctcgccgtagtgtccgtgagcccactgctactcacgtccagccaacagaaggccgactggatccccctggccttaaccatcaaggggctcaaccccaccgcgatcttcctgaccacgctgagccgcaccagcaagaaacggagctggccgctcaacgaggccatcatggccgtcggcatggtatcgattctggcttccagcctgctcaagaacgacatccccatgaccggccccctggtggcagggggcctgctcaccgtctgttacgtgctcacggggcgaagcgcggacttggagctcgagcgggccgctgacgtccgctgggaagaacaggcggagatctccgggagctcccccatcctgagcatcaccatctccgaggatgggagcatgtctatcaaaaacgaggaggaggagcagaccttgacaatcttgatccggacgggcctgctcgtcatcagcggcctattcccggtgtccatccccatcaccgccgcggcctggtacctgtgggaggtgaagaagcaacgcgcaggggtcctgtgggacgtgcccagccccccgcccgtgggcaaggccgagctggaggacggggcctaccggatcaagcagaagggtatcctggggtactctcagatcggcgcgggtgtctacaaggaggggaccttccacaccatgtggcacgtcacccggggcgccgtgctgatgcacaaggggaagaggatcgaacccagctgggcagacgtgaagaaggacctcatatcctacggcgggggctggaaacttgagggcgagtggaaggagggggaagaggtccaggtgctagccctcgagcccggaaagaacccccgcgcagtacagactaagcccgggctgttcaagaccaacaccggcacaatcggtgcggtgagcctggacttctcccccggcacgagcggctcccccatagtggataagaaggggaaggtcgtcggtctctacgggaacggggtggtaacgcggagcggaacctacgtgtccgccatcgcacagaccgagaagtccatcgaggacaaccccgagatcgaggacgacatcttccgcaaaaagcggctgaccatcatggacctacaccccggggcgggcaaaaccaagcgttacctgcccgcgatagtacgggaggccatcaagcgtgggctccggaccctgatcctagcccccacccgagtcgtggccgccgagatggaggaggcgctccgcggcctgcccatccggtaccagacccccgccatccgcgccgagcacaccgggcgggagatcgtggacctgatgtgccacgccaccttcaccatgcgcctgctgagccccatccgggtccccaattacaacctcatcattatggacgaggcccacttcacggaccccgcgtccatcgccgcccgcggctacataagcacccgggtggagatgggcgaggccgctgggatattcatgaccgcgacgccgcccggctcccgcgacccgttcccccaaagcaacgcccccatcatggacgaagagcgggagatccctgagcggtcctggaacagcgggcacgagtgggtgacggacttcaagggcaagaccgtctggttcgtaccgtccatcaaagccgggaacgacatagccgcgtgcctgcggaaaaacggcaagaaggtgatccagctgtctcgcaagacctttgactccgaatacatcaagacccgtacgaacgactgggacttcgtcgtgaccaccgacatctctgagatgggcgccaacttcaaggccgagcgcgtgatcgacccccggcgctgtatgaagccagtcatcctcaccgacggcgaagagcgggtgatcctcgccgggcctatgccggtgactcactcctcagccgcacaacgccgggggcgtgtcggccggaaccccaagaatgagaacgaccagtacatctacatgggggagcccctagagaacgacgaggattgcgcccactggaaagaggccaagatgctgctcgacaacatcaacacccccgagggcatcatcccgtccatgtttgagcccgagcgggagaaggtagacgcaatcgacggcgagtaccgcctgcgaggggaggcccgcaaaaccttcgtggaccttatgcggagaggcgacctccccgtctggttggcctaccgggtggccgccgaggggatcaactacgccgatcgccggtggtgtttcgatggggtcaagaacaaccagatcctggaggagaacgtggaggtggaaatatggaccaaggagggggagcgcaagaagctcaagccgcggtggctggacgccagaatctacagcgaccccctggcgctcaaggagtttaaggagttcgccgccggccggaagtccctgacgttaaacctcatcaccgagatgggccgcctgcccaccttcatgacccagaaggctcggaacgcgctggataacctcgccgtcctgcatacggccgaggccggtggccgagcctacaaccatgcgctaagtgagctccccgagaccctagagaccttactcctgctgaccctcctggccacggtgaccgggggcatcttcctgttcctcatgtccggcaaggggatcggcaagatgaccctggggatgtgctgtattataaccgccagcattctcctctggtacgcccagatacagccgcactggatagccgcgagtataatcctggagttcttcctgatagtgcttctgatccctgagcccgagaagcaaaggacaccccaggacaaccagctgacgtacgtcgtgatcgccatcttgaccgtggtcgccgccaccatggccaacgagatgggcttcctggagaagactaagaaggacttcgggctgggcagcatcacgacccagcagccggacagcaacatactcgacatcgacctgcgccccgcgtccgcctggaccctgtacgccgtggccactacgttcattacccccatgctgcggcactctatcgagaactcctcagtgaacgtctccctgacggcaatcgcgaaccaggcaaccgtactgatgggattgggcaagggttggcccctatcgaagatggacatcggggttccgctcctcgccattggctgttactcccaggtcaaccccatcacgcttaccgccgcgctgctgctgctcgtggctcactacgccatcatcgggcccggcctccaggccaaggccacacgcgaggcgcagaagcgcgccgccgccggcatcatgaagatacccgccgcggacggaatgaccgtgatcgacctggaccccatcccatacgaccccaaattcgagaagcagctggggcaggtcatgctcctggtgctgtgcgtgacgcaagtacttatgatgcgcaccacctgggccctgtgcgaggccctgaccctcgccacggggcccatcagtaccctgtgggagggcaaccccggacgcttctggaacaccaccatcgccgtgtccatggccaacatcttccgcgggagctacctggcgggcgccgggctcctgttctccatcatgaaaaacacagccaacacccgccggggcaccgggaacaccggcgagacgctgggcgagaaatggaagaaccgcctcaacgcgctgggaaagagcgagttccagatctacaagaaatcgggcatccaggaagtggaccggaccctagctaaggaggggatcaagcgcggggagaccgaccaccacgccgtcagccgaggttccgcaaagctccgctggttcgtggagcggaatttggtgactccggagggcaaggtcgtggacctggggtgcggtcgcggggggtggagctactactgcggggggcttaaaaatgtgaaggaggtcaagggcttgacgaagggcggtcccggccacgaggagcccatcccgatgtccacctacgggtggaacctggtgcggctccagagcggcgtggacgtcttcttcacaccgcccgagaagtgcgacaccctgctgtgcgacatcggagagtccagcccaaacccaacggtggaggccggccgcaccctccgggtgcttaacctggtcgagaactggctgaacaacaacacccagttctgcattaaggtactgaacccctacatgcctagcgtgatcgagaagatggaggcgctacaacgcaagtacggcggggccctggtcagaaaccctctctcccgcaacagcacccatgagatgtactgggtgtccaacgccagcggcaatatcgtctccagtgttaacatgatctcccggatgctgatcaatcgcttcaccatgaagcacaagaaggccacgtacgagcccgacgtggacctggggagcgggacccggaacatcgggatcgagtccgagacccccaacctcgacatcatcgggaagcgcatcgagaagattaagcaggagcacgagacctcatggcattacgaccaggaccatccctacaagacgtgggcctatcacggttcctatgagaccaagcagacggggagcgcgtccagcatggtgaacggcgtcgtgcggctgctgaccaagccatgggacgtgatccccatggtcacgcagatggccatgaccgataccacccccttcgggcagcagcgagtgttcaaggaaaaggtggatacgcgcacccaggagcccaaggagggaaccaagaagctgatgaagataaccgccgagtggctgtggaaggagctgggcaagaaaaagacgccgcggatgtgcacccgcgaggagttcacccggaaggtccgctccaacgccgcccttggggcgatcttcaccgacgagaacaagtggaagtctgccagagaggccgtagaggatagtggcttctgggagctggtcgacaaggagcgcaaccttcacctcgaggggaagtgcgaaacgtgcgtgtacaacatgatgggcaagcgggagaagaagttgggggagtttgggaaggcaaagggcagccgcgcgatttggtacatgtggctgggggcccggttcctcgaattcgaggcccttggcttcctgaacgaggatcactggttctcacgtgaaaatagcctcagcggggtggagggcgaggggctgcataaactggggtacatcctccgggacgtctccaagaaggagggcggggccatgtacgccgacgacaccgcgggctgggacacccgcatcactctggaagacctgaagaacgaggagatggtaacgaaccacatggagggggagcaccggaagctcgccgaggccatcttccgcctgacgtaccagaacaaggtggtccgggtgcagcgccccacaccccggggcaccgtgatggacatcatcagccgccgtgaccagcgcgggtccggccaggtcgtgacgtacgggctgaacaccttcaccaacatggaagcgcagctcatccgccagatggagggggagggcgtgttcaaatcgatccagcacctgacggtcaccgaggagatcgccgtgaagaactggctggagcgggtggggcgtgagcggctctcccgcatggcgatctcgggcgacgactgcgtggtgaaaccactggacgatcggttcgccagcgcgctgaccgccctcaacgatatgggcaaggtgcgcaaggacatccagcagtgggaaccaagccggggatggaacgactggacccaggtccccttctgctcccaccacttccacgagctgatcatgaaggacggccgcgtgttagtggtcccgtgtcggaatcaggacgagctcatcgggcgcgcccggatcagccagggcgcaggctggtccctgcgtgagaccgcctgcctgggcaagagctacgcccagatgtggtccctcatgtactttcaccggcgcgatctgcggctggccgccaatgcgatctgcagcgccgtgccctcccactgggttcccattagccgaacgacgtggtccatccacgccacgcatgagtggatgaccaccgaggacatgctcacggtctggaaccgggtgtggatccaagagaacccctggatggaggacaagacccccgtggagagctgggaggagatcccctacctgggcaagcgggaggaccagtggtgtgggagcctgatcggcttaacctcccgggccacatgggcgaagaatatccaaacggccattaaccaagtccgcagcctgatcgggaacgaagagtacaccgactatatgccgtccatgaagcgcttcaggcgcgaggaggaagaggccggcgtgctgtggtga

SEQ ID NO: 24862 - RNA, 9876 nt, synthetic construct
  misc_feature 1..9876: note = derived and/or modified CDS sequence (opt11) from DENV-2__KX380831__SS-prME
  source 1..9876: mol_type = other RNA
accgcgggcatcatcatcatgatgatcccaacggtgatggctttccacctgaccacccggaacggggagccgcacatgatagtcagccggcaggagaagggcaagagccttctgttcaagaccgagaacggtgtgaacatgtgcaccctcatggcgatggacctaggggagctgtgcgaagacaccatcacctacaactgccccctgctcaggcaaaacgagcccgaggacatcgactgctggtgcaacagcacctccacctgggtgacctacgggacctgcaccgccaccggggagcaccggcgcgagaagcggagcgtcgccctggtcccccacgtgggcatggggctggaaaccagaaccgagacatggatgagcagcgagggggcatggaagcacgcccagcggatcgagacctggatcctccgccaccccggatttacaatcatggccgccattcttgcctacaccatcggcaccacttacttccaaagagtgctcatcttcatcctcctgacggccgtgaccccctccatggcgatgcgctgcatcgggataagcaaccgtgacttcgtggagggcgtctccggcgggtcctgggtggacattgtgctggagcacggctcctgtgtgacaactatggccaagaacaagcccacgttagatttcgaactgatcaagaccgaggccaagcatctggctaccctcagaaagtactgtgtggaggccaagctgaccaacacgacaaccgcgagccggtgcccgacccagggggaaccctccctgaacgaggagcaagacaagcgattcgtgtgtaagcacagcatggtagaccgaggctggggcaacgggtgcggtctcttcgggaagggcgggattgtgacctgcgccatgttcacttgcaaaaaaaacatggagggcaaggttgtacagcccgagaacctcgagtacactatcgtgatcacgccccatagcggcgaggagaacgccgtggggaacgacacaggcaaacacgggaaggagatcaaggtcacgccacagtcgtctatcaccgaggccgaactgacaggctatgggaccgtcacgatggaatgcagcccccgcacaggactcgatttcaatgagatggtcctgctgcaaatggagaacaaggcctggctcgtccaccggcagtggttcctggacctgcccttgccctggctgccgggcgccgacacccaggggtccaattggatccagaaggagacgctagtgacctttaagaacccgcatgcaaagaagcaggacgttgtcgtgctcggatcccaggagggggccatgcacaccgccctaaccggagccaccgagatccagatgtcatccgggaacctcctgttcacggggcacctgaagtgccgcctgcggatggacaaactccagctgaaaggaatgagctacagcatgtgcaccgggaagttcaaagtcgtgaaggagatcgcggagactcagcacggcacaatcgtgatccgcgtccagtacgagggggacggaagcccctgcaagatccccttcgagatcatggatctcgagaagcggcacgtgctaggccgcctgatcacggtgaaccccatcgtcacggaaaaggactctccggtcaatatcgaggccgagccgcctttcggggactcatacattatcattggtgtggaaccggggcaactaaaactatcctggttcaagaagggaagctccatcgggcagatgttcgagaccaccatgcgtggcgccaaacggatggccatcctgggcgatacggcctgggatttcgggagcctgggcggggtcttcacctccatcggcaaggcgctccaccaggtgttcggggccatctacggtgccgccttctcgggagtttcctggaccatgaagatcctgatcggggtcgtgatcacctggatcggcatgaactcacgcagtacaagcctgtccgtgtccctggtgttagtgggggtggtcacactgtacttaggcgtaatggtgcaggcggactccggttgtgttgtgagctggaagaacaaggagctcaaatgtggatcaggcatcttcatcaccgacaacgtgcacacctggacggagcagtacaaatttcagccggaatcccccagcaagctggcctccgccatccaaaaggcccacgaggaggggatctgcggcatcagaagcgtcacccgcctggaaaacctcatgtggaagcagatcacccccgagctgaaccacatcctgaccgagaacgaggtgaagctcaccatcatgaccggggatatcaagggcatcatgcaggccgggaagcggtccctgcgcccccagccgaccgagctgaagtacagctggaaggcatggggcaaggccaagatgctatccactgagttacacaaccacacgttcctgatcgatggtcctgagaccgccgagtgccccaacaccaaccgggcctggaactcactcgaggtggaggactatgggttcggcgtcttcaccacgaatatctggctgaagttaaaagaacgccaagacgtgttctgcgactccaacctcatgagcgccgcgatcaaggacaaccgggccgtgcacgccgacatggggtattggatcgagagtgccctgaacgacacctggaagatcgagaaggcaagcttcatcgaggtcaagtcctgccactggccgaaaagccacacgctgtggtccaacggcgtactcgagagcgaaatgatcatccccaaaaacttcgcgggccccgtgtcccagcacaactaccgccccggttaccacacccaaaccgcggggccgtggcacttggggcggttagagatggactttgacttctgcgagggcacgaccgtcgtggtaaccgaagactgtgggaaccgcggccccagcctccggacgaccaccgccagcggcaagctcatcaccgagtggtgctgccgctcctgcaccctgccgccgctccgttaccgcggggaagacggctgctggtacgggatggagatccggccgctgaaggagaaggaggaaaacctggtcaacagcctcgtgacggccggccacgggcaaatcgacaacttttcactgggggtgctgggcatggccctcttcctggaggaaatgttgcgaacccgtgtcgggactaagcacgccatcctcctggtagccgtgagcttcgtcaccctgatcacgggcaacatgtccttccgcgacctagggagggtgatggtgatggtcggcgccacgatgaccgacgacatcgggatgggtgtgacatacttagccctgctcgctgcctttaaggtgaggcccacgttcgccgccggactgctactccgcaagctgaccagcaaggagctgatgatgaccaccatcgggatcgtcctcctctcccagagcacgatcccggagtccatcttagaactcaccgacgcactggcgttgggcatgatggttctcaagatagtccggaacatggagaagtatcagctggccgtgaccatcatggccatactgtgtgtccccaacgcggtcatcttgcagaatgcctggaaggtgtcgtgtaccacgctggcggtggtctcagtgagccctctgctcctgacctccagccagcagaaggccgactggatcccgttagccctcactattaaggggctgaaccccaccgccatcttcctgaccaccctctccaggacctccaagaaacggtcctggccattaaacgaggcgatcatggccgtgggcatggtctcgatcctggcatccagcctcctgaagaacgacatcccgatgaccggccccctggtggccgggggtctgctgacagtttgctatgtgttaactgggcgcagcgctgacctcgagttggagcgggcggccgacgtgcgctgggaggaacaggcagagatctccggcagctcccccatcctgagcatcaccatctccgaggacggaagcatgtccatcaagaacgaggaggaggagcagaccctcactatcctgatccggaccggcctgctcgttatcagcggtctgttccccgtatccatccccattaccgccgctgcctggtacctgtgggaagtgaagaaacagcgcgcgggggtcctctgggacgtccccagtccgccgcccgtgggcaaggccgagctggaggacggggcatatagaatcaaacagaagggcatcttagggtactcccagatcggcgccggcgtctacaaggaggggacatttcacaccatgtggcatgtgacgcgcggcgcggtgctcatgcacaaggggaagcggatcgagccctcttgggccgacgtgaagaaggacttgatctcctacggcggtggctggaagctcgagggcgagtggaaggagggggaggaggtccaggtgctcgccctggaacccggcaagaacccgcgcgccgtgcaaaccaaaccgggtctgttcaaaaccaacaccggcacgatcggagccgtcagcctcgacttctcccctggcacctccggctcccccatcgtggacaagaaggggaaggtcgtcggcctgtacgggaacggcgtggtaaccagaagtggcacctacgtctccgcgatcgcccagaccgagaagtccattgaggacaacccggagatcgaagacgacatcttccgcaagaagcggctgactatcatggacttacatcccggggctggcaagacgaagcgctacctccccgccatagtgcgggaggcgatcaagcgcggcctgcggacccttatcctagctcccacgcgcgtggtcgcggctgagatggaggaggctctgcgcggcctgccgatccggtatcagaccccagccatacgagccgagcacaccgggagggagatcgtcgacctcatgtgccacgccacctttacgatgcgcctgctcagtcccatccgggtgcctaactacaacctcatcatcatggacgaggcccattttaccgaccccgcctccattgcagctcgcggatacataagcacccgtgtcgagatgggcgaggccgccgggatctttatgaccgcgacgccacccggctcccgcgaccccttcccgcaaagcaacgcgcccatcatggacgaggagcgtgagatccccgagcgatcctggaatagcgggcacgagtgggtgaccgacttcaagggcaagaccgtgtggttcgtcccctccatcaaggccgggaatgacattgccgcttgcctgcggaagaacggaaagaaggtgatacagctgagccgcaagaccttcgactccgagtatatcaagacgcggaccaatgactgggacttcgtggttacaaccgacatctccgagatgggcgcgaacttcaaggcagagcgcgtgatcgatccacggcgctgcatgaagcccgtgattctcacggacggggaggagcgggtcatcctggccggccccatgcccgtgacccactcctcagccgcgcagcgcagggggcgcgtcgggcgcaacccgaagaacgagaacgaccagtacatttatatgggggagcccctggagaatgacgaggactgcgcgcactggaaagaagccaagatgctcctggacaacatcaacaccccggagggaataatcccctccatgttcgagccagagcgggaaaaggtcgacgccatcgacggcgagtaccgcctgcgcggggaggcccgcaagaccttcgtggacctcatgcggcgcggcgacctcccagtttggctggcctaccgcgtggcggccgaagggatcaactacgccgacagacgatggtgcttcgacggcgttaaaaataaccagatcttggaagagaacgtcgaggtggagatctggacaaaggaaggggaacggaaaaagctgaagccccgctggcttgatgcccgcatctacagcgacccgcttgcactcaaggaattcaaggagtttgcagccgggcggaagtccctgactctcaacctcataaccgagatgggacgcctgcctaccttcatgacgcagaaagccaagaacgcactcgacaacctggcggtgcttcacaccgccgaggctgggggccgggcctacaaccatgccttatctgagctgcccgagaccctggagaccttactgctgctcacgctgctggcaaccgtaaccgggggcatcttcctctttctgatgagtggcaaggggataggcaagatgaccctcgggatgtgctgcattatcaccgccagcatcctcctctggtacgcgcagattcagccccattggatcgccgcctccatcatcctggagttctttctgatcgtgctgctgatccctgagcccgagaagcagcgcacaccccaagacaaccagttaacctacgtggttatcgcgatactgacggttgtggccgcaaccatggctaacgagatgggcttcctggagaagacgaaaaaagacttcggactcgggagcatcaccacgcaacagcccgagagcaacatcctggacatcgacctgcggccggcaagtgcgtggacactctacgccgtcgccacaacgttcatcacccccatgctgcgccacagcatcgagaactccagtgtgaatgtgagcctgaccgccatcgccaatcaggcgacggtcttaatgggcctggggaagggctggcctctgtcaaagatggacatcggggtgcccctcttagccataggctgttactcacaggtgaacccgatcaccctgacggcggccctacttttgctcgtggctcactacgccatcatcgggcccggactgcaggcaaaggccaccagagaggcccagaagcgcgcggccgccggcatcatgaagaaccccacggtggacgggatgaccgtcatcgacctggaccccattccgtatgatcccaagttcgaaaagcaactcggccaggtcatgctgttagtgctctgtgtcacccaggtcctgatgatgcggaccacgtgggccctgtgcgaggccctcacactggccaccgggcccatcagcactctgtgggaggggaaccccgggcgcttctggaacactaccatcgccgtgtcaatggccaacatcttccgcggcagttacttggccggtgccgggcttctgtttagcatcatgaagaacaccgccaatacccggcgcggaacggggaataccggcgagaccctcggcgaaaagtggaagaaccggctgaacgccctgggtaaatcagagtttcagatctataagaagtccggaatccaggaggtggaccgcaccctcgccaaggaggggatcaaacgaggcgagacggaccatcacgcagtgtctcgagggtccgcgaagctgcggtggttcgtcgagcgcaatttggtgaccccggaagggaaggtcgtcgacctcggctgcgggcggggcggatggagctactactgcgggggtctgaagaatgtgaaggaggtcaagggcctgacaaagggcgggcctggccacgaagagcccatccccatgtccacttacggttggaacctcgtgcgcctgcagagcggagtggacgtcttcttcacgccgcctgagaaatgcgacacactgctctgcgacatcggggagtcctccccgaatcccaccgtagaggccggccgtactctgcgcgtgctgaatctcgtcgagaactggctgaataacaacacccagttctgcatcaaggtgctgaacccatacatgccttctgtgatcgagaagatggaggccctgcagcggaagtacggtggggccctcgtccgcaatcccctgtcccggaatagcacgcatgagatgtactgggtgagcaatgccagcggcaacatcgtgtccagtgtcaacaccatctcccgcatgctgataaaccgattcaccatgcgccacaagaaggcgacctatgagccggacgtggacctcgggagcgggacgcggaacatcggtatcgagtccgagacccccaacctggacattatcggaaaacgcatcgagaaaatcaagcaggagcacgaaactagctggcactacgaccaggaccacccctacaagacctgggcctaccatggctcctacgagacgaagcagactgggagcgccagctcaatggtcaatggcgtcgtgcgcctgctaaccaagccctgggacgtgatcccgatggtcacccagatggcgatgacggacactacaccattcgggcagcagcgggtgttcaaggagaaggttgacacccgtacgcaggagcccaaggagggcaccaagaaactgatgaagataacggccgagtggctgtggaaggagctcggcaagaagaagaccccccggatgtgcacgcgcgaggagttcacccggaaggtacgctccaacgcggcactaggtgccatcttcactgacgagaacaagtggaagtcggccagggaagccgtggaggactccggcttctgggagctggtcgacaaagaacgcaatcttcacctggaagggaagtgcgagacctgcgtgtacaacatgatgggcaagcgagagaaaaagctgggagagttcggcaaggccaagggcagccgcgccatctggtacatgtggctcggggcgcgattcctagagtttgaggcgttaggattcttgaacgaggaccactggttcagtcgcgagaacagcctgagcggggtggagggcgaggggctgcacaaactcggctacatcctgcgggacgtctccaagaaggagggcggggcaatgtacgccgacgatacggcgggctgggacacgcgcatcaccctggaggacctgaagaatgaggagatggtaaccaatcacatggagggtgagcacaagaagctggccgaggcgatcttcaaactgacgtatcagaacaaggttgtccgggtgcagcgcccgacaccccgggggaccgtgatggacatcattagccgccgggaccagcgcgggtccggccaggtcgtgacgtacggcctcaataccttcaccaacatggaggctcaactgatccggcagatggagggggaaggcgtgtttaagagcatccagcagctgaccgtcaaggaggagattgccgtgaagaactggctcattcgcgtggggcgcgaacggctgtcacgcatggccatatccggcgacgactgcgtcgtgaagcccctggacgacagattcgcctccgccctcaccgcgctgaacgacatgggcaaggtgcgcaaggacatccagcagtgggaacccagccgggggtggaatgactggacgcaggtccctttctgctctcaccacttccacgagctgatcatgaaggacggccgcgtgctggtggtcccctgccggaaccaggacgaactgatcgggagagcccggatctcccagggcgctgggtggtccctgcgcgaaaccgcctgcctgggcaaaagctacgcccagatgtggtccctgatgtatttccaccgacgtgacctgcgtctcgcggccaacgcgatttgcagcgccgtgccgtcccactggatcccgactagccgcacgacctggtccattcacgcgacgcacgagtggatgaccacagaggacatgcttacagtgtggaatagggtctggatccaggagaacccgtggatggaggacaagacgcccgtggagagctgggaggaaatcccctacctgggcaagcgcgaggaccagtggtgcgggagcctcataggcttgaccagtcgggcgacctgggccaagaacattcaaaccgccatcaaccaggtgcgcagcctgatcggtaacgaggagtacactgactacatgccctccatgaagaggttccgccgcgaggaggaggaagcaggcgtcctctggtga

SEQ ID NO: 24863 - RNA, 9876 nt, synthetic construct
  misc_feature 1..9876: note = derived and/or modified CDS sequence (opt11) from DENV-2__KX380808__SS-prME
  source 1..9876: mol_type = other RNA
accgctggaatcatcatcatgatgatccctaccgtgatggcgttccaccttaccaccaggaacggggaaccccatatgatagtcagcaggcaggaaaagggcaagagcctcctgttcaagaccgaaaatggggtgaacatgtgcaccctaatggcaatggacctcggtgagttatgcgaggacaccatcacttacaactgccccctgctcaagcaaaacgaaccggaggatatcgactgctggtgtaactcaaccagcacttgggtgacctacgggacctgcaccgcgacaggggaacaccgccgagagaagcgcagcgtcgcattagtgccgcacgtgggaatgggcctggagacccggaccgagacatggatgtccagcgagggcgcttggaagcacgcccagcgcatcgagacctgggtgttacgccaccccgggtttaccataatggcggccatcctcgcctacaccatcgggaccacctacttccagcgcgtgctgattttcatcctcctgacagccatcgcgccctcaatgacaatgcggtgcatcgggataagcaaccgcgacttcgtggagggcgtctccggtgggagctgggtggacatagtactggagcacggttcctgcgtgaccacaatggccaagaacaaacctactctcgactttgagctgatcaagacggaggcaaaacaccccgccaccctgagaaagtactgtatcgaggccaaactcaccaacacgaccactgcgagccgctgccccacccaaggggagccctctctaaacgaggagcaagacaaaaggttcgtgtgtaagcactcaatggtggaccgaggctggggcaacggttgcggcctgttcgggaagggcgggatcgtcacgtgtgccatgtttacgtgcaaaaagaacatggagggcaagatcgtccagcccgagaacctcgaatacaccatcgtgataacgccacactccggggaggagaacgccgtcggcaacgacacaggcaagcacgggaaggagatcaaggtgaccccacagagcagtatcactgaggccgagctgaccggctacgggacggtcacgatggagtgcagcccccgcacaggcctggacttcaacgagatggtcctccttcagatggagaacaaggcctggctggtgcacagacagtggttcctcgacctgccactgccctggttaccgggggctgacacccagggatccaactggatccaaaaggagaccctggtcacctttaagaacccccatgccaagaagcaggacgtcgtggtcctgggcagccaggagggggcgatgcacaccgccctcaccggcgccaccgaaatacaaatgtcttccgggaacctactgttcactggccatctgaagtgccggctacgcatggacaagctgcagcttaaaggcatgagctactccatgtgcactgggaagttcaaggtggtgaaagagatagctgagacccagcacggcactatcgtcatccgagttcagtacgagggggacggcagcccctgcaaaatccccttcgagatcatggacctagagaagcgccatgttctgggccgtctcatcacggtcaacccaattgtgaccgagaaagattccccggtgaacatagaggcggagccgccctttggcgacagctatattatcataggggtcgaaccggggcaacttaagttgagttggttcaagaagggcagttccatcgggcagatgttcgagaccaccatgcgcggcgccaagaggatggccatccttggcgacacggcatgggacttcggaagcctaggaggggttttcacctccatcggcaaggcgcttcaccaggtgttcggggctatatacggcgccgctttctccggcgtcagctggaccatgaagatattaatcggggtggttatcacctggatcggcatgaacagccgctccaccagcttgtctgtcagtctggtgttggtaggcgtcgtgaccctctatctgggagttatggtgcaggctgactccggttgtgtggtgtcatggaagaacaaggagctgaagtgtggcagcggcatattcatcaccgacaacgtacacacctggacagagcaatataagttccagcccgaatccccctctaaactagcctccgccatccaaaaagcacacgaggaggggatctgtggcatacgaagcgtgacgcggctggagaacctgatgtggaagcaaatcacccccgagctcaaccacatcctgtccgagaacgaggtgaagctgaccatcatgacgggggatatcaagggcatcatgcaggccgggaagcggtcgctcagaccgcagcccactgaacttaagtactcctggaaagcgtggggaaaggccaagatgctttcgaccgagctacataaccacaccttcctgatcgatggcccagagacggctgagtgccccaacaccaatcgcgcatggaactccctggaagtcgaggactacgggttcggcgttttcactaccaacatttggctcaagctgaaggaaagacaagatgttttctgcgattctaagctaatgtccgctgcgatcaaggacaatcgcgcggttcatgccgacatggggtattggatagaaagtgccctcaacgacacgtggaagatcgagaaggcatccttcatagaaatcaagtcgtgtcactggcccaaatcacataccctgtggtcaaacggcgtactggagtcagagatgatcatacccaagaacttcgcgggccccgtaagtcagcacaattaccggccggggtaccacacccagacggccgggccttggcatttggggcggttagagatggacttcgacttctgcgagggcactacagtagtggtaaccgaggactgcgggaacagaggcccctctctgcgcacaaccactgcctccgggaagctgataactgagtggtgctgccgcagctgcaccctgcccccgctgcggtatagaggggaagacggttgctggtacgggatggagatccgccccctcaaggagaaggaggagaacttagtcaactccttggtaactgccggtcatgggcaaattgacaatttctccctcggcgtgctgggcatggcgctctttctagaggagatgcttcggacgcgcgtcgggacgaaacacgccattctgctcgtagccgtgtccttcgtgaccctgattaccggaaatatgagcttccgggacttggggcgcgtgatggtgatggtcggcgccacgatgaccgacgatatcgggatgggcgtgacctacctcgccctgttagcggccttcaaggtgaggcccaccttcgccgcaggcctactgctgcggaaacttacgtccaaggagctgatgatgaccaccatcgggatcgtcctcctcagtcagagtaccatacccgagacgatccttgagctaactgacgccctggcgctcggcatgatggtgcttaagatcgtgcgcaatatggagaagtaccaactcgccgtcaccatcatggctatactgtgcgtgcccaatgccgtcatcctacaaaatgcctggaaggtgagctgcaccacgctcgcggtggtttccgtgagccccctgctcctcacctccagccaacagaaggccgactggatcccccttgcgctaaccatcaaggggctcaaccccactgccattttcttaactacgctgtcccggaccagtaagaagcgctcctggccgctgaacgaggcgatcatggccgtgggcatggtgtctatcctggcctcctccctgcttaagaatgacatcccaatgaccggcccgttggtggccgggggccttctcacggtgtgctacgtcctgaccggtcgatcagccgacctggagttagagagagcggcagacgttcgctgggaggagcaggccgagatcagtggcagcagcccaatcctgtcaatcaccatctccgaggatggatcgatgtccattaagaacgaggaggaggaacagaccctgacaatcctcatcaggactggattacttgttatcagcggcctcttcccggtctcgatccccattaccgccgccgcgtggtacctctgggaggtgaaaaagcaacgggcaggggtactttgggacgtccccagtcccccgcccgtcgggaaggccgagctcgaggacggggcttaccgcatcaaacaaaagggaatcttgggttactcccagattggcgccggcgtgtacaaggaggggaccttccacaccatgtggcacgtcacccggggcgctgtcctgatgcataaggggaagcgaatagagccctcttgggccgatgtgaagaaagacttgatctcctacggcgggggatggaagctagaaggcgagtggaaggaaggagaggaggtccaagtactcgctctcgagcccggcaagaatcctcgggctgtccaaaccaagccaggcctcttcaagaccaacaccgggactataggggctgttagccttgacttctcgccaggcacgagcggctcccccatagttgacaagaaggggaaggtcgtaggcctctacgggaatggcgtggtaacccgctctggcacgtacgtcagtgcgatcgcccagacggagaaatcaattgaagacaatcccgagatcgaggatgacatattcagaaagaagcgcttgaccataatggatctgcaccccggtgccggaaagaccaagcggtacctgcccgctattgtgcgcgaagctatcaagcgggggctccgcaccctcatcctggcccccacgcgggttgtcgccgcagaaatggaggaggcccttcgcgggctccccatccgctaccaaacccccgctatccgggcagaacacaccgggcgcgagatcgtggatttaatgtgtcacgccaccttcacgatgaggcttctgagccctatccgagtgccgaattacaacctgatcatcatggacgaggcccactttaccgacccggcctccatcgctgctcgaggatacatcagcaccagagtggaaatgggcgaagcggccgggatctttatgaccgccacgccgccgggttccagagacccgttcccccagagcaacgccccaatcatggatgaagaacgcgagatccccgaacggtcctggaacagtggtcacgagtgggtgacagattttaagggaaagaccgtgtggttcgtcccgtccatcaaggccggcaatgatatcgccgcctgcctgcgcaagaacggcaagaaggtcatccagctgagccgcaagactttcgatacggagtacatcaagactaggactaacgactgggacttcgtggtcaccacggatatctcagaaatgggcgctaactttaaggccgaacgggtaatcgaccccagaaggtgcatgaaaccggtgatcctgactgatggggaggagagggttatcctcgccgggcccatgccggttacccacagctccgccgcccagcggcgggggcgggtgggccgaaatcccaagaatgagaacgatcagtacatatacatgggggagcccctggagaatgacgaggactgtgcgcactggaaggaggcaaagatgctgctcgataacatcaacactcccgagggcatcatcccgagtatgttcgagcccgagcgcgagaaggtcgacgctatcgatggcgagtaccggctgcggggcgaggccagaaagacgttcgtggacctgatgcggcggggcgatttacccgtgtggctggcctaccgcgtcgcagcggaaggtatcaattacgccgacaggagatggtgcttcgacggcgttaaaaacaaccagatcctggaagagaacgttgaggtagagatctggaccaaggagggggaacgtaagaagttgaagccgcgctggctggacgcaagaatctattccgaccccctggccctcaaagagttcaaggagttcgcggctggcagaaagagcctcaccttaaacctcatcaccgagatgggccggctgcctacattcatgactcaaaaggctagaaacgccttagacaacctcgcggtgctgcacacggccgaggctgggggccgggcttacaatcacgccctgagtgagctccccgaaaccttggagacgctgctactgctcaccctcctggcaaccgtcactggcggcattttcctgttcttgatgagcggcaaagggatcggcaaaatgaccctcgggatgtgctgcataattactgcgtctatcctgttgtggtatgcccaaattcagccgcactggattgccgcaagcatcattctagagttctttctgatagtcctactgatccccgagcccgagaaacaaagaacaccccaggacaaccagctgacctacgtggtaattgccatcctcaccgtggtggcagccaccatggccaacgagatgggcttcctggaaaagactaagaaggacttcggcctgggctctatcacaacccagcagccggagagcaacatactcgacatcgacctgcggcccgctagtgcgtggaccctgtacgccgtagccaccaccttcataaccccgatgctccgccacagtattgagaacagctccgtgaacgtgtctctcacggccatcgcaaaccaggcgaccgtcctgatggggctaggtaagggctggccattatccaagatggatattggggtgccgctgctcgcgatcggttgttacagccaagtgaaccccatcaccctgaccgccgcccttctcctgttggtcacgcattacgcgatcatcgggcctggcctccaggccaaggccactagagaggcccagaagcgcgccgcggccggcatcatgaagatacccacagtcgacgggattaccgtgatcgacctagaccccatcccgtacgaccccaagttcgagaagcagctgggccaggtcatgctcctggtgctgtgcgttacgcaggtcctcatgatgcgtaccacctgggcgctgtgcgaggccttaaccttagccaccggtcccatatccacgctatgggaggggaacccggggcgcttctggaacaccaccatagcggtaagcatggccaacatcttcagaggctcttacctcgccggcgccgggctactcttttcaattatgaagaacacggccaatacacggcgcggcacagggaacaccggcgaaacgctgggagaaaagtggaaaaaccggctcaacgcacttgggaagtcggagttccagatatacaagaagtcgggaatccaggaggtggaccgaacccttgcaaaagaggggatcaagcggggtgagaccgaccaccacgccgtatcacgcggcagcgcaaagctcaggtggttcgtggagcgcaacctggtaacccccgagggtaaggtcgtggacctgggttgtgggcgaggtggctggtcctattactgcggcgggctcaagaacgtcaaggaggtcaagggcctgacgaagggtggaccgggccacgaggagcccatcccaatgagcacctacggttggaacctggtgaggctccaatcaggtgtggacgtcttcttcacaccacccgagaagtgcgataccctgctgtgtgacatcggagagagcagccccaatccgaccgtggaggctggcagaacgttacgcgtgctgaacctggtcgagaactggctcaacaacaatactcagttctgcatcaaggtgcttaacccctacatgccatctgtgatagaaaagatggaggccctgcagcggaagtacggaggggccctcgtccgcaacccgctctctcgaaactccactcatgagatgtactgggtgagtaatgcctcgggcaatatcgtgagctccgtcaatatgatcagccgcatgttaataaaccggttcaccatgcgccacaagaaggcaacgtacgaaccggacgtcgacctggggtccggcacccggaacattggaatcgagtcagagacccccaacctcgacataatcggcaagcgcatagagaagatcaagcaggagcacgagacctcctggcattacgaccaggaccacccctacaagacgtgggcgtaccacggtagctacgaaaccaaacagaccggctccgccagcagcatggtgaacggggtcgttcgcctcttgaccaagccgtgggacgtaatccccatggttacgcagatggccatgacggacaccacccccttcgggcagcagcgggtatttaaggaaaaggtggatacgcgcacccaagagcctaaggagggcaccaagaagctcatgaagatcactgctgaatggttgtggaaagaattaggcaagaagaagacgcctcggatgtgcacgagagaggagttcacacgaaaggtacgcagcaacgccgcgctcggagccatcttcaccgacgagaacaagtggaagtccgcccgggaggccgtagaggacagcggtttctgggagctggtcgacaaggagcggaacttacacctcgagggcaaatgcgaaacgtgcgtatacaatatgatgggaaaacgggagaagaaactcggcgagtttggcaaggccaaaggctcccgcgcaatctggtatatgtggttaggggcacggttcctagagttcgaggcgttgggctttcttaacgaggaccactggttcagccgcgagaactccctctccggggtggagggcgaggggctgcataaactgggctacatcctaagggatgtcagcaagaaggagggcggagccatgtacgccgacgacaccgccggatgggacacgaggataactctagaggatctgaagaacgaggagatggtgacgaatcatatggagggagagcacaagaaactcgccgaagcgatatttcggcttacatatcagaataaagtggttcgcgtgcagcgtccaactcccaggggcaccgtgatggacatcatctcccgacgagatcaacgggggagcggccaggtggtgacgtacgggctgaacaccttcaccaacatggaggcccagttaatccgccagatggagggagagggcctcttcaagtccattcaacatctgaccgtcacagaggagatcgcggtcaagaactggctggtaagagtagggcgggaacgcttgagccggatggccatatctggggatgattgcgtcgttaagcccctggacgaccgcttcgccagcgcgctcacagctctcaacgacatggggaaggttcgaaaggacatccagcagtgggagccgtcgcgcgggtggaacgactggactcaggtccccttttgctcacaccacttccacgaactgatcatgaaggacggcagagtgctcgtggtcccgtgcaggaaccaggacgaactgatcggacgggcgcgcatttcgcagggcgcggggtggtcactgagggagaccgcgtgtctgggcaagagctacgctcagatgtggagcctgatgtatttccaccgccgggacctgcgcctcgccgcaaacgcaatctgctccgccgttccttcgcactgggtgccgacctcccggaccacctggtcgattcacgcaacccacgaatggatgactacggaggacatgcttactgtctggaatcgagtgtggatccaggagaatccctggatggaggacaagacccccgttgagtcctgggaggagatcccctacctgggcaagcgtgaagaccagtggtgcgggagcctgattggcctgaccagccgcgccacctgggcgaagaatatccagaccgcgatcaaccaggtcaggtcgcttatcgggaacgaggagtacaccgattacatgccgagcatgaaacgcttccgccgcgaggaggaggaggccggggtgctctggtaa

SEQ ID NO: 24864 - RNA, 9876 nt, synthetic construct
  misc_feature 1..9876: note = derived and/or modified CDS sequence (opt11) from DENV-2__KX380832__SS-prME
  source 1..9876: mol_type = other RNA
accgccgggataatcatcatgatgatcccgaccgtgatggccttccatctgaccacccggaacggtgagccccacatgatcgtcagccggcaggagaagggcaagagtctgctgttcaagacggagaacggggtgaacatgtgcaccctgatggcgatggacctcggggagctatgcgaggataccataacctacaactgccccctgcttaggcagaacgagcctgaagacatcgactgctggtgcaacagtaccagcacctgggtgacctacgggacctgcaccgcgaccggagagcaccgtcgcgagaaacggagcgttgccctggtgccgcacgtgggcatggggctggagacgcgcacagagacctggatgtcctccgagggcgcgtggaagcacgcacagcggatcgagacctgggtcctccgccaccccggatttacggtgatggcggccatcttagcctacaccatcggcaccacctacttccagcgggtgctgatcttcatcctcctgacggccgtcgcgccctccatgaccatgcgctgcatcgggatcagcaaccgggacttcgtggaaggagtgtccggcgggagctgggttgacattgtgctggagcacggctcttgcgtgaccacaatggccaagaacaagcccactctcgacttcgaactgataaagaccgaggccaagcatccggccacactgcgcaagtactgcatagaggcgaagctcaccaacacgaccacagcgagcagatgtccgacccagggagagccctccctgaacgaggagcaggataagcgctttgtctgtaagcatagcatggtggaccggggctggggcaacgggtgcggcctgttcgggaagggcgggatagtaacctgcgccatgttcacatgcaagaagaatatggaggggaagatagtccagcccgaaaaccttgagtacacaatcgttatcacgccccattccggcgaggaaaacgccgttgggaacgacacggggaagcacgggaaggagatcaaagtcaccccgcaaagctccataaccgaggccgagctgaccggctacggaaccgccacgatggagtgctcgccacgcaccggcttggacttcaacgagatggtgctgcttcagatggagaacaaagcgtggctggtgcaccggcagtggttcctcgacctgcccctgccctggctcccgggcgccgacactcaggggtcaaactggatccaaaaggagaccttagtcacgttcaaaaacccccacgcaaagaagcaggacgtggtcgtgctgggctcacaagagggggccatgcacaccgcccttaccggcgcgaccgagatccagatgagctccgggaaccttctcttcacgggccacctcaagtgccgcctgcggatggataagctgcagctcaagggcatgagctactccatgtgcaccggtaaattcaaggtggttaaggagatcgccgagacccagcacggcaccatagtgatccgagtgcagtacgagggggacggctctccatgcaagatccccttcgaaatcatggatctggagaaacggcatgtcctgggccgcttgatcacggtgaacccgatcgtcaccgagaaggactcccccgtcaacatcgaagccgaaccgcccttcggggactcatacattatcatcggcgtagagcctgggcaactgaagttatcctggttcaagaagggcagcagcattgggcagatgtttgagaccactatgcggggcgccaagcggatggcaatcctcggagacacagcatgggactttgggagcctgggcggggtgttcacctccatcggcaaggccctgcaccaggtcttcggggcaatctacggagccgctttcagcggcgtgtcatggactatgaagatcctcatcggggtggtcatcacctggatcggcatgaacagtcgctcaacgtctctctccgtgagcctggtcttagtcgggatagtaaccctctacctaggtgtaatggtccaggccgactccggttgtgtggtgagctggaagaacaaggagctgaagtgcggcagcggcatcttcattaccgacaacgtccatacctggacggagcagtacaagttccaacccgagtcccccagcaagttagcctccgcgatccagaaggcgcacgaggaagggatctgcgggatccggagcgtgacccgccttgagaacctgatgtggaagcagatcacccccgagctcaaccacatcctgtctgagaacgaggtgaaactcaccatcatgacgggggacatcaagggcatcatgcaggcggggaagcggagcctccggccgcagcccaccgagctcaagtactcatggaaagcctggggcaaggccaagatgctgagcaccgagctccacaaccacaccttcctgatcgacggacccgagaccgccgagtgcccgaacacgaaccgggcctggaactcactggaggttgaggactacgggttcggggtgttcaccacgaacatctggttaaagcttaaggagcgccaggacgtcttctgcgactcaaagctgatgtccgcggccatcaaggacaaccgggccgtccacgccgacatggggtactggatcgagagcgccctcaacgatacttggaagatcgagaaggcctccttcatcgaggtgaagagctgccactggcccaagtcccacaccttgtggtcaaatggcgtgctggagtctgagatgatcatacccaagaatttcgccggacccgtcagccagcacaactatcgtccggggtaccacactcagaccgccggcccctggcatctcgggcggctggagatggacttcgacttctgcgaaggcaccacggtggtggtcaccgaagactgcgggaacagaggccccagcctgcggaccactacggcctccggtaagctcatcacggagtggtgctgtcgctcctgcacactcccccccctgcggtaccgcggggaagacggttgttggtacggtatggaaattcgccccctcaaggagaaggaggagaacctggtgaactccctggtgacagcgggccacgggcagatcgacaacttcagcctcggtgtcctgggcatggccctgttcctcgaggagatgcttcgaacgcgggtggggaccaagcacgccattctgctcgtggcggtctcgttcgtgaccctgatcaccggcaacatgtcgttccgcgacctggggcgcgtgatggtaatggtgggcgccaccatgactgacgacattggaatgggcgtgacctatttagcactgctggccgccttcaaggtccggcccacctttgccgccggcctcctactgcgcaaactcacgtccaaggagctgatgatgaccaccatcgggatagtgctactcagccagtccactatccccgagacgatcctggagctgaccgacgcgcttgccctgggcatgatggtgttgaagatcgtccggaacatggagaaataccaactcgccgtaaccatcatgaccattctgtgcgtcccaaacgctgtgatactgcaaaacgcctggaaggtgtcctgtacgattctcgcggtagtgtccgtgtcccccctgctgctcacctccagccagcagaaggcggactggatccccctggccctgacgatcaagggtctcaacccgaccgccattttcctgacgaccctgagccgtacaagcaagaagagaagttggccgctcaacgaggcgatcatggccgtcggaatggtgagcattctggcctccagcctgttgaagaacgacatccccatgaccggcccactggtggcagggggcctgctcacggtttgctacgtgctaacagggcgcagcgccgacctggaactcgagcgggcggccgacgtgcgctgggaggagcaggccgagatcagcgggagctcccccatcttaagtatcaccatttccgaggacgggagcatgtccatcaaaaacgaggaggaggagcagaccttaacgattctcatccggaccggcctgctagtcatcagcggactcttcccggtatccatccccatcaccgccgccgcatggtacctgtgggaggtgaagaagcagcgcgccggggtactgtgggacgtgcccagccctccgcccgtgggcaaagcggagctcgaggacggggcttacagaatcaagcagaaaggtattctagggtactcccagataggcgccggcgtctacaaggaggggacgttccacaccatgtggcacgtgacgcgcggcgcggtgctgatgcataagggtaaacgaatcgaaccgagctgggccgacgtcaagaaggatctcatctcctacggcgggggctggaagctggagggcgagtggaaggagggggaggaggtacaggtgttggccctggagcccggcaagaacccccgcgccgtccaaaccaagcccgggctgttcaagacaaacaccggcacgataggagccgtgtcgctagacttctcccccggcacctcagggtcccccattgttgacaagaaagggaaggtagtgggcttgtacgggaacggcgtggtaacccggagcggcacctatgtgtcagcaatcgcccagacagaaaagtccatcgaggacaaccccgagatcgaggacgatatcttccgcaagaagagactcaccatcatggacctgcaccccggggccggtaagactaaacgctacctacccgccattgtgcgggaggccatcaagcgcgggctccggactctgattctggccccgactcgcgtcgtggcagccgaaatggaggaggccttgcgcggcctgccgattcggtaccaaactcccgcaatccgcgcagagcacaccggacgggagatcgttgacctgatgtgccatgcgactttcacgatgagactcctgagcccgatacgggtaccgaactacaacctgatcataatggacgaggcccacttcaccgaccccgcctccatagctgcccgcggctatatctccacccgggtggagatgggcgaggccgctggtattttcatgaccgctacgccgcccggctcccgcgacccattccctcagagcaacgctcccataatggacgaggagcgtgagatccccgagcgctcctggaactccgggcacgaatgggtgaccgatttcaagggcaagacagtctggttcgtgccgtccatcaaggccgggaacgacattaccgcctgcctccggaagaacggcaagaaggtgatacagctcagccgcaagacgtttgactccgagtacatcaagacccggaccaatgactgggacttcgtagtcacaacggacatcagcgagatgggcgcaaacttcaaggcggagcgcgttatcgaccctcggcgctgcatgaagcccgttatactgaccgacggggaggagcgggtgatactcgccggccccatgccggtgacccattcctctgccgcacagaggcggggacgtgtaggccgcaaccccaagaacgagaatgaccagtacatctacatgggggagccactggagaacgacgaggactgcgcccattggaaggaggcgaagatgctcttggataacatcaacacacccgagggcatcatcccgtccatgttcgagccagagcgggagaaggtggacgccatcgacggcgagtaccgcctgcgcggtgaagcccgcaagacctttgtagacctgatgcgacgcggtgacctcccagtctggctggcctaccgggtggccgcggaggggatcaactatgccgaccgcagatggtgctttgacggagtcaagaacaatcagatcctggaagagaacgtggaggtggagatatggaccaaggagggggagcgcaagaagttgaagccgcgttggctggacgccaggatatacagcgatcccctggccctcaaggagttcaaggaattcgccgcgggccggaaatccctgaccctgaacctcatcaccgagatgggccgccttccgacgttcatgacccagaaggcccggaacgcgcttgacaacctcgcagtcctccacactgcggaggccgggggccgcgcctacaatcacgccctgagcgagctccccgagacccttgagactctgctcctactaaccctcctggcgaccgtgacaggcggaatcttcctgttcctcatgtccggcaagggcatcggcaagatgactttagggatgtgctgtatcatcacggcgagcatcttgctctggtacgcccagatccagccgcactggatcgccgccagtatcatcctggagttcttcctgatcgtgctcttgatcccagagccagagaagcagcggacgccgcaggacaaccagctgacctacgtcgtgatcgccatcctcacggtggtagcggccactatggcgaacgagatgggcttcttggagaagaccaaaaaggactttgggctgggcagcattacaacccagcagccggatagcaacatcttggacatagatctgcgccccgcttcagcctggactctgtacgcggtagccactaccttcatcaccccgatgttacggcacagcatcgagaacagtagcgtgaacgtctccctgactgccatcgccaaccaagccaccgtactgatgggactcgggaagggttggccgctcagcaagatggacatcggcgtgccgctgctcgcgatcggctgctactcgcaagtcaaccccatcacgttgactgccgcccttctcctgctggtggcccactacgcaatcatcgggcccggcttgcaggccaaggccacacgcgaggcccagaagcgggcagcggccggcatcatgaagatccccgccgccgacggcatcacagtgatcgacctggacccgataccctacgaccccaagttcgagaagcagctgggccaggtcatgctcctggtactgtgcgtgacccaggtcctcatgatgcggaccacctgggcattatgcgaagcactgaccctcgctaccgggcctatcagcacgctgtgggagggcaacccgggtcgcttctggaacacgaccatcgcagtctccatggccaacatattcagaggcagctacctggccggcgccgggttgctattctccatcatgaagaataccgccaacacccgccggggtacggggaacaccggcgagactctaggcgagaagtggaagaaccgcctgaacgccctgggcaagagcgagttccaaatatataagaagtcaggcattcaggaggtggatcggacactggccaaggaggggatcaagaggggcgagacggaccaccacgcggtctctcggggttccgcaaaactccgctggttcgtggagagaaacctggttacccccgagggaaaggtcgtggacctgggctgtgggcgcggtgggtggagttactactgcggcgggcttaagaacgtaaaggaggtcaagggcctgaccaagggggggcccggccacgaggagcctattccgatgtccacgtacgggtggaacctggtccgtctacagtcaggcgtggatgtattttttacgccgcccgagaagtgcgatacgctgctctgtgacatcggggaatccagccccaatccgaccgtggaggccggccgcactttacgggtgctgaacctggtcgaaaactggctcaacaacaacacccaattctgtatcaaggtcttaaacccctacatgccgagcgtgatcgagaagatggaggctctgcagcggaaatacggcggggccctggtcagaaaccccctttcccgcaactcaacgcacgagatgtactgggtgagcaacgcgagcggcaacatcgtgtccagcgtaaatatgatctcccggatgctgataaaccgtttcaccatgaagcacaagaaggccacctacgagccggacgttgacctggggagcggcacccggaacatcgggatagagtccgagacgcccaacctcgacatcattgggaagcgcatcgagaagatcaagcaggaacacgagaccagctggcactacgaccaggatcacccctacaagacatgggcgtaccacggctcgtacgagaccaagcagacgggatctgcctccagcatggtgaatggggtcgtgaggctgctgaccaaaccgtgggatgtcatccccatggttacccagatggccatgaccgacacgacccccttcgggcagcagcgtgttttcaaggagaaggtggacacccgcacccaagaacctaaggagggcacgaagaagctcatgaagatcaccgccgagtggctgtggaaagagctcgggaagaagaagaccccccggatgtgcacccgggaggagttcacgcggaaggtccgctccaacgccgccctaggtgccatcttcactgacgagaacaagtggaagtcggcccgggaggcggttgaggactccggcttttgggaactggtcgataaggaacgcaacttacatctcgaggggaagtgcgagacctgcgtctataacatgatgggcaagcgggagaagaaactgggggagtttggcaaggcaaagggcagccgtgccatttggtacatgtggttgggcgcacggtttctcgagttcgaggcgctgggcttcctgaacgaggaccactggttcagtcgcgagaactctctcagcggggtggagggtgaggggctgcacaagctgggctacatcctccgggacgtctccaagaaggagggcggggcgatgtacgccgacgataccgccggctgggacacgcgtatcaccctggaggaccttaagaacgaagaaatggtgaccaaccacatggagggggagcaccggaagttggccgaagcgattttccgcctgacctaccaaaataaagtggtgcgggttcagcgccctacgccccggggcacggtgatggacataatttctcgccgggaccagcgggggtccggccaggtcgtgacctacggcctgaacaccttcacgaacatggaggcccagctcattcggcagatggagggggagggcgtgttcaagagcatccagcacctgaccgtcacagaggagatcgccgtgaagaactggttagagcgggttgggcgtgaacggctgtcacgcatggccatcagcggcgacgactgcgtcgtgaagcccctggacgaccggtttgcgagtgcgctgacagcactcaatgacatggggaaggtgaggaaggacatccagcagtgggagcccagccgtgggtggaatgactggactcaggtccccttctgctcccaccatttccacgagttaattatgaaggatggccgggtgctggtggtcccctgccggaaccaggacgagctcatcgggagggcacggattagtcagggcgccgggtggtccctgcgcgagaccgcctgcctaggcaagtcatacgcgcagatgtggtccctcatgtacttccaccggcgcgacctgcggttggccgccaacgcaatctgcagcgccgtaccctcccactgggttccgacaagccgcaccacctggtccatccacgccacgcacgaatggatgaccaccgaggatatgctcaccgtctggaaccgggtgtggatccaggagaacccctggatggaagacaagacacccgtggagtcttgggaggagatcccctacttgggcaagcgcgaggaccagtggtgcgggagcctgatcggcctcacctcccgggcgacctgggccaagaacatccagaccgccatcaatcaggtccgaagcctgatcgggaacgaggagtacacggactatatgccgagcatgaagcgcttccggcgcgaggaggaagaggcaggcgtactgtggtga

SEQ ID NO: 24865 - RNA, 9876 nt, synthetic construct
  misc_feature 1..9876: note = derived and/or modified CDS sequence (opt11) from DENV-2__KX380833__SS-prME
  source 1..9876: mol_type = other RNA
actgcagggatcatcatcatgatgatccccaccgtgatggcctttcacctgactacacggaacggggagcctcacatgatcgtgagccggcaagagaagggcaagagcctcctgtttaagaccgaaaatggggtgaacatgtgtaccctgatggcgatggacctcggcgagctgtgcgaggacaccatcacctacaactgtcccctgctccgccagaacgagcccgaggacatcgactgctggtgcaacagtaccagcacttgggtgacctacgggacctgtaccgccaccggggagcaccggcgcgagaaacggtcagtcgccctggtaccccatgtaggcatggggctggagacccgcaccgagacctggatgtccagcgagggggcctggaagcacgctcagcggatcgagacctgggttctccgccaccccgggttcaccgttatggcggccatcctggcttacaccatcggcacgacttatttccagagagtgttgatcttcatcctcctgaccgccgtcgcgccctccatgaccatgcgctgcattgggataagcaaccgagacttcgtggagggcgtgtccggcgggagctgggtcgacatcgtgctggagcacggctcctgcgtcaccaccatggccaagaacaagcccacgctcgattttgagttaatcaagaccgaggccaagcaccccgccaccctgcgcaagtactgtattgaggccaagctaaccaacacgaccaccgcgagccggtgcccgacccagggtgagccatccctgaacgaggagcaggacaagcgcttcgtatgtaagcacagcatggtggaccggggctggggcaacgggtgcggcctgttcgggaaaggcgggatcgtgacctgtgccatgtttacgtgcaagaagaacatggaaggcaaaatcgtccagcccgagaacctcgagtacaccatcgttatcacgccacactccggcgaggagaacgccgtgggtaacgacacgggcaagcacgggaaggagataaaggtcaccccacagagttccatcaccgaagctgaactgaccggctacgggaccgccacgatggagtgcagcccccgtaccggcctggacttcaacgagatggtgctcctgcagatggagaacaaggcttggctggtacaccggcagtggttcctagacctgcccttaccctggctcccgggcgccgacacccagggctccaattggatacagaaggagactctggtaacgttcaagaacccccacgccaagaagcaggacgtggtcgtgctgggctctcaggagggggcaatgcataccgccctcaccggcgcaaccgaaatccagatgagctccgggaatctgctatttacgggccacctaaagtgccgcctgcggatggacaagctccagctcaagggcatgagctacagtatgtgtaccgggaaattcaaggtggtcaaagagatcgctgagacacagcatgggaccatcgttatccgcgtgcagtatgagggggatggcagtccctgcaagatccccttcgagatcatggacctggagaaacggcacgtcctgggccgcctgatcacggtgaatccaatcgtgaccgagaaggactcccccgtcaacatcgaggccgagccgcccttcggcgacagctacataattatcggcgtggagccggggcagctgaagctgtcttggttcaagaagggcagctcgattgggcagatgttcgagaccaccatgcgcggcgccaagcggatggctatcctcggcgacacggcgtgggacttcggtagcctgggaggggtgttcacctctatcggcaaggccctgcaccaagtcttcggggccatctacggcgccgcgttctctggcgtgtcctggacaatgaaaattctcatcggggtagttatcacttggatcggcatgaatagtcgctccacgagcctgagcgtgagcctggtgctggtcgggatcgtgaccctctaccttggcgtgatggtccaggccgattccgggtgcgtagtgtcatggaagaataaggagctgaagtgcggcagcggcatttttataaccgacaacgtacacacttggacggagcagtataagtttcagcccgagtcccccagcaagctcgcctccgcgatccagaaggcccacgaggaggggatctgcggcatccggagcgtgaccagactggagaacttaatgtggaagcagatcacgcctgagctcaaccacattctgagtgagaacgaggtgaagctgaccatcatgacgggggacatcaagggcatcatgcaggcggggaagcggagcctgcgaccgcagcccaccgagctgaagtactcctggaaggcctggggcaaagccaaaatgctaagcaccgaactccacaaccacaccttccttatcgacggccctgaaacggccgagtgcccgaacaccaaccgggcctggaactccctggaggtcgaggactacgggtttggcgtgttcaccaccaacatctggctcaagctgaaggagcgccaggacgtgttttgcgatagcaagctgatgtccgcggccattaaggacaacagagccgtccacgccgacatgggttactggatagagagcgcccttaacgacacgtggaagatcgagaaggcgtcctttatagaggtcaaaagttgccactggcccaagtcccacaccctgtggagcaacggcgtgctagagtcggagatgatcatccccaagaacttcgccggccccgtgagccagcacaattaccgcccagggtaccacacccagaccgccggcccttggcaccttgggagactggagatggatttcgacttctgcgaaggaaccacagtagtggtcaccgaggactgcgggaaccgcggcccctccctacggacaaccacggcgtccggcaagctcatcacggagtggtgctgccgcagctgcaccctgccacccctgcggtacagaggtgaggatggctgctggtacggcatggagatccgacctctcaaggagaaggaggagaacctggtgaactcccttgtgaccgcaggccacgggcagatcgacaacttcagcctaggcgtcctgggcatggccctgttcctcgaggaaatgctgaggacgcgggtagggaccaagcacgccatcctgctcgtcgccgtctccttcgtgaccctgattaccggcaacatgagcttccgtgacttggggcgagtgatggtcatggtgggcgccacgatgaccgatgacatcgggatgggagtcacatacctcgcgctgctggccgccttcaaggtccggcccaccttcgccgccggcctcctgctgcgcaagctcacatccaaggagctgatgatgacaaccatcgggatagtgctgctgtcacagagcaccatccccgaaactatactggaactgaccgacgctttagccctgggcatgatggtgctgaagatcgtccggaatatggagaagtaccagctcgcggtgacgataatggctatcctgtgcgtcccgaacgccgtgatcctgcagaacgcgtggaaggtgagctgcaccatcctcgcggttgtgtccgtgagccccctgctcctcaccagttcccaacagaaggccgactggatccccctggccctcaccatcaaagggctcaacccgaccgcaatcttcctgaccaccctgtcccgcaccagcaaaaagcgatcgtggccgctcaacgaggccattatggccgtcggcatggtatccatcctggcctcctccctgctcaagaacgacatccccatgaccggccccctggtggccgggggcctgctcaccgtctgctacgtgctgaccggtcgcagcgcggacctagagctcgagcgggccgccgacgtgcgctgggaggagcaggccgaaatctcaggaagctcccccatcctgagcatcaccatctccgaggatgggagcatgtccatcaagaacgaggaggaagagcagaccctgaccattctcatccggacgggcctgctggtcataagcggcctcttcccggtgagtatccccatcaccgccgcggcctggtacctgtgggaggtgaaaaagcagcgcgccggggtcctgtgggacgtcccctctcccccgcccgtcggcaaggcagagctcgaggacggggcctaccggattaagcagaagggcatccttgggtactcccaaatcggcgcgggcgtctacaaggaaggtaccttccacaccatgtggcatgtgacccgcggcgccgtgctgatgcacaaggggaaacggatcgagccgagctgggccgacgttaagaaggacctcatctcctacggcggtggctggaagctggaaggcgagtggaaggagggggaggaggtgcaggtgctggccctcgagcccgggaagaaccctcgggccgtccagacgaagccggggctgttcaagaccaacacggggacgatcggtgctgtatctctggacttcagtcccggcacgagcgggtcccccatcgtggacaagaaggggaaggtcgtgggcctctacgggaacggtgtggtcacacggtcaggcacttacgtatccgccattgcacagaccgagaagtcgattgaggacaacccggagatcgaggacgatattttccgcaagaagcgattgacgatcatggacctgcaccccggggccggcaagaccaagcgctacctgcccgcgatcgttcgggaggccatcaagcgcgggctccggaccttaatactggcccctaccagagtcgtggccgcagagatggaggaggcactgcgcggcctgcccattcggtaccaaacccccgctattagggccgagcacacagggagggagatcgtggacctcatgtgccacgccaccttcaccatgaggctcctgagccccatccgagtccctaactacaacctgatcatcatggacgaggcccacttcacggaccccgcgtccatcgccgcccgcggctacattagcacccgggtggagatgggagaggcggccgggatctttatgaccgcgacgccccccggctcccgcgacccgttcccccagagcaacgcccccatcatggacgaggaacgggagatccccgagcgctcctggaactccgggcacgagtgggtgaccgacttcaaaggcaagaccgtctggttcgtgccctccatcaaggccgggaacgacatcgcagcgtgcctccggaagaacggaaagaaggtaatccagctgagcaggaagacctttgactccgagtacatcaagacccggacgaacgactgggattttgtcgtcaccaccgatatcagcgagatgggcgccaacttcaaggccgagcgcgtgattgaccctcggcgctgcatgaagcccgtcatcctcaccgatggggaggagcgggtaatcctcgccgggcccatgcccgtgacgcactccagcgccgcgcagaggcgggggcgggtcggccgcaacccaaaaaacgagaacgaccagtacatctatatgggggagcccctggagaacgacgaggactgcgctcactggaaggaggcaaaaatgctactcgataacatcaacaccccggaaggcatcatcccgtctatgttcgagcccgagcgggagaaggtggacgccatcgacggcgaataccgccttcgaggtgaggcccgcaagactttcgtggacctgatgcggcggggcgacctccccgtctggttagcgtaccgggtggccgccgagggtatcaactacgccgaccgccggtggtgcttcgacggcgtcaagaacaaccagatcctggaggagaacgtggaggtagagatatggaccaaggagggggagcgcaagaagctcaagccgcggtggctagacgcccgcatctacagcgaccccctggcgctcaaggagttcaaagagttcgccgccggccggaagtccttaacgctgaacctcatcaccgagatgggtcgcctgcccaccttcatgacccagaaggcccggaacgcgctggacaacctcgcagtcctccacacggccgaggccgggggccgcgcctacaaccacgcgctgagtgagctccccgagaccctggagaccctgctcctgctgaccctcctggccacggtgaccgggggcatcttcctgttcctcatgtccggcaaagggatcggcaagatgaccctggggatgtgctgcatcatcaccgcctcaatcctgttgtggtacgcccaaatccaaccgcactggatcgccgcgtccatcatcctagagtttttcttaatcgttctcttgatccccgaacccgagaagcagcggacaccccaggacaaccagctgacgtacgtcgttatcgccatcctcaccgtggtcgccgcaaccatggctaacgagatgggcttcctggagaagaccaagaaggactttgggctgggcagcatcacgacccagcagccggacagcaacatcctcgacatcgacctgcgccccgcgtccgcctggaccctatatgctgtggccaccacgtttatcactcccatgctccggcactctatcgagaactccagcgtgaacgtctccctgaccgccatcgcgaaccaagccaccgtgttgatggggctcgggaagggctggcccctgagcaagatggacatcggggtaccgctgctcgccatcggctgctactcccaggtcaatcccatcacgctgaccgcggcgctgctcctgctggtggcccattacgccatcatcgggcccggcctccaggccaaggctaccagggaggcgcaaaagcgggccgccgccggcatcatgaagatccccgccgcggatgggatcaccgtgatcgaccttgaccctataccctacgatcccaagttcgagaagcagctgggccaagtcatgctcctcgtgctttgcgtgacgcaagtgctcatgatgcgcaccacctgggcgctgtgcgaagccctgaccctcgccacggggcccatcagcacgttatgggagggcaacccgggacgtttctggaacaccacgatagccgtgtccatggcgaacatcttccggggtagctacctggcaggcgccggcctcctgttctccatcatgaagaacacggccaacacccgccggggcaccgggaacacaggagagaccttaggcgaaaaatggaagaaccgcctaaacgcattaggcaagagcgaattccagatctataagaagtccggcatccaggaggtggaccggaccctggcaaaggaggggatcaaacgcggcgagaccgaccatcacgccgtctcgcggggatccgccaagctccgctggttcgtagagcggaacctggtgacccccgagggcaaggtcgtggacctgggctgcggtcgcggcgggtggagctactactgcggcggcctcaagaatgtgaaggaggtcaagggccttacgaagggcgggcccggccacgaggagcccatcccgatgtccacctacgggtggaacctggtgcggctccaaagcggcgtggacgtcttcttcacaccgccggagaagtgcgacaccctgctgtgtgacataggggagtctagccccaacccgacggtggaggccgggcgcaccctccgggtgctgaacctggtcgagaactggctcaacaacaacacccagttctgtattaaggtactgaacccctacatgcccagcgtcattgagaaaatggaggcgctgcagagaaagtacggcggtgccttagtacggaacccgctgtcccgcaacagcacccacgagatgtactgggtgtccaacgccagcggcaacatcgtgtcctcggtcaacatgatctcccggatgttaataaaccgcttcaccatgaagcacaagaaggccacgtacgagcccgacgtggatctggggagcggcacccggaacatcggaatcgagtccgagacccccaacctcgatatcatcggcaagcgcatagaaaagatcaagcaggagcacgagaccagctggcactacgaccaggaccatccctacaagacgtgggcgtatcacggctcctacgagaccaagcagaccggcagcgcgtccagcatggtgaacggcgtcgtgcgcctgctgaccaagccgtgggacgtgatccccatggtcacgcagatggccatgaccgacaccacccccttcgggcagcagcgggtgtttaaggaaaaggtggatacacgcacccaggagcccaaggagggcaccaagaagctcatgaaaatcaccgcggagtggctgtggaaagagctgggcaaaaagaagacgccgcggatgtgcacccgggaggagttcaccaggaaggtccggagcaacgccgccctcggggctattttcaccgacgagaacaagtggaagtccgcccgggaggccgtcgaggattccgggttctgggagctggtagacaaggagcgcaacctgcacctcgaggggaagtgcgaaacgtgcgtgtacaacatgatgggcaagcgggagaagaagttgggggagttcggcaaggccaagggtagccgcgcgatctggtacatgtggctgggggcccggttcctcgagttcgaagcactgggattcctcaacgaggaccactggttctcccgcgagaacagcctcagcggggtggagggcgaggggctgcacaagttgggctacatcctccgggacgtctccaagaaggaggggggggccatgtacgccgacgacaccgcgggctgggacacccgaattaccctggaggacttgaagaacgaagagatggtgacgaaccatatggagggggagcaccggaaactcgccgaagccatattcagactgacctaccagaacaaggtggtccgggtgcagcgccccacgccccggggcaccgtgatggacatcatcagccgccgggaccagcgcgggtccggccaagtcgtcacgtacggcctgaacaccttcaccaacatggaggctcagctcatccgccagatggaaggggagggagtgttcaagagcatccagcacctgaccgtcacggaggagatagccgtgaaaaattggttggagcgggttgggcgcgagcggctctcccgcatggcgatcagcggcgacgattgtgtcgtgaagcccctggacgaccggttcgcctccgccctgaccgctctcaacgacatgggcaaggtccgcaaggacatccagcagtgggagccgagccgggggtggaacgactggacccaagtccccttctgctcccaccacttccacgagctgatcatgaaggacggccgcgtgctggtggtcccctgccggaaccaggacgagctcatcgggcgcgcacggatcagccagggcgcgggctggtccctgagagaaaccgcttgtctgggcaagagctacgcccagatgtggtccctcatgtacttccatcggcgcgacctgcgtctggccgccaacgcgatctgcagcgccgtgccctcccactgggtgccgatcagccgcacgacctggtccattcacgccacccacgagtggatgacgaccgaggacatgctcacggtctggaatcgggtgtggatccaggagaacccatggatggaggacaagacccccgtggagtcatgggaggagattccctatctgggcaagcgtgaggaccagtggtgcggaagcctgatcggccttacctcccgggccacctgggcgaagaatattcagacggccataaaccaggtcagaagcctgatcgggaatgaggagtatactgactacatgccgtccatgaagcgcttccggcgagaggaggaggaggctggcgtgctgtggtga

SEQ ID NO: 24866 - RNA, 9876 nt, synthetic construct
  misc_feature 1..9876: note = derived and/or modified CDS sequence (opt11) from DENV-2__KX380834__SS-prME
  source 1..9876: mol_type = other RNA
acggcgggtatcatcatcatgatgatccccactgtgatggcctttcacctgaccacgcgaaacggcgagccccacatgatcgtcagccgtcaggagaagggcaagtctctcttgttcaaaactgagaacggggtaaacatgtgcaccctgatggcgatggacctcggcgaactgtgcgaggacaccatcacctacaactgccccttgctccgccaaaacgagcccgaggacatcgactgctggtgtaacagcacaagcacctgggtgacctatgggacctgcactgccaccggcgagcaccgtcgcgaaaagcggagcgtcgccttggtgccccacgtgggcatggggttggagacccgcaccgagacctggatgagctccgagggcgcctggaagcacgcccagcggatcgaaacctggatcttgcgccatcccgggttcacgatcatggcggccatcctggcctacaccatcggtaccacctacttccagcgggtcttaattttcattctccttacagccgtgacgccctccatggctatgcgctgtatagggattagcaaccgggacttcgtggaaggcgtgtccggcgggagctgggtggatatcgtactggagcacggctcctgcgtcaccactatggccaaaaacaagcctactctagacttcgaactgatcaagaccgaggccaagcacctagccaccttgcgcaagtactgcgtggaagccaagctgaccaatacgaccaccgcaagccggtgcccgacccaaggggagccctccctgaacgaggagcaagacaagcgcttcgtgtgtaagcacagcatggttgatcggggctggggcaatggatgtggcctatttgggaagggcggtattgtgacgtgcgccatgttcacgtgtaagaagaacatggagggcaaggtggtgcagccggagaacctggagtacaccattgtcattaccccccattccggcgaggaaaatgctgtggggaacgacacgggtaagcacggtaaagagattaaggtcacgccccagagctccattaccgaggccgagttgaccggctacgggaccgtgactatggagtgcagcccgcgcaccggcctcgacttcaacgagatggtgctgctgcagatggagaataaggcctggctcgtacaccggcagtggttcctggacctgccccttccctggctgcccggcgcggatactcaagggtcaaactggatccagaaggagactcttgttacgtttaaaaacccacacgcgaagaagcaggacgtcgtggtgctcggcagccaggagggggccatgcataccgctctcactggcgctaccgagatccagatgagctcagggaatcttctgttcacggggcacctgaagtgccgtctgcggatggataagctccagctgaagggcatgtcatattccatgtgcaccgggaagttcaaggttgttaaggagatagcggagacccaacacggaaccatcgtgatccgcgtgcaatacgagggggacggcagcccctgcaagataccctttgagatcatggacctggagaagcggcatgtgctcggccgccttattacggtgaacccgatagtcaccgagaaagactccccggtgaacatagaggccgaaccgccattcggggacagctacataatcatcggtgtggagcccgggcagctgaagctctcctggtttaagaaaggcagctcaatcggccagatgttcgaaaccaccatgcgaggtgccaagaggatggccatactgggtgacacggcctgggacttcgggagcctagggggtgtcttcacctctataggcaaagcactccaccaggtgttcggggccatctacggcgcggccttcagtggtgtatcctggaccatgaagatcctgatcggggtcgtgataacctggataggtatgaactcgcgctccacaagcctgtccgtatctctggtcctcgtcggggtggtcaccttatatcttggcgtgatggttcaggcggattcagggtgcgtggtgagttggaaaaacaaggagctgaagtgcggaagcggaatcttcatcaccgataacgtgcacacatggacggagcagtataaattccagccagagtcccccagcaagctggcctccgccatccaaaaggcacacgaggaagggatttgcggcatacgaagcgtcactcgcctggagaaccttatgtggaaacaaataaccccggagctgaaccacatcctgaccgagaacgaagtgaagctgacgatcatgactggagacatcaagggcatcatgcaggccggaaaacgatccctgcgcccgcagcccaccgagcttaagtatagctggaaggcctggggcaaggctaagatgctatccaccgagctgcacaatcacacgttcctgatcgatggacctgagacggccgagtgccccaacacgaaccgggcctggaactcactcgaggtggaagactacgggtttggcgtcttcactacgaatatctggctgaagcttaaagagcgccaggacgtattttgcgactccaacctcatgtcggcggcgatcaaggacaaccgggcggtgcacgccgatatgggctactggattgaatccgccctgaacgacacctggaagatagagaaggccagctttatcgaggtgaagtcatgccactggcccaaaagccacacactgtggtcaaacggcgtgctcgagtccgagatgatcatacccaagaatttcgcgggccccgtttcccagcacaactaccgccccgggtaccacacccaaacggccggcccgtggcacctggggcggctagagatggacttcgacttctgcgagggcacgactgttgtggtgaccgaggattgtggtaaccgcggacccagcctccggaccacgaccgcgagtggcaagctgataacggagtggtgctgcaggtcctgcactctgcccccgctcagatatcgcggggaggacggttgctggtatgggatggagatacggccactgaaggaaaaggaagaaaacctggtcaatagcctcgttacggccggtcatgggcaaatagacaacttcagtctgggcgtactgggcatggccctctttttagaggagatgctacgcacacgggtcgggaccaaacacgcaattctcctggtggccgtgtctttcgttaccctgatcacggggaacatgagtttccgcgatctcgggcgcgtgatggtgatggtcggggccaccatgaccgacgacatagggatgggcgttacttacctcgccctgttagcggccttcaaggtgcggccaacgttcgccgcgggcctcctgctgcgaaagctgaccagcaaggagctgatgatgaccacaatcgggatcgtcctcctgtcccaaagtacgatccccgagagcatcctcgaactcacagacgccttggcgctgggcatgatggtgttaaaaatcgtacggaacatggagaaatatcagcttgcagtgaccatcatggcaatcttgtgcgttccaaacgcagtaatcctgcagaacgcctggaaggtgagttgtaccacgctggcggtggtctccgtgagcccgctgctcctgacctccagccaacagaaggccgactggatccccctggccctcaccatcaagggcctgaacccaacggcaatcttcttgacgaccttatcccgcacctctaagaagcggtcctggcccttaaatgaggctattatggcagtagggatggtctcgatcctggcctccagcctcctgaagaacgacatcccgatgaccggccccttggttgccggcgggcttttgaccgtgtgttacgtcctgactgggcgcagtgcggacctcgagctcgagagggcggcagacgtacgctgggaagagcaggccgagatctccggcagttccccgatattatctatcaccatctccgaggacgggtcaatgtcaatcaaaaacgaggaggaggagcagactcttacgatcctgatccggacgggcctgctggtgatctccggcctgttccccgtctccatcccgatcacagcggccgcgtggtacctgtgggaggtgaagaagcaacgcgccggggtgctctgggacgtcccctcccctccgcccgtaggcaaggccgagctggaggatggggcctaccggattaagcagaaagggatcctgggctactcccagataggcgccggcgtttacaaggaggggacctttcacaccatgtggcacgtcacgcgcggcgcggtcctgatgcacaaggggaagcggatcgagcccagctgggccgacgtgaaaaaggacctgatttcctacggggggggctggaagcttgagggagagtggaaggagggggaggaggtccaagtgctcgcccttgagcccggcaagaacccgcgcgccgtgcagaccaagcctggactgttcaagaccaacactggaacaattggggctgtcagcctcgacttctcccccggcaccagcggctcccccatcgtagacaagaagggcaaggttgtcggcctgtatgggaacggcgtggtgacccggagcggcacctacgtatcagcgatcgcccagacggagaagtccatcgaggacaacccggagatagaggacgacatcttccgcaagaagcggctcaccatcatggacctgcatcccggggcgggcaagaccaaacgctacctccccgctatcgtgcgtgaagcaataaagcgcgggctgcggaccctgatcctcgcacccacgcgcgtcgtcgccgccgagatggaagaagccctgcggggcctgccaatccgataccaaacacccgcgatccgcgcggagcacaccggtcgagagatagtggaccttatgtgccacgccaccttcacgatgcgcctactgtcacccatccgcgtgcccaactacaacctcatcattatggacgaggcccacttcaccgaccccgcctccatcgcggcccgaggctacattagcacccgggtcgagatgggcgaggcagccgggatattcatgactgccacgccgccaggctcccgggatcccttcccgcagagcaacgcccccataatggacgaggagcgggagatacccgagcgttcctggaacagtgggcatgaatgggtgacagactttaagggaaagaccgtgtggttcgtcccctccatcaaagccggcaacgacatcgctgcctgtctgcggaaaaacgggaagaaggtaattcagctgagtcggaagaccttcgattcagagtacatcaagacgcggaccaacgactgggacttcgtggtcacgaccgacatcagcgagatgggcgcgaactttaaggccgagcgcgtaatcgacccacggcgctgcatgaagcccgtcatccttacggacggcgaggagcgggttattctggccggcccaatgcccgtgacgcacagcagcgccgcccagcgccggggtcgcgtgggccgcaacccgaagaacgagaacgaccagtacatctacatgggagagcccctggagaacgacgaggactgcgcgcattggaaggaggccaagatgctcctcgacaacatcaacacccccgagggcattattccaagtatgttcgagccggagcgggagaaggtcgacgcgatagatggagaataccgcttgcgcggggaggcccgaaagaccttcgtagatctcatgcggaggggcgacctgcccgtctggttagcctatcgggtggccgccgaggggatcaactacgcagaccgccggtggtgcttcgacggcgttaagaacaaccagattctcgaagagaacgtcgaggtggagatctggaccaaggagggggagcgcaagaagctgaaacctcggtggctggacgccaggatctacagcgatcccctcgcgctcaaggagttcaaggagtttgcggccggccggaagtcccttactctcaacttgataaccgaaatggggcgcctgcccacattcatgacgcagaaggccaagaacgccctcgacaacctggcggtgttgcataccgccgaggccgggggcagagcatacaatcacgccctcagcgagctgcctgagacgctggagaccctcctgctattaacgctgctggcgaccgtcaccggtggcatcttcctcttcctgatgtccgggaaagggataggtaagatgaccctggggatgtgctgcatcatcaccgccagcatcttactgtggtacgcccaaatccagccacactggatcgcagcctccatcatcctggagttcttcctcatcgtcctgctgatcccggagcccgagaagcagcgcacgccgcaggacaaccagctcacctatgtagtcatagcgatcttgaccgtagtcgccgccacgatggccaacgagatgggcttcctcgaaaagactaagaaagacttcgggctaggctcaatcacaacccagcagcccgagagcaacattctggatatcgatctccggccggcatcagcgtggaccctctacgccgtagccactacctttatcacccctatgctacgccattcaatcgagaactcctcagtgaacgtgtccttaaccgcaatcgccaatcaggcgacggtactcatgggcctggggaagggctggcccctgtcgaagatggacatcggggtgccccttttagctatcggctgctactcccaggtgaatccgatcaccttaaccgccgcgctccttctgctcgtcgcgcattacgccatcatcggccccggcctacaggcaaaggccacgagagaggcccagaagcgcgcagccgccggcataatgaagaaccccacggtcgacgggatgaccgtgattgacctggaccccatcccgtacgaccccaagtttgagaagcaattaggccaggttatgctgttggtgctctgcgttacccaggtcctgatgatgcggaccacctgggccctgtgcgaggccctcactctggcgaccgggccaatctcaacgctgtgggaggggaaccccgggagattctggaacacgacgatcgccgtgtccatggcgaacatatttcgcggtagctacctcgccggcgcaggtctactgttcagcatcatgaagaacaccgcaaacacccggagagggacgggtaatacgggggaaaccctcggcgagaagtggaagaaccgactgaacgccctgggcaaatcagagttccaaatatacaagaagtccggcatccaggaggtggaccgcaccctcgcaaaggaggggatcaagcggggcgaaacggaccaccacgccgtctctcgcgggtccgctaaattgcggtggttcgtggaacgcaacctggttacgccggagggcaaggttgtggacctcggctgcgggcggggcgggtggtcatactattgcggcggactgaagaacgtgaaggaggtcaaaggcctgaccaagggtgggccaggccacgaggagcccatccccatgtccacctacggatggaacctcgtgcgcctccagagcggcgtagacgtcttcttcacgccgccggagaagtgcgacacactgctctgcgacatcggcgagtccagcccaaatcccacagtggaggccggtcggaccttacgcgtgctgaacttggtcgaaaactggctcaacaacaacactcagttctgtataaaggtgttgaacccgtatatgcctagcgtaattgagaagatggaagctctgcaacggaagtacggcggggcccttgtccgcaaccccctctcccggaacagcacgcatgaaatgtactgggtgtccaacgcctctggcaacatcgtatccagcgtcaacatgatctcccgcatgctgatcaaccggttcactatgcgccacaagaaggcgacgtacgaaccggacgtggacctggggtcaggcacacggaacatcgggattgagagcgagacgcccaacctggacatcataggaaagcgcatcgagaagatcaagcaggagcacgaaaccagctggcattacgaccaggatcacccctacaagacctgggcctaccatggctcctacgagaccaagcagaccgggagcgcctccagcatggtgaacggcgtggtgaggcttctcaccaagccatgggacgttatcccgatggtgacccagatggccatgaccgacactactccatttgggcaacagcgggtgttcaaggagaaagtggacacccgcactcaggaacccaaggaaggcaccaagaagctgatgaagatcaccgccgaatggctgtggaaggagctcggcaagaaaaagactcccaggatgtgcacccgcgaggagttcacccggaaagtgcgctcaaatgcggcacttggggccatattcaccgacgagaacaagtggaagtccgcccgagaggccgtggaggactccggcttctgggagcttgtcgacaaggagaggaatctccacctggaggggaagtgcgagacctgcgtgtacaatatgatgggcaaacgggagaaaaaactgggggagttcggcaaagcgaagggcagccgcgcgatctggtacatgtggctcggcgcccggttcttagagttcgaggcccttggtttcttaaacgaggaccactggttctcacgcgaaaacagcctgagcggggtagagggcgaggggctgcacaagctgggctatatactgcgggatgtcagcaagaaggaggggggggcgatgtacgccgatgacaccgcgggctgggatacgaggatcaccctcgaagatctcaagaatgaagagatggtaaccaaccacatggaaggggagcacaagaagctggccgaggccatcttcaagctcacttaccagaacaaggtggtccgagtgcaacgcccgacgccccggggcaccgtcatggacatcatcagccgccgcgatcagcgcgggtccggccaagtcgtgacctacggcctaaacacgttcactaacatggaggcgcagctgatccggcagatggaaggcgagggcgttttcaagagtattcagcaactgactgtcaaggaggagattgccgtgaagaactggctcattcgcgtggggcgggagcggctctcccgcatggcgatcagcggagacgactgcgtcgtgaagccccttgacgaccgcttcgccagtgccctcacagcactgaacgacatgggcaaagttagaaaggatatccagcaatgggagcccagccgggggtggaacgactggacccaggtaccgttttgctcccaccacttccatgagcttatcatgaaggacggccgcgtcctcgtagtcccctgccggaaccaggacgagctgattggtcgcgctcggatatctcagggcgcggggtggagcctgcgcgagaccgcttgcctcggcaagagctacgcacagatgtggtccctgatgtatttccaccggcgcgacctgcggctcgcagccaacgcaatctgctcggccgtgccctcccactggatcccaaccagccgcaccacatggtccatccacgccactcacgagtggatgactaccgaggacatgctcaccgtgtggaaccgggtctggatccaggagaacccgtggatggaggataagacccccgtggaatcttgggaggaaataccctacctggggaagcgcgaggaccaatggtgtgggagcctcatcggtctgacgtcccgggcgacctgggccaagaatatccagactgccattaaccaggtgcgcagcctgatcggcaacgaggagtacaccgactacatgccatccatgaaaagattccgtcgcgaggaggaggaggctggcgtgttatggtag

SEQ ID NO: 24867 - RNA, 9876 nt, synthetic construct
  misc_feature 1..9876: note = derived and/or modified CDS sequence (opt11) from DENV-2__KX380835__SS-prME
  source 1..9876: mol_type = other RNA
actgccgggatcatcatcatgatgatccccaccgtgatggccttccacttaaccacccggaacggggaaccccatatgatcgttagtcggcaggaaaaaggcaagagcctgctgttcaagaccgaaaacggggtgaacatgtgcaccctgatggcgatggacctcggcgagctgtgcgaggacaccataacctacaactgccccctcctccgccagaacgagcccgaggacatcgactgctggtgcaacagcacgagcacctgggttacctacgggacctgcacggccaccggcgaacaccgtcgcgagaagcggtccgtcgcactggtgccccacgtggggatgggtctcgagactcgcaccgagacctggatgtccagcgagggcgcgtggaagcacgcccagcggatcgaaacatgggtcctccgccaccccgggttcaccgtaatggcggctatcctggcctacaccatcggcacaacctacttccagcgcgtgctgatcttcattctgctgaccgcggtcgcaccctccatgaccatgcgatgcatcgggatcagtaaccgggatttcgtagaaggcgtgtccggcggcagttgggtagacatcgtactagagcacggctcctgtgtgaccacaatggccaagaacaagcccacgctcgatttcgagctgattaagaccgaggccaaacaccccgctactctgcgcaagtactgcatcgaggcaaaactcaccaatacgaccaccgcgtcccgatgccccacgcagggagagccgtccctgaatgaggagcaggacaagcgattcgtctgcaaacactcaatggtggaccggggctggggcaacgggtgtggcctcttcggtaaaggcgggatagttacgtgcgcaatgttcacatgcaagaagaacatggagggcaagatcgtgcagcccgagaatctcgagtatacgatcgtgatcacgccgcactccggcgaggagaacgccgtggggaacgacacgggtaagcacgggaaagagatcaaagtcacgccacagagctccataaccgaagccgagctgacgggctacgggaccgcaacgatggagtgcagcccacggaccgggttggactttaacgaaatggtgctgcttcagatggagaacaaggcttggttagtgcaccggcaatggttcctcgacctgcctctgccctggctcccgggagccgacacccagggcagtaactggatacagaaggagaccctggtcactttcaagaacccccacgctaaaaagcaggatgtggtcgtgctggggagccaggagggagccatgcacaccgcacttaccggggcaactgagatccagatgagctcggggaacctgctgtttacgggccacctcaaatgcagactgcggatggacaaactgcagcttaagggcatgagctactccatgtgcaccgggaagtttaaggtggtcaaggagatcgccgagacacagcacggcaccatagtgatacgcgtacaatacgaaggggatggcagcccctgtaagatccccttcgaaatcatggacctagaaaagcggcacgtgctgggccgcctcatcacggtgaacccgatcgtgacagaaaaggactccccggtaaacatcgaggccgagccgcccttcggagatagctacataatcattggcgtggagccggggcagctgaaactttcctggttcaagaagggcagctccatcggtcagatgttcgagacaaccatgcgcggcgccaagcgcatggctatcctcggtgatacggcctgggactttggctccctgggaggtgtcttcacctccataggcaaggccctgcaccaggtcttcggtgccatctacggcgccgcattctccggagtgtcctggaccatgaagatcctcattggggtagtcatcacctggatcggtatgaacagcaggtccaccagtctttccgtcagcctggtactggttggcatcgtcaccctctacctgggagtgatggtgcaagctgactccgggtgcgtggtgagttggaagaacaaggagctgaagtgcggttccggtatcttcatcaccgacaacgtccacacctggacggagcagtacaagttccagcccgaatcaccgagcaaactcgcgagtgccatccagaaggcccatgaggaggggatctgcggtatccggagcgtgacccgtcttgagaacctgatgtggaaacagatcacccccgaactcaatcacattctgtccgaaaacgaggtgaagctgacaattatgactggggacatcaagggcatcatgcaggcggggaagcggagcctgcggccgcagcccaccgaactgaagtactcctggaaagcctggggcaaggccaaaatgctgagcaccgagttacataaccataccttcctgattgacggaccagagacggccgagtgcccgaacaccaatcgggcttggaactccctggaggtcgaggactacgggttcggggtgttcaccaccaacatctggttaaagctgaaggagcgccaggacgtgttctgtgacagtaagctgatgtccgcggccatcaaggacaaccgggcggttcatgccgacatggggtactggattgagtctgcccttaacgacacgtggaagatagagaaagcgtccttcatcgaggtcaagtcgtgccactggccaaagagccacaccctgtggagtaatggcgtgctagagtccgagatgatcatccccaagaacttcgccggccctgtgagccaacacaactaccggccggggtaccacacgcaaacggccggcccctggcacctcgggcgactcgaaatggatttcgacttctgcgaaggcaccacggtggtggtcaccgaggactgcgggaaccggggaccctctcttagaacaaccacggcgtctggcaagctcatcaccgagtggtgctgtcgcagctgtaccttacccccgctgcggtacagaggggaggacggctgctggtacggaatggagatccgtcccctcaaggagaaggaggaaaacttggtgaactctctggtgaccgctggccacgggcagatcgacaacttcagcctcggagtgctgggcatggccttgtttctcgaagaaatgctgcgaactcgcgtgggcaccaagcacgccatcctgctggtggccgtctcattcgttaccctgattacgggcaacatgagcttcagagacttggggcgagtgatggtaatggtgggcgccaccatgactgacgatatcgggatgggcgtgacctacctcgcgttgctggccgccttcaaggttcgacccaccttcgccgccggcctcctgctgcgtaagctcacgtccaaggagctgatgatgaccaccatcgggatcgtgctgctcagccagtcgaccatcccagagacgatccttgagctgaccgacgcactcgccctcggcatgatggtgttgaagatcgtccggaacatggagaaatatcagctcgccgtgacgatcatggccatcctgtgcgtcccgaacgccgtgatcctgcagaacgcatggaaggtttcttgcactatacttgccgtcgtgtccgtgagcccgctgctgctcacatccagccagcagaaggccgactggatccccctggctctgaccatcaaaggtttgaaccccaccgcgattttcttgactacgctgtcaagaaccagtaagaagcggtcctggccgctcaacgaggccatcatggcagtcggcatggtaagcatcctggcatccagccttcttaaaaatgacattcctatgaccggccccctggtggctgggggcctgctcactgtttgttacgtgctgacggggagaagcgcggacctcgagctcgaacgggccgccgacgtacgctgggaggagcaggcagagatcagtgggagctcccccatcctgagcataaccatctccgaggacgggagcatgtccatcaagaacgaggaggaggaacaaacattgaccatcctcatccgaacgggcctgttagtcatttcgggcctcttcccagtttccatccccatcaccgccgctgcctggtacctgtgggaggtaaagaagcagcgcgccggcgtgctgtgggacgtcccctcaccgccgcccgtaggcaaagccgagctcgaggacggggcctaccggataaagcagaaagggatcctggggtacagtcagatcggcgcgggcgtgtataaggagggaacgttccacaccatgtggcacgtgactagaggcgcggtactgatgcataaggggaaacggatcgaacccagctgggctgacgtgaaaaaggacctaataagttacggaggaggctggaagctggagggtgagtggaaagagggggaagaggtccaagtgctggcgctcgaacccggtaagaaccccagagccgtccagacgaagcccgggctgttcaaaacgaatactggcactatcggtgcagtgagcctggatttctccccggggactagcggctcccctatcgtggataagaaaggtaaggtcgtggggctctacggcaacggcgtggtcacccggtccggtacatacgtttccgccatcgcccaaacggagaagtccattgaggacaatccagagatcgaagacgacatcttccgtaagaagagattgactataatggacctgcaccccggagccggtaagaccaagcgctacctgcccgcgatcgtgcgggaggctatcaagcggggtctccggaccctgatcctggcccccacccgcgtcgtggcggccgaaatggaagaggcgctccgaggcttaccaatccgataccagacgccggccatccgcgctgaacacaccgggcgggagatcgtggacctaatgtgccacgcgacattcacaatgcgcctcctgagcccaatacgggtcccaaactacaacctgatcatcatggacgaagcccacttcacggaccccgcgtccatcgcagcgcgcgggtacatttccacccgggtagagatgggcgaggcggctgggatcttcatgaccgcgacaccgcccggaagccgcgacccgttcccccaatcaaacgcccccatcatggacgaagagagagagattcccgaaagatcctggaacagcgggcacgagtgggtaaccgattttaagggaaagactgtatggttcgtgcccagcatcaaagctgggaacgacatcgccgcatgcctccggaaaaatggcaaaaaggtgatccaacttagcagaaagaccttcgacagcgaatacatcaaaaccaggaccaacgactgggatttcgtggtgaccactgacatcagcgagatgggcgccaactttaaggcggagcgcgtaatcgaccctcggagatgcatgaaacccgtaatcctgacagacggcgaagaacgcgtgatactagccggtcccatgccggtgactcactcatctgccgctcagcgtcgtggccgcgtcggccggaatccgaagaatgagaacgatcagtatatctacatgggggagcctctggagaacgacgaggattgcgcccattggaaggaagcaaagatgctgcttgataacatcaacacccctgagggcataataccatccatgttcgagccggaacgggagaaggtggacgcaatagacggcgagtaccgactacgcggcgaagccaggaagacattcgttgacttaatgcggcgcggcgacttaccagtctggctggcctaccgtgtggcagctgaggggatcaactacgccgaccgacggtggtgctttgacggggtcaagaacaaccaaatcctggaggagaacgtggaggtagaaatctggaccaaggaaggagaacggaagaaacttaagcctcgctggctggacgcccggatctattccgaccccctggcgctcaaggagttcaaggagttcgccgcagggcggaagtccctgacgctgaatctcatcaccgagatgggacgcctgcccactttcatgacccagaaagcacggaacgcgctggacaacttagccgtgctgcacacggccgaggccggagggcgagcctacaaccacgcgctgtcggaactccctgagaccctggagactttactcctgcttaccttactggcaactgtgacgggcggcatcttcctgttcctcatgtccggtaaggggatcggaaagatgactctggggatgtgctgcatcattaccgcctccatcctgctctggtacgcccagatccagccacactggattgcagcgtccatcatcctcgagttctttctgatcgtgctcctaatccctgagccagagaagcagcggacgccccaggacaaccagctcacgtacgtcgtgatcgccattctcactgtggtcgccgccaccatggccaacgagatgggcttcctggagaagaccaagaaggacttcgggctgggctccatcactacacagcagccggacagcaacatcctcgatatcgacttacggcctgcttccgcctggactctgtacgcggtggccaccacgttcatcacccccatgctccgacatagcatcgaaaactcgagcgtcaacgtttcgctaactgccatcgcgaaccaggcgaccgttctgatgggtctcggtaaaggttggcctctgagcaagatggacataggggtgccgctgctcgccattggctgctactcccaggtcaaccccatcacgttaaccgccgcgcttctcctgttagtggctcactacgcaataatcgggcccggcttgcaagccaaggctaccagggaggcgcagaagagggcagccgcaggcataatgaaaaaccccaccgtggacggcatgacagtaatcgacttagatccgatcccctacgaccccaagttcgagaagcagctcggccaggttatgcttctggtgctgtgtgtcacccaggtgctcatgatgcgaacaacatgggccctctgcgaggccctgacattagccacggggcccattagcaccctgtgggagggcaacccggggaggttctggaacaccacgatcgccgtgtccatggcaaacatattccggggcagctacctggccggcgcggggctcctgttctccatcatgaaaaataccgccaacacccgccggggcaccggtaacacgggcgagacccttggtgagaagtggaagaaccgactcaacgctttaggcaagtccgagttccagatctataaaaagtccggaatccaagaggtcgaccgaaccctggccaaggaggggatcaagcgcggcgagaccgaccaccacgcggtgtcacggggatcggccaaactgcgctggttcgtagagcggaacttggtcacgcccgagggcaaggtggtggacttaggctgcgggcggggtgggtggagctactattgtggcgggctaaagaatgtcaaggaggtgaagggcctgaccaaaggcggcccgggccacgaggagcccatcccgatgagtacgtacgggtggaacttagtaagactccaaagcggggtcgacgtcttcttcactccgcccgaaaagtgcgacacgttgctgtgcgacatcggggagtcctctcctaatccgaccgtggaggcagggagaacgctgcgggtcctgaacttggtggagaactggctcaataacaacactcaattctgcatcaaggtgctaaacccttacatgccatccgtcattgaaaagatggaagccttacagcgcaaatacggaggggctttagtgaggaacccgctttcccggaacagtacacacgagatgtactgggtttccaatgcctcgggcaacatagtctcctcagtgaacatgatttcccggatgctgatcaaccggttcacgatgaagcacaagaaagccacctacgagcccgatgtggacctggggagcggaacacggaatatcgggatcgagagtgagacccccaacctcgacattataggcaaaaggatcgagaagatcaaacaggagcacgagacaagttggcattacgaccaagaccacccctacaagacctgggcctatcacggctcctacgagaccaaacaaaccggtagtgcctcctctatggtcaacggtgtggtgcgccttctgacgaagccgtgggacgtcattcccatggtgacccagatggccatgacagacaccacaccgttcgggcagcagcgggtgttcaaggagaaggtcgacacccgcacccaggaaccaaaggaaggaaccaagaaattgatgaagatcacggcggaatggctatggaaagaactgggcaagaagaagaccccgcggatgtgcacccgcgaagagttcacgcggaaggtgcggtccaacgccgccttaggtgccatcttcacggatgagaacaaatggaagtctgcccgggaggcggtggaagactctggattttgggaactggtggacaaagagcgaaacctgcacctcgaaggaaagtgcgagacctgtgtgtataacatgatgggtaagcgggagaagaaactgggggagttcggcaaggccaagggcagccgcgcaatttggtatatgtggctgggagcacggtttctcgagttcgaggcgctgggcttccttaacgaggatcactggttctctagggagaacagcctcagcggtgtcgagggcgagggcttacacaagctgggctacattctccgggatgtctccaagaaagagggcggggcgatgtacgccgacgataccgccggttgggacactcgcatcactctggaggacctgaagaacgaggagatggtgaccaatcatatggagggagagcatcggaaacttgccgaggcgatttttcgcctcacataccagaacaaggtcgtgcgggtgcagcgtccgacgccccggggcacggtcatggacattattagcagacgtgaccagcgcggcagcggccaagtggtgacctacggcctgaacacctttaccaacatggaggcccagctcattcgacagatggagggagagggcgttttcaagagtatacagcacctgactgtaaccgaggaaatcgcggtcaagaactggctggaacgggtcgggcgcgaacggctctccaggatggccatcagcggcgacgactgcgtggtgaagccactggacgaccgttttgccagtgctctgaccgcgctcaatgatatgggcaaagtcagaaaggatatccagcagtgggagccaagccgggggtggaatgactggacccaagtgcccttttgctcacaccacttccacgagctcattatgaaggacggccgtgtcctcgtcgtaccctgccgtaaccaagacgagctcatcgggagggccagaattagccaaggcgccgggtggtccctacgcgagactgcgtgtctgggcaagagctacgcccagatgtggtccctcatgtacttccacagaagagacctgcggcttgccgccaatgcaatctgcagcgctgtgccatcccactgggtccctatctctcgtaccacctggtccatccacgcgacacatgagtggatgacaacggaggatatgctgactgtgtggaaccgggtgtggatccaggagaacccctggatggaggataagacaccggtcgagagctgggaagagataccatatctgggcaagagagaagatcagtggtgtggtagcctgatcggcctcacctcccgggccacgtgggccaagaacatccagaccgccatcaaccaagtgcgcagcttaatcggtaacgaggagtacaccgactacatgccgtccatgaagagattccggcgcgaggaggaggaggcgggcgtgttgtggtag

SEQ ID NO: 24868 - RNA, 9876 nt, synthetic construct
  misc_feature 1..9876: note = derived and/or modified CDS sequence (opt11) from DENV-2__KX380836__SS-prME
  source 1..9876: mol_type = other RNA
accgctgggatcatcataatgatgataccaaccgtgatggccttccacttgactactcgcaatggggaaccgcacatgattgtgagccggcaggagaagggcaaaagcctcctgttcaagaccgagaatggggtgaacatgtgcaccctgatggcgatggacctcggtgagctgtgcgaggacaccatcacctacaactgtcccttactaaggcagaacgagcccgaggacatcgactgctggtgcaatagcactagcacctgggtgacgtacggtacttgcaccgctacgggcgagcaccggcgcgagaagcggagcgtcgccctggtaccccacgtgggcatgggtttagagacccgaaccgagacctggatgtcatctgagggcgcctggaaacacgcgcaacggatagagacctgggtactccgtcaccccggtttcaccgtgatggcagccatcctggcctacaccatcgggaccacctactttcagcgggtgttgatcttcatcctcctgaccgccgtcgcgccttccatgaccatgcgctgcatcgggatctctaaccgggacttcgtggagggcgtctctggcgggagttgggtcgacattgtcctggagcacggctcctgcgtgaccactatggccaagaacaagcccacgctcgacttcgagctgatcaagaccgaggcgaagcacccagccaccctgaggaagtactgcatcgaggccaagctcaccaacacgactaccgctagccggtgcccgacacagggcgaaccctccctgaacgaggagcaagataagcgcttcgtctgcaaacatagcatggtggaccgaggctggggcaacgggtgcggcttgttcgggaaaggcgggatagtcacgtgtgccatgttcacatgcaagaagaacatggaggggaagatcgtccagccggaaaacctcgagtacacaatcgtgattacaccccactccggcgaggaaaatgccgtggggaacgacacgggcaagcacggtaaggagatcaaggtcaccccgcagagcagcatcaccgaggccgagctgaccggatacgggaccgctacgatggagtgcagcccaagaacaggcttagacttcaacgagatggtgctcctgcagatggagaacaaagcgtggctggtgcacagacagtggttcctcgacctgccactgccctggctccctggcgccgacacgcaggggtccaactggatccaaaaggagaccctggtaacattcaagaacccccacgccaagaagcaggacgtggtcgtgctgggcagccaggagggggccatgcacaccgccctcaccggcgcgaccgagatacagatgtcgagtgggaacctgctgttcacgggccacctcaagtgccgcctgcggatggataagctgcagctcaaaggcatgagctactccatgtgcaccggtaagtttaaggtggtcaaagagatcgccgaaacccagcacggcaccatcgtgattcgcgtgcagtacgagggggacggatcaccctgcaagatccccttcgagatcatggacctggagaagagacacgtcctgggccgcctaattacggtgaacccgatcgtgactgagaaggactcccccgtcaacatcgaggcggaaccgcccttcggggacagctacatcatcatcggcgtggagccggggcagctgaagctgtcctggttcaaaaaggggagctccatcgggcagatgtttgaaaccaccatgcgcggcgcgaagcggatggccatcctcggcgacaccgcgtgggacttcgggagcctgggaggggtgtttacctcaatcggcaaggccctgcaccaagtcttcggggcaatctacggcgccgcgttcagcggggtttcctggaccatgaagatcctcataggggtggtcataacatggattggcatgaacagccgatcgacgagcctgtccgtgagtctggtgctggtcgggatcgtgaccctctacctgggcgtgatggtccaggctgactccgggtgcgtggtgtcttggaagaacaaggagctaaagtgcgggagcggcatcttcataaccgacaacgtccacacctggacggaacaatataagtttcagcccgagtcccccagtaagctcgcctccgccatccagaaggcacacgaggaggggatctgcggcatacgtagcgtgacccgcctagagaacctgatgtggaaacagatcacccctgagctcaaccacatcctgtccgagaatgaggtgaagctcacgatcatgacgggggacatcaagggcatcatgcaggcggggaagcggagcctccgcccgcagcccaccgagcttaagtactcctggaaggcctggggcaaggccaagatgctgagcaccgagctccacaaccataccttcctgatcgacggccccgagaccgccgaatgtccgaacacaaatcgggcctggaactccctggaggtagaggactacggattcggcgtattcaccaccaacatatggctcaaacttaaggagcgccaggacgtgttctgcgacagcaagctgatgtccgcggcaattaaggacaacagagcagtacacgccgacatggggtactggatagagagcgctcttaacgacacatggaagatcgaaaaggcgtcattcatagaggtaaagtcgtgccactggcccaagagccacaccctttggagcaatggagtcctggagtccgagatgattatccccaaaaatttcgccggccccgtgagccagcacaactaccgcccggggtaccacacacaaaccgccggcccatggcacctcgggcggctggagatggactttgacttctgtgaaggcaccactgtggtggttaccgaggactgcgggaaccgcggccctagcctgcggaccaccacggcgtccggtaagctcatcaccgaatggtgctgccgcagctgcaccctgccgccgctccggtaccgcggggaggacggttgctggtacgggatggagatcagacccctcaaggagaaggaggagaacctggtaaactcactggtgaccgcggggcacgggcagatcgacaacttcagcctaggagtcctgggcatggcactgttcctggaggaaatgctgagaactcgggtcgggaccaagcatgccatactgctcgtggccgtcagcttcgtcaccctgatcaccggcaacatgtcgttccgcgacctgggcagggtgatggttatggtgggcgccacgatgaccgacgacattgggatgggcgtgacttacctcgcgctgttggccgcattcaaggtccggcccacttttgccgctggcctcctgctgcgcaagctcacgtccaaggagctgatgatgaccaccatcgggatagtgctgttgtcacaatccactatccccgagacgatcctagaactgaccgacgcactcgccctgggtatgatggtgcttaagatcgtccggaacatggagaagtaccagctggctgtgaccatcatggccatcctgtgcgtcccgaacgccgtgatcctgcagaacgcgtggaaggtgagctgcacgatcctcgccgtcgtctccgtgagccccctgctgctcacaagttctcagcaaaaggccgattggatccccttagccctcaccatcaaggggctcaacccgaccgcgatcttcctaactactttatcccgcaccagcaagaagcgatcctggccgctcaacgaggccatcatggccgtcgggatggttagcatactggcatccagcctgcttaagaacgacatccccatgactggccccctggtggccgggggcctgctgacagtctgctacgtgctgacggggcgcagcgcggaccttgagctcgagcgggccgctgacgtgcgctgggaggagcaagccgagatctccggcagctccccgatcctgagcatcaccatctccgaggacgggagcatgtccattaagaacgaggaggaggagcaaacactgaccatcctgatccggacgggcctgttggtcatcagcggactcttcccggtaagcatccccattaccgccgccgcctggtacctctgggaagtgaagaagcagcgcgcaggggtactgtgggacgtgcctagcccgccgcccgtcggcaaggccgagctcgaggacggtgcctatcggatcaagcagaagggcatcctgggatattcccaaatcggcgcgggcgtctataaggaggggaccttccacaccatgtggcacgtgactcgcggcgctgtgctgatgcacaaggggaagcggatcgaaccaagctgggccgatgtcaagaaagacctcatctcatacggcggaggctggaagctggagggcgaatggaaggagggagaggaggtacaggtcctggccctcgagcccggcaagaacccccgcgcggtccagacgaagcccgggctgttcaagaccaacaccggtaccattggggcggtgtctctggacttctcccccgggacgagcggctcccccatcgtggacaaaaaggggaaagtcgtaggcctctatgggaatggcgtggtcacccgaagcggcacctatgtgtccgcgatcgcccagactgagaagtccatcgaggataaccccgagatcgaggacgacattttccgcaagaagcgactgacgatcatggacctgcaccccggggccggaaagaccaagcgctacctacccgcgatcgtgcgggaagcgataaagaggggactcagaaccctgatcctggccccgacccgcgtcgtggcagccgaaatggaagaggcgctccgtggcctacccatacgttaccagacgcccgccatccgcgccgagcacactgggcgagaaatcgtggacctcatgtgccacgccaccttcaccatgcgcctcctgagtccgatccgggtaccgaactacaacctgattatcatggacgaggcccacttcacggaccccgcgtccattgccgcgcgcggctacatcagcacccgggtggaaatgggtgaggccgccggtatattcatgacagcgacaccgcccggctcccgcgacccgttcccccagagcaacgcccccatcatggacgaggagagagaaatccccgagcgctcctggaatagcgggcacgagtgggtcaccgacttcaaaggcaagaccgtctggttcgtgccgtccatcaaagcaggtaacgacatcgccgcgtgcctccggaagaacggcaagaaggtgatccagctgagccgcaagaccttcgactccgagtacatcaaaacccgtacgaatgactgggacttcgtcgtgaccaccgacatcagcgagatgggcgccaacttcaaagccgaaagagtgatcgaccccaggcgctgcatgaagcccgttatcttaacagacggggaggagcgggtgatccttgccggaccgatgcccgtgacacactcctctgccgcgcagcgccgggggcgtgtcggccgcaatccgaagaacgagaacgaccagtacatctacatgggggagcccctggagaacgacgaggactgcgcccattggaaggaggccaagatgctgctcgataacatcaacacccccgaaggcatcatcccgtccatgttcgagccagagcgggagaaggtagatgcaatcgatggcgagtaccgcctgcggggcgaggcccgcaagaccttcgtggacctgatgcgccggggcgacctccccgtctggctggcgtatcgggtcgccgccgaagggatcaactacgccgaccgccggtggtgcttcgacggcgtcaagaacaaccagatcctggaggagaatgtggaggtggagatctggaccaaggagggggagcggaagaagctcaagccgcggtggctggacgcgcggatatacagcgaccccctggcactcaaggagttcaaggagttcgccgccggacggaaatccctgacgctgaacctgatcaccgagatgggtcgcctccccaccttcatgacccaaaaggccaagaacgcgctggataacctcgccgtcctgcacacggccgaggccggagggcgggcttacaaccatgcgctgagcgagctccccgagaccctggagaccctgctcctgctgaccctcctggccactgtgaccgggggaatcttcctgttcctcatgtccggcaaagggattggcaagatgaccctggggatgtgttgcataatcaccgctagcatcctcctctggtacgcccagatccaaccgcactggatcgccgcgagtatcatcctcgagttcttcctgatcgtcctcctaatacccgagccggagaaacagcgcactccccaggacaaccagctgacgtacgttgtgatcgcaatcctcaccgtggtcgccgccacaatggccaacgagatggggttcctggagaagacgaagaaggacttcgggctgggctccatcacgacccagcagcctgagtcaaacatcctcgatatcgacctacgccccgcgtccgcttggaccctgtatgcagtggccaccacgttcatcacccccatgcttagacacagcatcgagaactccagcgtgaacgtttccctgaccgctatagcgaatcaagccaccgtgcttatgggcctcgggaagggctggcccctgagcaagatggacatcggggtgccgctgctcgccatcggctgctactcccaggtgaacccgatcacgctgaccgcggcgctactcctgctggtggcccactacgccatcatcggacccggcctccaggccaaggccacccgggaggcgcagaagcgcgccgccgccggcatcatgaagaatcccaccgtcgacgggatgacggtcatcgatctggacccgatcccatacgaccccaagttcgagaagcagttaggccaggtgatgcttctggtcctttgcgtcacccaagtcctcatgatgcggaccacctgggcactgtgcgaggcgctgacactcgccaccgggcccatcagtaccctttgggagggcaacccggggcgcttctggaacaccactatcgccgtgagcatggccaacatcttccgcggcagctacctggcaggggctgggctactgttcagtatcatgaagaacaccgccaacacccggcgcggcaccgggaacacgggtgagacactgggcgaaaagtggaagaatcggctcaacgccctgggcaaaagcgagttccagatctacaagaagtccggcatacaggaggtcgaccgtaccctggctaaggaagggatcaaacggggcgagaccgaccaccacgcggtgagccgcgggtccgctaagctcaggtggttcgtggagcgcaacctcgtaacgcccgaaggcaaggtggtggacctcggctgcgggcggggcgggtggagctactattgcggcgggctcaaaaacgtcaaggaggtgaagggcctgaccaagggagggccaggccacgaggagcctatcccgatgtccacctacgggtggaacctggtgcgcttgcaatcaggcgtcgacgtgttcttcacgccgcccgagaagtgcgacacgcttctgtgcgacatcggggagagcagccccaacccgaccgtagaagcaggccgtaccctccgcgtccttaaccttgtggagaactggctcaataacaacacccaattctgcatcaaggtgctgaatccttacatgcccagcgtcatagaaaagatggaggcgctacagcggaagtacggcggggccctggtgcgcaatccgctgtcccggaacagcacccacgaaatgtactgggtgtccaacgcgagcgggaacatcgtctctagcgtgaacatgatttcccgcatgctgatcaaccggttcacgatgaaacacaagaaggccacctacgagccagacgtagacctggggtcaggcacacgcaacatcggtatcgaatcagagacccccaacttggacatcattggcaagcggatcgagaaaatcaaacaggagcacgagacgagctggcactacgaccaggaccacccctacaagacctgggcctaccacgggtcctatgaaaccaagcagaccgggtctgcctccagtatggtgaatggcgtggtgcgcctgctgacgaagccgtgggacgttatccccatggtaacgcagatggcgatgaccgacaccacacccttcggccagcagcgcgtgttcaaggagaaggtcgacacccggacccaggaacccaaggagggcaccaagaagctgatgaagatcacggcggagtggctgtggaaggagctgggcaagaagaagaccccgcgcatgtgcacccgggaggagttcacccgcaaggtgcggtccaacgcagcactcggggctatcttcacagacgagaacaagtggaagagtgcccgcgaggcggtcgaagactccggattctgggagctggttgacaaggagaggaacctgcacttagagggcaagtgcgagacctgtgtgtacaacatgatggggaagcgcgagaaaaagctgggggagttcggcaaggccaaaggctctcgggccatctggtacatgtggttgggggcacgctttctcgagttcgaggcgctgggattcctgaatgaggaccactggttcagtcgggagaactcattgagcggggtcgagggcgaggggctgcataagctgggatacatcctccgcgatgtgtccaagaaggagggtggggccatgtacgcggacgatacagcgggctgggataccaggataacgctggaggacctgaagaacgaggagatggttaccaaccatatggagggggagcaccgcaaactcgccgaagcgatatttcggctgacctaccaaaataaggtcgtgcgggtgcagcgaccgacgccccgagggacggtcatggacataatctcgcggcgcgaccagcgggggtccggccaggtggtgacctacgggctgaacaccttcacaaacatggaggcccaattaatccgccaaatggagggggagggcgtcttcaagagcatccagcacctgacggtgaccgaggagatcgcagtcaaaaactggctggaaagagtcgggcgggagcgcttgtcccggatggccatctccggcgacgactgcgtggtgaagcccctggacgaccgattcgcctccgcgctgaccgccctgaacgatatgggcaaggtccggaaggacatccagcagtgggagccgtcgcgcggatggaacgactggacccaagtgcccttttgttcccaccacttccacgagttgatcatgaaggacggtcgagtgctggtcgtgccgtgccgcaaccaggacgaacttatcgggcgggcccgcatcagtcagggcgccgggtggtccctgcgggagacggcctgccttggcaaatcttacgcccagatgtggtccctcatgtacttccaccgccgtgacctgcgcctggccgccaacgccatttgcagcgctgtgccctcccactgggtcccgatcagccggaccacttggtcaatccacgcgacccacgaatggatgaccacggaggacatgctgaccgtgtggaatcgcgtatggatccaggaaaacccctggatggaggacaaaacccccgtcgagagctgggaggaaatcccgtacctcggtaagcgggaggaccagtggtgcgggagcctgatcgggctaacctcccgagccacgtgggccaaaaacatccagaccgccatcaaccaggtgcggtcactaatagggaacgaggagtacaccgactacatgccgtccatgaagaggttccgccgggaggaggaggaggcgggcgttctttggtga

SEQ ID NO: 24869 - RNA, 9876 nt, synthetic construct
  misc_feature 1..9876: note = derived and/or modified CDS sequence (opt11) from DENV-2__KX380838__SS-prME
  source 1..9876: mol_type = other RNA
accgctgggatcataatcatgatgattccgaccgtgatggcattccaccttaccacacggaacggggaaccgcacatgatcgtgagccggcaggaaaagggcaaatctctcctgttcaagacagagaatggggtgaacatgtgcaccctcatggccatggacctgggcgagctgtgcgaagatactattacctacaattgcccactgctacgccaaaacgagcccgaggacatcgactgttggtgtaatagcaccagcacctgggtcacctatgggacctgcaccgctacgggcgagcacaggcgagagaagagaagcgtcgcacttgtaccccacgtggggatgggcctggagacgcgaacggagacctggatgtctagcgagggggcctggaagcacgcccagcggatcgagacatgggtcctccgccaccccggcttcacggtgatggctgcgatcctagcatacaccatcggcaccacatactttcagcgggtgctgatctttatcctactgacggccgtggcgccctcgatgacgatgagatgtatcgggatcagcaaccgggattttgtggagggcgtgagcggcgggtcctgggtagacatcgtcttagaacacgggtcctgcgtgacaaccatggccaagaacaagccgacgctggacttcgaattaattaagacggaagcaaagcatccggccaccctgcgcaagtactgcatagaggccaaactcaccaatactaccaccgcgagccgatgcccgacgcaaggggagccgtccctgaatgaagaacaggataagcgcttcgtctgcaagcactcaatggtggaccgaggctgggggaatgggtgcggcctgttcgggaagggtgggatcgttacgtgcgccatgttcacgtgcaagaaaaacatggagggtaagatcgtccagcccgagaatctcgagtataccatcgtgatcacaccccattccggagaagaaaacgcggtggggaacgacacaggcaaacacggaaaggagatcaaggtcaccccacagtcaagtattaccgaggccgagctcacgggttacgggaccgctaccatggagtgtagcccccgtaccggcctggatttcaatgagatggtcctcctacagatggagaacaaggcatggctggtgcaccggcagtggttcctcgatctccccttgccctggctcccgggtgctgatacacagggttccaactggatccaaaaggagaccctggtcacctttaagaacccgcacgccaagaaacaggacgtagtcgttctgggcagccaggagggggccatgcacaccgcattgaccggcgcgacggagatacagatgagttccgggaacctcctgtttacaggacacctcaagtgtaggcttcggatggacaagctgcagctcaagggaatgagctatagcatgtgcaccgggaagttcaaggtagtgaaggagatcgccgagacgcaacacggcaccatcgttatacgcgtgcagtacgaaggggatggaagcccatgcaagatccccttcgagatcatggacctcgagaaacggcacgtccttggacgcttgatcacggtgaacccaattgtgactgagaaggattcccccgtcaacatcgaagccgagccgccctttggggactcatacatcatcataggcgtggagccgggccagctgaagctgtcctggttcaaaaagggtagttccattgggcagatgttcgagactaccatgcgcggcgctaagagaatggcaattctcggagacactgcctgggatttcggaagcctaggcggggtgtttacgtccatcggaaaggcgctgcaccaagtcttcggcgccatttacggtgccgctttcagcggcgtgtcttggaccatgaagatcctcataggggtcgtcatcacctggattggaatgaacagccgaagtacgtcactgtccgtgagcctggtactggtcggtatcgtgaccctgtacctaggtgtgatggtccaagccgactccgggtgcgtggtgagctggaagaacaaagagctgaaatgcgggagtggcatcttcatcacagacaacgttcacacttggacggagcagtataagtttcagcccgagtccccctcgaagctcgcctccgcgattcagaaggcccacgaggaggggatatgcggcatccgaagcgtgaccagactggaaaatctaatgtggaagcagataacccctgagctcaaccacatcctgtcagagaacgaggtgaaacttaccatcatgacgggcgatatcaaaggtattatgcaggcgggaaagcggagcctccgcccgcaacccaccgaactgaagtattcctggaaggcatggggcaaggctaagatgttaagtaccgagctccacaaccacacatttctaattgacggccctgagacggcagagtgccccaacactaaccgggcctggaacagtctagaggttgaggactacggatttggggtcttcacgaccaacatctggcttaagctgaaggagcgccaggacgtgttttgcgacagcaaacttatgtccgcggcgatcaaggacaaccgcgccgttcacgccgacatggggtactggatcgagtcagccctcaacgacacgtggaaaatagagaaggcatccttcattgaggtaaagagctgccactggcccaagtcccacaccctgtggtcgaacggcgtgctggagtccgaaatgattatacccaaaaactttgccggcccggtaagccagcacaactaccgcccgggataccacactcagaccgccggcccctggcacctcgggcggctggagatggacttcgacttctgcgagggtaccactgtggtagttactgaggattgcgggaaccgcggcccgtcgctgcggacaacaactgcctccggcaagctaattaccgagtggtgctgtcgcagctgtaccctgcccccactgaggtaccgaggcgaggatggctgctggtacgggatggagattcggcccctgaaagagaaggaggaaaacctggtcaattccctggtcacagcgggccatgggcagatagataacttctctttgggcgtgctgggcatggcgctattcctcgaggaaatgctcaggacacgcgtggggacaaagcacgccatcctactcgtggcggtctcctttgtgaccctgatcaccggtaatatgagcttcagagacctggggagggtaatggtcatggtgggcgcaaccatgaccgacgacatcgggatgggcgtgacctacctcgccttactggcagcgttcaaagtccggcctacattcgctgccggccttttgctgcgtaagctcacgtccaaggagctcatgatgaccaccattgggatcgtgttactctcccagtcaaccatcccggaaaccatcttagagcttaccgacgctctcgccttgggcatgatggtgctgaagatcgttcggaacatggaaaagtaccagctcgccgtgactataatggccacgctgtgcgtccccaacgccgtgatcctgcaaaacgcgtggaaggtaagctgcacgatcctcgccgtcgtctccgtgtctcccctcttactaaccagcagccagcagaaggcggattggatacccttagcgctgaccataaagggactcaacccaaccgcgattttcctcacgaccttaagtcggacctcaaagaagcgatcttggcccctcaacgaggcaataatggctgtcggaatggtatctatcctggcctcctcgctattgaagaacgacatccctatgaccggaccacttgtagcgggtggactgttaaccgtctgttacgtgttgaccgggcgctcggcagacctggaattagaaagagccgctgacgtgcggtgggaggagcaggcagagatctccgggagctcgcccatcctttcaattacaatatccgaggacggcagcatgtccattaaaaacgaagaagaggagcaaaccctgacgatcttgattcggactggattgctagtgatctcaggactcttccctgtgtccatccccattactgccgcagcctggtacctgtgggaggttaagaagcagcgcgccggggtgctatgggacgtgccctcgccaccgccagtaggaaaggccgagcttgaggacggggcctaccgaatcaagcagaagggcatactggggtactcccagatcggcgcgggcgtctacaaggagggcacgttccacacaatgtggcatgtgacccgcggtgccgtcctgatgcataaggggaagagaatcgagccctcatgggccgacgtgaagaaggacctaatctcctacggcggagggtggaagttagagggcgaatggaaagagggagaggaggtccaggttcttgctctggaacccggcaagaacccccgcgccgtgcaaaccaagcccggtctgttcaagaccaacaccgggacgatcggagcggtgtcactagacttttcgcccggcacgagcggctccccaatcgtcgacaagaaggggaaggtcgtaggcctatatgggaacggcgtggtcaccaggagcggcacgtacgtgtcggccatcgcccagacggagaagtcgatcgaagacaaccccgagatcgaggatgacatctttcgcaaaaagaggctgaccattatggacctgcaccctggggccggcaaaaccaaaagatatttgcctgcgattgtgcgggaggctatcaaacgcgggctccggacccttatactggcgccgacacgcgtcgtggcggccgagatggaagaggccctccgcggcctgcccatcagataccagacccccgccatccgcgctgagcacactgggcgtgaaatagttgatcttatgtgccacgcgacgtttacaatgcgcctacttagccccatacgcgtgcctaactacaacctgatcatcatggatgaggcacattttaccgaccccgcgtcgatcgccgcgagagggtacatcagcaccagagtggaaatgggtgaagccgccggcatcttcatgacggcgactccgcccggctcgcgcgacccgttcccacaaagcaatgcacccattatggacgaggaacgagaaattcccgagcgctcctggaacagcggccacgaatgggtgaccgacttcaaaggcaaaacggtatggttcgttccgtccattaaagccgggaatgacatcgcagcctgcttacggaaaaacggcaagaaagtgattcagttatcacgcaagactttcgactccgagtacatcaaaacacggaccaacgattgggactttgtggtgactaccgacatttcagagatgggcgccaactttaaggcggagcgcgtgatcgaccccaggcgctgcatgaagcccgtgatcctgacggacggggaggagcgagtgatcctcgccggccccatgccggtgacgcattcctccgcagcgcagagacgtgggcgggtcggccggaaccctaagaatgaaaacgaccaatacatctacatgggggagcccctggaaaatgatgaggattgcgcccactggaaggaagccaagatgctgctcgacaacatcaatacgcccgaaggtataatcccgtccatgtttgagccagagcgggagaaggtagacgcaatcgatggtgagtaccgcctccggggtgaggcccgcaaaacctttgtggacctgatgagacgcggcgatctccccgtctggctggcatacagggtggccgcggaaggtatcaactacgctgacagacggtggtgtttcgacggcgtcaaaaacaaccaaatcctggaagagaatgtggaggtcgagatttggacgaaggagggggaaaggaagaagctcaagcctcgatggctggatgcccgcatatacagcgatcccttagccctcaaggagtttaaggagttcgctgctggccggaagtctctgaccctgaaccttatcaccgagatgggacgtctgcccacgttcatgactcagaaggcccggaacgcgctcgacaatctcgccgtcttacacactgcagaggccgggggccgcgcttataaccatgcactaagcgagctgcccgagaccctagagaccctgctcctgctgacgctcctggccaccgtgacagggggtatcttcctgtttctcatgtctggtaagggcatcggcaagatgaccctgggcatgtgctgcattataacggccagcatcctcctatggtacgcacaaatccagccacactggatcgctgcctccatcatattggagttctttctgatagtgctattgatcccggaacctgagaagcagcgcacacctcaggacaaccagcttacctacgtcgtgatcgccatactgaccgtcgtcgctgccaccatggccaacgaaatgggtttcctggagaaaacgaagaaggacttcgggctgggcagtattaccacccaacaacctgactcgaacatcttagacatcgacctgcgcccagcgtccgcctggactctttacgcggtggcaacgacattcatcaccccaatgctccggcattcaatcgagaacagttccgtgaacgttagtcttactgctattgcgaaccaggcgacggtgctgatgggcttggggaaggggtggcccttgtcgaagatggacatcggggtaccgctgctcgccatcggctgttactcccaggtcaacccgatcaccctaacagccgcgctgttgttgctggtggcccattacgcgatcatcgggccaggcctccaagccaaggccacccgcgaggcgcagaagcgggccgctgctggcataatgaagatccccgccgcggacggtatcaccgtgatcgacctggacccgattccctacgaccccaaattcgaaaagcagctgggacaggtgatgttgctggtgttatgtgtgacgcaggtactcatgatgaggaccacctgggccctgtgcgaagctctgacgcttgccaccgggcccatcagcaccctttgggaaggaaacccggggcgcttttggaacacaacaatcgccgtaagcatggcgaacatcttccggggcagctacctggccggcgctgggttattattcagtatcatgaagaacaccgccaatacaagacggggcaccggcaacacgggcgaaacactgggcgaaaagtggaagaaccgactcaacgctcttggcaagagcgagttccaaatttacaagaagagtggtatacaggaggtggaccggacgctggccaaagagggcatcaaacgcggcgaaaccgaccaccacgcagtctcgcggggatcagccaagctccgctggttcgtggagcggaacctggtcacacccgagggcaaggtcgtcgatctgggctgcgggcggggcgggtggagttactactgcggcggtctcaagaacgtgaaagaagtcaagggcttgaccaagggcggtcccggccacgaggaacctataccgatgtccacatacgggtggaacctcgttcggcttcagtcgggcgtcgacgtcttctttacgccgcccgaaaaatgcgacactctgctctgcgacattggggagagcagccccaaccccaccgtggaggccggccgtaccctgcgagtgctgaacttagtcgaaaactggctaaacaacaacacccaattctgcatcaaggtgctgaacccatacatgcccagtgtgatagaaaagatggaagccctgcagcgcaagtatggaggggcactggtgcggaaccccctgagccggaacagcacacacgaaatgtactgggtgtccaacgcaagcggcaacatcgtgtccagcgtcaatatgatctcccgaatgctgattaaccgcttcacgatgaagcataagaaggcgacatatgagcccgacgtggatctggggagcggtacacggaacatcgggatcgaatcagaaacccccaacctggacatcatcggcaagcggatcgagaagatcaagcaggagcacgagacgtcatggcattacgatcaagaccatccctataagacctgggcctatcacggctcctacgagactaagcagactgggtcagcttcgagcatggtgaatggcgtcgtgcgcttgttgactaagccgtgggatgtcatacccatggtcacccagatggccatgacggacaccacgccattcgggcagcagagagtgtttaaagaaaaagtggatacgcgcacccaggagccgaaagagggaactaaaaagttaatgaagatcacggcggaatggctctggaaggaactgggcaagaaaaagacaccgagaatgtgcacccgcgaggagttcacccggaaagtccgctccaacgccgcccttggggcgatctttacagacgagaacaaatggaagtccgcccgcgaggctgtggaagactccggcttctgggaactcgtcgacaaggagcgcaatctgcatctcgagggaaagtgcgagacctgtgtgtacaatatgatgggcaagcgggagaaaaagctgggcgagttcggcaaggcgaaggggagccgcgcgatatggtacatgtggctgggggcccggttcctcgagttcgaggcgctgggctttctaaatgaggaccactggttctcgagggagaacagcttgtctggcgttgaaggcgaaggattacacaagctgggttacatcttacgggacgtctccaaaaaggaaggcggggccatgtacgccgacgataccgctggatgggacaccaggatcacgctggaggacctgaagaacgaggagatggtgaccaaccatatggagggggagcatcggaagttagccgaggccatcttccgccttacctatcagaacaaggtggttcgggtgcaacgccccactcccagaggcacggtgatggatataatctctcgccgcgaccagcgaggatccggacaggtcgtgacttacggcctaaacactttcaccaatatggaggcccagctcatacggcagatggaaggggaaggcgtattcaaatcaatccagcaccttacagtcaccgaggaaatcgcggtgaagaactggctggagagagtggggcgcgagcggctctccaggatggcaatcagcggcgacgactgcgtcgtgaagcccctggatgaccggtttgccagtgccttaaccgccctcaacgacatggggaaggtgcgcaaggacattcagcagtgggagcctagtcggggctggaacgactggacgcaggtccctttctgctcccaccacttccacgagttgataatgaaggacggtcgcgtcctggtggtcccctgccgtaaccaggacgagttgataggacgcgcccggatcagccaaggtgcggggtggagcctacgcgagaccgcctgcctgggcaagtcctacgcccaaatgtggtccctcatgtacttccaccggcgcgacctgaggcttgcggccaacgcgatctgcagcgccgtgccctcccattgggttcctatctcccggaccacctggtccatccacgccacccacgagtggatgaccacggaggacatgctcactgtttggaaccgagtgtggatccaggagaacccctggatggaggacaagactccagttgagagctgggaggagataccatacctaggtaagagagaggaccagtggtgtggcagcctgatcggccttacatctcgggccacgtgggccaaaaatatccagactgctattaaccaggtccgcagcctgatagggaatgaggagtacaccgactacatgccgtccatgaaacgattccgccgcgaggaggaagaggccggtgtgttgtggtga

SEQ ID NO: 24870 - RNA, 9876 nt, synthetic construct
  misc_feature 1..9876: note = derived and/or modified CDS sequence (opt11) from DENV-2__KM279515__SS-prME
  source 1..9876: mol_type = other RNA
accgcgggcattataataatgatgatcccaactgtgatggcattccacttgacaacgagaaacggggagccccacatgatcgtcagccgtcaagaaaagggcaagtcccttcttttcaagaccgaaaacggggttaacatgtgcaccttgatggccatggacttaggggagctatgtgaggacaccatcacttacaactgccccctgctcaggcagaacgagcccgaggacatagactgctggtgcaacagtaccagcacctgggtgacctacgggacgtgtaccgccaccggcgagcatcggagggagaagcgtagcgtcgccctggtcccgcatgtggggatggggcttgagacccgcacggagacctggatgtctagtgagggagcctggaagcacgcgcagcggattgagacttggatcctacgacaccccgggttcaccatcatggccgctatcctggcctacaccatcgggaccacctactttcagcgggtcctaatatttatcctgcttaccgccgtgaccccatccatggcaatgcgctgcataggtatcagcaatagagacttcgtagaaggggtgagcggagggagctgggtggacatcgtgctagagcacggctcttgcgtcaccaccatggccaagaataagccaacgctggacttcgagctgatcaagaccgaggcgaagcacctggcaaccctccgcaagtactgcgtagaggccaaacttacgaacaccaccacggcgtcccgctgtcccacccagggggagccgtccttgaacgaggagcaggacaagcgctttgtgtgtaagcacagcatggtcgacagaggttgggggaatggatgcggcctcttcgggaagggtgggatcgtgacgtgcgccatgttcacgtgcaagaagaacatggaagggaaggtagtgcaacccgagaatctggagtacaccatcgtcataacgcctcactccggcgaggagaacgcagtgggaaacgatacggggaagcacgggaaagaaatcaaagtcactccacagagcagtataaccgaggcggagctgaccggctatggaaccgtcaccatggaatgtagtccgcgcaccggactcgacttcaatgagatggtgctgctgcaaatggagaacaaggcctggctcgtccacaggcagtggttcctggatctgcccctgccatggctgccgggcgcggacacccaagggtccaattggattcagaaagaaacactggtgaccttcaaaaacccgcatgccaagaagcaggacgtagtggtgctcggcagccaggaaggggcaatgcacaccgccctcactggcgctaccgaaatccaaatgtcgagcgggaatttactcttcaccggccacctgaagtgccgtttgcgtatggataagctccagttaaagggtatgtcttactccatgtgcacggggaagttcaaggtagtgaaagagatagcggagactcagcatggtaccattgtaatccgcgtgcaatacgagggagatggcagcccctgtaagatccccttcgagatcatggacttggaaaagagacacgcactcgggcgtttgatcacggtgaaccccattgtgacggagaaggattccccggtcaacatcgaggccgagccgccttttggggactcatacatcatcatcggcgtcgaacccggacaactcaagctctcctggttcaagaagggcagctcgatcggtcagatgttcgagaccaccatgcgcggcgccaaaagaatggcaatcctaggcgataccgcgtgggactttggttcgcttggcggggtgtttacctccatcggcaaagccctccaccaggtctttggggccatctatggagccgcgttttcaggggtatcctggaccatgaagatcctgatcggcgtagtcatcacctggatcgggatgaacagccgctcaacgagcctgtcagtaagcctggttctcgtaggggtggtaacgctgtatctaggcgtcatggtgcaggcagattccgggtgcgtagtcagctggaagaataaggagctaaaatgcggcagcggcatcttcatcaccgataacgttcatacttggacggagcaatacaagttccagccggagtccccgagcaagctggcgtccgcaatccaaaaggcccatgaggaagggatctgcggcattcggagcgtaacccgcctggaaaacctcatgtggaagcagatcacgccggagctcaaccatatccttacggaaaatgaggtcaagctcacgatcatgacgggggatatcaaggggatcatgcaagcaggaaaacggtcattacgcccacaaccgaccgagctgaagtattcgtggaaggcctggggtaaggccaaaatgctctccaccgagctgcacaatcatacgttccttatcgacggccccgaaaccgccgagtgcccgaacactaacagggcgtggaacagcctcgaggtggaggactacgggttcggcgtcttcaccacgaatatctggctgaagctgaaggagcgccaagacgtcttctgtgactcaaaattgatgagcgcggccattaaagacaaccgtgcggttcacgccgacatggggtactggatagagtccgccctgaacgacacctggaagatcgagaaggcgagcttcattgaggtcaaatcctgccactggcctaagagccataccttatggagtaatggcgtgctggagtcggaaatgatcatcccaaagaacttcgccgggcccgtgtcccagcacaactaccgccccggttaccacacgcaaaccgccggcccgtggcacctggggcggctggagatggacttcgacttctgcgagggaactaccgtggtcgtgacagaagactgtgggaacaggggacctagcctacggaccacgaccgcctccggtaagctgatcaccgagtggtgctgccgcagttgtaccctgcccccgctccgctaccgcggtgaagacggatgctggtacgggatggagatccggccgctaaaggaaaaagaggagaacttggtgaacagcctggtcacggcgggacacgggcagatcgataactttagcctgggcgtgctgggaatggctctgttcctggaggagatgctgcgcacccgggtggggaccaagcacgcgatcctcctggtggcagtgagtttcgtaactctgattacggggaacatgtcctttcgcgacctcgggcgcgtcatggtgatggtgggtgctaccatgactgatgacatcggcatgggcgtcacatatctggcgctccttgccgccttcaaggtacggcccacgtttgccgcggggctcctgttacggaaactgacgagcaaggagctgatgatgaccactatcgggatcgtgctactgtcacaaagcacgatcccggaaagcatattggagctcaccgatgctctggccctgggcatgatggtcctcaagatagtacggaacatggagaagtaccagttagccgttacaattatggccatactgtgcgtgccgaacgccgtgatccttcagaacgcgtggaaggtaagctgtaccacgctagccgtggtttcagtctcgcccctgcttctgacttccagccagcaaaaggcggactggatccccctggccctgacaatcaaggggctgaacccgaccgcaatcttcctgacgaccttgtcccgcaccagcaagaaaagatcttggcccctgaacgaggccattatggccgtgggcatggtaagcatacttgcctccagcctcctgaagaacgacatcccaatgacgggcccactggtagcgggtggcctcctgacggtgtgctacgtgttaaccggtcgcagcgcagacctcgagctagagcgcgcggccgacgtacgttgggaggaacaggccgagatctccggcagctcgcccatcctgagcataaccatcagcgaagacggtagcatgtccatcaagaatgaggaagaagaacagacgctcacgattctgatccggaccggcttactcgtgatcagcggccttttcccagtgtccattccgatcaccgcagccgcctggtacctgtgggaagtgaagaagcagcgtgccggggtcctctgggatgttccctccccgccgcccgtaggcaaggccgagctggaggatggtgcctatcgaatcaagcagaaaggcatcctggggtactcccagatcggcgccggggtgtacaaggaggggacgttccacactatgtggcacgtgacgcgtggcgccgtactgatgcataaggggaagcggatcgagccatcatgggcggacgtgaagaaggacctgatttcctacggcgggggctggaagctagagggcgagtggaaggagggggaagaggttcaagtcttagcccttgaacccggtaaaaacccgcgcgccgtgcagaccaagccggggttattcaagaccaacaccggtacgatcggggccgtaagtctcgactttagccccggcacgagcggctcccccatcgtcgacaagaagggcaaagtggtgggattatatggtaatggcgtcgtaaccaggagcggtacatatgtcagcgctatcgcccaaacggagaagtccattgaggataatccggaaatcgaggacgatatcttccgcaaaaagcggctgaccatcatggatctgcatccaggggccggcaagacgaaacgctatttgcccgcaatcgtccgggaggccatcaagcgcggattgcgcaccttaatattggcccccacacgcgtagtagccgccgagatggaggaagcgctgcgaggcctaccgattcggtaccagacacccgccatccgcgccgagcacaccggcagagagatcgtggacttgatgtgtcacgccacctttacgatgagactcctgagccccatccgggtgccgaactacaacttaattatcatggacgaggcccacttcactgatccggcttccattgcagcccgtggctacatcagtacccgggtggagatgggcgaagccgcgggaatcttcatgaccgcaacgccacccggctctcgcgacccctttccgcagagcaacgccccaataatggacgaagaacgggagatacccgagcgttcctggaacagcgggcacgaatgggtaaccgatttcaaggggaagaccgtttggttcgtcccctccataaaggcagggaacgacattgccgcctgcctgcggaagaacggcaagaaagtcatacagctgtcgcgcaagacctttgactccgagtacatcaaaacgcggaccaacgattgggattttgtggtgaccaccgacatcagtgagatgggtgccaactttaaagccgaacgcgtaatcgacccgcgacgctgtatgaaacccgtgatcctcacggatggagaagaaagagtgatcttagccggacccatgcccgtaacccactccagcgccgcgcagaggcggggtcgcgttgggcgcaatccgaagaacgagaacgaccagtatatctacatgggagagcccctggagaacgacgaagactgcgcccactggaaggaagccaagatgctcttggataacatcaacacgccggagggcattataccatccatgttcgagcctgagcgggagaaagtggacgcgatcgacggtgagtacagactgaggggtgaagctaggaaaacgttcgtggatcttatgaggcgcggcgacctgcctgtgtggttggcgtatcgagtcgccgcggaggggatcaactacgccgaccgccgctggtgcttcgacggagtaaagaacaaccagattctcgaggagaatgtggaggttgagatctggacgaaggaaggcgagaggaagaagctgaagccccggtggctggacgcccgcatctacagcgacccgctcgcgctgaaggagttcaaagagttcgccgcggggagaaagtccttgaccctcaatcttatcaccgagatgggcagactgcccacctttatgactcagaaggcaaagaatgcgctcgacaacctggcggttctgcacaccgctgaggccgggggccgcgcatacaatcacgccctcagcgagctccccgagactctggagaccctgctactgctcacgctgctggcaacggtgactgggggcatcttccttttcctgatgtccggaaagggtatcggaaaaatgacacttgggatgtgctgcataatcaccgccagcatcttactgtggtacgcccagatccagcctcactggatagccgcgtccatcatcctggagttctttctcattgtcctgctgatacctgagcccgaaaagcagcgaacgccccaggacaaccagctaacctacgtcgtgatcgccatcctgacggttgtggctgccacgatggcgaacgagatgggctttctggaaaagacgaagaaggactttgggctcggcagcatcactacacagcagcctgagagcaatatcctggacatcgacctgagacctgcttcagcctggaccttgtacgccgtggccaccaccttcattaccccgatgctgcgccactctatcgaaaattccagcgtcaacgtgagcttgaccgccatcgcgaaccaagctacggtgttgatggggctggggaagggctggcccctgagcaagatggatataggggtccccctcctggccatcggatgctactcccaggtaaacccgatcacgttaaccgcggccctcctgttattagttgcccattatgccataatcgggccggggctgcaggccaaagctacaagagaggcgcagaagcgggccgcggccggcataatgaagaatcccacagtcgacgggatgactgtgatcgacctggaccccatcccgtacgaccctaagttcgagaagcagctcggccaagtgatgttactggtcctctgtgtgacccaggtgctcatgatgcggaccacatgggccctgtgcgaggcgctgaccctggcgaccggacccatcagcaccctctgggagggcaaccccggacgcttctggaacacgaccatcgcggtctcaatggccaatatatttaggggctcgtacttggccggagcggggcttctcttctcaatcatgaagaacaccgccaacacgcggcggggcacgggcaacaccggcgagaccttgggcgagaaatggaagaacaggctcaatgccctgggaaagagcgagttccagatctacaaaaagtccggcatccaggaggttgacaggaccctcgctaaggaggggatcaagcgaggcgagacagaccaccatgcagtgagccgcgggtctgccaaacttcggtggttcgtggagcgcaatttggtaacccctgagggcaaagtggtggatctggggtgcgggcggggcggatggagttattactgcggcggactgaagaacgtgaaggaggtgaagggcctaaccaagggcggacccggccatgaggagccgatccccatgtcgacctacgggtggaaccttgtccggctgcagagcggagtggacgtgtttttcactccgcccgagaagtgcgacacactgctatgcgatatcggggaatcctcgcccaaccccacggtcgaagccggccgcaccttgcgcgtgttgaacctcgtagagaactggctgaacaacaatacccagttctgtatcaaggtattgaacccgtatatgcctagcgtgatcgaaaagatggaggccctgcaaaggaagtacggtggggccctagtgcggaaccccttgtcgcgcaacagcacacacgagatgtactgggttagcaacgcgagcggtaatatcgtgtccagtgtaaacatgatttcacgtatgcttatcaaccggttcaccatgcgccacaagaaggcgacctacgagccggacgtcgacctcgggagcggcacccggaatatcggcatcgagtcggaaaccccgaatctggacatcatcggtaagcgcatcgagaagatcaaacaagagcatgaaacctcttggcactacgaccaagaccacccctataagacctgggcctatcacggctcctacgagacgaagcagacagggagcgcctcctcgatggtgaacggcgtggttcgcctgctcacaaagccctgggacgtgatcccaatggttacgcagatggccatgaccgacacgacgcccttcgggcaacagagggtattcaaggagaaggtggatacccgcacacaggaacccaaggagggcactaagaagttgatgaagataacggcggaatggctctggaaggagctcggaaagaagaaaacgccacgcatgtgtacccgcgaggaatttacgcgtaaagtccgcagcaacgccgcgttgggggccatcttcaccgacgagaacaaatggaagtccgccagagaggccgtcgaggactccggcttctgggagctggtggacaaggagcgcaacctccacctggaggggaagtgcgaaacctgtgtctacaacatgatgggcaagcgggagaaaaagctgggagagttcggaaaggccaagggtagccgcgctatttggtacatgtggcttggggcccggttcttggagttcgaggcactgggcttcctcaatgaggatcactggttttcccgcgagaacagcctgagcggggtggagggcgaagggctgcacaagctcggttacatcctgagggatgtgtccaagaaggaaggtggggctatgtacgccgacgataccgccgggtgggacacgcggatcaccctggaggacttgaaaaacgaggagatggtgacgaatcacatggagggcgagcacaagaagttggccgaggcgattttcaagctaacctaccaaaataaggtggtgcgggtccagcgcccgacaccccgggggactgttatggacataattagccgccgggaccaacgcggcagtggacaagtggtcacctacggtttgaacaccttcactaatatggaggcccagctgatcagacagatggagggagagggggtgttcaagagcatccagcaactaaccgtgaaggaggagatcgccgtcaagaactggttaatacgcgtaggtagagagcggctgtcccgcatggccatctcgggggacgactgcgtggtaaagcccctagatgaccggttcgcctccgcgctcacagcattaaacgacatgggcaaggtgcgcaaggacatccaacagtgggagcctagcaggggttggaacgactggacccaggtaccgttctgctcccaccacttccacgagcttattatgaaggacggtcgagtgttggtggtgccctgccggaaccaggacgagctgattgggcgtgcacgaataagccagggcgccggctggagccttcgcgagacggcctgcctcggcaagagctacgcacagatgtggtctctgatgtactttcaccgccgagaccttcggctcgcagctaacgccatatgcagcgccgttccctcccattggatccccacctctcgaactacttggtccatacacgcgacgcatgagtggatgaccaccgaagacatgctgactgtttggaatcgcgtgtggatccaggagaacccttggatggaggacaagacccccgttgagacttgggaagagatcccctacctcgggaagcgagaggaccagtggtgcgggagcctcatcggtctgacgagccgggcgacctgggcaaagaatatccagaccgccatcaaccaagtgcgttccctgatcggcaatgaggagtacaccgactatatgccctccatgaaacggttccgccgcgaagaggaggaggcgggcgtactctggtga

SEQ ID NO: 24871 - RNA, 9876 nt, synthetic construct
  misc_feature 1..9876: note = derived and/or modified CDS sequence (opt11) from DENV-2__KM279516__SS-prME
  source 1..9876: mol_type = other RNA
accgctggaatcataatcatgatgatcccgaccgtgatggccttccacctgaccacccgaaatggggagccacacatgatcgtcagccgacaggagaagggcaagagtcttttattcaagaccgagaacggggtgaatatgtgcaccctgatggccatggacctcggcgagctgtgcgaggacaccatcacgtacaattgcccactacttcgtcaaaatgagcccgaggacatcgactgctggtgcaactcaacctccacctgggtgacctacgggacctgcaccgccaccggcgagcaccgccgcgagaaacgatcagtcgccctggtgccacatgtgggcatggggctggagacccgcaccgagacctggatgtcctccgagggcgcctggaagcacgcccagcgtatcgagacctggatcctccgccaccccggtttcacgattatggcggcgatcctggcatacaccatcggcaccacctacttccaacgagtcctgatcttcattctcctgacggcagtcacaccttccatggcgatgcgctgtatcgggatttctaaccgggatttcgttgagggcgtatctgggggcagctgggtggatatcgtgctggagcacggctcctgcgtcaccaccatggccaagaacaagcccacgctcgatttcgagctgatcaagaccgaggcgaagcacctggccaccctccgcaagtactgtgtggaggccaagctgaccaatacgacgaccgcgagccggtgcccaacccagggggagccctccctgaacgaagaacaggacaagcgcttcgtgtgcaagcacagcatggtcgatcggggctggggaaatgggtgcggcttgttcgggaaaggcgggatcgtgacctgtgcaatgtttacgtgtaagaagaacatggagggaaaggtggtccagcccgagaatctggagtacacaatcgtgatcactcctcattcgggtgaagagaacgccgtgggcaacgacaccgggaagcacggtaaggaaatcaaggttacgccccagagctcgataaccgaggccgaattaacgggctacgggaccgtgacgatggagtgctctccgcgcactggcctcgacttcaacgagatggttctgctgcagatggagaataaggcctggctcgtgcaccggcagtggttcttagaccttccgctcccctggctgcccggcgcggacacccagggttccaactggatccagaaggagaccctggtgacctttaagaacccacacgccaaaaagcaggacgtcgtcgtgctcggaagccaggaaggcgccatgcacaccgcgctgaccggcgccaccgagatccagatgagctccggcaacctgctgttcacgggccacttgaagtgccgcctgaggatggacaagcttcagctgaagggcatgtcgtattctatgtgtaccgggaagtttaaggtagttaaggaaattgctgaaacccaacacggcaccattgtgatccgcgtccagtacgagggggatggtagcccctgcaagatcccattcgagatcatggacctcgaaaagcggcacgtgctcggccggctgatcacggtgaaccctatcgtgaccgaaaaggactcgcccgtgaacatcgaggccgaacctcccttcggggactcatacatcataattggagtcgagcccgggcagcttaagctgtcctggttcaaaaagggttcatccatcgggcagatgttcgagaccaccatgcgcggggccaagcgtatggccatcctgggcgacacggcctgggatttcgggtccctcggcggggtcttcaccagcattgggaaggcgctccaccaggtgttcggagccatctacggcgccgcattcagcggtgtttcctggacaatgaaaatcctgatcggggtcgtgattacctggatcggtatgaacagcaggtccactagtctgagtgtgtccctggtactcgtgggtgtggtcacgctctacctgggagtgatggtgcaagccgattccgggtgcgttgtgagctggaagaacaaggagctcaagtgtggcagcggcatattcattaccgataacgtgcatacctggacggagcaatacaaattccagccggagtcccccagcaagctggcatccgccatccagaaggcccatgaggagggcatctgcggaatcagatccgtgacccgcctggagaatctcatgtggaagcagatcacccccgagcttaaccacatcctgaccgagaacgaggtaaaactcacgatcatgacgggagatatcaagggcatcatgcaggctgggaagcgctccttgcgaccacagccaacagagctaaagtacagctggaaagcgtggggcaaggccaagatgctctccaccgagctgcacaaccacacgttcctgatcgatggccccgagaccgccgagtgccccaacaccaaccgggcctggaattcgctcgaagtggaggattacggattcggcgttttcactacgaacatctggctaaagctgaaggagcgccaggatgttttttgcgactccaaactgatgagcgccgcgatcaaggacaacagagctgtgcacgccgacatggggtactggatcgagtccgccctgaatgacacctggaaaatcgaaaaggccagcttcatcgaggtcaagtcctgccactggccaaagagccacacactgtggtccaacggcgtgctcgagagcgagatgatcatcccgaagaatttcgcaggccccgtgtcccagcacaattaccgccccgggtaccacacccagaccgcgggcccgtggcacctgggacggctggagatggacttcgacttctgcgagggcactaccgtcgtagtgaccgaggactgcgggaaccgcggacccagcctccggacaactaccgcctcaggcaagcttatcacggagtggtgctgccgctcgtgcaccctcccgcccttacggtaccgaggggaagacggctgctggtacggaatggagattcggccactgaaagagaaggaagagaacctggtaaacagcctcgtgacggccggacacgggcagattgataacttctcactcggcgtactaggtatggcactcttcctggaagagatgctgcgcacccgggtgggtacaaagcacgctatcctcctggtggctgtgagcttcgtcaccttaatcacgggcaacatgtccttccgcgacctcgggcgcgtcatggtgatggtcggcgccactatgacggatgatatcgggatgggcgtgacctacctggcactgttagcggcgttcaaggtgcgaccgacgttcgccgcgggactcctgctccgcaagctgaccagcaaggagcttatgatgacaacaattggcatagtcctcctttcccagtcgacgatccccgagaacatattagagctcaccgacgcactggcgctaggcatgatggtgctcaagattgtccggaatatggagaagtaccagctggccgtgaccatcatggccatcctgtgcgtacccaatgcagtcatcctccagaatgcctggaaggtgtcctgcaccacgctggcggtggtcagcgtttcccccctgttactgacctcctcccagcagaaggccgattggatccccctggccctcacgataaagggattaaacccaaccgccatcttcctgacgacccttagccgcacctccaaaaagcggagctggcccttgaacgaagcgatcatggccgtgggcatggtctccatcctggctagctccttactgaagaacgacatcccgatgaccggccccctggtggcggggggactcctgacggtgtgctacgtcctgactgggcgctctgccgatctcgagctcgaacgggcggccgacgtgcgctgggaggagcaggccgagatcagcggctcgagccctatcctttccatcacaatcagcgaagacggctccatgagcattaaaaacgaagaggaggaacagaccctcacgatcttgatccggaccggcctcctcgtgatatccggtctgttccccgtcagcatcccgatcaccgccgccgcttggtacttatgggaggtaaagaagcagagagccggggtgctttgggacgtccccagcccgccgcccgttggcaaggccgagctggaggacggagcctaccggatcaagcaaaaaggcatcttaggctatagccagatcggcgctggcgtgtacaaggaagggacttttcacaccatgtggcacgtcacgcggggcgcggtgttaatgcacaagggaaaacggatcgagccctcctgggccgacgtgaagaaggacctgatctcgtacggcggcggttggaagctggagggcgagtggaaagagggggaggaggtccaggtgctcgccctggagcccggcaagaacccgcgcgctgtgcagaccaagcccgggctgttcaaaaccaacacaggcacgatcggggcagtgtccctcgacttcagccccggaacatccggctcccccatcgtagacaagaaagggaaggtggtcggtctgtacgggaacggcgtggtaactcggtccggcacgtacgttagcgcgatcgcccagacggagaaatccatcgaggacaatccggagattgaggacgacatcttcagaaagaagaggctaacaatcatggatcttcaccctggggctggcaagaccaagcgctaccttcccgcgatcgttcgcgaagcgatcaaacgcgggctgcggactctgatactcgcccccacgagggtggttgcagccgagatggaggaggccttacgcggccttccgatacggtaccagacccccgcaatccgggccgagcacaccgggcgggagatagtggacctcatgtgccacgcaacgtttacgatgcgccttttaagcccaataagggtacctaactacaatttgataattatggacgaggcccacttcaccgacccggcgagcattgcggccagaggctatatctccaccagggtcgaaatgggcgaagccgccggaatattcatgaccgcaacgccgccgggcagccgcgatcccttcccgcaatccaacgccccgatcatggacgaggagcgggagatccccgagcgctcttggaattctggtcacgagtgggtgaccgacttcaaaggcaagacagtgtggttcgtccccagcatcaaggcaggaaacgacatcgccgcctgcctgcggaagaacggcaaaaaggtgatccagctttcccgcaaaaccttcgacagcgagtacatcaagacgagaacgaatgattgggacttcgtggtgaccacggacatttcggaaatgggcgcgaacttcaaggcagagcgcgtgattgacccgcggaggtgcatgaagcccgtgatcctcacggacggagaagaacgtgtaattctggccggccccatgcccgtgacgcacagctccgcagcccaacgccgggggcgcgtgggccggaacccgaagaacgaaaacgatcagtacatctacatgggggagcccctggagaacgatgaagactgcgcccactggaaggaggccaaaatgctcctggacaatatcaacacccccgagggcatcatcccctcaatgtttgagccggagcgagagaaagtggacgccattgacggtgagtaccgcctgaggggggaagcccgcaaaaccttcgtagacctcatgagacgcggcgacttacccgtgtggctggcataccgggtggcggccgaggggatcaactacgccgatcgccggtggtgtttcgacggcgtgaagaataaccagatcctcgaagaaaacgtcgaggtggagatatggactaaagagggggagcgaaagaagctgaagccccggtggctggatgcccggatatactccgacccgcttgctctgaaggagttcaaggagttcgcagccggccgaaagagcctgaccctcaacctgatcaccgagatgggtcgtctgcccactttcatgacgcagaaggctaagaacgccctagataacctggcggtgttacacacggccgaggccggcggccgggcgtacaaccacgccttatcagagctgcccgaaactcttgagactctcctgctgctaacgcttttggcaaccgttaccgggggcatcttcctcttcttaatgagcggcaaggggatcggtaagatgaccctggggatgtgttgcatcatcaccgcctccatcctcctgtggtacgcccagatccagcctcactggatcgccgcctcaatcatcctggaattcttcttaatcgtcctgctgatcccagagcccgagaaacagcgcacgccccaggacaaccagctcacctacgtggtcatcgccatcctaactgtggtggccgcaaccatggccaatgagatgggcttcctggaaaagacgaagaaggacttcgggctcggttccatcactacccagcagcccgaaagcaacatcctggacatcgatctgcggcctgcctcggcgtggaccctctacgccgtcgcgacaaccttcattacccccatgttacgccactcgatcgagaacagctccgtaaacgtcagcctgaccgctatcgcaaaccaggcgacggtcctcatgggattagggaaaggttggcccctgtctaagatggacattggggtgcccctcctggccatcggttgttatagccaggtaaatccgatcaccctgaccgccgccttactgctgctcgtcgcacactatgccatcatcggtccgggcctgcaggccaaagctacccgggaggcccagaagcgcgcggccgccggcataatgaaaaacccaactgtggacggcatgaccgttattgatctggaccctatcccgtacgaccccaagttcgaaaagcagctcggtcaagtcatgctgcttgttctctgcgtgacccaggtcctgatgatgcggacaacgtgggccctgtgtgaggctctcaccttggcgaccggccctatctccactctgtgggaaggcaaccccggccgcttctggaacacgacaatcgccgtttccatggccaacatcttccgcggcagctacctcgcgggcgccggattactgtttagcatcatgaagaacaccgcgaacacgagacgcggaacggggaacacgggtgagaccctcggcgagaaatggaagaaccggctgaacgcccttgggaagtccgaattccaaatctacaagaaaagtggcatccaggaagtggatcgcaccttagccaaggaggggattaaacggggcgagacggaccatcatgccgttagccgcgggagcgcgaagttgcggtggttcgtggagcgcaacctggtgacacctgaaggcaaggtcgttgacctcggctgcggacggggcggatggtcctactactgcggcggcctgaaaaatgtgaaagaggtcaaggggctgaccaaaggcgggccaggccacgaagagcccatccccatgagcacctacgggtggaacctcgtcagactgcagtccggcgtggacgtctttttcacgcctcccgagaagtgcgacaccctgctgtgcgacattggggagtcgtcccccaacccgactgtcgaggccgggcggaccctgcgagtgctgaacctcgtcgagaactggctgaacaacaacacccagttctgtatcaaagtgctgaacccttacatgcccagcgttatagagaaaatggaggccctgcagcggaagtacggtggtgctttggtgcgcaaccccttgagccggaactccacgcacgagatgtactgggtgtctaacgcctctggcaatatcgtgagctcggtcaacatgatatcccgcatgttaatcaaccggtttaccatgagacacaagaaggcgacctacgaaccggatgtcgacttagggtccggcacccggaacatcgggatagagtcagagacgcccaatctcgacataatcggcaaaagaatagagaagataaagcaagagcatgagacctcctggcattacgaccaggaccacccctataagacatgggcataccacggctcctacgagacaaagcagactggttccgcaagctccatggtcaacggagtggtccggctgctcaccaagccgtgggacgtgatcccgatggtcacccagatggcaatgacggacacaacccccttcgggcaacagagagtcttcaaggagaaggtcgatacccggacccaagagcccaaggagggcacgaagaagctcatgaagattacagcggagtggctgtggaaggagctcggcaagaagaagacgccccggatgtgcacccgggaggaattcacccggaaggtgcgcagcaacgcggccttaggtgccattttcaccgatgaaaacaagtggaagtccgctcgggaggctgtcgaggattctggcttctgggagttagtagacaaggagcgcaacctccaccttgagggaaagtgcgagacttgcgtgtacaacatgatgggaaagcgggagaagaagctgggggagttcggcaaagcaaagggctctagggccatctggtacatgtggctcggggcccggttccttgagttcgaggcgctgggttttctcaacgaggaccactggttcagccgcgagaactccctgagcggagtcgagggggaggggctccacaaactaggctacatcctgcgggatgtgagcaagaaggaaggcggggcgatgtacgcggacgacaccgccggctgggacacccgcattacactggaggacctaaagaacgaggaaatggtgacaaaccacatggagggggagcacaaaaagctggccgaggccatcttcaagcttacctaccagaacaaagtggtccgtgtgcagcgaccgacacccagaggtacggtgatggacatcatcagtcgccgagaccagcgcgggagcggccaggtcgtgacgtacggcctcaacacctttacgaacatggaggctcagctgatccggcagatggagggggagggcgtattcaagtccatccagcagctgaccgtaaaagaggagatcgccgtgaagaactggctgattcgcgtggggcgcgagcggctgagccgcatggccatatcaggcgacgactgcgtcgttaagccgctagacgaccggttcgccagcgccctcacagccctgaacgacatgggcaaagttcgcaaggacatccaacaatgggagccctctcgggggtggaacgactggacccaggtcccgttctgctcccaccacttccatgagctgatcatgaaggatggccgcgtgctcgtggtcccctgccggaatcaggatgagctgatcgggcgggcccggatatcccaaggtgccgggtggagcctgcgcgaaacggcctgccttggcaagtcttacgcccagatgtggtcactgatgtacttccaccggcgcgacctgcggctcgcggcaaacgccatctgtagcgccgtgcccagccactggatccccacctcccgcactacctggagcatacacgccacccacgaatggatgacgaccgaggacatgctgaccgtctggaaccgggtatggatccaggagaatccgtggatggaggataagactcccgtggaaagttgggaggagatcccctacctgggcaagcgcgaggaccagtggtgcggatccctcatcggactgacgagccgtgcaacctgggcgaaaaatatccagaccgcaatcaaccaggtgcgctccctgatcggcaatgaggagtacaccgactacatgcccagtatgaagaggttcagacgcgaggaggaggaggccggcgtcttgtggtga

SEQ ID NO: 24872 - RNA, 9876 nt, synthetic construct
  misc_feature 1..9876: note = derived and/or modified CDS sequence (opt11) from DENV-2__KM279517__SS-prME
  source 1..9876: mol_type = other RNA
accgcgggcatcatcatcatgatgattcccaccgtaatggcctttcacctgaccaccagaaacggggagccccatatgatcgtctcccggcaggagaagggcaagagtctcctattcaagaccgagaatggcgtaaacatgtgcaccctgatggcgatggacctaggcgagctgtgtgaagacaccatcacatacaactgtcctttattacgccagaacgagccggaggacattgactgctggtgcaattcgaccagtacctgggtaacctacgggacctgtaccgcgaccggcgagcaccggcgcgagaagcgaagcgtggccctggtgccccacgtggggatggggttagagacacgcaccgaaacgtggatgtcgtcggagggcgcttggaagcacgcccagcggatcgagacctggatcttaagacacccaggatttactatcatggcagctatcctagcctataccatagggaccacctattttcagcgcgttctgatcttcattctcctgactgccgtgacaccaagtatggctatgcgctgcattgggatcagcaaccgggatttcgtggagggagtctccggcgggagctgggtggacattgtgctagagcacggttcctgcgtcacaaccatggccaagaacaagcccacgctggactttgagctgattaagaccgaggcgaagcatcttgccaccctacgcaagtactgcgtagaggccaagttaaccaacacgaccaccgcgagccggtgtccaacccagggcgaacccagcttgaatgaagagcaggacaaaaggtttgtgtgcaagcacagcatggtagatcgggggtggggcaacgggtgtgggcttttcggcaagggcgggatcgtgacgtgtgccatgttcacgtgtaagaagaacatggagggaaaggtggtccagcccgagaacctggaatatactatcgttatcacaccgcattccggcgaggagaacgccgtagggaacgacacgggtaagcacggaaaggagatcaaggttacaccccaaagcagtattaccgaggcagagctgaccggctacgggacggtgactatggagtgcagcccgcgcactggcctcgacttcaacgagatggtactactgcagatggagaacaaggcctggctcgtccatcggcagtggttcctggacctgccgctgccctggcttcctggcgccgatacccaggggagtaactggatccagaaggagaccctggtaacgttcaaaaacccgcacgcgaaaaaacaagacgttgtggtgctcgggagccaggagggggccatgcacaccgccctgaccggggccaccgagatccaaatgagctcgggcaatcttctgttcacggggcatctgaagtgccgcctgagaatggacaagctccagctcaaagggatgagctactccatgtgcaccggcaagttcaaagtcgtgaaagagatcgcggagacccagcacggcacgattgtaatccgcgtccagtatgagggggacggcagcccctgtaagatccccttcgagatcatggacctggaaaagcggcacgtgctcggtcgcctgatcacggtgaaccctatcgtcaccgagaaggactcgccagtaaacatcgaggccgaaccgcccttcggggattcatatatcatcattggtgtggagcctggccagctcaagctctcctggttcaagaagggcagctctatcggccagatgttcgagactacgatgcgcggtgcgaagaggatggccatcctaggtgatacggcatgggacttcggcagtctgggcggggtcttcacaagtataggcaaagccctccaccaagtattcggggcaatctacggtgccgccttctcgggcgtctcctggaccatgaagatcctgataggggtcgtaatcacctggatcggcatgaacagcaggtccactagcctatccgtaagcctggtcttagtgggggtggtaaccctgtatttaggggtcatggtgcaggctgactcggggtgcgtcgtcagctggaagaacaaagagttgaagtgcggctcgggcatctttatcacagataacgtgcacacctggactgagcagtacaagttccagccggagagtccgcccaagttagcgagcgcaatccaaaaggcccacgaggaggggatctgcggcatccgatccgttacccgcctggagaacttaatgtggaagcagatcacgcctgagctgaatcacatcctgaccgaaaacgaggttaaacttacgatcatgaccggggacatcaaaggcatcatgcaggccgggaagcgtagcctccgaccgcagcccacggagctgaagtattcttggaaggcttggggcaaggccaagatgctcagcaccgagctgcacaatcacacgttccttatcgacggccccgagaccgccgagtgcccaaacaccaaccgggcctggaacagcctcgaagtggaagactacgggttcggggtcttcaccacaaacatttggctgaagctgaaggaaaggcaggatgttttctgcgacagcaagctaatgtccgcggcgataaaggacaatagggccgtgcacgccgacatggggtactggatcgagagcgctctgaatgacacctggaagatagaaaaagcttccttcatcgaggtcaagagctgccactggccaaagtcacataccctatggagcaacggcgtgctagagtccgaaatgatcatccccaagaacttcgcgggccccgtaagccagcacaactaccgcccggggtaccacacgcagaccgcaggaccttggcacctcggtcggctggaaatggacttcgacttttgcgaaggcacgaccgttgtagtgaccgaagattgcggaaacaggggcccttccctacggaccacaaccgcgagcggtaaactgatcacagagtggtgctgccgcagctgtacccttccgcccctgcggtaccgcggggaggacggctgctggtatgggatggagatacggcccctgaaggagaaagaggaaaatctagtcaattccctcgtgaccgccggccacggacagatcgacaattttagcctgggcgtcctaggcatggccttattcctagaggagatgctgcgcacccgggtgggtacaaagcacgcaatcctcctggtggccgtgtccttcgtaaccttgattaccggcaacatgagctttcgcgacttgggacgagtgatggttatggtcggcgccaccatgacggacgacattgggatgggagtgacgtacctggcactgctcgcggctttcaaggtaagacccacgttcgcagccggcttgctgcttcgtaagctgacgtctaaggagctgatgatgaccacgatcgggatcgtactcttaagccagtccacaatccccgagtcgatccttgagctcaccgacgccctcgccctgggaatgatggtgctcaagatcgtccgtaacatggagaaataccagctggcggtaacgattatggcaatactgtgtgtgccgaacgcggtcatcctccagaacgcctggaaggtctcctgtaccactctggccgtggtcagcgtcagcccactgctcttaacaagctcccaacagaaggccgactggataccactggccctaaccatcaagggactaaatccgaccgcgatcttcctgactaccttgagccgaacttccaagaagcggagctggccgctgaatgaggcgatcatggccgtggggatggtctccatcctggcgagctccttgctgaagaacgacatccccatgacgggccctctggtagccgggggattgctcacggtatgctacgtcctgaccgggcgcagcgcagatttagagttggagcgggcggccgacgttcgctgggaggagcaggccgagatcagcgggtcaagccccatcctaagtatcaccataagcgaggatgggtccatgagcatcaagaacgaagaggaggagcaaaccctcactatcctgatacggaccggattactcgtgatttccggcctgttcccggtgagtatccccataactgctgcagcttggtacctgtgggaggtgaagaaacaacgcgctggggtgttatgggacgtacccagccccccgcccgtgggcaaggccgagttggaggacggggcataccgaatcaagcagaaagggatcctggggtacagccagataggcgcgggcgtatataaggaggggactttccatactatgtggcacgtcacgcgcggcgcggtgctcatgcacaaggggaagcggatcgagccgtcctgggccgacgtaaagaaagacctgatcagctacggagggggctggaaactggagggcgaatggaaggagggggaggaagtccaagtgctcgccctggagccaggtaagaatccccgcgccgtgcagacgaagcctggacttttcaagaccaacacgggcacgatcggggccgtctccctcgacttctcgcccggtacctccggtagccccatcgtggacaagaaggggaaggtcgtgggcctgtacgggaatggagtggttacacggtccggcacctacgtctcagccattgcccagacggagaagtcaatcgaggacaaccccgagatcgaagatgacatcttcaggaagaagcggctgacgatcatggacttacaccccggagcaggcaaaaccaagcgatacctccccgcaattgtgagggaagcaataaagaggggactccggacgctgatcctcgccccgaccagggtggtcgccgccgagatggaagaggccctgcgtggcctgcccatccggtaccagaccccggcaatccgcgccgagcacaccgggagagagatagtagacctcatgtgccacgctacctttacgatgcgcctgctgagccccatccgggtaccgaactacaaccttatcattatggacgaggcccacttcactgaccccgcctccatcgcggcccgcggatacatctccacccgggtcgaaatgggcgaggcagcaggtatcttcatgacagcgacgccgccgggcagccgcgacccgttcccccagtccaacgcacctatcatggacgaagaacgtgagatccctgagcgcagctggaactcagggcacgagtgggtgacggacttcaaaggtaaaaccgtatggttcgtccctagcatcaaggcgggtaacgacattgcagcctgtctgcggaagaacggaaagaaggtaattcagttaagccgcaagacctttgacagcgagtacatcaagacgcggaccaacgactgggatttcgttgtcacaaccgacatctctgagatgggcgcgaacttcaaggccgaacgcgtgatcgaccccaggcgctgcatgaagcccgtcatactcacggacggggaggagcgggtcatcctggccggccccatgccggtgacccactcgtccgccgctcagcgccgggggagagtgggccgtaaccccaagaacgagaacgaccagtacatctacatgggggaacctctggagaacgacgaggactgtgcacactggaaggaggcgaagatgctcctggataacatcaatacccccgaaggtatcataccgagcatgttcgagcccgagcgggaaaaggtggacgccatcgacggagagtaccgcctccgaggggaggcccgcaagacattcgtggatctaatgagacgcggcgatctgcccgtatggctggcctatcgggtggcggccgaagggataaactacgccgataggaggtggtgttttgacggcgtgaagaacaaccaaatcctcgaggaaaacgtggaggttgagatctggacgaaggagggggagcgcaaaaagctgaagccccggtggctcgacgcccgcatctactccgaccctttggcactgaaggaattcaaggagttcgcggcgggccggaagtcccttaccctcaacctgataaccgaaatgggccgcctgcccacatttatgacgcagaaggccaagaacgccctcgacaacttagccgtactgcataccgccgaggccgggggcagagcctacaaccatgccctctctgaacttccggagaccctggagactctcttgctgctcacgctgcttgcaaccgtcacagggggcatattcctcttcttgatgagcggcaaggggatcggcaagatgaccctgggcatgtgttgcatcatcaccgcttcaatcctcctgtggtacgcacagatccagccgcattggatcgccgcctcgataatactggagtttttcctcatcgtgctgctaatacccgaacccgaaaagcagcgcacgccccaggataatcagctcacctacgtggtcatcgcgatcctgacagtcgtggccgcaaccatggccaacgagatgggcttcttagagaagacgaagaaggacttcgggcttggcagcatcaccacccagcagcctgagtcaaatatactcgacatcgacttgcggcccgcctctgcctggacactatacgcagtagccacgactttcatcacccccatgctgcgccacagcatcgagaattcatccgtgaatgtgtccctgaccgccatcgccaaccaggccacggtcctcatgggtctggggaagggatggcccctgagtaagatggacatcggagtgccattactagccatcggctgctattcacaggtaaaccccataaccctaaccgccgccctcctgttgctggtcgcccactatgccatcatcgggcccggcttacaggcgaaagccacccgggaggcccaaaagcgcgcggcagccggaatcatgaagaaccccactgtggacggcatgaccgtgatcgacctggacccgatcccgtacgacccgaagtttgagaagcagctcgggcaagttatgctcctggtgttgtgcgttacacaagtactgatgatgcgaaccacgtgggccttgtgcgaggccctcaccctggccacagggcccatctccaccctgtgggagggaaacccgggccgcttctggaacactacaatcgctgtcagtatggcaaacatcttccgcggctcctatcttgccggtgccgggctgctgttcagcataatgaagaacaccgccaacacccggcgcggcacgggcaacacaggcgagaccctgggcgagaagtggaagaaccgcctgaacgccctgggaaagtccgagtttcagatatacaagaaatccggcatccaggaggtggacaggactcttgccaaggaggggatcaagcggggcgagacggatcaccacgcagtcagtcgcgggagcgctaagctgcggtggttcgtggagcgcaaccttgtgacccccgagggcaaagtcgtggatctcgggtgcgggcggggcgggtggtcctattactgcggcgggctgaagaatgtcaaggaggtcaagggcctgaccaaaggcggaccgggccacgaagagccaatcccgatgtccacttatgggtggaacttagtgcgcctgcagtccggagtggacgtctttttcacaccgcccgagaagtgtgacaccctcctctgcgatataggggaaagctcccccaacccgaccgtggaggctggccggaccctgagggtgctaaacctcgtagaaaactggctgaacaacaacacccaattttgcatcaaagtgttgaacccatacatgccgtcggtgatagagaaaatggagacgctacagcggaagtacggcggggccctggttcgcaatccgctgtctcgcaactcgacccatgagatgtattgggtgagcaacgcgtccggcaacatcgtgagctcagtgaacatgatatcacgaatgctgatcaaccggtttaccatgcgtcacaagaaggccacctatgagcccgatgtggacctcgggtccggtacgcggaacattgggatagagagtgagacacccaacctggacataatcggcaagcgcatagagaagattaagcaggagcacgaaacatcatggcactacgaccaggaccacccctacaagacctgggcgtaccacggctcatacgagacgaaacagaccgggtccgccagctcaatggtgaacggagttgttcgcctactcaccaagccgtgggacgtgatccccatggtcactcagatggctatgacggacaccacccccttcggacagcagcgcgttttcaaggagaaggtcgatacccgcacgcaggagccaaaggaaggcaccaagaaattaatgaagatcaccgctgaatggctgtggaaagagctgggcaaaaagaagacccctcgaatgtgcacgagagaggagttcacacgcaaggtgcgcagcaacgctgctctgggggcgatctttaccgacgaaaacaagtggaaatccgcacgggaggccgtggaggacagcggcttttgggagctggtagacaaggaacggaacctccacctggaggggaagtgcgaaacctgcgtgtacaacatgatggggaagagagagaaaaagctgggggaatttgggaaggccaaaggctcccgcgcaatatggtacatgtggttgggggcccgattcctggaattcgaggccctgggtttccttaacgaggaccattggttcagcagggagaacagcctgagcggggtcgagggcgaggggctgcataagctcgggtacatcctgcgggacgtcagcaaaaaggagggcggtgcaatgtacgctgacgatactgcgggctgggacacccgcatcaccctggaggatctcaagaatgaggagatggtgaccaaccacatggagggggagcacaagaagcttgcagaggccatcttcaagctgacctaccagaataaggtggtccgggtgcaacgcccgacgccccggggcaccgtgatggacatcatcagtcgccgggaccagcgggggtcgggccaggtcgtgacctacggtctcaatactttcaccaacatggaggcccagctgatccggcagatggaaggggagggcgtgttcaaatccatccagcagttgacagtcaaggaggagatcgcggtgaagaactggctcatacgtgtgggccgcgaaaggcttagccgcatggccatttccggcgacgactgcgtcgtcaagcctctggatgaccggttcgccagcgccctaaccgccctgaatgacatgggaaaggtgcgcaaggacattcaacaatgggagccgtcccgggggtggaatgactggacgcaggtccccttctgcagccaccatttccacgagctgatcatgaaggatggacgcgtgctagtggtcccatgccggaatcaggatgagctgatcgggcgcgcgcgaatatcacagggagccgggtggtccctgcgcgagaccgcctgcctcggcaagtcctatgcccagatgtggagcctgatgtactttcaccggcgggacctgcggctcgcggcgaacgctatctgctcggcggtgcccagccattggatcccaacctcccgcaccacatggtcaatacacgcgacgcacgagtggatgactaccgaggacatgctgaccgtgtggaaccgggtctggatccaggagaatccctggatggaggacaagacgccggtggagtcctgggaggaaatcccatatctcggaaagcgggaggaccagtggtgtgggagcctcataggcctgactagccgggcgacctgggcgaagaacatccagactgccatcaaccaggtacgctccctgatcggtaacgaggagtatactgactacatgccgtcaatgaagcggtttcgccgagaggaagaggaggcgggcgtgctctggtaa

SEQ ID NO: 24873 - RNA, 9876 nt, synthetic construct
  misc_feature 1..9876: note = derived and/or modified CDS sequence (opt11) from DENV-2__KM279518__SS-prME
  source 1..9876: mol_type = other RNA
acagcgggtattatcatcatgatgatccccacagtgatggcctttcacttaaccacccggaacggggagcctcacatgatcgtcagccggcaggagaagggcaagagccttttattcaagacagagaacggagtgaacatgtgcaccctgatggcgatggatctcggcgagctctgcgaggacactatcacctacaattgtcccctgttacggcaaaacgaacccgaggacatcgactgttggtgcaacagcacgagcacctgggtgacctacggaacctgcaccgccaccggcgagcatcggcgggagaagcggagcgttgcactggtgccccacgtgggcatggggttggagacccgcaccgagacctggatgagcagcgagggtgcctggaagcacgcccaacggatcgaaacctggatcttacgccaccccgggttcaccatcatggcagctatcttggcctacaccattggtaccacctacttccagcgggtcctgatttttatcctcctgacagctgtgaccccatccatggcgatgcgctgcatagggatatccaaccgggactttgtggagggcgtctccggcgggtcctgggtggacattgtgcttgagcacggctcctgcgttactacaatggccaaaaacaagcccacgctcgacttcgagctaatcaagacggaggctaaacacctggccaccttgcgtaagtactgcgtggaggccaagctaactaacacgactaccgcgtcccggtgtccaacacagggagagccttccctgaacgaggagcaagacaaacgcttcgtctgcaaacacagcatggtcgacaggggctggggcaatggctgtggattattcgggaagggcgggatcgtaacctgcgccatgttcacgtgcaaaaaaaacatggagggcaaggttgtccagcccgagaacctagagtacaccatcgtgattacaccccactccggcgaggagaatgccgtgggcaacgatacaggcaaacacggcaaggagatcaaggtgacccctcagtcctccataaccgaggcagaactgaccgggtacgggacagtgactatggagtgcagtccgcggaccggtctcgacttcaacgagatggtgctgctgcagatggagaataaggcctggctcgtccatcggcaatggtttctggacctcccgctaccttggctgcccggcgcggacacccaggggtccaactggatccagaaggagacgctggtgacgttcaagaacccacacgccaaaaagcaggacgtcgtcgttctaggcagccaggagggggctatgcacaccgccctaacgggcgccacagagatccagatgagcagcgggaatctgctgttcacgggccacctgaaatgccgcctgcgtatggacaagctccagctcaaaggcatgagctactccatgtgcaccgggaagttcaaggttgtaaaggagatcgcggagacgcagcatggcactattgtgattcgcgtgcagtacgagggggacggcagcccctgcaagatccccttcgagatcatggatctggagaagcgccacgtgctcggccgcttgatcactgtgaaccccatcgtcaccgaaaaagactccccggtgaatatagaggccgaaccgcccttcggtgacagctacatcatcattggcgtggaacctggccaactaaaactctcttggttcaaaaagggcagctccatagggcagatgttcgaaacaaccatgaggggggccaaacggatggctatcttgggagacacagcttgggatttcgggtcgctaggaggggtgtttacctccatcggaaaggcactccatcaggtgttcggggcaatttacggcgcggccttctccggcgtgtcctggacaatgaaaatcctgataggtgtcgtcatcacatggataggcatgaacagccgatccactagcctctctgtgagcctggtcctcgtgggagtggtaaccctgtacctgggcgtgatggtgcaagcagactccggatgcgtcgtcagctggaagaataaagagctcaagtgtggcagcgggatcttcatcaccgacaatgtgcatacgtggacggagcagtacaagttccagccggagtcaccatcaaagttggcctccgccatccaaaaggcccacgaggaggggatctgcggtatccggagtgttacacgcctggagaacctcatgtggaagcagataacccccgagctgaaccacatcctgacagagaacgaggtgaagctcactatcatgaccggggatatcaaaggcataatgcaggccgggaagaggtccctgcgcccccagccgaccgagctgaaatatagctggaaggcgtggggcaaggccaaaatgctctccaccgagctgcataaccacactttcctgatcgacggccccgaaaccgccgaatgccccaacaccaaccgagcctggaacagcttggaagtagaggactatgggtttggggtcttcaccacgaacatctggctgaagctgaaggagcgccaggacgtcttctgtgactcaaagctcatgagcgccgcgatcaaagacaatcgagccgtgcacgccgacatggggtactggatcgaatcagccctaaatgacacgtggaagattgagaaggctagctttatcgaggtgaaatcctgccactggcccaagtctcacaccctgtggtccaacggtgtgctcgagagcgagatgataatccccaagaatttcgcgggcccagtgtcccaacataactaccgccccggataccacacccaaaccgctggcccgtggcacctggggcgactggagatggacttcgacttctgtgaaggcacgaccgttgtcgtaaccgaggactgcgggaaccgcggcccaagcctgcggaccacgacggcaagcggcaagctcatcaccgagtggtgctgccgctcttgcacattaccgccactgcggtaccggggggaagacggctgctggtacgggatggagatacggccgttaaaggagaaggaggagaacctggtgaacagcctcgtgaccgccggccatggccagatcgacaacttctccctgggcgttctgggcatggccctcttcctggaggaaatgctgcgaacccgggttggaaccaagcacgccattctcctggtcgctgtgagcttcgttaccctgattacgggcaacatgtcctttcgtgacctcggacgcgtgatggtgatggtcggcgccacgatgacagacgacattggcatgggggtgacgtacctggctctgctcgcggccttcaaggtccggcccacgttcgccgccggtctgctactccgaaagctaaccagcaaggaactgatgatgactacaatcgggatcgtcctcctgtcccagagcacgatccccgagtccatcctagagctgactgatgcgctggcgcttgggatgatggtgttgaaaatagttcggaacatggagaaataccagcttgcagtgacgatcatggcaatcttatgcgtgcccaacgccgtcatcctccagaatgcttggaaggtgagctgtaccacgctagcggtggtctccgtgagcccgctgctcctgacctccagccagcaaaaggcagactggatccccctggcactcaccatcaaagggctgaaccccaccgccattttcctgacgaccctctctcgcactagcaagaagcggtcctggcccttgaacgaagcgattatggcggtaggaatggttagtatcttggccagtagcctcctgaagaacgacatcccgatgaccggccccctggttgccggtggcctgttaaccgtttgctacgtactaaccgggcgcagcgctgacctagagctggagagggcggcggatgtgaggtgggaggagcaggccgaaatctccggcagctcccccatactgagcatcaccatcagcgaggacggaagcatgtctattaagaacgaagaagaagaacaaaccctcacgattctgattcggaccggcctgctcgtgatctcaggcctgtttcccgttagtattccgatcaccgccgccgcgtggtatttatgggaagtgaagaagcagcgcgccggggtgctttgggacgtcccctccccgccccccgtgggcaaggctgagttagaggacggcgcctaccggatcaaacagaagggaatcctggggtactcccagatcggcgccggcgtgtataaggaggggactttccacaccatgtggcacgtcacccgcggcgcggtgttaatgcacaaaggtaagcgcatagagccctcatgggccgatgtgaagaaggacctgatctcctatggcggcggctggaagctggagggcgagtggaaggagggggaagaggtccaggtgctcgcactcgagcctggaaagaatccccgcgccgtgcagacgaagcccgggcttttcaagaccaacaccggcacgatcggggccgtcagcctcgacttctcccccggtaccagcggctcgcccatcgtggacaagaaggggaaagtggtcggcctgtacgggaacggcgtggtgacccggagcggcacctacgtgtccgcgatcgcccagacggagaagtccatcgaggacaaccctgagatcgaagacgacatcttccgcaagaagcggctgaccataatggatctccatcctggtgccggcaagactaagcgctacctccccgccatcgtgcgggaggcgattaagcgcgggctgcggaccctaatcctcgcccccacgcgcgtggttgccgccgaaatggaagaggccctgcgcggcctaccaatcagataccagacgcccgcgatccgtgccgaacacaccgggcgggaaatagtggacttaatgtgtcacgccacattcacaatgcgcttactgtcccccattcgggtgcccaactacaacctcattatcatggacgaggcgcatttcaccgacccggcctccatcgcggcccgcggctacatcagcacccgagtcgagatgggcgaggccgccggcatatttatgaccgccacgccgcccggctcacgcgaccccttcccacagagcaacgcgcccatcatggacgaagagcgggagatccccgagcgctcctggaacagcgggcacgagtgggtgaccgacttcaagggcaagaccgtgtggtttgtaccatccatcaaggccgggaatgacatcgccgcctgcttgcgtaagaatggcaagaaggtgattcagctgagccgcaagacgtttgactctgagtacataaagacgcggaccaatgattgggacttcgtagtcaccacagacatctcagagatgggcgcaaacttcaaggccgaacgggtgatcgacccgcggcgctgcatgaagcccgtgatattgacggacggggaagagcgggtcattctggctggacccatgcccgtaactcactcgagcgctgcccaacgccgggggcgcgtaggccggaacccgaagaacgaaaacgaccagtacatctacatgggggagcccctagagaacgacgaggactgcgcccattggaaggaggccaagatgctcctagacaacatcaacactcccgagggaataataccatccatgttcgaaccggagagagagaaggttgacgccatcgatggcgagtaccgcctgaggggggaggcccgcaagacctttgtggacctcatgcggcgcggcgatctgcctgtctggctggcctaccgggtggcggctgaggggatcaactatgctgatcgtaggtggtgcttcgacggcgtgaagaataaccagatcctcgaggagaacgtcgaggtggagatatggacaaaggagggggagcgcaagaagctgaagccacgctggctggacgcccgcatttacagcgacccgctcgccctgaaagagttcaaggagttcgcggctgggcgtaaatcccttaccctcaacctgatcactgagatgggccgcctgcccaccttcatgacgcagaaagccaagaacgcactcgacaacctggcggtgttgcacaccgcggaagccgggggcagagcctataaccacgccctaagcgaattgccagaaaccctggagaccctcttgttgctaacgctactggctactgtcaccgggggaatcttcctattcttgatgtccggcaaaggaattggcaagatgaccttggggatgtgttgcatcattactgcctcgatcctcctgtggtacgctcagatccagcctcactggatcgccgcctctatcatcctggagttctttctcatcgttctcttgatcccagagcccgaaaagcaacgcacgccccaagacaaccagctaacgtacgtcgtcatcgcgatcctgaccgtggtagcagccaccatggcgaatgagatgggcttcctggaaaagacgaagaaggacttcgggcttggctccatcaccacacagcaaccggagagcaacatcctggacatcgacctccggccggccagtgcatggacgctctacgccgtggcgacgacatttatcacccctatgctgcggcacagcatcgagaactcctcagtcaacgtgagcctgaccgctatcgcaaatcaggcgacggtcctgatgggcctgggaaaaggctggcccctgagcaagatggacatcggtgtgcccctacttgccataggctgctattcccaagtgaacccgatcacactgaccgcggcgctcctgctgctcgtcgcgcactacgccatcatcgggcccgggctgcaggccaaagccacccgggaggcccagaagcgcgcggccgcgggcattatgaagaatcccacggtggatgggatgaccgtcatcgaccttgatcccatcccttacgatcccaagttcgagaagcagctcggacaggtcatgttgctggtgctctgtgtgacccaagttctgatgatgcggaccacgtgggccctttgcgaggcactcacgctggcgaccgggccgatcagcaccctgtgggagggcaaccccgggcgtttctggaacacgaccatcgccgtgtctatggccaacatcttccgcggcagctacctcgcaggcgccgggctgctgttctctatcatgaagaacaccgcgaacacccggcgcggaacggggaacaccggcgaaaccctcggcgagaagtggaaaaacagactcaacgcccttggcaaatcagagttccagatatataagaagtccggaatacaggaggtagaccgcaccctcgccaaggaagggatcaagaggggcgagactgaccaccacgccgtcagccgcgggtccgcgaagcttcggtggttcgtggagcgcaacctggttaccccagagggcaaggtagtggacttgggttgcgggcgcggagggtggagctactattgcggcggtcttaaaaacgtgaaggaggttaagggacttaccaagggcgggcccggccacgaagagccgatccccatgagtacgtatgggtggaacttggttcgcctgcagagtggcgtcgacgtcttcttcacgccccccgagaagtgtgacaccctgttatgtgacataggggagtccagccccaaccccacagtggaggccggccgtaccctgcgcgtgctgaaccttgtagagaactggctgaataacaacacccagttctgcatcaaggttctgaacccgtacatgccctctgtgatcgagaagatggaggccctgcagcggaagtatggaggcgctctcgtgcgcaatcccctgtcccggaacagcacgcacgaaatgtactgggtatccaatgcaagcggcaacatcgtgtccagcgtgaacatgatttcccgaatgctgatcaatcggtttacaatgcgacacaagaaggcgacctacgaacctgacgtggatctagggtctggcacccggaacatcggtatcgagtccgagacgcccaatctggacatcatcggcaagcgcatcgagaagatcaagcaggagcacgaaacctcttggcattacgaccaggatcacccttacaagacctgggcctaccatggctcctacgagactaagcaaaccgggagcgcctcctcaatggtgaacggcgtagtccgcctgctcaccaaaccgtgggacgtgatccccatggtgacccagatggccatgactgacacgacccctttcggacaacagcgggtgttcaaggagaaagtggatacccgtacccaggaacccaaggagggcacgaagaagttgatgaagataaccgccgagtggctgtggaaggagctcggcaagaaaaagacgccacggatgtgcacccgcgaggaattcacccggaaggtgcgctcaaacgcggcccttggggccatcttcaccgacgagaataagtggaagtcggccagggaggccgtcgaggactccggcttctgggagctggtcgataaggaacgcaacctccacttagaggggaaatgcgagacctgcgtctacaacatgatgggcaagcgggagaagaagctgggggaattcgggaaggcgaagggcagccgcgcgatctggtacatgtggctcggggcaagattccttgagttcgaggcgctgggattcttgaatgaggaccactggttttcccgagagaactcactgagcggggtggagggcgagggtctgcacaaactcggctacatcctgcgggacgtctccaagaaggagggcggagcgatgtacgccgacgacaccgccggatgggacacgcgcatcaccctcgaggacctcaagaatgaggagatggtgaccaaccatatggaaggggagcataagaagttagccgaggccatcttcaagctgacataccagaacaaggtggtgcgggttcagcgccagacgccgcgtggtaccgttatggatataatcagccgccgggatcagcgcgggtccggccaggtcgttacctatggcctcaacacctttactaacatggaagcgcagctgatacggcagatggaaggggagggcgtgttcaagagcatccagcagctcaccgttaaagaagagattgcagtgaagaactggttgatccgggtcggtagggaacgtctgtcccgcatggccataagcggcgatgactgcgtggtcaagcccctcgacgaccggttcgcctccgccctaaccgcgctgaacgacatgggcaaagtacgcaaagacatccagcagtgggagccatcacgggggtggaacgactggacccaggttcccttctgctcccatcacttccacgagctgatcatgaaggacggccgcgtcctcgttgttccgtgtcggaaccaggacgagctcattgggcgcgctcggattagtcagggcgccgggtggtccctgcgcgagacggcctgcctcggcaagagctacgcccaaatgtggagcctgatgtacttccaccggcgcgacctgcggctcgcggcaaacgccatctgcagcgccgtgccaagccactggatccccacctctcgaaccacttggtccatccatgccacccacgagtggatgacgaccgaggacatgctgaccgtgtggaaccgggtgtggatccaggagaacccctggatggaggacaagacccccgtcgagagctgggaggagattccctacctgggcaagcgcgaggatcaatggtgcgggagccttatcggcctgacgtcccgggccacctgggcaaagaacatccaaaccgccatcaaccaggtgcgcagcctaatcggaaacgaggagtacaccgactacatgccctccatgaagcggttccgcagggaggaggaggaggccggcgtcctctggtga

SEQ ID NO: 24874 - RNA, 9876 nt, synthetic construct
  misc_feature 1..9876: note = derived and/or modified CDS sequence (opt11) from DENV-2__KM279519__SS-prME
  source 1..9876: mol_type = other RNA
accgcggggatcatcatcatgatgatccccaccgtgatggcattccacttaactacgcgcaacggggagccccacatgatcgtctctcggcaggaaaagggcaagagcctcttgttcaaaaccgagaacggggtgaacatgtgcacccttatggcgatggaccttggcgaactctgcgaggacaccatcacctacaactgtccactgctccgccagaacgagcccgaggacatcgactgctggtgcaacagcacctctacttgggtaacgtacggaacctgcacagctaccggtgagcacaggcgcgagaagcggagcgtcgccctggtgccccacgtcggaatggggctggagactcgcaccgagacctggatgagcagcgagggcgcctggaagcacgcccagcgtatcgagacttggatactccgccaccccgggttcactattatggcggccattttggcctacaccatcgggaccacctacttccagcgggttctgatctttatcttactgacagccgtaaccccctccatggcgatgagatgtataggcatctcaaaccgggacttcgtcgagggcgtgtccggagggagctgggttgatatcgtgctggagcacggctcctgcgtaaccactatggccaagaacaagcctacactcgacttcgagttgatcaagactgaggccaagcacttggcgacactccgcaagtactgcgtggaggccaagctcaccaacacgaccacggcgagccggtgtcccacccagggcgagccctccctgaatgaggaacaggacaagcgcttcgtgtgtaagcacagcatggtcgaccggggctggggcaacgggtgcggactcttcgggaagggcggcatcgtgacgtgtgccatgttcacgtgcaagaaaaacatggagggcaaggtggttcagcccgaaaacctggagtacaccatcgtgatcacgcctcactctggcgaggagaacgccgtggggaacgatacgggcaagcatggaaaggagatcaaggtcacgccccagagctccatcaccgaggccgagctgaccggctacgggaccgtgaccatggagtgcagcccgcggaccggcctcgacttcaacgagatggtgctgttacagatggagaacaaggcttggctcgtccacaggcagtggttcctagacctgcccctcccctggctgcccggcgctgacacccaggggtccaactggatccagaaggagaccttagtgacgttcaagaacccgcacgccaagaagcaggacgtagtagttcttggcagccaggagggggccatgcacaccgccctgactggcgccaccgaaatccagatgagctccgggaacctcttgttcactgggcacctgaaatgcaggttacgtatggataagctccagctgaagggcatgagctactcgatgtgcaccgggaagttcaaggtcgtgaaggagatcgcggagacccagcacggtacaatcgtgattcgcgtacagtacgagggggacggtagcccttgcaagatcccattcgagatcatggacctggagaagcggcacgttctcggtaggcttataacggtgaaccctatcgtcaccgagaaggattccccggtgaacatcgaagccgagccgccattcggggacagctacatcattatcggcgtggagcccgggcagctgaagctctcttggtttaagaagggcagctccatcgggcagatgtttgagacgaccatgcgtggcgcaaagcggatggccatcctgggcgacacggcctgggacttcggttccctaggtggggtcttcacctccatcgggaaggcgctccaccaggtgttcggggccatctacggcgccgcgttcagcggtgtgtcctggaccatgaagatcctgatcggggtcgtgatcacctggatcggcatgaacagccgcagtacgagcctgtccgtgagcctggtcctcgtgggggtggttacgctgtacctgggcgtgatggtccaggcggactccgggtgcgtcgttagctggaagaacaaggagttaaagtgcggatcgggcatattcattaccgacaacgttcacacttggacggagcagtacaagttccaacccgagtcccccagcaagctggcctccgccatacagaaggcccatgaggaggggatctgtggcatccggagcgtcacccgcttggagaacctcatgtggaagcaaatcacccccgaactgaaccatatcctgaccgagaacgaggtgaagttgaccatcatgaccggtgatatcaagggaatcatgcaggccgggaagcggtccctgcgcccccagccaactgagctgaagtacagctggaaggcgtggggcaaagccaagatgctctccactgagctgcacaaccacacattccttatcgatggcccagagaccgccgagtgccccaatacaaacagggcctggaacagcctcgaggtcgaggattacgggttcggagtattcaccacgaatatctggctgaaactgaaggagcgccaggatgtgttctgcgactccaagctcatgagcgcagcgatcaaggataaccgggcggtgcatgccgatatggggtactggattgagtctgccctgaacgacacctggaagatcgagaaggcctcattcatcgaggtcaagtcctgccactggcccaagagccacaccctgtggtccaacggcgtgttagagagcgagatgatcatcccgaagaacttcgcgggacccgtgagtcagcataactaccgccccgggtaccacacccagaccgccggcccatggcacctggggcgcctggagatggatttcgatttctgcgagggcacgaccgtcgtcgtgaccgaggactgcgggaatcgcggccccagcctccgtacgacgaccgcctccggaaagttaattacggagtggtgctgccgctcctgcactctgccgcccctccgttaccgcggggaagacggctgttggtacggtatggagatccgaccgctgaaggagaaagaggagaacctggtcaactcactcgtgacggctggccacggtcagatcgacaacttctccctgggcgtgctgggcatggcactcttcctggaggagatgctgcgcacccgggttgggaccaagcacgccatcctcctggtagccgtcagcttcgtcaccctgattacgggcaacatgtccttccgcgacctcgggcgcgttatggtgatggttggcgccaccatgaccgatgacatcgggatgggcgtgacctacctggccctgctcgccgctttcaaggtgcggcccacgttcgcggcgggcttactccttcgcaagctgaccagcaaggaactgatgatgaccaccatcggcatcgtcctcctttcgcagagcacgatccccgagtccatcctggaactcacggatgccctggcgctgggcatgatggtactaaagatcgttagaaatatggagaagtaccagctggccgtgaccatcatggccatcctgtgcgtgcccaatgccgtcatccttcagaacgcctggaaagtcagctgcacgacgttagcggtggtctccgtgagcccactgctcctgacctccagccagcagaaggccgactggatccccctggcactcaccataaaagggctgaaccccaccgccatcttcctgacgaccctctcccgtaccagcaagaagcggtcctggcccctgaacgaggccatcatggccgtgggtatggtctcaatcctcgcctcttcgctccttaagaacgacattcctatgaccggccccctggtagccgggggcctactgacggtgtgctacgtcctgactgggagatccgccgatctagagttagagcgggcggccgacgtacgctgggaggagcaagcagaaatttccggcagtagccctatcctgtcgatcaccatctccgaggacgggagcatgtccatcaagaacgaggaggaggagcaaaccctcacgatactgattcggaccggcttgctcgtgatcagcggcctgttccctgtctccatcccgatcaccgccgccgcgtggtatctgtgggaggtgaaaaagcagcgcgcgggggtgctctgggatgtcccatccccaccgcccgtgggcaaggccgagctggaggacggtgcctaccgaatcaagcagaagggcatcctggggtactcccaaataggggccggcgtgtacaaggaggggaccttccacaccatgtggcacgtcacacgcggcgcggtgctcatgcacaaggggaagcggattgagcctagctgggctgacgtgaagaaggacttgatctcctacggcgggggttggaagctggagggcgagtggaaggagggggaggaggtccaggtgctagccctagagcccggcaagaacccgcgcgccgtgcagaccaagcccgggctgttcaagaccaacaccggcacgataggggccgtcagcctcgacttctcccccggcaccagcggctcccccatcgtggacaaaaaggggaaggtggtcggcctgtacggcaacggcgtagtgacccgcagcggcacatatgtctccgcgatcgcccagacggaaaagtccatcgaggacaaccctgaaatcgaagacgacatcttccgcaagaagcggttgaccataatggacctgcaccccggggctggaaagaccaagcgctacctccccgcaatcgttcgcgaggcgatcaagcgtggcctgcggacgctgatcctcgcgcccacgagagtggtcgccgctgagatggaggaggccctgcgcggtctgcccatacgttaccagaccccagcgatccgtgctgagcacactggccgggagattgtggacctcatgtgccacgccaccttcacgatgcgcctgctcagccccatccgagtgcccaattacaacctcatcatcatggacgaggcgcacttcactgacccggcatccatcgcggcccgcggctacattagcacacgggtcgagatgggcgaggccgctgggatcttcatgaccgccactccgcccggctcccgcgacccgttcccccagtctaacgccccgataatggatgaggagaaggagatccccgaacggtcctggaacagcgggcacgaatgggtgaccgactttaaagggaagaccgtgtggttcgtcccatccatcaaggccgggaacgacatcgccgcatgcctgcgcaagaacggcaagaaggtgatccagttaagccggaagaccttcgacagtgagtacatcaagacgcgcactaacgactgggacttcgtggtgacgaccgacatctccgagatgggcgcgaactttaaggccgagcgggtgattgacccgcggcggtgcatgaagcccgtgatcctcacggacggggaggagcgcgtcatcctggcaggccccatgccagtgacccactcctctgctgcccagcggcggggccgggtgggacgcaatcctaagaacgagaacgaccagtacatctacatgggtgaacctctggagaacgacgaggactgtgcacactggaaggaggccaagatgctcttggacaatatcaacacgcccgagggcatcatcccttctatgttcgagccagagagggaaaaagtcgatgccatcgatggcgagtacagactgcgcggcgaggcccggaagaccttcgtggacttaatgcgccggggcgacctacccgtctggcttgcctaccgagtggcggccgaggggatcaattacgccgaccggcgctggtgtttcgacggcgtaaagaataaccagatcctcgaggagaacgtcgaagtggagatttggacgaaggagggggagcggaagaagctgaagccccgctggctggacgcccggatttattccgacccgctcgcactgaaggagttcaaggagtttgcggccggccgcaaatccctgacgctcaatctgatcacggagatgggccggctgcccacattcatgacgcagaaggccaaaaacgcactcgacaaccttgcggtgctccacaccgccgaggccggagggcgcgcctacaaccacgccctcagcgaacttcccgagaccctggagactctcctgttactcacgctgctggcgaccgtcaccgggggcatcttcctcttcctgatgagcggaaaggggatcgggaaaatgacgttggggatgtgctgcatcatcacagcgagcatcctcctgtggtacgcccagatccagccccactggatcgccgcctccatcatcttagagttcttcctcatcgtgctgctgataccggaaccagagaagcagcggacgccccaggacaaccagctcacctatgtggtcatcgcgatcctgaccgtggtcgccgccaccatggccaacgagatgggcttcctggagaagacgaagaaggactttgggctcggttccatcacgacccagcagcccgagagcaatatcctggatatcgacctgcgcccggcctccgcgtggactctctatgccgtagcgacgactttcatcacccccatgctgcgccacagcatcgagaactcaagcgtgaacgtgagtctcaccgctatcgccaaccaggcgacggtcctgatgggtctaggcaagggctggccacttagcaagatggacatcggagtgcccttactagccatcggctgctactcccaggtgaatccgattaccctgaccgccgccctcctgctgctcgtcgcgcattacgccatcatcgggcctggcctgcaggccaaggccacccgcgaagcccagaaacgtgcagctgcgggcatcatgaagaacccgacggtggacggcatgaccgttatcgacctggaccccataccttacgatcccaagttcgagaagcagctcggccaggtgatgttattagtgctctgcgtcacccaggtcctgatgatgcgcactacttgggcactgtgcgaggccctcaccctggctaccgggcccataagcaccctgtgggagggcaaccccgggaggttttggaacacgactatcgcagtgtccatggccaacatctttcgcggctcctacctcgccggcgccggtctgctgttctccatcatgaagaacaccgctaatacccgccggggcacgggaaacaccggcgaaaccctgggcgaaaagtggaaaaaccgcctgaatgcgttgggcaagagcgagttccagatctacaagaaatccggcatccaggaggtagaccggacactcgccaaggaggggattaagcgtggcgagacggaccaccacgccgtcagcagaggctccgcgaagttgagatggttcgtggagcggaacctggtgactccggaaggcaaggtcgttgacctcggctgtgggcgcggcgggtggagctactactgtgggggcctgaagaacgtgaaagaggtcaagggcctgaccaagggcgggcccggccacgaggagcctatcccgatgtccacctacgggtggaacctcgtgcggctgcagagcggcgtcgacgtcttcttcacaccgcccgagaagtgcgataccctgctctgcgacatcggggaatccagccccaacccaaccgttgaggccggccgcaccctgcgggtgctgaacttagttgagaactggctgaacaataacacccagttttgcatcaaggtgctgaacccgtacatgccaagcgtgatcgagaagatggaggccttgcagcgcaagtatggcggggccctcgtccggaaccccctgtcccgcaacagcactcacgagatgtactgggtatccaacgccagtggaaacattgtcagcagcgtcaacatgatcagtcggatgctgatcaaccgtttcactatgcggcacaagaaggcgacctatgaaccggacgtcgacctggggtcgggcacgcgcaacatcgggatcgagtccgagacgcccaatctggacatcatcgggaaacggattgagaagatcaagcaggagcacgaaacctcctggcactacgaccaggaccacccatataaaacatgggcctaccacgggtcgtacgagacgaagcagacggggagcgcctccagcatggtgaacggcgttgtgcgcctgctcactaagccttgggacgtgatccctatggtaacccagatggccatgaccgacacgaccccctttggacaacagcgcgtgttcaaggagaaggtcgacacccgcacccaggagccgaaggagggcacgaagaaactcatgaagatcaccgccgagtggctgtggaaggagctgggcaagaagaagacgccccgcatgtgcacccgggaggagttcacacgtaaggtacggtccaacgcggcgctgggggctatcttcacggacgaaaacaagtggaagtctgcccgtgaggccgtggaggactccggcttctgggagctggtcgacaaagagagaaatctccacctggaggggaagtgtgagacctgcgtgtacaatatgatgggcaaacgcgagaagaaacttggggagttcggcaaggcgaagggtagccgggccatctggtacatgtggctcggggcccgcttcttggagtttgaggccctggggttccttaacgaggaccactggttctcccgagagaacagcctgagcggggttgagggcgaggggctgcacaaactcggctacatcctgcgcgacgtctccaagaaggagggcggcgcgatgtacgccgacgacaccgccggatgggatacgcgtatcaccctggaggacttgaaaaacgaggagatggtgacaaaccacatggagggggagcacaagaagctggctgaggccatcttcaagctgacctaccagaacaaggtggtcagagtgcagcgaccgacgccccgcggcactgtgatggacatcatcagccggagagatcagcggggatccggccaggtcgtgacctacggcctcaacaccttcacgaacatggaagcgcagctgatcagacagatggagggtgagggcgtgtttaagagcatccagcagctcaccgtcaaggaggagatagcggtgaagaactggctcatccgggtggggcgcgagagactgagccggatggccatcagcggcgacgactgcgtcgttaagccgctggatgataggttcgcatccgccctcaccgccctgaatgacatgggcaaggtccggaaagacatccagcagtgggagcccagccgcgggtggaacgactggacgcaagtccctttctgttcccaccacttccacgagctgatcatgaaagacggccgagtcctcgcggtgccctgccgcaaccaggatgaactgatcgggcgggcccgcatctcccagggcgcagggtggtccctgagggagacagcctgcctcggaaagagctacgcgcagatgtggtccctaatgtacttccaccgccgggacctacgcctcgccgccaacgccatctgtagcgctgtcccctcccactggattcccaccagccggaccacatggtctatccacgcgacccacgagtggatgacgaccgaagacatgctgaccgtgtggaatcgcgtgtggatccaagaaaacccgtggatggaggacaagaccccggtcgagagctgggaggagatcccctatctaggcaagcgggaggatcagtggtgcggaagcctcattggcctaacgtcccgcgccacctgggcaaagaacatccagacagccattaaccaagtccgtagcctgatcgggaatgaggaatatactgactacatgccaagtatgaagcgtttccggcgtgaggaggaggaggcgggcgtgctctggtaa

SEQ ID NO: 24875 - RNA, 9876 nt, synthetic construct
  misc_feature 1..9876: note = derived and/or modified CDS sequence (opt11) from DENV-2__KM279520__SS-prME
  source 1..9876: mol_type = other RNA
accgccgggataatcatcatgatgatccccaccgtgatggcattccatctgaccacgaggaatggcgaaccccacatgatagtcagtcggcaggaaaaaggcaagtcgctcctgttcaaaactgagaacggtgtgaatatgtgcaccctgatggcgatggatctcggcgagctgtgcgaggacaccatcacgtacaactgcccactgttgcgtcagaacgagcccgaggacattgactgttggtgcaattccacgagcacctgggtgacctacgggacgtgcaccgccacgggtgagcatcggcgcgaaaagagaagcgtcgcactggtgccccacgtgggtatggggttggagacccgcaccgagacatggatgagcagcgagggcgcctggaagcacgcgcagcggatcgagacctggatccttcgccaccccgggttcaccatcatggcggccatactggcctacaccatcggtaccacctactttcagcgggtcctgatcttcatcctgctgaccgccgtgactccatccatggcaatgcgatgcataggtatctcaaaccgggacttcgtggagggggtctccggcggcagctgggtggatatcgtactggagcatggcagttgcgtcactaccatggcccgaaacaagcccacactggacttcgagctgatcaagaccgaggcaaagcatctcgccaccctccggaagtattgtgtggaggccaagctgaccaacactaccactgcatcccgctgtcccacccagggggagccgtccttgaacgaggaacaggacaagcggttcgtgtgcaagcacagcatggtagatcgcggatggggtaacggctgcggcctcttcgggaaaggagggatcgtaacttgcgcaatgttcacgtgcaagaagaacatggaggggaaggtggtccagccagagaacctggagtacaccatcgtcatcactccccactccggcgaggaaaatgcagtgggaaacgatacgggcaagcacgggaaagagattaaggtcacaccccaaagctccattaccgaagccgaactgaccggctatggtaccgtgacgatggagtgcagcccgcggaccgggctagacttcaacgaaatggtcctcctgcagatggagaacaaggcctggctcgtccacagacaatggttcctggacctgccacttccttggctgccaggcgcggacacccaggggtccaactggatccagaaggagaccttagtaactttcaagaatccgcatgcgaagaagcaggacgtcgtggtgcttggctcacaggaaggggcgatgcacaccgccctgaccggcgccacagagatccagatgagctccgggaacttactgttcacgggccacttgaagtgccggctacgaatggataagctccagctgaagggaatgtcctactcgatgtgcacggggaagttcaaagtcgttaaggaaatagccgaaacccagcacggcaccatagttatcagagtccagtacgagggggacggcagcccctgcaagatcccattcgaaataatggacctggagaaacgccatgccctcggacgcctgatcacggtgaaccccatcgtgaccgaaaaagactccccggtcaacatagaggccgagccaccctttggggactcatatatcattatcggcgtggaacccgggcagctgaagttgtcgtggttcaaaaagggcagctccatcgggcagatgttcgagaccaccatgcggggcgccaagcgcatggccatcctgggagacacggcttgggacttcgggagcttgggcggagtgttcacctccatcggcaaggccctccaccaggtcttcggggccatctacggcgccgcgttcagcggcgtctcttggaccatgaagatcctgattggcgtagtcataacctggatcggcatgaacagccgcagcacgagcctttccgtgtcgctggtgctcgtgggggtggtgactctgtacctgggcgtcatggtgcaggccgacagtgggtgcgtggtcagctggaagaataaggaattgaagtgcggcagcggcatattcatcactgacaacgtgcacacctggacggagcagtataagttccagccggagtcccccagtaagctggcatccgcgattcagaaggcccacgaggagggcatctgcggcatccgcagcgtgacccgactggagaatctcatgtggaaacagatcaccccggagttgaaccacatcctgaccgagaatgaggtcaagctcacgatcatgaccggcgacatcaagggcatcatgcaggcggggaagcgctccctgcggccccaaccgaccgagctgaagtacagctggaaggcctggggcaaggccaaaatgttgtcaaccgagttacacaatcacacgttcctgatcgacggcccagagaccgccgagtgtcccaacaccaatcgcgcttggaacagcctggaggtagaagactacgggttcggcgtgttcaccacgaacatttggctgaagctgaaggaacggcaagatgtcttctgtgactctaagttgatgagcgctgccatcaaagataaccgcgcggtacacgccgacatggggtactggatcgagtccgcccttaacgatacttggaagatcgagaaggcgagctttattgaggtgaagtcctgtcactggcccaagagccacaccctgtggtccaacggagtcctcgagtccgagatgatcatccccaagaacttcgccggccccgtatcccagcataactatcggcccggctatcacacccagactgccggcccgtggcacttgggacgcctggagatggatttcgacttttgcgagggcacgacggtggtcgtgaccgaagactgcgggaaccggggcccgagcctccgcaccacaactgcctcgggcaagctgatcaccgagtggtgttgccggagctgcaccctgccaccactgcgctaccgcggggaagacggctgctggtacgggatggagatacgcccgctgaaggagaaagaggagaacctggtgaacagcctggtcacggccggccacgggcagatcgacaacttctccctgggcgtgctgggtatggccttattcctggaagagatgctgcggacccgcgtaggcaccaagcacgcgatcctcctggtcgccgtgagtttcgtcaccctgatcacaggcaatatgtccttccgcgatctcgggcgtgtaatggtgatggtgggcgcgaccatgactgacgacatcgggatgggcgtcacctacctagcgctgctcgccgccttcaaagtacgcccgactttcgccgctggcttgttgctcaggaagctgaccagcaaggagctcatgatgacgaccattggaatagtactcctgtcccagagcacgatacccgaaagtatcctggaattgaccgacgcactggcactggggatgatggtccttaagatcgttcgcaacatggagaagtaccagctagcagttaccatcatggcaatcttgtgcgttcctaacgctgtgatcctccagaacgcgtggaaggtcagctgcaccacgctggcagtggtcagcgtctcgccgttactcctgacctcaagccagcagaaagcagactggatccccctggccctcaccataaagggactgaacccgaccgcgatcttccttactactctctctcgtaccagcaaaaagcgctcctggcccttgaacgaggctatcatggccgtggggatggtgagcatactggcgtcgagcctcttaaagaacgacatcccgatgacaggccccctggttgccgggggcctcctgacggtgtgctacgtgctgaccgggcggagcgcggacttagagctggagcgcgccgccgacgtaaggtgggaggaacaagccgagatctccggcagctcccccatccttagcatcaccatctctgaggacgggtctatgtcgatcaagaatgaagaggaggagcagacgctcacgatcctgatccgcaccggtttgcttgtgatcagtggcctgttccccgtgtctatcccaatcactgccgccgcttggtacctgtgggaggttaagaagcaacgggccggggtgctctgggacgtgcccagcccgccgccggtcggcaaggccgagctggaggatggcgcctaccggatcaaacagaagggcatcctggggtactcccagataggcgccggcgtgtacaaggaggggaccttccacaccatgtggcacgtgacaaggggagccgtcctcatgcacaaaggaaagcgcatagagcccagctgggcagacgttaagaaggacctcatctcctacggcgggggctggaagctggagggagagtggaaggaaggggaggaggtgcaggtcctggccttggagcccggaaagaacccgagggcagttcagactaagcccgggctgttcaagaccaacaccggtacgatcggtgctgtgagcctcgacttcagtcccggcacctccggctcccccatcgtagacaagaagggcaaggtggttgggctgtacgggaatggagtcgtgacgaggagcggcacctacgtgtccgctatcgcacaaactgagaagtccatcgaggacaaccctgagatcgaggacgacatattccggaagaagcggctaacgatcatggacctgcaccccggcgccggcaagaccaagcggtacctccccgcaatcgttagggaagccataaagcggggcctacgcaccctgattctcgcccccacgcgcgtggtggccgcggaaatggaggaggcactgcgcggcctgccgatacgctaccagactcccgccatccgtgccgagcacacaggccgggagatagtcgacctcatgtgccacgccacattcacgatgcggcttctgtcgccgatccgcgtgccaaactacaacctcatcatcatggacgaggcccacttcaccgaccccgcgtccattgccgcccgaggctacatcagcacccgcgtggagatgggcgaggcagcagggatctttatgaccgcgacgccgcccgggtcccgggatcccttcccacagtcaaacgcccccatcatggacgaagaacgcgagatccccgagcggtcctggaacagcggtcatgagtgggtcacagacttcaagggaaagaccgtgtggttcgtcccctccatcaaggccgggaacgacatcgcggcgtgcctccggaagaacggcaagaaggttatccaactgagcagaaagaccttcgactcggagtatattaaaacacgcaccaatgactgggacttcgtggtgactactgacatcagcgaaatgggcgcgaacttcaaggccgagcgggtcatcgatccgcgtcggtgtatgaagcccgtaattctcacggacggggaggagcgcgtgatcttagcgggccccatgcccgtcacccattcaagcgctgcgcagagaagagggcgcgtgggccgtaacccgaagaatgagaacgaccagtacatctacatgggtgaacccctggagaacgacgaggactgcgcgcactggaaggaagccaagatgctcctggacaacatcaacacacccgaggggatcatcccgtccatgttcgaaccggaacgcgagaaagttgacgccatcgacggcgagtaccggctgagaggggaagcgcggaagaccttcgtcgacctcatgcgacgaggcgacctgcccgtgtggctggcataccgcgtggccgcggaggggattaactatgccgatcggcgctggtgcttcgacggcgtgaaaaacaaccagatcctcgaggaaaatgtggaagtcgagatttggacgaaggaaggggagcggaagaagctgaagccccgctggctggacgcccgtatctactctgatcctctcgccttgaaggagttcaaggagttcgccgccggccgcaagtccctgaccctcaacttgatcacagagatgggccggctgcccactttcatgacgcagaaggccaagaacgcgctcgacaacctggccgtgttgcacaccgccgaggccgggggccgtgcttacaaccacgcgctctcagagctgcccgagactctggagactctcctgctgcttacgctgctggccaccgtaaccgggggcatctttctcttccttatgtcgggcaaagggattggcaagatgaccctgggtatgtgctgcatcatcaccgccagcatcctcctatggtacgcccaaatccagccccactggatcgccgcctccatcatcctggagttcttcctcatcgtccttctgataccggagccagaaaagcaacgaacgccccaggacaatcagcttacctacgttgtgattgcgatcctgaccgtcgtggccgccactatggccaacgagatgggcttcctagagaaaacgaagaaggacttcgggttaggcagcatcaccacccagcagcccgagtccaacatcctagacattgacttacgcccggcgtcagcctggaccctctacgccgtggcaacgacctttataacccctatgttacggcatagcatcgagaacagttctgttaacgtatccctgaccgctatcgcgaaccaggccaccgtcctcatgggcctggggaaggggtggcccctgagcaaaatggacatcggggtgcccctattggccatcggctgctattcccaggtgaacccgatcaccttaaccgccgcgcttctactcctcgtggcccactatgccatcatcgggcccggtctgcaggccaaagccactcgcgaggcgcagaaaagagccgccgcgggaatcatgaagaacccgacggtagacgggatgacggtgatcgacctggaccccataccatacgaccccaaattcgaaaaacagctcggccaggtgatgttattagtcctgtgcgtgactcaggtccttatgatgcgtaccacgtgggctctttgcgaggcgctaaccctagcaaccgggcccatcagcaccttatgggagggcaaccctggtcgcttctggaacacgacgattgccgtctctatggcaaacatattccggggaagctacctcgccggcgcggggctgctgttctccataatgaagaataccgccaacacacgccggggcacggggaacactggggagacgctcggagagaagtggaagaatcggctcaacgccctgggaaagagcgagttccagatctacaagaagtccggcatccaggaggtggatcggaccttggcgaaggaggggatcaagcgcggcgagacggaccaccacgcggtgtcccgggggtccgccaagctgcgctggttcgtcgagcggaacctggtgactccggagggcaaagtggtggatctcggctgcgggcgcggcgggtggtcgtactactgcggcgggctgaagaacgtcaaggaggtgaaggggctgaccaaaggagggccgggccacgaggagcccatccccatgtccacttacgggtggaacctcgtccggctgcagagcggcgtggatgttttcttcacgccgcccgaaaagtgtgacaccttactctgcgacataggggaatctagcccaaaccccaccgtcgaggcaggcagaacactgcgggtgttaaacttagtggaaaactggctgaacaataacacccagttctgcatcaaggtcctaaacccgtacatgccctccgttatcgagaagatggaggccctgcagcgcaaatacggcggggccctcgtgcggaatcccctgagtcgcaatagcacgcacgagatgtactgggtttctaacgcatctggcaacatcgtgtccagcgtaaacatgatctcgcggatgctgataaaccgcttcaccatgcgacacaagaaggcaacctacgaaccggatgtcgacctagggtcaggcacccgcaatatcgggatagagtccgagactcccaacctggacataatcggtaaacgcatcgagaagattaaacaagagcacgagactagctggcattatgaccaggaccacccctacaagacctgggcgtaccacggctcctacgagacgaagcagacggggagcgcctccagtatggtgaacggggtggtacggctgctcaccaagccgtgggacgttataccgatggtgacccaaatggccatgaccgacacgacccccttcgggcagcagcgagtcttcaaggagaaggtggacactcggacccaggagcccaaggagggcacgaagaaactgatgaaaattacggcagagtggctgtggaaggagttgggcaagaagaagacaccccggatgtgtactcgggaggagttcacgcgcaaagtccggtctaatgccgctctgggagccattttcaccgatgaaaacaagtggaagtccgcacgtgaggcagtggaggactccggattctgggagctggtggacaaggaacggaacctccacctagaagggaagtgtgagacctgcgtctataacatgatgggtaagcgcgagaagaagctgggggagttcggcaaggcaaagggcagccgagcaatctggtacatgtggctcggggcgcgattcctggagttcgaggctttaggcttcctcaacgaggatcactggttcagcagagagaacagcctgagcggggtggaaggcgaaggtcttcacaaattaggctacatcctgagggacgtatcaaagaaggagggcggggctatgtatgctgatgacacggccggctgggacacacgaatcacgctggaggatctcaagaacgaggaaatggtcacgaatcatatggagggggagcacaagaagctggcggaggcgatcttcaagctaacataccagaacaaggtggtgcgcgtccagagaccgacaccccgcggcactgtgatggacatcatcagccggcgggatcagcgggggtctggccaggtggttacctacggcctcaataccttcaccaacatggaggcccagctgatccgccagatggagggggaaggcgtgtttaagagcatccaacagctaaccgtgaaggaggagattgccgtcaagaactggctcatacgcgtggggcgggagcgattatcccggatggctatcagcggcgacgactgcgtggtaaagccactggacgacaggttcgcatccgcgttgaccgccctgaatgacatgggtaaagttcggaaggacatccagcaatgggaacccagccgcggctggaacgactggacccaagtcccgttctgttcccaccatttccacgaactgatcatgaaagatggtagagttctcgtcgtaccctgcagaaaccaggacgagctgatcgggcgggctcgcattagccagggcgctgggtggtctctacgggagacggcgtgcctcggcaagagctacgcgcagatgtggtccctgatgtacttccaccgccgggacctgcgcctcgccgctaacgctatatgtagcgccgtgccctcccattggatcccgacatcgcggaccacctggagtatccacgctacacacgagtggatgacgaccgaggacatgctcaccgtgtggaaccgcgtgtggatccaggaaaacccgtggatggaggacaagacccccgtcgagacgtgggaggaaatcccctacttaggcaagcgggaggaccagtggtgtgggagcctcatcggcctgaccagccgcgccacctgggccaagaacatacaaactgccataaaccaggtgcggagtctaatcggaaacgaggagtacacggactatatgcctagtatgaaacgcttccgccgggaggaggaggaggcgggcgtcctatggtga

SEQ ID NO: 24876 - RNA, 9876 nt, synthetic construct
  misc_feature 1..9876: note = derived and/or modified CDS sequence (opt11) from DENV-2__KM279521__SS-prME
  source 1..9876: mol_type = other RNA
accgcgggcatcatcatcatgatgatccccaccgtgatggcattccacttaactacccggaatggtgagcctcacatgatcgtaagccggcaggagaagggcaagagccttttattcaagaccgaaaatggggtaaacatgtgcacccttatggccatggacctcggggagctgtgtgaagacaccattacctacaactgtccattactcaggcagaacgagccagaggacatcgattgttggtgcaattcgacgagcacctgggtaacctacgggacctgcaccgctacgggcgagcaccggagggagaagcgtagcgtagcgctggtgccccacgttgggatggggctggaaaccaggacagagacctggatgtctagtgagggcgcctggaagcacgcccagcggatagagacctggatcctccgccatcctgggttcaccatcatggccgccatcttggcctataccataggaaccacgtacttccaacgggtcctgatcttcatactcctcactgcggtgaccccaagtatggcgatgaggtgcatcgggatcagcaaccgggactttgtggaaggcgtaagcggcggttcttgggtggacatcgtgctggaacacggaagttgcgtcactacgatggctaagaacaagccgacgcttgactttgagctgatcaagaccgaggcgaagcacttagcaaccctccgcaaatattgcgtggaggccaagctgactaacacgaccaccgcgagccggtgtccaacgcagggagaaccctcgctgaatgaggaacaagacaagcgatttgtttgcaagcacagcatggtagaccggggatggggaaatggctgtggcctcttcgggaagggcgggatcgtcacatgcgcaatgttcacatgcaagaagaacatggagggcaaagtggttcagccagaaaacttggagtacaccatcgtgattacaccccactctggtgaggagaacgctgtcggtaacgatacgggtaagcacggaaaggaaattaaggttacaccccagtcttccataaccgaggccgagctgaccggctacggtacagtgacgatggagtgttcgcctcgcacgggtcttgacttcaacgagatggtgctccttcagatggaaaacaaggcctggctcgtgcataggcaatggttcttggacctgccgctaccctggttgcccggagcggacacacaaggatcaaactggatccagaaggagacactggtgacgtttaagaaccctcacgctaagaagcaagacgtcgtagtgcttggcagccaggagggggccatgcacaccgccctgaccggcgccacagagatccagatgtcttccgggaacctcctgtttaccggacatttaaagtgccgcctgcggatggataaacttcaattaaagggcatgagctatagtatgtgtactgggaagttcaaagttgtgaaggagatcgcggagacccagcatgggaccatcgtcatccgcgtccagtacgagggggacggcagcccctgcaaaatccccttcgagatcatggacctagagaagcggcacgtcttaggacgcctgattacggtaaatcccatcgtcaccgaaaaggactccaccgtgaacatcgaggccgaaccgccctttggggacagctatatcatcatcggcgtggagcccgggcagctgaagttatcctggttcaaaaagggcagctccattgggcaaatgttcgaaacgacaatgcggggcgctaagcgtatggccatattaggcgataccgcctgggactttgggagtcttggcggggttttcacatccatcggcaaggcgctccaccaggtgttcggcgctatctacggcgccgccttctcaggcgtgtcctggaccatgaagatcctgatcggagtcgtgataacgtggatcggaatgaactcgcgttccacatcgctgtccgtgtctctggtattagtgggggttgtcaccctgtacctgggtgtgatggtgcaggcggattcagggtgcgtggtgagctggaagaacaaggagctcaaatgtggtagcggcattttcatcaccgacaatgtgcatacgtggacggagcagtacaaattccagcccgagtcgccgagtaagctggcttccgctatccagaaggctcacgaggagggtatctgcggcatcaggagcgttacaaggctcgagaaccttatgtggaagcaaatcacccccgagctgaaccatatcctgacggagaacgaagtgaagctcaccatcatgaccggcgacataaaaggcataatgcaggccgggaagcggtccctgcgaccgcaacccacggagttgaagtactcatggaaggcgtgggggaaagccaagatgttgtccacggagttacacaaccataccttcttaatcgacggtccggaaaccgccgaatgcccgaacacgaatcgggcatggaacagcctcgaggttgaagattacgggttcggcgtcttcacaaccaatatctggctgaaactgaaggagcgccaggacgtattttgcgatagtaagctcatgtccgcagcaattaaagacaaccgggccgtgcatgcagacatggggtactggatcgaatccgccctaaacgacacttggaaaatagaaaaggcctctttcattgaggttaaatcctgccactggcccaagtctcacacactgtggtccaacggtgtcctcgagagtgaaatgatcatcccgaagaacttcgcggggcccgtgtcccaacacaactatcgacccggttaccatacacagacggccggtccctggcacctggggcggctagagatggacttcgacttttgcgaaggcacaaccgtcgtggtgaccgaagactgcgggaatagaggacccagcctccggacgaccaccgccagcggcaagttgataaccgagtggtgctgccgcagttgcacgctgccgcccctccggtaccgcggggaggacggttgctggtacgggatggagatcaggccgctgaaggaaaaggaagagaacctggtcaatagtcttgtgaccgccggccatgggcagatcgacaactttagtttgggcgtgctgggcatggcgctctttctcgaagagatgcttcgcacgcgtgtggggaccaagcacgccatactactggtggctgtcagcttcgtgaccctaatcaccggcaacatgtccttccgcgacctcggccgcgtgatggtgatggtaggcgcgaccatgaccgacgacattgggatgggagtgacgtacctggccttactggccgccttcaaggtgcggccaacattcgccgccggcctgttgctacgcaaactaacttcaaaggagctgatgatgactacgattgggatagtcctcctatcgcagagcacgatcccggagtccattctggagctcaccgacgccctggcgttgggaatgatggtgttgaagatcgtccggaacatggagaagtatcagctggcggtaactatcatggcaatcctgtgcgtccccaacgcagtcatcctccagaatgcctggaaggtttcgtgcacgacgcttgccgtggtaagcgttagccccctgctcttgacctccagtcagcagaaagcggactggatcccgttggcgctcacaatcaaagggctgaatccgacggccatcttcttaaccactttgagccgcactagcaagaagcggtcctggccgctgaacgaggcaatcatggccgtgggcatggtaagcatcttagcatccagcctgctgaaaaatgacatccccatgactggcccgttggtggctggtgggctgctaacggtgtgttatgtcctgaccgggcggagcgccgatctcgagctcgagcgggcggctgacgtgcgctgggaggagcaggcggagatctccggcagctccccaatcctgagcatcaccatctccgaggacgggagcatgtccatcaagaacgaggaggaggagcagacgctcactatcctgatccgaacaggcctgctcgtgatcagcggtctgtttcccgtcagtattcccataaccgcagccgcctggtacttatgggaggtgaagaagcaacgggccggtgtactctgggacgtaccaagtccacctcccgttggcaaagccgagctggaggacggtgcataccgaatcaaacagaaagggatcctgggctacagccaaatcggagccggagtgtacaaggaagggaccttccacacgatgtggcatgtcacccgcggcgccgtgctgatgcataagggcaagcggatcgagccatcatgggccgacgtcaagaaagacctaatatcctacggcgggggatggaaactcgagggcgagtggaaagaaggggaagaggtacaagtattggccctggagcccggtaagaacccccgtgccgtgcaaaccaagccggggctgttcaagacaaatacgggcaccataggagcagtcagcttagatttctccccgggcacgagcggctcccctatcgtggacaagaagggcaaggttgttggcttatatgggaatggcgtggtgacgcgatcaggcacctatgtctccgccatcgcacaaaccgagaagtccatcgaggacaacccagaaatcgaggacgacatttttagaaagaaacggctgaccattatggatctgcacccgggcgcgggcaagaccaagagataccttcccgcgatcgtacgcgaggcgatcaagcgcggcctaagaacgctgatcttggccccgacccgtgtggtggccgcggaaatggaagaggccctgcgcggcctgcccattcggtaccagactccggcgatacgagccgaacacacgggtcgggagatcgtggatctcatgtgtcacgccacgttcaccatgagactgctctctcccatccgtgtgccgaactacaatctcatcattatggatgaggcccacttcaccgaccccgcatccatcgcggcccgcggctatatcagcactcgggtagagatgggagaggccgccggcattttcatgacggccacaccgccaggctcccgcgatcccttccctcagtctaacgccccaatcatggacgaggagcgtgagatccccgagcgatcctggaacagcggccacgaatgggttaccgactttaagggcaagacagtgtggtttgtcccttccatcaaggccgggaacgatatcgccgcctgcctgcggaaaaacggcaagaaagtaatccaactgtcgcgcaaaactttcgactccgagtatatcaagacacggaccaacgattgggatttcgtcgttaccacggacatcagcgaaatgggcgcgaacttcaaagctgaacgcgtgatcgacccccggcgctgcatgaagccagttatccttaccgatggggaggagagggtaattttagccgggcccatgcccgtgacgcactccagcgccgcccagcgccggggccgcgtgggccgcaacccaaagaatgagaatgaccagtatatctacatgggtgaaccgctggaaaatgatgaggactgcgcgcactggaaggaagcgaagatgctcctggacaacatcaacaccccagagggcattatcccgtcaatgttcgaacccgaacgggagaaggtcgatgccatcgacggcgagtatagacttcgcggggaggcgagaaagacgttcgtggatctcatgcgccgaggcgacctgcctgtatggctggcttatcgggtggccgccgaggggattaactacgccgaccgccggtggtgtttcgacggtgtgaagaacaaccagatcctggaagagaatgtcgaggtggagatctggaccaaggaaggggagcgtaagaaattaaagccccggtggctggatgccagaatttacagcgatcccttagccctgaaggagttcaaggagttcgcagccggcaggaagtccctgaccctcaacctgatcactgagatgggccgccttccgacgttcatgacacagaaggccaagaacgccctcgataacctcgcggtgctgcacacggccgaagccggagggcgggcgtacaaccacgccctctccgagctgcccgagacattagagactcttttgctgttaaccctgctggcgaccgtcaccgggggaatcttcctcttcctgatgagtggcaaagggatcgggaagatgaccttgggtatgtgctgcatcataacggccagcattctgctctggtacgcgcagatccagccccactggatcgcagcatccataatcttggagttctttctcatcgtgctgttaatacccgaaccagagaagcagcgcacgccccaggataaccaactcacctacgtagtcatcgcgatcctgaccgttgtggccgccacgatggccaacgagatgggcttcttggagaagaccaagaaggacttcggactcggttcaataaccacccaacagcccgagtcaaatatcctggacatagacttgcggccggccagcgcgtggacgctctacgccgtcgccaccacgtttattaccccgatgttacgccacagtatagaaaactccagcgttaacgtgtccctgacggcgatcgccaaccaggcgacggtcctcatgggcttgggtaagggctggcccctaagcaaaatggacatcggggtgccgctactggcaatcggctgctactcacaggtcaaccccattaccctcacagccgccctactgctactcgttgcgcactacgccataatcgggcctggtctgcaggccaaggccacacgcgaggcccaaaagcgagcagccgcaggcataatgaagaaccccaccgtggacgggatgaccgttatcgacttagaccccatcccgtacgacccgaaattcgaaaagcagctcggccaggttatgctgctcgtgctctgcgtgacacaagtcctgatgatgaggactacctgggccctgtgtgaggcgcttactttggcgacagggcctatatctacgctgtgggagggcaacccggggcgcttctggaataccactatcgccgtttccatggccaacatcttccgcggcagctacctggcgggcgccgggcttctattcagcatcatgaagaacacagcgaatacgcggcgcggcacagggaacactggtgaaaccctgggcgagaagtggaagaaccggctgaatgcgctgggcaaatccgagttccagatctataaaaagtccggtatccaggaggtggaccgcacgctcgcaaaggaggggataaagcgtggcgagactgaccaccacgccgtcagtcgcgggtccgcgaagctgagatggttcgtggagagaaacttagtgacgccggagggaaaggtagtggacctcgggtgcgggcggggcggatggagctactactgcggcggattaaagaacgtgaaggaagtgaaagggctgaccaagggcgggccagggcacgaggagccaatcccgatgagtacgtatggttggaatcttgttcgcctgcagagcggagtggacgtcttcttcacacctcccgagaagtgcgacaccctattatgcgacatcggagagtcgagtcccaaccccaccgtggaggccggccgaacgctgcgcgtgctgaacttggtcgaaaactggcttaacaataacacgcagttctgtatcaaagtactgaacccgtacatgcccagtgtgatcgagaagatggaagccttacagcggaaatacggcggggccctcgtccgcaacccccttagccggaatagcacgcacgagatgtactgggtgtccaacgccagcggaaacatcgttagcagcgtcaatatgatctctagaatgctgattaatcggttcaccatgaggcacaaaaaggcaacctacgagcccgacgtggacctcggtagtggcacccggaacattgggatcgagtcggagaccccgaatttggacattatcggtaaacgcatagaaaagatcaaacaagaacacgagaccagctggcactatgatcaagaccacccgtataagacatgggcctatcacgggtcctacgagactaagcagacagggtcagcgtccagcatggtgaacggcgtagtgcgcctactcaccaagccctgggacgtgatccccatggtaacccagatggctatgacggacaccaccccgttcgggcagcagcgggtgttcaaggagaaggtcgacacccgcacgcaggagcccaaggaaggcactaagaaacttatgaagattacagccgagtggctttggaaggagctcggcaagaaaaagacgccccgaatgtgcacgcgggaggagttcacccggaaggtacgctccaacgcggcactcggtgccatttttaccgacgagaataagtggaagtccgcccgggaggccgtcgaggactccggtttctgggagctggtcgataaggagcgcaacctgcacctggaaggaaagtgcgagacctgcgtttacaatatgatgggcaagcgggagaagaagctgggtgagttcgggaaggcgaagggctcgcgcgccatctggtacatgtggttaggggccagatttttggagttcgaagctctgggcttcttgaacgaggaccattggttttctagggaaaacagcctgagcggggtggagggcgaagggctgcataaactcggctacatcctgagagacgtctccaagaaggagggcggggcgatgtatgccgacgacacggccgggtgggacacccgaatcaccctggaggacctcaagaatgaagaaatggtaaccaaccatatggagggcgaacacaagaagctggctgaagcgatattcaagctcacgtaccaaaacaaggtggtgcgtgtgcaacgcccgactccacggggaaccgtaatggacatcatttcacggcgggaccagcgcgggtcggggcaggtcgtgacctacggcctaaacacgttcaccaacatggaagcccaactgatccggcagatggaaggcgagggcgtgttcaagagcatccagcagctcactgtaaaagaggagatcgctgtgaagaattggttaatcagggtggggcgcgagcggctctcccgcatggcgatctcgggggatgactgcgtcgtaaagcctttagacgaccgattcgcctccgcactcaccgcactaaatgatatgggcaaagtgcgcaaggacatacagcagtgggagcccagccgggggtggaacgattggacgcaagtccccttctgcagccaccacttccacgagctgatcatgaaggatggccgtgtgctcgtggtcccgtgcaggaaccaggacgagctgattgggcgcgcccgcatttctcagggtgcagggtggtccctgcgcgagacagcctgtctcggcaaaagctatgctcagatgtggtcgctgatgtatttccaccggagagacctgcggctcgcggcaaacgctatctgcagcgcagtcccatcccactggatcccgaccagccgcacaacgtggtcgatacacgccactcacgaatggatgacaactgaagatatgctgactgtgtggaaccgggtatggatccaagagaatccatggatggaagacaagacgccggtcgagagctgggaggagattccctaccttggcaaacgcgaggaccaatggtgcgggtctctaatcggcttaacctcccgggcaacatgggccaagaatatccagactgccatcaaccaagtgagatcactgatagggaatgaagagtacacggattacatgcccagtatgaaacgcttccgccgagaagaggaggaggccggtgtcctgtggtag

SEQ ID NO: 24877 - RNA, 9876 nt, synthetic construct
  misc_feature 1..9876: note = derived and/or modified CDS sequence (opt11) from DENV-2__KM279583__SS-prME
  source 1..9876: mol_type = other RNA
accgccgggataatcatcatgatgatcccaaccgtgatggccttccacctcaccacccggaacggggagccccatatgatcgtcagccgccaggagaagggcaagagcttactgttcaagaccgaaaatggggtgaacatgtgcaccctgatggcgatggacctcggcgagctgtgcgaggacaccatcacctacaactgcccattgttgcgccagaacgagcccgaggacatcgactgctggtgcaacagcaccagcacctgggtaacatacggcacctgcaccgctaccggagagcaccggcgagagaagcggagcgtcgccctagtgccccacgtaggcatggggctggagactcgcacagagacctggatgtccagcgaaggcgcctggaagcacgcccagcggatcgagacctggattctccgccaccccggattcacgatcatggccgccatcctcgcctacaccatcgggaccacctacttccagagggttttgattttcatcctcctgactgccgtgaccccctccatggcgatgcgctgtatcgggatcagcaatcgggatttcgttgaaggcgtctctggcggttcatgggtggacatcgtgctggagcacggctcctgtgtcaccaccatggccaagaacaagcccactctcgactttgagctgataaagactgaggcaaagcacctggccaccctccgcaagtactgtgtggaggccaagctgaccaacacgacgaccgcgtcacggtgccccacccagggggagccctccctgaacgaggagcaagacaagcgcttcgtgtgtaagcattcaatggtcgaccggggctggggcaacggatgcggcctcttcgggaagggcgggatcgtaacgtgcgccatgttcacttgcaagaagaacatggagggcaaggtggtgcaacccgagaacctggagtacacgatcgtcatcacgccccactccggcgaggagaacgccgtcgggaacgacacgggaaagcacgggaaggagatcaaggtcacgccccaaagctcaataaccgaagccgagctgacgggctacgggactgtgacgatggagtgcagcccgcgcaccggcctcgacttcaacgagatggccctgctgcagatggagaacaaggcgtggctcgtgcaccggcagtggttcctggacctgcccctcccatggcttcccggagccgacacgcaggggtccaactggatccagaaagagaccctggtcacgttcaaaaacccgcacgccaagaagcaggacgtggtagttctcggcagccaggagggagctatgcacacagccctgaccggcgcgaccgagatccagatgagctcagggaaccttctattcacgggccacctgaagtgccgcctacggatggacaagctccagctgaaggggatgagctattccatgtgcaccgggaagttcaaggtagtcaaggagatcgccgaaacccagcacggcacgattgtgatccgcgtgcagtacgagggggacggcagcccctgtaagatcccctttgaaatcatggaccttgaaaagaggcatgtcctcggccgcctgattacggtcaaccctatcgtgactgagaaggactccccggtcaacatcgaggccgagccgcccttcggggactcttacataatcatcggcgtcgagcccgggcagctgaagctatcctggttcaagaagggctcctccatcgggcagatgttcgagaccactatgcgcggtgccaaacggatggccatcctgggcgatacggcgtgggatttcggtagcctaggcggggtcttcacctctataggcaaggccctccaccaggtctttggggccatctacggcgcggcgttcagcggcgtgagctggaccatgaagatcctgatcggggtggtcatcacctggatcgggatgaacagccgctccacgagcctgtccgtcagcctggtgctcgtcggggtggtgaccctgtacctgggcgtcatggtacaagccgactccgggtgtgtggttagctggaagaacaaggagttgaagtgcggcagcggcatcttcatcacagacaacgtgcacacctggaccgagcagtacaagttccagccggagtcccccagcaagctagcctctgccatccagaaggcccacgaggaggggatctgcggcatccggtcagtgacccgcctggagaacctcatgtggaagcaaatcacccccgagctgaaccacatccttaccgaaaacgaggtcaagctcacgatcatgaccggcgacatcaagggcatcatgcaggcgggcaagagatccctgcgcccccagccgaccgagcttaagtacagctggaaagcctggggcaaggccaagatgctctcaaccgagctgcacaaccacacgttcctgatcgacggccccgagaccgcggaatgccccaacaccaaccgggcctggaacagcctcgaggtggaggactacgggttcggcgtgtttacaacaaacatctggctgaagctgaaggagcgccaggacgtcttctgtgacagtaagctcatgtctgcggcaatcaaagacaatcgggccgtccacgcagacatgggctactggatcgagtccgccctgaacgacacctggaagatcgagaaggctagcttcatcgaggtgaagtcctgccattggcctaagagccatacactgtggtctaacggcgtcctcgagagcgagatgatcatccctaagaatttcgccggccccgtttcccagcacaactaccgcccggggtaccacacccagaccgccggcccgtggcacttggggcgtctcgagatggacttcgacttctgcgaaggcacgaccgtagtagtgaccgaggactgcgggaacagaggccccagcttacggaccacaacggccagcggcaagctgatcacggagtggtgttgccgctcctgcacgctcccgcccctcagataccgaggagaagacgggtgctggtacgggatggaaattcggccgctgaaggagaaggaggagaacttagtgaacagcctcgtcaccgcgggccatgggcagatcgataacttcagtctgggtgtgctgggtatggccctgttcctggaagagatgctgcggacgcgggtgggtaccaaacacgccattctcctggtcgcggtgagcttcgtcaccctgattactggaaatatgtccttccgcgacctggggcgcgtcatggtgatggtgggcgccaccatgaccgacgacatcgggatgggcgtcacctacctggcgttacttgccgccttcaaagtgaggcccacgtttgccgccggcctgctgctacgtaagctaaccagcaaagagcttatgatgaccaccataggcatcgtgctcctgtcccaatcgacaatccccgagtccatcctggagctcaccgacgctctggctttagggatgatggtcctcaagatcgttcggaatatggagaaatatcagcttgccgtaacaattatggccatcctctgtgtacccaacgccgtgatcctccagaacgcgtggaaggtctcgtgcaccaccttagctgtggtgtccgtcagtccgctgctcctcacctccagccagcaaaaggccgactggatccccctcgcattgaccatcaaaggactgaacccgaccgctatcttcctgacgaccctctcccgcactagcaagaagcggtcctggccactgaacgaggccatcatggccgttggcatggtgagcattctggcctccagcctcctaaagaacgacatcccgatgaccggccccctggtcgctgggggcctcctgacggtgtgttacgtgctgaccgggcgcagtgcggacttagagctggagcgggccgccgatgtccgttgggaggagcaagccgagatatctggctcgtcccccattcttagcatcacaatcagtgaggatgggtccatgtccatcaagaacgaggaagaggagcagacccttacgatactgatcagaaccggcctattagtgatcagcggcttgttcccggttagcattccgatcacagccgcggcctggtacttgtgggaggtcaagaaacagcgtgccggggtgctctgggatgtgccctcaccgccacccgtcggcaaggctgagctggaggacggggcgtaccggataaagcagaagggcatcctgggttactctcagattggcgctggcgtatacaaggaggggaccttccacaccatgtggcatgtgacgcgcggcgccgtcctcatgcacaagggtaagcggatcgagccctcatgggccgacgtgaagaaggacctgatctcctacggcggaggatggaagctggaaggcgagtggaaggagggggaggaagtgcaagtcctcgccctcgagcccggcaagaacccgcgcgccgtgcagaccaagcccgggctgttcaagaccaacacgggcacaatcggggcggtgagcctcgacttctcccccggcaccagcggctcccccatcgtcgacaaaaaggggaaggtggtgggcctgtacgggaacggcgtcgtgacccgaagcggcacctacgtctccgccatcgcccagacggagaagagcattgaggacaacccggagatcgaggacgatatcttccgcaagaagcggctgactatcatggacctgcatcccggggcgggcaagacaaagcgctacctccccgcgatcgtccgggaagccatcaagagggggctgagaaccttaatcctagcccccacgcgcgttgtggccgccgagatggaggaggcgcttcgcggcctgccaatccggtaccagacccccgccatccgcgccgagcacactgggagggagatcgtcgacctcatgtgccacgcaaccttcacgatgcgcctgctgagccccatccgggtgcccaattacaacctcattatcatggacgaggcacacttcacggaccccgcgtccatcgccgcccgcggctacatcagtaccagagtagagatgggcgaggccgccgggatcttcatgaccgcgacgccgcctggctccagggaccccttcccgcaaagcaacgcccccatcatggacgaggagcgggagataccagagcgctcctggaatagcgggcatgagtgggtcaccgactttaagggcaagaccgtgtggtttgtgccatccatcaaggccggcaacgacatcgccgcgtgcctgaggaagaacggcaagaaggtcatccagctgagcaggaagaccttcgactccgagtacataaagactcggaccaacgactgggacttcgtggtgaccaccgatatcagcgagatgggcgccaacttcaaggccgaacgcgtcattgacccccggcgctgtatgaagcccgtgatcctaacggacggtgaggagcgagtgatactggcaggccccatgcccgtaacccactccagcgccgcgcaaaggcgggggcgcgtcggccgcaacccgaaaaacgagaacgaccaatacatctacatgggggagccgctagagaacgacgaggactgtgcccattggaaggaggccaagatgctcctcgacaacatcaacacacccgagggcatcatccccagtatgttcgagccggagcgggagaaggtggacgccatcgacggcgagtaccgcctgcgcggagaggccagaaaaaccttcgtcgacctcatgcgacgcggtgacctgcccgtgtggctggcgtaccgggtcgccgccgaggggataaactacgcagaccgccggtggtgcttcgacggcgtaaagaacaaccagatcctcgaggaaaacgtagaggtagagatctggacaaaggagggtgagcgcaagaagcttaagcctcggtggctggacgcccgcatctactccgatccgctcgcgttgaaagaattcaaggagttcgccgccgggcggaaatccctgaccctcaacttgatcaccgagatgggccgcctgcccaccttcatgacgcagaaggccaaaaatgcgctggacaacttggcagttctgcacaccgcggaggccgggggccgggcctacaaccacgcgctcagcgaactgcctgagacgctggagactctcctgctgttaacgctgctggccaccgtgaccgggggcattttccttttcctgatgagtggcaagggaatcggcaagatgaccctgggaatgtgctgcatcatcaccgccagtatcctcctgtggtacgcccagatccagccccactggattgcggcgtccatcatcctggagttcttcctcatcgtccttctgatcccggagcccgaaaagcagaggacgccccaggataaccagctaacatacgtggtgatcgccatcctgaccgtcgttgccgccaccatggccaacgagatgggtttcctggagaagacgaagaaggacttcggcctcggcagcatcaccacccaacagcccgagagcaatatcctggacattgacctgcggcccgcgtccgcctggacactctacgccgtggcgacgaccttcatcacccccatgttacgccacagcatcgagaactcctctgtcaacgtgtccctgaccgcgatcgcgaaccaggccacggtcttgatggggctggggaagggatggcctctgagcaagatggacatcggggtcccattactggccatcggctgctactcccaagttaatcccatcaccttgaccgccgcgctcctgttactcgtggcccactacgccatcatcgggcccggtctgcaggccaaggctacccgggaggcgcagaagcgcgccgccgccggcatcatgaagaaccccacggtcgacgggatgaccgtgatcgacttagatcccatcccgtacgaccccaagttcgagaagcagctcggccaggtgatgcttttagtcctctgcgtaacccaggtgctgatgatgcgcacaacttgggctctgtgcgaggctctcaccctggccaccgggcccatcagcaccctgtgggagggaaatccaggtcgcttctggaacaccaccattgccgtctcgatggccaatattttccgcggcagctaccttgctggcgcagggctgctgttctcaatcatgaagaacacagcgaatacccgccgcggcacggggaacaccggtgagaccctcggcgagaagtggaagaaccggctgaacgccttgggtaagagtgaattccagatctacaagaagtctggcatccaggaggttgaccgcaccctggccaaggaagggatcaagcggggcgagacggaccaccacgcggtgagccgcgggtccgccaaactgcgctggttcgtggagcgaaacctggtgacccctgagggtaaggtggtcgacctcggctgcgggcggggcgggtggagctactactgtggcggcttaaagaacgtcaaggaggtgaagggcctgacgaagggcgggcccggccacgaggagcccatccccatgtccacctacggttggaacctcgtccgcctacagagcggcgtagacgtcttcttcacgccgcccgaaaagtgcgacaccctactctgcgatatcggcgagtccagcccgaatcccaccgtcgaggccggccggacgctgcgcgtgctgaacctcgtggagaactggctgaacaacaacacccagttctgcatcaaggtactgaacccctacatgcccagcgttatcgagaaaatggaagccctgcagcggaagtacggcggggcattggtgcgcaaccccctcagccggaacagcacgcatgaaatgtactgggtctccaatgcgagcggcaacatcgtgagcagcgtgaacatgatctcacgcatgctgatcaacagattcaccatgcgccacaagaaggccacctacgagccggacgtcgacctcgggagcggcacccggaacatcgggatcgagtcggaaactcccaacctggacatcataggcaagcgaatcgagaagatcaagcaggagcacgagacctcatggcactacgaccaggaccacccctacaagacctgggcgtaccacggttcctacgaaacaaagcagacggggtcggcgtccagcatggtgaacggagtggtccgcctgctcaccaagccctgggacgtgatcccgatggtgacccagatggccatgactgacacgacccccttcgggcagcagcgggtctttaaggagaaggtggacactagaacacaagagcccaaggaaggcacgaagaagctgatgaagatcaccgcggagtggctgtggaaggagctcggcaagaagaagacgccacggatgtgtacccgcgaagagttcacgcggaaagtcagatccaacgcagccctgggtgccatcttcaccgatgaaaacaagtggaagtcggccagagaggcggtggaggactccggcttctgggagctggtggacaaggagcgcaacctccacctagaagggaagtgcgagacctgtgtttacaacatgatgggaaaacgggaaaagaagctgggggagttcggcaaggccaagggcagccgcgctatctggtacatgtggctgggagcccggttcctggaattcgaggcgctgggcttcctcaacgaggaccactggttcagccgcgagaactctctaagcggagtagaaggcgaggggctgcacaagctcggctacatcctgcgggacgtgtccaagaaagagggcggtgccatgtacgccgacgacaccgccggatgggatacgcgcattaccctggaagacctcaagaacgaggagatggtaaccaaccacatggagggggagcacaagaagcttgccgaggcgatctttaagttaacgtaccagaacaaggtcgtccgggtacagcgaccgacgccccggggcaccgtgatggatatcatctcccgccgggaccagcgcgggtcgggccaggtggtcacgtatggcctcaacaccttcacgaacatggaggcccagttaatccggcagatggaaggggagggtgtgttcaagtcaattcagcagctgacggtgaaggaggagatcgccgtcaagaattggctcattcgcgtgggccgtgagcggctgtcccgcatggccatcagcggcgatgactgtgtggtgaagcccctggacgaccggttcgccagtgcgctgacggcgttgaacgacatgggcaaggtgcgcaaggacattcagcagtgggagcccagccgaggctggaacgactggacgcaggtgccgttctgcagccaccacttccacgaactgatcatgaaggatggacgcgttctcgtggtgccatgccggaaccaggacgagctcatcgggcgcgcccggattagtcagggcgccgggtggtccctgcgcgagacggcctgcctcggcaagtcatacgcgcagatgtggtccctgatgtacttccaccggcgtgacctgcggctggccgccaacgccatttgcagcgccgttccgtcgcactggatccccaccagccgcaccacctggtccatccatgcgacccacgagtggatgacgaccgaggatatgctgacggtgtggaaccgggtgtggatacaggagaacccgtggatggaggacaagaccccagtcgagagctgggaagaaatcccatacttaggcaagcgcgaggaccaatggtgcggatccctcatcggcctcacgtcccgggccacttgggccaagaacatccagacagccatcaaccaggtgcgcagtctgatcgggaacgaggagtacaccgactacatgccctctatgaagcggttcagacgcgaggaggaggaggcgggcgtgctctggtga

SEQ ID NO: 24878 - RNA, 9876 nt, synthetic construct
  misc_feature 1..9876: note = derived and/or modified CDS sequence (opt11) from DENV-2__KM279585__SS-prME
  source 1..9876: mol_type = other RNA
accgcggggatcataataatgatgatacccaccgtgatggcgttccacctaacgacccggaacggggaaccgcacatgatcgtgtctcggcaagagaaaggtaagtctctcctgttcaaaaccgagaacggggtgaatatgtgcaccctgatggcgatggacctcggcgagctgtgcgaagacaccatcacctacaactgccctctgcttcgccaaaacgagcccgaggacatcgactgctggtgcaatagcaccagcacctgggtaacctacgggacttgcaccgccacaggcgagcaccggagggagaagcggtcagtggcattggtgccccacgtgggcatgggcctggaaacgagaaccgagacctggatgagcagcgagggcgcctggaagcatgcccagcgcatcgagacatggatcctacgccaccccgggtttactataatggcggccatcctggcctatacaatcggcaccacatacttccagcgtgtcctgatattcatacttctgacggccgtgacccccagcatggcgatgcgctgcatcgggatctccaaccgcgatttcgtggagggcgtttccggagggtcatgggtggatatagttctggagcacggctcctgcgtcacgacaatggccaagaacaagccgacgttagacttcgagttgataaagaccgaggcaaagcacctggccacactccgcaaatactgcgtggaggccaagctgaccaacacgaccaccgcgagccggtgccccacccaaggggagccctcgcttaacgaggaacaagacaagcgtttcgtttgcaagcacagcatggtcgacaggggctggggcaatgggtgtggtctcttcgggaagggcgggatcgtgacgtgcgcgatgttcacgtgcaagaagaacatggaagggaaggttgtccagcccgaaaacctggagtacaccatcgtgatcacgccacacagcggcgaggagaatgccgtgggaaacgacacgggcaagcacgggaaggaaatcaaagtcacaccccaatcctccatcaccgaggccgagctgacaggctacgggacagtgaccatggaatgctcgccgcgcaccggcctcgacttcaacgagatggtcctgctgcagatggagaacaaagcctggctagtccaccggcaatggttcctggacctaccactcccttggctgccgggcgcggacacccagggttccaactggatccagaaggaaacgctcgtgacattcaaaaatccgcacgccaagaagcaagatgtcgtggtgctcggcagccaggagggcgcaatgcacacagcgctgacgggcgccacagagatacagatgagctccgggaacctcctgttcacgggccacctgaagtgccgcctgcggatggacaagctccagttgaagggcatgagctactccatgtgcaccggtaaatttaaagtcgtgaaggagatcgcggagacccagcacggtaccatcgtcgtccgcgtgcagtacgagggggacggcagcccctgcaagattcccttcgagatcatggaccttgagaagcggcacgtgctaggacgcctgataacggtcaatcctatcgtgactgagaaggactccccggtgaacatcgaggcggagccgccattcggcgactcctacatcatcatcggagtcgagcccggacagctgaagctgtcctggttcaagaaagggagctccataggtcagatgttcgagaccaccatgcgcggcgccaagagaatggcaatactgggtgacacggcttgggatttcggatcactgggcggagtgtttaccagtatcggcaaggcgcttcaccaggtattcggggccatctacggagccgcctttagcggcgtctcatggaccatgaagattctgatcggggtggtgatcacctggataggcatgaacagcaggtccacgagcctgtccgtcagcctggtgctcgtcggggtcgttaccctgtatttgggtgtgatggtccaggcggactccgggtgcgtggtgtcctggaagaacaaggagcttaagtgtggctcggggatctttataacagacaacgtccatacctggacggaacagtataagtttcagccggagtcccctagcaagctggcctccgccatacagaaagcacacgaggaggggatttgtggcatccggagcgtgactcgcctggagaacctcatgtggaagcaaatcacccccgagttaaaccacatcctgaccgagaacgaggtgaaacttacgattatgaccggggacatcaagggaatcatgcaggccgggaaacggtcattgcgcccgcagccaaccgaattgaaatattcttggaaggcgtggggaaaggccaagatgctctccacagagctgcacaatcacacgttcctcatcgacgggcccgagaccgccgagtgccccaacaccaaccgcgcctggaacagcctagaagtggaggactacgggttcggcgtgttcaccacgaacatttggctgaagctgaaggagaggcaggacgtgttctgcgactccaagctcatgagcgcggccatcaaagacaaccgggcagtccacgccgacatgggttactggatcgagtccgcgctgaacgacacctggaagatcgagaaggcctctttcatcgaggtaaagtcctgccactggcccaagagccacactctgtggagtaacggcgtgctcgagagcgagatgatcatcccaaagaacttcgccggccccgtttcccagcacaactacagacctgggtatcacacccagacggccggaccgtggcatctgggaagactggagatggatttcgacttctgcgagggcacgaccgtggtggtgaccgaggactgcggtaaccgaggcccctcgctgaggaccacgaccgcgagcggtaagctgatcacggagtggtgctgcagatcctgcacgctgccacccctccggtatcgcggagaagatggctgctggtatgggatggagatacgtccgctgaaggagaaggaagagaacctcgtgaactcgctcgtaacggccggacacggccagatcgacaacttcagccttggcgtcctgggtatggctctctttctggaggagatgctgcgaacccgggtggggaccaaacacgcgatcttactggtggccgtctcgttcgtgaccctgataacgggcaacatgtctttccgggaccttggtcgcgtgatggtcatggtgggggccaccatgaccgacgatatcgggatgggcgtgacctacctggccctgttagcggccttcaaggtccggcccacgttcgccgccggactgctactccgtaagctgacctcaaaggagctcatgatgacgaccattgggatcgtactgctgtcccagagcacgatccccgaatccatcctggagctcaccgacgctctggcgctgggcatgatggtcctcaagatagtgcggaacatggagaagtaccagctggccgtgaccataatggccatcctgtgtgtcccaaacgccgtgatcttacaaaatgcctggaaggtgtcgtgtaccacgctcgcagtcgtgtcggtaagcccgctgctgctgacctccagccaacagaaggcagactggatccccttggccctcaccatcaaggggctgaatcccacagccatcttcttaacgaccctttcccgcacctctaaaaagcggtcctggcctctgaacgaggcgatcatggctgtaggcatggtgagcattctggcctccagcctcctgaagaacgacatccctatgaccggccccctggtggctggagggctcttgacggtctgttatgtactgaccggtcgctcggcggacctcgaactggagcgggcggcagacgtgcgctgggaggagcaggccgagatctccggcagctcccccatcctatcaatcaccatctccgaggacggcagcatgagcatcaaaaacgaggaagaggagcagaccctcactatcctgattcggaccgggctcctcgtcatcagcggactgttccccgtatccatcccgatcaccgccgccgcgtggtacttgtgggaagtgaagaaacagcgtgccggggtcctctgggacgtgccctccccgccaccagtgggaaaggcggagctggaggacggggcataccggatcaagcagaagggcatcctggggtactcacagatcggtgctggcgtctacaaggaagggaccttccacaccatgtggcacgtgacacgcggcgcggtgctgatgcacaaaggaaagcggatcgagcccagctgggccgacgtcaaaaaggaccttatctcctacggtgggggctggaagctggagggcgagtggaaagagggggaggaggtccaggtcctcgccctggagcccggcaaaaacccgcgcgctgtccagaccaagcccgggctgttcaagaccaacaccggcacaatcggggccgttagcctagacttctcacccggcaccagcggctctcccatcgtggacaagaaggggaaggtcgtaggcctgtacgggaatggggtggtaaccaggagcgggacctatgtgtctgcgatcgctcagactgaaaagagcattgaggacaacccagagatcgaggacgatatcttccgcaaaaagcggctgaccattatggatctgcatcccggtgccggaaagaccaagcgctacctacccgccatcgtgcgcgaggcgatcaagcgcgggctgcggacccttatcctcgcccccacccgcgtcgtggccgctgagatggaggaggctttacgcggtctaccaatccggtaccagacccccgcgatccgggccgagcataccgggcgcgaaattgtggacctgatgtgccacgcaaccttcacgatgagacttctgagccccattcgggtccccaactataacttgatcataatggacgaggcccacttcaccgacccggcctccatcgcggcccgcggctacataagcactcgggtggagatgggcgaggccgccgggatcttcatgactgccacgccgcccgggtctcgcgaccccttcccgcagagcaacgctccaatcatggacgaggagcgggagatccccgagcgctcctggaacagcggacatgaatgggtcactgactttaagggcaagaccgtctggttcgtaccctccataaaagccggaaacgacatcgccgcttgcctgcggaagaacgggaagaaggtgatccagctgagccgcaagacctttgactccgagtatatcaaaacgcggaccaacgactgggatttcgtcgtgactacagacatctctgaaatgggcgcgaacttcaaggccgagcgcgttatcgacccgcggcgctgtatgaagcccgtcatcctcaccgacggggaggagcgggtgatcttggccggccccatgcccgtaacccacagcagcgcggcccagcgccgggggcgagtcggccgcaacccgaagaacgagaacgaccagtacatctatatgggggagcccctggagaacgacgaagactgcgcgcattggaaagaggccaagatgttgctggacaacatcaacacgcccgaaggaattatcccctccatgttcgagccggagcgggagaaggtggacgccatcgatggcgaatatcgcttaagaggagaggcccgtaagacattcgtcgacctcatgcggcgcggcgacctgcctgtgtggctggcatatcgggtcgcagcagaggggataaactatgcggaccgccggtggtgcttcgatggggtcaaaaacaaccagatcctcgaggaaaacgtggaggtggagatttggacgaaggagggtgagcgcaagaagctgaagccacgctggctggacgcccgcatttatagcgatccgctcgccctgaaggagtttaaggagttcgcggccggtcggaaatccctgacactcaatctgatcaccgaaatgggccgcctaccgaccttcatgacgcagaaagccaagaacgccctcgacaacctggcggtcctgcatacagccgaggccgggggacgagcctacaatcacgccctaagtgagctgcccgagaccctggagaccctcctgctgctcactctgctggcgaccgtgaccgggggcatcttcctttttctgatgtcgggcaaagggatcggcaagatgaccctggggatgtgctgcatcataaccgccagcatcctcctatggtatgcgcagatccagccccattggattgccgccagtataatcctggaatttttcctcattgtgctactaatcccggagcccgagaagcagcgaacaccccaggacaaccagctcacctacgtcgtgatcgcgatcttaacagtggtcgccgcaacaatggccaacgagatgggcttcctggagaagaccaaaaaggacttcgggctcggctctatcacaacacaacagcccgaaagcaacatcctggacatcgacctgcgcccggccagcgcatggactctgtacgccgtggccacgaccttcatcacgcccatgttacgccatagcatcgagaactccagcgtgaacgtctccctgaccgccatcgcgaaccaggcgacggtgttgatgggcctgggaaaaggctggccactgtcaaagatggatatcggagtgccactcctggctattggctgctactctcaggtcaacccgataaccctgaccgccgccctcttactgcttgtggcccactacgcgatcatcgggcccggcctgcaggcgaaggccactcgggaggcccagaagcgcgctgcagccggtatcatgaagaaccccacagtggacgggatgacggtcatcgatctggacccgatcccgtacgaccccaaattcgagaaacagttgggacaagtgatgctgttggtgctgtgcgtcacccaggtgttgatgatgcgcaccacctgggccctgtgtgaggccctcaccctggcgacggggcccatcagcacgctgtgggaagggaaccccgggcgcttctggaatacgaccatcgccgtatccatggccaacatcttccgcggcagctacctcgccggagcggggctgctgttttccatcatgaagaataccgcgaacacccgacgcggcacagggaacacaggtgaaaccctcggcgagaagtggaagaaccggctcaacgccctaggaaagagcgagttccaaatctacaagaagtccggcattcaagaagtcgaccgcaccctagccaaagagggaattaagcgcggcgagacggatcaccacgctgtgagccgcggatcagcgaagctgcggtggttcgtggagcggaacctagtcaccccggagggcaaggtagttgacctcggctgcgggcggggtgggtggagctactactgcggcggactgaagaacgtaaaggaggtgaagggcctgaccaagggcgggcccggtcacgaggagccgatacccatgtcaacatacggctggaacctcgtacgcctgcagagcggcgtcgacgtgttctttaccccacccgagaagtgcgacaccctgttgtgcgatatcggggagtccagccccaaccccaccgtggaggccggacgcactctgcgcgtgctcaacttagtggacaactggctaaacaacaatacccaattttgcatcaaggtgctgaacccgtacatgcccagcgtcatcgagaagatggaggccttacagcggaagtacggtggggccctcgtgcgcaaccccctgtccaggaatagcactcacgagatgtactgggtgtccaacgcgagcggtaatatcgtgtccagcgtgaatatgatctccaggatgctgatcaatcggttcactatgcgccacaagaaggcgacctacgagcccgacgtggacctcgggagcggcacccggaacatcgggattgaaagcgagacgcccaaccttgacatcatcggcaagcgcatagagaagatcaaacaagagcacgagactagctggcactacgaccaggaccacccctataagacctgggcctaccacggctcgtacgagaccaagcagacggggagcgcctcctctatggtcaacggcgtggtgcgcctgcttaccaaaccgtgggacgtcatccccatggtaacccaaatggccatgaccgatacgacccctttcgggcagcagcgggtcttcaaggagaaagtggacacacgcacacaggagcccaaggagggcactaagaagctgatgaagatcacagccgagtggttgtggaaggaactcggtaagaagaagacgccaagaatgtgcacacgcgaggaatttactcggaaggtccgctccaacgcggccctcggggcaatcttcacagacgagaacaagtggaagtctgcccgggaggctgttgaggactccggcttttgggaactggtggacaaggagcgcaacctccacctggaggggaaatgcgagacctgcgtgtacaacatgatgggcaagcgggagaagaagctcggggagttcgggaaagcgaagggtagccgcgcaatctggtacatgtggctcggagcgcggtttctcgagttcgaggctctgggcttcttaaatgaggaccattggtttagtcgcgaaaacagcctgagcggggtcgagggcgaggggctacacaagctcggctacattctgcgggatgtgtccaagaaggagggcggggcgatgtacgccgacgacaccgccggttgggatacgcgcatcaccctggaggacctcaagaacgaggagatggtgactaaccacatggaaggggagcacaagaagctggctgaggccatcttcaagctgacataccagaacaaagtagtccgggtacagcggccaacaccccgcggcaccgttatggatataatctcacgccgggaccagcgcggctctggccaagtggtgacctacgggctcaacaccttcactaacatggaggcacagttgatccggcagatggagggggaaggcgtgttcaagtccatccagcagctgacggtgaaggaggaaatcgccgtgaagaactggctcatccgcgtcgggcgcgagcggctgtcccgcatggccataagcggtgacgactgcgttgtgaagcccctggacgaccgtttcgcctccgcactcaccgcgttaaacgatatgggcaaggtccgcaaggacatacagcagtgggagccctctcgagggtggaatgactggacccaggtgccattctgttcccaccattttcacgagctgatcatgaaagacgggcgcgtgctcgtcgtgccctgccggaaccaggacgagctgatcgggcgcgcccggataagccagggcgccggctggtccctgagagagacggcctgtctcggcaagtcctacgcgcagatgtggaacctgatgtacttccatcggcgcgacctgcggctcgcggcgaacgccatatgctccgccgtaccatcacactggatccccacttcccgcaccacgtggagcatccatgcgactcacgagtggatgacgactgaagacatgctaaccgtttggaacagggtatggatccaggagaacccgtggatggaggacaaaacccccgtcgaatcctgggaagaaataccctatctaggcaaacgcgaggaccagtggtgcgggtcgctcataggcctgacgagccgggcgacatgggcaaagaacattcagaccgccatcaatcaggtgcgctccctgattgggaacgaggagtacaccgattatatgccctcgatgaagcggtttaggcgcgaagaggaggaggcgggcgtgctctggtga

SEQ ID NO: 24879 - RNA, 9876 nt, synthetic construct
  misc_feature 1..9876: note = derived and/or modified CDS sequence (opt11) from DENV-2__KM279525__SS-prME
  source 1..9876: mol_type = other RNA
accgccggcatcatcatcatgatgatccccaccgtcatggccttccacctgaccacccggaacggggaaccccacatgatcgtcagccgtcaggagaagggcaagtccctcttgttcaagaccgagaacggagtgaacatgtgcaccctgatggcgatggacttaggcgagctttgcgaggacacaatcacgtacaactgccccctgctcagacagaacgagccagaggacatcgactgctggtgtaacagcacttcgacctgggtgacctacgggacctgcaccgccaccggcgaacaccgacgggaaaagcggagcgtcgccctagtaccccacgtgggcatggggctggagacccgcaccgagacctggatgtccagtgagggcgcctggaagcacgcccagcggatcgagacctggattctccgccacccagggttcaccatcatggcggccatactggcatacaccatcggcactacctacttccagcgggtcctcatcttcatcctcctgaccgcggtgaccccgtccatggccatgaggtgcatcgggataagcaatcgggactttgtggagggcgtctccggcgggagctgggtggacatcgtgctggaacacggctcctgtgtcaccaccatggcaaagaacaaacccacgctcgacttcgagctgatcaagacggaagccaagcacctggccacactccgcaagtactgcgtggaggccaagctgaccaacacgaccaccgcgagtcggtgccccacccagggggagccctccctgaacgaggagcaggacaagcgcttcgtgtgcaaacacagcatggtcgaccgggggtggggcaacgggtgcggcctcttcggcaagggcggaatcgttacgtgcgccatgttcacgtgcaagaagaacatggagggaaaggtggtccagcccgagaacctagagtacaccatcgtgatcacgccccactccggagaggagaacgcggtggggaacgacacaggcaagcacgggaaggagatcaaagtaacgccccagagctccatcacagaggccgagctaaccgggtacggaactgtgacgatggagtgcagcccgcggaccgggctcgacttcaacgaaatggtgttgctgcagatggagaacaaggcctggctcgtccacaggcagtggttcctggacctgcccctcccctggctgcccggcgcggacacccaggggtccaactggatccagaaggagaccctggtgacgttcaagaacccgcacgccaagaagcaagacgtggtagttctcggctcacaagaaggggccatgcacaccgccctgaccggcgctaccgagatccagatgagctccgggaacctcctgttcacgggccacctgaagtgcagactgcgaatggacaagctccagttgaagggaatgagctacagcatgtgcaccgggaagtttaaggtagtgaaggagatagcggagacccagcacggcaccatcgtgatccgcgtccagtacgagggggacggaagcccctgcaaaatccccttcgagatcatggacctagagaagcggcacgtgctcggacgcctgatcacggtgaaccccatcgtcactgagaaggactctccggtcaatattgaggccgagccgcccttcggggacagctacatcatcattggtgtggaacccgggcagctgaagttgtcctggttcaagaagggctcctccatcggccagatgttcgagacgaccatgaggggcgccaagcggatggccatcctgggcgacacggcctgggatttcgggagcctgggcggggtctttaccagcatcggcaaggcgctccaccaggttttcggagccatttacggcgcagcatttagcggagtgtcttggaccatgaagatcctgatcggtgtcgtaattacctggatcggcatgaacagccgctccacgagcctatccgtgagcctggtcctcgtgggggttgtcaccctgtacctgggagtgatggtgcaggctgactccgggtgcgtcgtgagttggaagaacaaggagcttaaatgcggatctggcatctttatcacggacaacgtacacacgtggacggagcagtacaagttccagccggagtcccccagcaagttggcctctgccatccagaaggcccacgaggagggaatctgcggcattagaagtgtcacacgcctggagaacctcatgtggaaacagatcacccccgagctgaatcatatcctgaccgagaacgaggtaaagctcacgatcatgacaggggacatcaagggcatcatgcaggccgggaagcggtcgctgcgcccccaaccgaccgagctgaagtacagctggaaggcctggggcaaagcaaagatgttgagcaccgagctgcacaaccacacgttcctaatcgacggccccgagactgccgagtgccccaacaccaaccgggcctggaacagcttggaggtcgaggactatgggttcggcgtcttcaccacgaacatatggctgaagctgaaggagcgccaggacgtgttctgcgattccaagctaatgagcgccgcgatcaaggacaatagagccgtacacgccgacatggggtactggatcgagtccgcccttaacgacacctggaagatcgagaaggctagcttcatcgaggtcaagtcctgccattggcccaagtctcataccctgtggtccaacggcgtgctcgagtcagagatgatcatccctaagaactttgcgggccccgtgtcccagcacaactaccgccccgggtaccacacccagacagccggaccgtggcacctggggcggctggagatggacttcgacttctgcgagggcaccaccgtagtagtgaccgaggactgcgggaatcgcggcccgtctctacggaccacgaccgcttcgggcaagctgatcacggaatggtgctgccgctcgtgcaccctgccgccactccggtaccgcggcgaggacggctgttggtacggaatggagatccggcccctcaaggagaaggaagagaacttagtcaacagcctcgtgacggccggccacgggcagatcgacaacttctccctgggcgtgctgggcatggctctcttcctggaggagatgcttcgcacacgggtcgggaccaagcacgccatactccttgtggccgtgtccttcgtcatcttaatcaccggcaacatgtcgttccgcgatctcgggcgcgttatggtgatggtgggagccacgatgaccgacgacatcgggatgggcgtaacgtacctggccctgctcgcggccttcaaagtgcggcccaccttcgccgccggcctgctgctccgcaagctgacgagcaaggagctcatgatgaccaccatcgggatcgtacttttatcccagagcacgattcccgagaatatcctggagctcacggacgctctggcgctgggcatgatggtgctcaaaatcgttcggaacatggagaagtatcagctggccgtaaccatcatggccatcctgtgcgtccctaacgcggtgatcctacagaacgcctggaaggtcagttgcaccaccctggcggtggtctccgtgtccccgctcctcctgacgagctcccagcagaaagcagactggatccccctagccttaaccatcaagggcctcaaccccaccgccatcttcctgaccacgctcagccgcacctccaagaagcggagctggccgctgaacgaggccatcatggccgttggcatggtctccatattggccagctccctcctgaagaacgacattccgatgaccgggccactggtggctgggggactcttgaccgtatgttacgtcctgacggggcgcagcgccgatctcgagctggagcgggcggccgacgtgcgctgggaggaacaggccgagatcagcggctccagccccatcctatccataaccatctccgaggacggatccatgagtattaagaacgaggaggaggagcagacccttacaatactgatccgtacgggcctgctcgtgatctccggcctgttccccgttagcatcccaattacagccgccgcttggtacctgtgggaggttaaaaagcagcgcgcaggagtactctgggacgtccccagcccgccgcccgtgggtaaggccgagctggaggacggggcctaccggatcaagcaaaaaggcatcttagggtacagccagatcggtgccggcgtgtataaggagggcaccttccacaccatgtggcacgtcaccaggggcgcggtactcatgcataagggcaaacgcatagagccatcctgggccgatgttaagaaagatttaatcagctacggcggggggtggaagctggaaggcgagtggaaggagggagaggaggttcaggtgctcgccctggagcctggcaaaaacccaagggccgtacaaacgaagcctgggttgttcaaaaccaacaccggcaccatcggggccgtcagtctcgacttcagcccaggcacgtccggtagccccatcgtcgataagaagggaaaggtagtcggtctttatgggaatggcgtcgtaacccggtccggaacctatgtctcagcgatcgcccagaccgaaaagtccattgaggacaacccggagatcgaggacgacatcttccgcaagaagaggctcacgatcatggacctgcaccctggtgccggtaagaccaagcgctacctccccgctatcgtgcgggaggcgatcaagcgcgggctgcgtaccctgatcctcgcacccacccgcgtggtcgccgccgagatggaggaggccttgcgggggctgccaattcggtaccagacgcccgcgatcagagccgagcacaccgggcgggagatagtggacctcatgtgccatgccacgttcaccatgcgcctactgtcccctatcagagtaccaaactacaacctcatcataatggacgaggcacacttcacggaccccgctagcatagcagcccgcggctacatctccacccgggtcgagatgggcgaggccgccggaatcttcatgacagccacgccgcccggcagccgcgaccccttcccgcagtccaatgcccccattatggacgaggagcgggagatccccgagcgctcctggaattccggtcacgagtgggtgacggatttcaagggcaagaccgtctggtttgtcccaagcataaaggctgggaacgacatcgccgcgtgcctgcggaagaacggcaagaaggtgatccaactgtcccgcaagacctttgatagcgagtacatcaagacccggacgaacgactgggactttgtggtgaccaccgacatcagcgagatgggtgcgaacttcaaggccgagcgcgtgatagacccgcggcgctgcatgaagcccgtaatcctcacggacggggaggagcgtgtcatcctggccgggcctatgcctgtgacgcacagctccgccgctcaacgccgggggcgcgtcggccgcaacccgaagaacgagaacgaccagtatatttatatgggtgagccccttgagaacgatgaggactgcgcgcactggaaggaggccaagatgctcctggataacatcaacacgcccgagggcatcatccccagcatgtttgagccggagcgggagaaggtcgacgccatcgacggcgagtacaggctgcgcggggaagcccgcaaaaccttcgtagacctcatgaggcgcggcgacctacccgtctggctggcctaccgagtggcggccgaggggatcaactacgccgaccgccgctggtgcttcgacggcgtgaagaataaccagatactcgaggagaacgtcgaggtggaaatatggacaaaggagggtgaacgcaaaaaactgaagcccagatggctggacgcccggatctactccgacccgctcgcactaaaggagttcaaagagttcgcggcgggccgcaaaagcttgacgctcaacctgatcaccgagatgggcaggctgcccacctttatgacccagaaagcaaagaatgccctcgacaacttagcggtgttgcacacagccgaggccgggggccgggcctacaaccacgcgctctccgagctccccgaaaccctggagaccctcctgctactcacgctgctggcaacggttaccgggggcatattcctattcctgatgagcggcaaggggataggcaagatgaccctggggatgtgctgcatcatcacagcttctatcctcctgtggtacgcccaaatccagccccactggatagccgctagcataattctggagttctttctcatcgttttgctgatcccggaacccgaaaagcagcgaacgccccaagacaaccagctcacgtacgtggtcatcgcgatcctcaccgtggtggcagcgacaatggccaacgagatgggcttcttggagaagacaaagaaggatttcgggctcggctccatcacgacgcagcagcccgagtccaacatcctggacatcgatttgcggccggcatcagcctggaccctatacgccgtggccaccactttcatcacaccaatgctgcgacactccatcgagaatagctcggtgaacgtgtccctgaccgccatcgccaaccaggcgaccgtcctcatgggcctggggaaaggctggcccctgtccaagatggacatcggcgtaccattactggcgatcggttgctacagccaggtgaaccctatcacgttaactgccgccctcctgcttttagtcgcgcactatgcgatcatagggccgggcttacaggccaaggcgacccgagaggcccagaaacgcgcggccgcgggaatcatgaagaaccctaccgtggacgggatgacggtaatcgatttagaccccatcccgtacgaccccaagttcgagaaacagcttggtcaggtcatgctgctggttctctgcgtgacccaggtacttatgatgcggaccacctgggccctgtgtgaggccctcacgctggcaaccggacccatttccaccctgtgggaaggcaatcccgggcgcttctggaataccacgatagccgtctccatggccaacatcttcaggggatcgtacctcgcgggtgccgggctgctattcagcatcatgaaaaacacggcgaacacccgccgcggcaccgggaacacgggcgagacgttgggcgagaaatggaaaaaccggctgaatgcactagggaagtccgaatttcaaatttacaagaagtccggcatccaggaagtggaccgcaccctcgctaaggaggggattaagcggggagagaccgaccaccacgccgtctctcgcgggagcgccaagctgcggtggtttgtggagcgcaacctcgtgacgccggagggaaaggtcgtcgacctcggctgtgggaggggcgggtggtcctactactgcggcgggctgaagaatgtgaaggaggtcaagggtctgactaagggcgggcctggccacgaagagcccatccccatgagcacatacgggtggaatctcgtgcgcctgcagtccggcgtggacgtcttcttcaccccgcctgaaaaatgcgacacgctgctctgcgacatcggggagagctcccccaaccccaccgtggaggctggccgaactttgcgcgtgctgaatctcgtcgagaactggctgaacaacaacacccagttctgtatcaaggtgctgaacccgtatatgcccagcgtgatcgaaaagatggaggccctgcagcggaagtatggcggggccctagtccgcaacccgctgagccgaaactccacccacgaaatgtactgggtgtctaatgcctccggaaacatcgtaagctccgtcaacatgatcagccgcatgctgatcaatcgattcacgatgcgccacaagaaggcgacctacgagccggacgtggacctcgggtccggcacccggaacatcgggatcgagagcgaaacccccaacctagacatcatcggcaagcgcatcgaaaagatcaagcaggagcacgagacgtcctggcactacgatcaggaccatccctacaagacctgggcgtatcacggcagctacgagaccaagcagaccggttccgctagctccatggtgaacggtgtcgtccggctgttaacgaaaccctgggatgtgatccccatggtcacccagatggccatgaccgacaccacgccattcgggcagcagcgggtgttcaaggagaaggtcgatacccgcacgcaggaacccaaggagggcaccaagaagctgatgaagatcacggccgagtggttatggaaagagctcggcaagaagaagacgccccggatgtgcacgcgcgaggagttcacccggaaggtgcgctctaacgcggccctgggggcgatctttacggatgaaaacaagtggaagtccgccagggaggccgtggaggacagcggcttctgggagttagtcgacaaggaacgcaacctccacctggaagggaagtgcgagacttgcgtgtataacatgatgggcaagagggagaagaagctgggggagttcggaaaagcgaagggctcccgcgccatctggtatatgtggctcggggcccggttcctggagttcgaggcactgggcttcctcaatgaggaccactggttcagccgcgagaactccctgtctggtgtcgagggggaggggctgcacaagctcggttacatcctgcgggatgttagcaaaaaggagggaggggcgatgtacgccgacgacaccgctggctgggacacccgcatcacgctggaggacctcaagaacgaggagatggtgacgaaccacatggagggggagcacaaaaagctggccgaggccatcttcaagctgacatatcagaacaaggtggtccgggtacagagaccgacgcctcggggcacagtgatggacatcatctcccgccgggaccaacgcggcagcgggcaggtggtgacctacggcttaaacaccttcaccaacatggaggctcagctgatccggcaaatggagggggagggcgtgttcaaatccatacagcagctgacggtcaaggaggagatcgccgtgaaaaactggctgatacgtgtggggcgcgaacggctgagccgtatggccatctctggcgacgactgcgtagttaagcccctggatgaccgtttcgccagcgccctcaccgctctgaacgacatgggcaaggtgcggaaagacatccaacagtgggagccctcccgggggtggaatgactggacccaggtcccgttctgcagccaccacttccacgagctgatcatgaaggacggaagagtgctcgtggtcccctgccgaaaccaggacgagctgatcgggcgcgcccggatctcccagggcgccgggtggtccctgcgcgagaccgcctgcctcggcaaatcctacgcccagatgtggtcactgatgtatttccatcggcgcgacctgcggctcgcagccaacgccatctgctctgctgttccctcccactggatccccacgtcccgcaccacgtggtcgatccacgcgacgcacgagtggatgaccacggaggacatgctgaccgtgtggaaccgggtctggatccaggagaacccgtggatggaggacaagacccccgtggagtcttgggaggagataccctacctgggcaagcgcgaggaccagtggtgcgggagcttaatcggactgaccagccgggcgacgtgggccaagaacatccagacagccatcaatcaggttcggtcacttatcgggaacgaggagtacaccgactacatgcccagcatgaagcggttccgcagagaggaggaggaagctggcgtgctgtggtga

SEQ ID NO: 24880 - RNA, 9876 nt, synthetic construct
  misc_feature 1..9876: note = derived and/or modified CDS sequence (opt11) from DENV-2__KM279528__SS-prME
  source 1..9876: mol_type = other RNA
acagcgggcatcataatcatgatgatccccaccgtaatggcctttcatctaaccacccggaatggggaaccccacatgattgtaagccggcaggaaaagggcaagagcctcctctttaagacggagaatggggtgaacatgtgcaccctgatggcgatggatctcggcgagctctgtgaggacaccatcacctacaactgtcccttgctccgccagaacgagcccgaggacatcgactgctggtgcaatagtacaagcacctgggtgacctacggaacctgcaccgccaccggcgagcaccggcgcgaaaagcggagcgttgccctggttccccacgtcggtatgggtttggagacgcgaaccgagacctggatgagcagcgaaggtgcctggaaacacgcacaacggatcgagacctggatcttgagacaccccgggttcacgataatggcggccatcctagcctataccatcggcaccacctacttccagcgggtcctgatcttcatcctcttgacggcggtgaccccctcaatggcgatgagatgcatcgggattagcaaccgggactttgtggagggcgtctccggagggagctgggtggacatagtgctggagcacggctcatgcgtcacgaccatggcgaagaacaagcctacgctcgactttgaactgatcaagaccgaagccaagcacctagctacgctccgcaagtactgtgtggaggctaagctgacaaacacgaccaccgcgagccggtgtcccacacagggggagccatccctgaacgaggagcaggacaagcgctttgtgtgtaagcactcgatggtcgaccggggctggggcaacgggtgcggcctattcgggaaaggagggatcgttacatgcgccatgttcacgtgcaagaagaacatggagggcaaggtggtacagccggaaaacctggagtatactatcgtgataactccccactcgggcgaggagaatgccgtcgggaatgacacgggcaagcacgggaaggagatcaaagtcaccccgcagagctccatcaccgaggccgagttgacgggatacgggactgttacgatggagtgctctcctcgcaccggcctcgacttcaacgaaatggtcctgctacagatggagaacaaggcttggctcgtccaccgccagtggttcttagacctgcccctcccctggctgcccggcgcggatactcaggggtccaactggattcaaaaggaaaccttggtaacctttaagaacccccatgccaagaaacaggatgtggtggtgctcggcagccaggagggggcgatgcacaccgccctgacgggcgcaaccgaaatccagatgtcgagtgggaatctcctgttcacggggcacctgaagtgccgactccggatggacaaactccagctgaagggtatgagctacagtatgtgcaccggtaagttcaaggtagtgaaggaaatcgccgagacacaacacggcaccatcgtgatcagggtccagtatgagggggacgggagcccctgcaagattcccttcgagatcatggacctggagaaacggcacgtcctaggccgcctgattacggtgaaccccatcgtgactgaaaaagactcgccagtaaacatcgaggcagagccgcccttcggagacagctacatcataatcggagtggaacccgggcaactcaagctctcttggttcaagaagggcagcagtatcgggcagatgtttgagactaccatgcgcggagccaagcgaatggccatcctcggcgacactgcctgggacttcgggagcctcgggggcgtctttacctccatcggcaaggcgttacaccaagtgttcggggccatctacggtgccgcgttttctggcgtgagttggaccatgaagatcttgattggggttgtgatcacctggatcggcatgaacagccggtccacgagcttgtcggtcagcttagttctcgtgggggtggtcaccctgtaccttggagtgatggtgcaggctgactccgggtgcgtcgtctcatggaagaacaaggagctcaaatgcggttctggcatcttcatcaccgacaacgtgcacacctggacagagcaatataagttccaaccggaatcgccgagcaagctggcctcggccatccagaaggcccacgaggaggggatctgcggcatccggagcgtcacacgactggaaaacctcatgtggaagcagatcactccagagttaaaccacattttaaccgagaatgaggtgaagctcacgatcatgactggggatatcaagggcatcatgcaagccgggaaacggtccctgcgtccgcaaccgactgagctgaagtacagctggaaggcatggggcaaagccaaaatgctctccaccgaactgcacaaccacacgtttctgatcgacggacccgagaccgcggagtgccccaacactaaccgagcatggaacagcttagaggttgaggactacgggttcggcgtcttcactactaacatctggctaaaactgaaggagcgccaggatgtgttctgcgactccaagctcatgagcgctgcgatcaaggacaaccgcgccgtgcacgcagacatgggctactggatcgagtccgctctgaacgacacatggaaaattgagaaggccagctttatagaggtcaaatcctgccactggcccaaaagccacaccctctggtccaacggtgtgctcgagagcgagatgatcatccccaagaacttcgcaggccccgtgtcccaacataattaccgccccgggtatcacacccagactgcaggcccgtggcaccttgggcggctggaaatggacttcgatttctgcgaggggacgactgttgtggtgacagaggactgcggcaaccgcggcccttcgctacgaaccacaaccgcatcaggcaaacttatcaccgagtggtgctgcaggtcctgtaccctgccgccgctccggtaccgcggggaagacggctgttggtatggaatggagatccggccgctgaaggagaaggaggagaacctggtcaacagcctcgtgacggccggccacgggcaaatcgacaacttctctttaggcgtgctaggcatggccctcttcctggaggagatgctcaggacccgcgtcggcaccaagcacgccattctccttgtggccgtgtcttttgtcaccttaatcacaggaaacatgtccttccgtgacctcggccgtgttatggttatggtcggcgccaccatgacagacgatatcgggatgggcgtgacctacctggccctgttagcggcctttaaggtgaggcccactttcgccgccgggctgctgctacgcaaactgacctcaaaggagctgatgatgaccaccatcgggatcgttctcctatcccagtctacgatccccaagtccattctggaattaaccgatgcccttgcgttaggcatgatggtgttgaaaatcgtgcgaaacatggagaagtaccagctcgctgttactatcatggccatcttgtgtgttcccaacgcagtcattttgcagaacgcctggaaagtgagttgtacgactttggcagtggtctccgttagcccgctcctattaaccagctctcagcagaaggccgactggatcccattggccctgacgatcaagggactgaacccgaccgctatattcctgacgaccctcagccgcacgtcaaagaagcggtcctggcccctcaacgaggcgatcatggccgtggggatggtcagcatactagcctcgagcctgctaaagaacgacatcccgatgaccggccccctggtggccgggggcctcctgaccgtctgctacgtcctgacggggcggtcagccgatctcgagctggagcgcgcggcggacgtgcgctgggaggagcaggccgagatctccggcagttcacctatcctatccatcaccattagcgaggacggaagcatgtccatcaagaacgaggaggaagaacagaccctcacgatcttaatcaggaccggtctgcttgtgatcagcggcctgttcccagtctctatcccgatcacggccgccgcgtggtacctctgggaagtcaagaagcagcgcgccggggtgctctgggacgtcccctccccgccgcccgtgggcaaggcagaactggaggatggtgcctaccggattaagcagaaggggattctcgggtactcccagatcggcgccggtgtatataaagaggggactttccataccatgtggcacgtcacgcgcggggcggtgctcatgcacaaggggaagcgtatcgaaccttcatgggccgacgtgaagaaggacctgatctcctatggcgggggctggaagctcgagggagagtggaaggaaggggaagaagtacaggtgttagctctggaaccaggtaagaatccgcgtgccgtgcagaccaaacccgggctttttaagaccaataccggcacgattggggccgtcagtctcgacttctcaccaggcaccagcggatcccctatcgtggacaaaaagggaaaagtggtcggactgtacggaaacggagtggtgacccggagcggcacctacgtctcagcgatcgcccagacggaaaagtccatcgaggacaacccagagatcgaggatgatatttttcgcaagaaacgactgacgataatggacctgcaccccggggcaggcaagaccaagaggtatctccccgctatcgttcgggaggcgatcaaaagagggctacggaccctgattctcgccccgactcgcgtggtcgcagccgaaatggaggaggccctgcgcgggctgcctatccgataccagactcccgcgattcgtgccgaacacactgggcgggagatcgtggacctcatgtgccatgccaccttcaccatgagactgctgtcccccatccgggtgccgaactacaacctcatcatcatggacgaggcccacttcaccgacccggcttccatcgcggcccgcggctatattagcacgcgggtagagatgggagaagccgccggaatattcatgaccgccacccctccaggctcccgcgacccctttccgcagagcaatgcgcctatcatggacgaggagcgggaaatcccggagcgctcatggaactctgggcatgagtgggtaaccgacttcaagggcaagactgtttggttcgtaccctccatcaaagctgggaacgacatcgccgcctgcctgcggaagaacggcaagaaggtgatccagctgtcacgaaagacgttcgactcagagtacatcaaaacgcggacgaacgattgggacttcgttgtcaccaccgatatcagcgaaatgggcgcgaactttaaggcggagcgcgtgatagacccgcggcggtgcatgaaaccggtgatactcactgacggggaggagcgggtcatcctggccggccccatgccagtgacccactccagcgccgctcagagacgggggagagtggggcgcaacccgaagaacgagaacgatcagtatatttatatgggagagcctttggagaacgacgaggactgcgcgcactggaaggaggctaaaatgctcctggataacataaacacgcctgaagggatcatcccctccatgttcgaaccagaaagagagaaggtcgacgctatcgatggcgagtacaggttacgcggtgaggcccgtaaaaccttcgtggacttaatgcggagaggggacctacccgtttggctagcctatagagtcgccgccgaggggatcaactatgccgatcgtcggtggtgtttcgacggcgtgaagaacaatcagatcctcgaggagaacgtagaagtggaaatctggacgaaagagggtgaacgcaagaaactcaaaccgagatggctggacgcccgcatctacagcgacccgctcgccctgaaagagttcaaagagttcgcggccggacgcaaatccctaaccctgaacttaattaccgagatgggccgcttgcccacctttatgacgcagaaggccaaaaacgccctcgacaatctggcggtgctgcataccgccgaggcaggcggccgtgcttacaaccacgcccttagcgagttgcccgaaactctggaaactctcctcctgttaacgctgttagctacagtgaccgggggcatcttcctgttcctaatgtccggcaaggggatcggcaagatgaccttagggatgtgctgcatcattaccgccagcatactcctatggtacgcccagatccagccccactggatcgccgcctcgatcatcctggagttcttcttgatcgtgctgctgattcccgagcctgaaaagcaacgcactcctcaggacaatcagctcacctatgttgtcatcgcgatactgaccgttgtggccgcaaccatggccaacgagatgggcttcctggagaagacgaagaaggacttcgggctaggaagcatcaccacccaacaacctgagtcaaacatacttgacatcgacctgcggcccgcctccgcgtggacactctacgccgtcgccacgacctttatcacccccatgctgcgccacagcatcgagaactccagcgtgaacgtgtcactaaccgccattgccaaccaggcgacggttctaatgggcttggggaagggctggcctctgagcaagatggatatcggggtacccctcctggccatcggctgctactcccaggtcaacccgattacgctgactgccgccctcttgctattagttgctcactacgcgataatcgggccgggcctgcaagccaaggcgacccgagaagcccagaagcgcgctgccgccggcattatgaaaaatccaaccgtggatgggatgaccgtgatagacctagaccccatcccgtatgacccgaaatttgagaaacaactcgggcaggttatgctgttagtgctgtgcgttacccaggtcctgatgatgcggaccacatgggcgttatgcgaggccctcactctggcaacggggcccatcagtacactgtgggagggcaaccccgggcggttttggaacacaaccatcgccgtgtccatggcaaacatcttccgcggcagctatctcgccggcgccgggctgctgttctctattatgaagaataccgcaaacactcggcgcggcaccggcaacacgggcgaaaccctcggggaaaagtggaagaatcggttaaacgccctgggcaaatctgagttccagatctacaagaagtctggcattcaggaggtggaccgcacactcgccaaggagggcattaagcggggcgaaacggatcatcacgccgtctcacgcgggtccgcgaaactgcggtggttcgtggagaggaacctggtgacaccagagggcaaggtcgtggacctcggctgcgggcggggcggctggagctactactgtggcgggttgaaaaatgtaaaggaggtcaaggggctgaccaaaggcggtcccggccacgaggagcccatacccatgtccacctacggttggaatctcgtccgcctgcagagcggggttgacgtcttctttacgccgcctgagaagtgcgataccctgctctgcgatataggggagtcgagccccaaccccaccgtggaggccggccggaccctgcgcgtgctcaacctagtcgaaaactggctgaacaacaacacccaattctgcataaaagtgctaaatccgtacatgcccagtgtgatcgagaagatggaggccctgcagaggaagtacggcggggcgcttgtccgcaaccccctgtcgagaaacagcacgcatgagatgtattgggtgtcgaacgcgagcggtaacattgtgtctagcgtcaacatgatctcccgtatgttaatcaaccggttcaccatgagacataagaaggcgacttacgaaccggacgtagaccttggaagcggcacgcgcaacatcgggatagaatccgagacgcccaacctagacatcatcggcaagcgcatagagaagataaagcaggagcacgagacgtcttggcactacgaccaggaccacccatacaagacctgggcgtaccacggctcctatgagaccaagcagacagggagcgctagtagtatggtgaacggcgtcgtcagactgctcaccaaaccttgggacgtgattccgatggtcacccaaatggccatgaccgacacgacgcccttcggacagcagagggtgttcaaagagaaggtcgacacacgcacccaggagcccaaggaagggacaaagaagctgatgaagatcaccgccgagtggctttggaaagaactcggcaaaaagaagacgccgcggatgtgcacgcgcgaggagttcacgcggaaggtgcgctccaatgcggctcttggggcaatcttcacagacgaaaacaagtggaaatcagcccgggaggccgtggaagactccggcttttgggaactggtcgataaggagcggaatctacacctggaggggaagtgcgagacctgcgtgtataacatgatgggcaagcgcgagaagaagctgggggagttcggcaaggcgaaggggagccgcgccatctggtacatgtggctcggggcccggtttctggaatttgaggctctgggcttcctgaatgaggatcactggttttcccgcgaaaatagcctgagcggggttgaaggcgaagggctacacaagttaggctacatactacgggacgtatccaagaaggaaggaggggcgatgtacgccgatgacaccgccggctgggacacgcgcataaccctggaggaccttaaaaacgaggaaatggtaaccaaccacatggaaggggagcacaagaaactggccgaagctatcttcaaactgacttaccagaacaaggtggtccgggtgcagaggccgacgccacggggcaccgtgatggacataataagccgccgggaccagcgcgggtcgggccaagtagtgacctacggcctcaacaccttcacgaatatggaggcgcagctgatacgacagatggagggggaaggcgtattcaagagcatacagcagttgaccgtcaaggaggagatcgccgtgaagaactggcttatccgcgtcgggagagaacgcctctcccgcatggccatctctggtgacgactgcgtcgtgaagcccctggatgatcggttcgcctccgcgttaacagctctgaatgacatgggcaaggtgcggaaggacatccaacagtgggagcccagccgcgggtggaacgactggacccaggtccccttttgttcccaccactttcacgagctcattatgaaagacggccgtgtgctcgtggtaccgtgtcggaaccaggacgagttgatcgggcgcgcccggataagccagggcgcaggatggtccttgcgcgagactgcctgtttgggcaagagctacgcgcaaatgtggtccctcatgtacttccaccggagagatctgcggctcgcggccaacgctatctgctccgcggtgccctcccactggatacccactagccgaacaacgtggtcgatccacgcaacacacgagtggatgacgacggaagatatgttgaccgtgtggaaccgcgtctggatccaggagaacccgtggatggaagacaagacccccgttgagagctgggaggaaattccctacctgggcaagcgcgaggaccaatggtgcggttcgctcattgggctgacatcgcgggcgacctgggccaagaacatccagacggccatcaaccaggtccgcagcctaatcgggaatgaggagtacaccgactacatgcccagcatgaagcggttccggcgcgaggaagaggaggctggcgtgttgtggtga

SEQ ID NO: 24881 - RNA, 9876 nt, synthetic construct
  misc_feature 1..9876: note = derived and/or modified CDS sequence (opt11) from DENV-2__KM279533__SS-prME
  source 1..9876: mol_type = other RNA
accgcggggatcatcatcatgatgatccctaccgtgatggccttccacctgaccacccggaacggagagccccacatgatagtcagtcggcaggagaaaggcaaaagcctcctgttcaagacagagaacggcgtgaacatgtgtaccctgatggccatggacctcggcgaactgtgtgaggacactattacctataactgcccgctgctgcgtcagaacgaacccgaggacatagactgctggtgcaacagcacatcaacatgggtgacatacgggacgtgcacagcaacgggcgagcaccggcgcgagaagaggagcgtcgcgttggtaccccacgtgggcatgggtctggagaccaggaccgagacctggatgtcgagcgaaggtgcctggaagcacgcccaacgtatcgagacctggattctccgccaccccgggttcacgatcatggcggcgattctggcctacaccattggaaccacttacttccagcgggtcctaatcttcatcctcctgacggctgttaccccctccatggcgatgcgctgcattggtatcagcaaccgggacttcgttgagggcgtatcaggcggcagttgggtcgacatagtgctagagcacgggtcctgtgtgaccactatggccaagaacaagcccacgctcgatttcgagctaatcaagaccgaggccaagcacctcgccaccctccgcaagtactgcgtggaggccaagttgaccaacacgaccaccgcgtcgcggtgccccacccagggtgaaccctcccttaatgaggagcaggacaaacgcttcgtttgcaagcactctatggtcgaccggggctggggcaacgggtgtggcctcttcgggaaaggcggcatcgtgacgtgtgcaatgttcacgtgcaaaaagaacatggaaggcaaggtggtccagcccgaaaacctggaatataccatcgtcatcactcctcattccggagaggagaacgcagtggggaacgatacgggaaagcacgggaaggaaatcaaggtcaccccccagtcttccataaccgaggcggaactgactggctacgggaccgtgacgatggagtgcagcccgagaaccggtctcgacttcaacgagatggtgctgctgcagatggagaacaaagcctggctcgtccaccggcagtggttcttggacctgcccctcccctggctgcccggcgcggatacccaagggtcgaactggattcagaaggagacgctggtgacgttcaaaaacccgcatgccaagaagcaggacgtggtggtactgggcagccaagagggcgccatgcacaccgccctaaccggcgccaccgaaatccagatgtcgtccgggaacctcctttttacgggccatctgaaatgccgcctcagaatggacaagctccagctgaagggcatgtcgtactccatgtgcactgggaagttcaaggtcgtaaaggagattgctgaaacgcagcacggcacaattgtgatacgtgtccagtacgagggggacggcagcccctgcaaaatccccttcgagattatggacctggagaagaggcatgtgctgggcaggctgatcacggtgaaccccatcgtcacggagaaggactccccggtgaatatcgaagccgagccgccttttggcgactcttacattatcattggcgtggagcccgggcagctgaaactctcctggttcaagaagggcagctccattgggcagatgttcgaaaccactatgcgcggtgcgaagcggatggccattctgggggacacggcctgggactttggctcgctaggcggggtcttcacgtccatcggcaaggcgctccaccaggtattcggggcgatttacggcgccgctttcagcggtgtgtcatggaccatgaagatcctgataggggtagtgatcacgtggatcggcatgaacagccgctccacaagcctgtcagtgagcctggtcctcgtgggtgtagtcacattatacctcggcgtcatggtgcaagcggatagtggctgcgtcgttagctggaagaataaagagctcaagtgcggcagcggcatcttcatcaccgacaacgtgcacacctggacggagcagtacaagttccagcctgagtcgccctctaaactagcgtcggcaatccaaaaggcccacgaggaggggatatgcggcatcagaagcgttacacgcctagagaatctgatgtggaagcagatcactcccgagctgaaccatatattaaccgagaatgaagtaaagctcaccatcatgaccggggacataaaggggatcatgcaggccgggaaacgatcactgcgcccccagcctaccgaactgaagtatagttggaaggcatggggcaaggctaaaatgctctccacagagctgcacaaccatacgttcttgatcgacggccctgagactgcggagtgccccaataccaaccgggcctggaacagtctcgaggtggaggactatgggttcggcgttttcactaccaatatctggctcaagctaaaggagcgccaggatgtgttttgtgactccaagctcatgagcgccgcgatcaaggacaaccgggcagtgcatgccgacatgggatactggatcgaatcagccctgaatgacacctggaagatcgagaaggcctcattcatcgaggtcaagtcctgtcactggcccaaatcccacaccctgtggtcgaacggggtgctagagagcgagatgatcataccgaagaactttgcaggccccgtgtcccagcacaattaccgccctgggtatcacacccagaccgctggcccgtggcacctcgggcggctggagatggacttcgacttttgcgaagggacgaccgtagtggttaccgaggactgcgggaaccgtggccccagcctcagaacaacgacagccagcggcaagctgatcaccgagtggtgctgccgctcatgcaccttaccgcccctccggtaccgcggagaagacggctgctggtacgggatggagatccggcccctgaaggagaaggaggagaacttagtaaacagcctcgtgacggctggccatgggcagatcgacaacttctccctgggcgtgcttggcatggccctcttcctcgaagagatgctgcgcacgagagtcggaactaagcacgccatcctcctagttgctgtgagcttcgtcacgttgatcacgggcaacatgtccttcagggacctcgggcgcgtaatggtaatggtcggcgcgacaatgaccgacgacatcgggatgggcgtgacctacctagcactgctcgcggccttcaaggtgcggccaacttttgctgccggcctgctgctccgcaaactgaccagcaaggagttaatgatgaccaccatcggaatcgtactcttatcccagtccaccatcccggagtctatcctggaactcacagacgcattggccctgggcatgatggtgctcaagatcgtccggaatatggaaaagtaccaactggccgtaaccataatggccatcctgtgcgtgcccaacgccgtaatcttacaaaacgcctggaaggtgagctgcaccacgctggcggtggtctccgtgagcccgctgctcctgacctcctcacaacagaaggccgattggatacccttagccctcaccatcaagggtctaaacccgactgctatcttccttacaaccctgtcccgcacgagcaagaagagatcctggccactgaatgaggcgatcatggccgtggggatggtcagcatactcgcctccagcttgctgaagaatgacatcccgatgaccggccccctggtagccggtggcctcttaacggtgtgttatgtactgaccggacgcagcgctgacctagagttagagcgggcagccgacgtgcgctgggaggagcaggccgagatctcgggcagctccccgatcttgagcataaccatatccgaggacgggtcaatgtccatcaagaacgaggaggaagagcagaccctcactattctgattaggaccggcctgctcgtgatcagcgggttattccccgtctccatccctatcaccgccgccgcgtggtacctgtgggaagtaaagaagcagcgcgccggggtactctgggatgtccccagtccgcccccagtcggcaaggccgagctcgaggacggggcttaccgtatcaagcagaaagggatcctggggtactcacagatcggcgcgggcgtatataaagagggcacctttcacacgatgtggcacgtcactcgcggtgcggtgctcatgcacaagggtaagcggatcgagccctcatgggctgacgtgaagaaggatctgatcagttacggcggcgggtggaagttagagggcgagtggaaggagggcgaggaggtgcaggtactcgccctggagccgggcaagaacccgagagcggttcagaccaaacccgggctgttcaagaccaatacaggcacgatcggggccgtcagcttggatttctcccccgggacctcgggctcccccatagtcgacaagaaggggaaagtggtgggcctgtatgggaacggcgtggtgacacggagcggcacctacgtctccgcgatcgcgcaaacggagaagtccattgaggacaaccccgaaatcgaagacgacatcttccgcaagaaacggctcacgatcatggacctgcaccccggggcaggcaagaccaagcgatatctacccgccatcgtgcgtgaggcgatcaagcgcgggcttcggacattaattcttgcccccacgcgcgtggtcgctgcagagatggaggaggcactgcgcggcctaccaatccggtaccaaacccccgccatccgagcggaacacaccgggcgtgagattgtcgacctcatgtgccacgccacctttacgatgcgcctgctgagcccgattcgggtcccgaactacaacctcattatcatggacgaggcccacttcaccgacccggccagcatcgctgcacgcggttacatcagcacccgagtcgagatgggcgaagccgccggaatcttcatgaccgccacgcctcccggctcacgcgatcccttcccccagagcaacgcgcccatcatggacgaggagagggagatccccgagcgctcgtggaacagcgggcacgagtgggtgaccgacttcaagggaaagaccgtgtggttcgtaccctccatcaaggccgggaacgacattgccgcctgtctgcggaaaaacggcaagaaggtaatccagctgagccgtaagaccttcgactccgagtacataaaaacacggacgaacgactgggatttcgtggtcaccacagacatcagcgagatgggagcgaacttcaaggccgaacgcgttatagatccgcggcggtgtatgaagcccgtgatccttaccgacggggaagagcgggtcatccttgccggccccatgccggttacccactccagcgccgcccagcgacgggggcgcgtgggcaggaaccccaaaaacgagaacgaccagtacatctacatgggggagccgctggagaacgatgaagattgtgcgcactggaaggaggcgaagatgttactggacaacattaatacacccgagggcatcatcccgtctatgttcgaaccggagcgggaaaaggtcgatgccatcgacggcgagtaccggctgcgcggggaggccaggaagacctttgtagacctcatgcggcgcggcgacctgccggtctggctggcctaccgcgtggcggccgaggggatcaactacgccgaccgccggtggtgcttcgacggtgtcaaaaataatcaaattctcgaagagaacgtcgaggtcgagatctggacaaaggagggcgaaaggaagaagctaaaacctcggtggctcgacgcaaggatttacagcgatccgctcgccttgaaagagttcaaggaattcgcggccggccggaagtcgcttacactcaacttaataactgagatgggccgcttgccaacattcatgacacagaaggcgaagaacgctctcgacaacctggcggtgcttcataccgcggaggcggggggtcgggcctacaaccatgccctcagcgaattgccagagacactcgagactctcttgctgctcactctgctggcgaccgtcaccggggggattttcctctttctgatgagtggcaaggggatcggaaagatgactctggggatgtgctgcatcatcaccgcgagtatccttttatggtacgctcagatccagccccactggatcgccgcctcaattatcctggagttcttccttattgtcttgctgatcccggagcccgagaagcagcgcacaccccaggacaaccaactcacctacgtggttattgcgatcttgaccgtggtggctgcgaccatggccaacgagatgggcttcctggagaagacgaagaaggacttcggactcgggagcatcaccactcagcagcccgagagcaatatcttagacatcgacttgcgtccagccagcgcgtggactctctacgccgtcgccacaaccttcatcacccccatgctgagacactctatcgagaactccagcgtgaatgtctccctgaccgccatcgcaaaccaagcgacggtcctcatgggcctgggcaagggctggcccctgagcaagatggacattggggtacccctcctagccatcgggtgctactcccaggtaaacccgatcactcttaccgccgccctcttgttactcgtcgcacactacgctataatcgggcccggcctgcaggcaaaggccacccgtgaagcccagaagcgggccgcagccgggattatgaagaacccaacggttgacgggatgaccgtgatcgatctggaccccatcccgtacgatcccaagttcgaaaaacagttaggccaggtcatgctgctggtcctctgcgtgacacaggttctgatgatgcgcaccacatgggccctgtgcgaggccttaaccctagcgaccgggcccatctctaccctatgggagggcaacccggggcgtttctggaacacaaccatcgctgtgtccatggcaaacatcttcagaggctcctacctcgccggggccgggctgctgttctccatcatgaagaacactgccaatacccggcgaggcactgggaacaccggcgaaaccctcggtgagaagtggaagaaccggctgaacgctctaggaaaaagcgagttccagatctacaaaaaatccgggatccaggaggttgaccgcacgctagctaaggaggggatcaaacgcggcgagacagatcaccacgccgtgagccgggggtccgctaagcttcggtggttcgtggagcgcaacttagtgaccccggaaggaaaggtcgtggacctcggctgcggtagaggcggttggtcatattactgtggggggcttaaaaacgtgaaggaggtcaagggcctgactaagggcgggcccggccatgaggaacccatcccgatgtccacctacgggtggaacctcgtgcggctgcaaagtggcgtggacgtgttcttcacgccgcccgaaaaatgtgacaccctgctctgcgacattggtgagtcgagccccaaccccactgtggaggccggccggaccttacgcgtgctgaacctagtggaaaactggctgaacaacaacacacagttctgtatcaaagtgttaaacccatacatgccatccgtgattgagaagatggaggcactgcagagaaaatatggcggggccttagtccgcaatccactgtcccggaacagcacgcatgaaatgtattgggtgtccaacgccagcggcaacatcgtatcctccgtgaacatgatttcccgcatgctaataaaccgattcaccatgcgccacaagaaggcgacctacgagccggacgtggacctgggtagtggcacacgcaatattggaattgagtccgagacccccaacctggacatcattggcaaaagaatcgagaagatcaaacaggagcacgagacgtcgtggcactacgaccaggatcacccctacaagacctgggcctaccacggctcctacgaaacgaagcaaacgggtagcgcctcaagcatggtcaacggcgtggtgcgcctgctcacaaagccctgggacgtgataccgatggtcacccagatggccatgaccgacacgacccccttcgggcagcagcgggtgtttaaagagaaggtagatacccgtactcaggagccgaaggagggcacaaagaagctgatgaaaatcactgcggagtggctgtggaaggagttgggcaagaagaagacgccccggatgtgtacccgtgaggagtttactcggaaggtgcggtcgaacgcggcgctgggggccatcttcaccgacgagaacaagtggaagtccgcccgggaagccgtcgaggactcaggcttctgggagctcgttgacaaggagcgcaacctccatctggagggtaagtgtgagacctgcgtatacaacatgatgggcaagcgcgagaagaaactcggcgagttcggtaaggccaagggcagccgtgccatctggtacatgtggctcggggcccggttcctggagttcgaggcgctgggattcctcaacgaagaccactggttctccagggagaatagcctgagcggggtagaaggcgaggggttacacaaactaggctacattttgcgggacgtctcaaagaaggagggaggggcgatgtacgctgacgacaccgccggctgggacacacgcatcaccctggaggacctgaagaacgaggaaatggtgaccaaccacatggaaggagagcacaagaagctggccgaggcaatcttcaaactgacgtaccagaacaaggtcgtgcgggtccagcgcccaacgccccggggcactgtcatggacatcatcagccgacgggaccaacgcgggtccggccaggtcgtcacctacggcttaaacaccttcacaaatatggaagcccaactaatccggcagatggagggggaaggcgtgttcaagagcatccaacaactgaccgtaaaggaagagatcgcagtgaaaaattggctcatacgggttggtcgcgagcggctgtccagaatggccatcagcggcgatgactgtgtagtgaagcccttagatgaccggttcgcctccgccctcacagcgctaaacgacatgggcaaagtgcgcaaggacatccagcagtgggagccgtctcgcgggtggaacgattggacccaggtcccgttctgctcccaccacttccacgagctgatcatgaaagacggacgcgtgctcgtcgtcccctgccggaaccaagacgagctcatcgggcgtgcccggatatcgcagggcgctgggtggtcactgcgcgagacggcctgcctcggcaagagctacgcccagatgtggtccctgatgtactttcacaggcgcgacttacggctggctgcaaatgccatctgcagtgcggtaccgagtcactggattcccaccagccgtaccacatggtccatccacgccacccatgagtggatgacgactgagaacatgctgacggtgtggaaccgggtctggatccaagagaacccgtggatggaagacaagacgccggtggagagctgggaggagataccgtacctggggaagcgcgaagaccagtggtgcgggagcctcatcggcttgacctcccgggcaacttgggccaagaacatccagactgcgatcaatcaggtgcgcagcttgatcgggaacgaggagtacaccgactacatgccctctatgaagcggttccgccgcgaagaagaggaggccggcgtgctctggtag

SEQ ID NO: 24882 - RNA, 9876 nt, synthetic construct
  misc_feature 1..9876: note = derived and/or modified CDS sequence (opt11) from DENV-2__KM279535__SS-prME
  source 1..9876: mol_type = other RNA
acggcgggaatcatcattatgatgatacccactgtgatggccttccacctgaccactcggaatggggagcctcatatgatcgtaagccgccaggagaaagggaagagcctcctgttcaagacagagaacggcgtgaatatgtgcaccctgatggcgatggacctcggcgagttatgcgaggacaccataacctacaactgcccactgttgcgacagaacgagccagaagatatagattgctggtgcaatagcacttccacctgggtaacatacgggacctgcaccgccaccggcgagcatcgccgcgagaagcggagcgtggccctggtgccccacgtgggcatggggctggagacccgcaccgagacttggatgagcagcgagggcgcttggaagcacgcccagcggatcgagacctggatcctgcgccatcccgggttcacgatcatggcggccattttagcctacaccatcggcacgacctactttcaacgggtcctgatatttatccttctgacggccgtcaccccctcaatggcgatgcgatgcatcggtatctcaaaccgggacttcgtggagggtgtatccggcggaagctgggtcgacatcgtgctggagcacggctcctgtgtaaccacgatggccaagaacaagcccactctcgatttcgagttaatcaaaaccgaggccaagcacctagctacgctccgcaaatactgcgtagaggccaagctcaccaacacgaccaccgcgagccggtgccccacacagggggagccctccttaaatgaagagcaggataaacgcttcgtgtgcaagcactcaatggtcgaccggggctggggaaatgggtgcggccttttcgggaagggcgggattgtgacttgcgccatgtttacatgcaagaagaacatggagggtaaggtggtccagcccgagaacttggagtacactatagtgatcacgccccattccggcgaggagaacgccgtagggaacgacacgggaaagcacgggaaggagatcaaggtaacccctcagagctctatcaccgaggccgagctgaccggctacgggaccgtgactatggaatgcagccctcgcaccggcttagacttcaacgagatggtgctgctgcagatggagaataaggcgtggctagtccaccgccagtggttcctcgacctgcctcttccctggctgcccggagccgacacccaggggtccaactggatccagaaggagacccttgtgaccttcaagaatccgcacgccaaaaagcaggacgtcgtggttttgggcagccaggagggagccatgcacaccgcccttaccggcgccaccgagatccagatgagctccggaaacctcttgttcacggggcacctgaagtgccgcttacgcatggataaactccagttgaagggcatgagctactccatgtgcaccggcaagttcaaagtcgtgaaggagatcgcggagacccagcacggaaccatcgtgatccgcgtccaatacgagggggacggcagcccttgcaagatccccttcgaaatcatggacctggagaagcggcacgtgctcggacggctcatcactgtaaacccgatagttaccgagaaggactccccggtgaacatcgaggcggagccgcccttcggggatagctacattatcatcggagtagaacccgggcaactgaagctatcctggtttaaaaagggcagctccatcgggcaaatgtttgagaccaccatgcgcggcgcgaagcgaatggccattctgggagacactgcgtgggactttgggagtctgggcggggtttttacaagcattggcaaggcgctgcatcaggtgtttggggcgatctatggcgccgccttctctggggtgtcctggaccatgaagatcctgataggggtcgtcataacgtggattggcatgaacagccgctcgacgagcctgtccgtgagcctggtcctcgtgggtgtggtcaccctgtacctaggcgtaatggtgcaggcagactccgggtgtgtcgtatcctggaagaacaaggagctcaaatgcggaagcggcatattcatcaccgacaacgtacacacctggacggagcagtacaagttccaaccggagagtcccagcaaactggcctccgcgatccagaaggcgcatgaggagggtatctgtgggatccggtctgtcacccgcctggaaaacctcatgtggaagcagatcacccctgagctaaaccacatccttaccgagaatgaggtgaagctcacgataatgaccggggatatcaagggcatcatgcaggcggggaaacggtccctgcgcccgcagccgaccgagttgaagtacagctggaaggcgtggggcaaggctaaaatgttgtccacagagctgcacaaccacacgttcttaatcgacggccccgagacagccgagtgcccgaacaccaaccgggcctggaacagccttgaagtggaggactacgggttcggcgtattcaccacgaacatctggctgaagctgaaagagcgccaggatgtcttctgtgactccaagctaatgagcgccgcgattaaggacaaccgcgccgtgcacgccgacatggggtactggattgaaagtgccctgaacgatacctggaagatcgaaaaagccagcttcatcgaggtaaagtcgtgccactggcccaagagccacactctgtggtccaacggcgtgctcgaatcggagatgatcatccccaagaacttcgccggcccggtgtcccaacacaactacagaccagggtatcacacccagaccgctgggccgtggcaccttgggcggctggagatggatttcgacttttgcgagggcacgaccgtcgtggtgactgaggactgcgggaacaggggcccatctttaagaaccacgaccgccagcgggaagttaataacggagtggtgctgccgctcctgtaccctgccgcccctccggtaccgcggggaggacggctgctggtacgggatggaaatccggccgcttaaggagaaggaggagaacctggttaatagcctcgtgacggccggtcatggacagatagacaacttctccctcggcgtcctgggcatggccctcttcttagaagagatgctgcgcacccgggtcggtaccaagcacgccatcctcctcgtggccgtgagcttcgtcaccctgatcacgggaaacatgtccttccgcgacttagggcgagtgatggtaatggttggagccaccatgaccgatgacatcgggatgggagtgacctatcttgccttattagcagccttcaaggtgagacccacgttcgccgccggactgcttttacgcaagctgaccagcaaagagctcatgatgactaccatcgggatcgtattgctgtcccagtcaacgatccccgaatccatcctcgaactcaccgacgccttagcgctgggaatgatggtactcaagatcgtccggaacatggagaagtaccagctggccgtcaccatcatggctatcagctgcgtacccaacgccgtcatcttacagaacgcctggaaggtgagttgtaccactctcgcggtggtcagcgtgtccccgctgctgctaaccagctcccagcaaaaagccgactggatcccactggccctgaccatcaagggtcttaatcccaccgccatcttcttgacgaccctgagccgcacatcaaagaagcgaagttggcccctcaacgaggcgataatggcagtaggaatggtctccatcctggctagttcattgcttaagaacgacatcccgatgaccggccccctggtggcagggggcctgctcacggtctgctacgtcctgaccgggcgaagcgcggaccttgagctcgaaagggcggccgacgttagatgggaggagcaggccgagatttcaggttcctctcccatcttatctatcaccatctcggaggacgggtccatgtccatcaagaatgaagaggaagaacaaaccctgacgattctcatccggaccggactgctagtgatctccgggctcttccccgtaagcatcccgatcaccgccgcggcgtggtacctgtgggaggtgaaaaagcagcgcgccggagtcctgtgggacgtaccctcaccgccgcccgtgggtaaagccgagctcgaggacggggcctatcgcatcaagcagaagggcatacttggatactcgcagatcggcgccggcgtttacaaggaagggacctttcacaccatgtggcacgtcacgcgaggcgcggtgctgatgcacaaagggaagcggatcgagccctcctgggccgacgtgaagaaggacctgatcagctacggggggggttggaagctggagggtgagtggaaggaaggggaggaggtccaggtcctggccctcgagcccggtaagaacccgcgcgcagtccagaccaaacctgggctgttcaagaccaacacgggcacgatcggcgccgtctccctggacttttccccgggcaccagcggaagcccaatcgtggacaagaaggggaaggtggtaggactctacgggaacggcgtcgttactcgctccggaacctacgtaagcgcgatagcccaaacggagaagtccatcgaagacaaccctgaaatcgaggacgacatcttccgtaagaagcggctgaccatcatggacctgcaccctggggccggcaagacaaagcggtacctgcccgccattgtgcgcgaggcgataaagcgtggactccggacactgatcctggccccgacacgcgtggtcgccgccgaaatggaagaggccctccgcggacttccaatccgctaccagaccccagcgataagggccgagcacactgggcgggagattgtagacctgatgtgccatgcgaccttcacgatgcgcctcttaagccccatacgggtgcccaattacaacctgatcatcatggacgaggcccacttcaccgacccggcctccatagcggcccgcggctacatatcgacccgggtcgagatgggcgaggccgcgggtatcttcatgacggccacgccgcccggcagccgcgaccccttcccgcagagcaacgctcccatcatggacgaagagcgtgagatccctgaacgaagctggaacagcgggcacgagtgggtgaccgacttcaagggaaagaccgtgtggttcgtccccagcatcaaagcggggaacgacatcgccgcttgcctccggaagaacggcaagaaggtaatccagctgtcgcgcaagaccttcgacagcgagtacataaagacgcggaccaacgactgggacttcgtggtcaccaccgacatctccgagatgggagcgaacttcaaggccgagcgcgtgatcgatccgcggcgctgcatgaaacccgtgatcctaacggacggggaggagcgggtcatcctggccggccccatgcccgtgacccacagttccgcagctcagcgccgtggtagggtgggccgcaatccgaagaacgagaatgaccagtacatctacatgggggagcctctggagaacgacgaggactgcgcgcactggaaggaggccaagatgctgctcgacaacatcaacacccctgagggcatcattccctcgatgtttgagccggagcgggagaaggtagacgcgatcgacggcgagtaccggctgcgtggggaggcacgcaaaacgttcgtggacctgatgagaagaggcgacctccccgtctggctggcctaccgggtagcggccgaaggaatcaactacgccgaccgccggtggtgcttcgacggggtgaagaacaaccaaatccttgaagaaaatgtagaggtggagatctggacgaaagagggagagcgcaagaagctcaagccccggtggttagacgccaggatttactccgatcccctggcgttgaaggaattcaaggagttcgccgccggtcggaagtccctgacccttaacctcatcactgaaatgggccgcctgcccaccttcatgacgcagaaagccaaaaacgccctggacaacctcgcggtgctgcacaccgccgaggccgggggccgcgcctacaaccatgcgctgtccgagctccccgaaaccctggagactctgcttttgctgacgttgctcgcgacagtaaccggcggcatatttttgttcctcatgtccggcaaggggataggcaaaatgacactgggtatgtgttgcattatcactgcctcgatcttgctctggtacgcccagatccagccccactggatcgccgccagcatcatcctggagttcttcctgatcgtgctcttgattccagagcccgagaaacagcgcacgccccaagacaaccagctgacctacgtggtcattgcaatcctcacggtggtcgccgccacaatggccaacgagatgggcttcttggaaaagacgaagaaggacttcgggctgggctcaatcaccacccaacaacccgagtccaacattctcgacatagatttacggccggccagcgcgtggaccctctacgccgtcgccacgaccttcattacccccatgctccgccactcgatcgagaacagctccgtaaacgtgagcttgacagctatcgccaaccaggcaacggtcctgatgggcctcggcaagggctggcccctgtcgaagatggacatcggggtgccattgctcgccatcggctgctatagccaggtgaacccgatcactctgaccgccgccctgctcctgctggtcgcgcattacgccattatcgggcccggcctccaggcaaaggcaacacgggaggctcagaagcgcgcagcagccggcatcatgaagaatcccacagtggatgggatgaccgtgatcgaccttgatcctatcccgtacgatccgaagtttgaaaagcagctgggtcaagtcatgctcctggttctgtgcgtgacccaggtcctcatgatgcgcaccacttgggccctttgcgaggccctgaccctcgcaaccgggcccatcagcacactgtgggagggcaacccggggcgcttctggaacacgacgatcgccgtgagcatggcgaacatcttccgcggctcctacctggcaggcgctgggttgctgttcagcatcatgaagaatacggctaacactcgtcgcggcactggtaataccggcgagacactgggggagaaatggaaaaacaggctcaacgccctcgggaagtccgagttccaaatctacaagaagtctggcatccaggaggtggatagaaccctggcgaaggaggggattaagaggggcgagacggaccaccacgccgtctcccgcggtagcgcgaagctccggtggttcgtagagcgcaatctggtgaccccggagggcaaagtagtggacctgggctgcgggcgaggcgggtggtcctactattgcggcgggctaaagaacgtcaaggaagtcaagggcctgacgaagggcggccccgggcacgaggagcccatccccatgagcacctacggatggaatctcgtgcgattgcagtccggcgttgacgtcttcttcacgccaccggagaagtgcgacaccctcctgtgcgacatcggggagagctcgcccaatcccaccgtggaagccggtcgtaccttacgcgtgttgaacctcgtcgaaaactggctcaacaacaacactcagttctgcataaaggtgctgaacccgtacatgcccagtgtgatcgagaagatggaggctctgcagcgtaagtacggcggcgccctggttcgcaaccccctgagccggaactccacgcacgagatgtactgggtctctaacgcctcaggtaacatcgtgtcttccgtcaacatgatcagcagaatgctgattaatcggttcactatgcgccacaagaaggcgacctacgagccggatgtagacctggggtccggcactcggaatatcggtatcgagagcgaaacgcccaacttagatatcatcggtaagcgcatcgagaaaatcaagcaggagcacgagacatcttggcactacgaccaggaccacccgtacaagacctgggcctaccacggcagctacgagaccaagcagactggttccgccagttctatggtgaatggtgtcgtgcgccttctgaccaagccctgggatgttatcccgatggtgacacagatggccatgaccgacacgacacccttcggacagcagcgggtgttcaaggagaaggtagataccaggacccaggagcccaaggagggcacgaagaagctcatgaagatcaccgccgagtggctgtggaaggagctgggcaagaagaagacgccccgaatgtgtacacgcgaagagttcacgcggaaggtgcgctccaacgccgccctcggggccatcttcaccgacgagaacaagtggaagtccgcccgagaggcggtggaggacagcggcttctgggaactggtcgacaaagagagaaatctgcacctcgaggggaagtgcgagacctgcgtatacaatatgatgggcaagcgagagaagaagctgggggagttcggcaaggcgaaaggctcccgcgctatctggtacatgtggctcggggcgcggttcctcgagttcgaggctctgggtttcctgaacgaagaccactggttcagccgggagaactctctctccggggtggagggcgagggactgcacaagttaggctacatcctccgggacgtaagcaaaaaggagggcggggcgatgtacgccgacgacacggcaggttgggacacgcgcatcaccctagaggacctgaagaacgaggagatggtcaccaaccacatggaaggggagcataagaagctcgctgaggccatcttcaagcttacttaccaaaacaaggtggtacgtgtgcagcgccccacgccccgtggaaccgtgatggacatcatctcccgaagagaccagcgggggagcggccaggttgtgacttacggcctgaacacatttaccaacatggaagcgcaacttatccggcaaatggagggggagggcgtgttcaagtctatccagcagctgaccgtgaaggaggaaatcgcagtgaagaattggctgatccgcgtggggcgcgaacggctcagcagaatggccatctctggtgacgactgcgtcgtgaagccgctggacgaccggtttgcctcggccctcaccgcgctcaatgacatgggcaaggtaaggaaggatatacagcagtgggaaccctcaaggggttggaacgactggacccaggtcccgttctgcagccaccactttcacgagctgatcatgaaggacggcagggtattggtggtcccctgccggaaccaggacgagctgatcggtagggcacggatttcccagggcgccggctggagcctgcgcgagacggcctgcctaggcaagtcctacgcccaaatgtggagcctcatgtacttccatcgacgcgacctgcggctggccgcgaacgcgatctgttccgcagtaccatcacactggattcccacctcccgcaccacctggagcatccacgccacccatgagtggatgacgaccgaggacatgttgaccgtgtggaatcgggtctggatccaggagaacccctggatggaggacaagacccccgtagagagttgggaggagataccctacctgggcaagagggaagaccagtggtgcgggtccctgatcggcctcacgagccgggcgacttgggcaaagaacatccaaaccgctatcaaccaggtgaggtccctgatcggtaacgaggagtatacagactacatgcccagcatgaagcggttccgaagggaggaagaggaagccggtgtcctgtggtga

SEQ ID NO: 24883 - RNA, 9876 nt, synthetic construct
  misc_feature 1..9876: note = derived and/or modified CDS sequence (opt11) from DENV-2__KM279539__SS-prME
  source 1..9876: mol_type = other RNA
acagcaggcattattatcatgatgattcccaccgtaatggccttccacctgaccacccgcaacggggagccccacatgatcgtcagccggcaggagaagggcaagagcttgctgttcaagaccgagaatggggtgaacatgtgcacccttatggcgatggacctcggcgagctgtgcgaagacacaatcacatacaattgtcccctgctccggcagaacgagcccgaggacatcgattgctggtgtaacagcaccagcacctgggttacctacgggacctgcacagccactggcgagcaccggagggaaaagcggtcagtcgctcttgtgccccatgtagggatggggcttgagacccgcaccgaaacctggatgtccagcgagggcgcctggaagcacgcccagcggattgagacgtggatcctaaggcaccccgggttcacgatcatggcggctatcctggcctacaccatcggcaccacctacttccagcgggtcctgatctttatcctcctgacagcggtgactccctccatggcgatgcggtgcattgggatcagcaaccgagacttcgtggagggcgtctccggcgggagttgggtggacatcgttctggaacatgggtcctgcgtcaccaccatggccaagaataagcccacgctcgacttcgagctgatcaagacagaggcgaagcacctggcaacccttcgcaagtactgcgtggaggccaagttaaccaacactactacggcgagccggtgcccgacccaaggggagccctccttaaatgaggagcaggacaagcgcttcgtgtgcaagcatagcatggtcgaccggggctggggtaacgggtgtggcttgttcgggaagggcgggatcgtgacctgtgccatgttcacgtgcaagaagaacatggagggcaaggtggtccagcccgagaacttagagtacacgatagtaatcacgccccactccggcgaggagaacgccgtggggaacgacacaggaaagcacggaaaggagatcaaggtcacgcctcagagctccatcaccgaagcggagctgacgggttacgggaccgtgacaatggaatgttctccgcgcaccggcttggatttcaacgagatggtgctgctacagatggagaataaagcatggctcgtccatcggcagtggttcctcgacttaccactcccatggttgccaggcgcggatacccaggggtccaactggatccagaaggagaccttagtcactttcaagaatcctcacgctaagaagcaggacgtcgttgtgctcggcagccaggaaggggcgatgcacaccgccctcaccggggccaccgaaatccagatgagctcagggaacctcctgttcacaggccacctgaagtgccgcctccgaatggacaagttacagctgaagggaatgagctactccatgtgcaccgggaagtttaaagtcgtgaaagagatcgcggagacccagcacggcaccatcgtgatccgagtccagtacgagggagacggcagcccctgcaagattcccttcgagataatggacctggaaaagcggcatgtcctgggcaggctgatcactgtaaaccccattgtcactgaaaaggactccccggtaaatatagaggccgagccgcccttcggggacagctacatcatcatcggggtcgagcccgggcagttaaagctctcctggttcaaaaagggcagcagtatcggccagatgtttgagaccaccatgcggggcgccaagcgaatggccatcctgggcgatacagcctgggatttcgggagcctgggcggggtcttcacctccatcggcaaggccctccaccaggtgtttggggcaatttacggcgccgccttcagcggcgtgtcatggacaatgaaaatactgatcggggtcgtgatcacctggatcggcatgaactctcgcagtacgtctctgtccgtgagcctcgtcctcgtgggcgtcgtcaccctgtacttgggcgtgatggtgcaggctgacagcgggtgcgtcgtgagctggaagaataaggagctcaagtgcggtagcggcatcttcatcaccgacaacgtccacacatggacagagcagtacaaattccaaccggagtcccccagcaaacttgcatccgccatacagaaggcgcacgaggaggggatctgcggcatcaggtccgtcacccgcctggagaatctcatgtggaagcaaatcacccccgagctgaaccacatcctgacggaaaacgaggttaagctcaccattatgacaggggacatcaagggcataatgcaggcgggcaaacggtccctgcgcccccagccgaccgagttaaagtacagttggaaggcgtggggcaaggccaagatgctctctaccgagctgcacaaccacacgttcctgatcgacggtcctgagaccgccgagtgcccaaacactaaccgggcctggaacagcctcgaggtggaggactacgggtttggcgtattcaccacgaacatatggctgaagctcaaggagaggcaggacgttttctgcgactccaagctaatgagcgccgcaataaaggacaaccgggccgtgcacgcagacatggggtactggattgaatccgccctgaatgacacctggaagatcgagaaggccagcttcattgaagtcaaatcctgccattggcccaagagccacaccctttggtctaacggcgttctcgagtccgaaatgatcatccccaagaacttcgccggccccgtatcccaacacaattaccgccccgggtaccatacccagaccgcaggtccgtggcatctggggcgcctggagatggacttcgatttttgcgagggcacgaccgtcgtcgtgacggaagattgcgggaaccgcggccccagccttcggacaacgaccgccagcggaaagctgatcaccgaatggtgctgccgatcctgtaccctgccgccgctccggtacagaggggaagacggctgttggtacggaatggagatccggccgctgaaggaaaaggaggagaacctggtaaactcactcgtgacggcaggccacgggcagattgataacttctccttgggcgtgctgggtatggccctcttcctggaggagatgctgcgcacccgggtcgggaccaagcacgccatactacttgtggccgtgagcttcgtgacattgatcacaggcaacatgtcctttcgcgacctcgggcgcgtgatggtgatggtcggggccacaatgaccgacgacatcggtatgggcgtgacgtatctggccctgctcgcagccttcaaggtgcggcccacattcgctgcgggccttcttctccgcaagctaacctctaaagagctgatgatgaccaccatcgggatcgtcctcctgtcccaatcgacgatccccgagtccatcttggagttgaccgacgccctggcgctgggaatgatggtgctaaaaatcgtgcgaaacatggaaaaataccagttggctgtgaccatcatggccatcctgtgcgtgcccaacgccgtcatcctccagaacgcatggaaggtgtcgtgcaccaccctggcggtagtctccgtgagccctctgctcttgacctcatcacagcagaaggccgactggatacccctggccctcactataaaggggctgaaccccaccgccattttcctgacgaccctctcccgtaccagcaagaagcggtcgtggcccttaaacgaggcgatcatggccgtaggcatggtctcaatcttggccagttcgctcctgaagaatgacatcccaatgacaggccccctggtcgctggcggactcctcacggtgtgctacgtcctgaccggacgcagcgccgacctcgaattggagcgggcggccgacgtgcgctgggaggaacaagccgagatcagtggttcatctccaatcctttccatcaccatctccgaggatgggtctatgtccataaagaacgaggaggaggagcaaaccttgacgatcctgatacggacgggcctgctcgtgatcagcggtctgtttccagtctccatcccgattaccgccgccgcgtggtacctgtgggaggtcaagaaacaacgcgccggggtactatgggacgtccccagtccgccgccagttggcaaagccgagctcgaggacggggcctatcggatcaagcagaagggcatactggggtattcccagatcggcgccggcgtatataaagaggggacattccacaccatgtggcacgtcacgcgaggtgcggtactgatgcacaagggtaaaaggatcgagcccagttgggctgatgtgaagaaggacctgatctcctatggagggggctggaagctggaaggcgagtggaaggagggtgaggaggtccaggtactagccctggagcccggtaagaacccgcgcgctgtgcagaccaaacccgggctgtttaagacaaacaccgggacgatcggggccgtcagcctcgacttctcccccggcacaagcggttccccaatagtggacaagaaggggaaggtggtcggcctgtacgggaacggtgtagtgacccggagcggcacatacgtctccgcgatcgcccagacggaggagagcatcgaggacaaccctgagatcgaggacgacatcttccgcaaaaagcggctgactatcatggacctgcacccaggagctggcaaaactaagcgctatctccctgccatcgtacgggaggcgatcaagcgcggtcttcggactctgattctcgcccccacgcgcgtggttgccgccgagatggaagaggccctgcgcggcctgcctatccggtatcagacccccgcgatccgcgccgaacacaccgggagggagatcgtggacctcatgtgccacgccaccttcacgatgcgcctactgagtcccatccgtgtgccgaattacaacctcattattatggacgaggcccacttcaccgacccggcctccatcgctgcccgcggctacatctcgacccgggtggagatgggcgaggccgccgggatctttatgactgccactcctcccggctctcgggacccatttccgcagagcaatgcgcccataatggatgaggagcgggagatccccgaacgctcctggaacagcgggcacgagtgggtcactgactttaagggcaaaaccgtctggttcgtcccctccatcaaggccgggaacgacattgccgcctgcttgcggaaaaatggcaagaaggtgatccagctgtcccgcaagactttcgactccgagtatataaagacccggactaatgactgggacttcgttgtcaccaccgacatctccgagatgggcgctaacttcaaagccgaacgcgttatcgatccgcggcgctgcatgaagcccgtgattttgacggacggggaggaacgggtcatcctggccgggcccatgcccgtgactcatagctcagccgcccagcgccgggggcgcgtgggccgcaacccgaagaacgagaacgaccagtacatatacatgggggagcccctggagaatgacgaggactgcgcgcactggaaggaggccaagatgctcctggacaacatcaacacccccgagggaatcatccctagtatgtttgagccggaacgggagaaagttgacgcaatcgacggtgagtaccgcctccgcggtgaggcccgtaagaccttcgtggacttgatgcggagaggggacctgcccgtatggctggcctaccgggtggcggccgaggggatcaactacgctgatagaaggtggtgtttcgacggcgttaaaaacaaccaaatcctcgaggagaacgtcgaagtggaaatctggacgaaggagggggagcggaagaagctgaagcccagatggctggacgcccgcatttacagcgaccctctcgccttaaaggagttcaaggagttcgcagcaggccggaagtccctgaccctcaacctgattaccgagatgggccgcttacccaccttcatgacgcagaaggccaagaacgccctcgacaatttggctgtgttgcacaccgcggaggcagggggccgggcctacaaccatgccctcagcgagctgcccgaaaccctggagaccttgctgctgctcacgcttctggcgaccgtcactgggggcatattcctcttcctgatgtccgggaaggggatcggaaagatgaccctggggatgtgctgcatcataaccgctagcatcctgctgtggtacgcccagatccaaccccactggattgccgcctccatcatcctggagtttttcctcatcgtgctactgatccctgagcccgagaagcagcggacgccgcaggacaaccagttaacttacgtcgtcatagcgatactgaccgtggtggccgcgaccatggccaacgagatgggcttcctggagaaaacgaagaaggacttcgggttaggaagtatcacgacgcagcaaccggaatcgaacatcttagatatcgaccttcggccggcctccgcgtggaccctctatgccgtcgcaacgacgtttatcaccccaatgctgcgccacagcatagagaactccagcgttaacgtgtccctgaccgctattgcaaaccaggcgacggtcctcatgggcttaggtaaggggtggcccctgagcaagatggacatcggggttcctttactggcgatcggctgttactcccaagtcaatccgatcacactgaccgccgccctcctgctgctcgtcgcgcactacgccatcattgggccaggcctacaggcgaaggcgacccgggaggcccaaaagcgcgcggccgcagggatcatgaagaatcctacggtcgacgggatgaccgtgatcgacctggaccccatcccatacgaccccaagttcgagaagcagttggggcaggtaatgctattggtgctctgcgtaacccaggtgctgatgatgcggaccacgtgggccctgtgcgaggcactcactttagcgaccgggccgattagcaccctgtgggagggaaatcccgggcggttctggaacacgaccatcgccgtatcaatggcaaacatcttccgcgggtcatatctcgccggggccggcttgttgttctccatcatgaagaacaccgccaacacgcggaggggcacgggcaacaccggtgagaccctcggcgagaagtggaagaaccggttgaatgcgctgggcaagagcgagttccagatctacaagaaatcgggcatacaggaggttgaccgaaccctcgcaaaggaggggataaagcgcggtgagacagaccaccacgccgtcagccgagggagcgcgaaactacggtggtttgtggagcgcaacctggtaacccctgaaggtaaggtcgtggacttgggctgcggccgcggagggtggtcatactactgcggcggtctcaagaatgttaaggaggtcaagggcctgaccaagggcgggccggggcacgaggagcccatccccatgagcacctacggctggaacctcgtgcgcctgcaaagcggcgtcgacgtcttctttaccccgcccgagaagtgtgacaccctgctctgcgacatcggggagagtagccccaatcccaccgtggaggccggccggacactgcgcgtgttaaacctagtagagaactggctgaacaacaacacccagttctgcatcaaggtgctgaacccgtacatgcccagtgtgatagagaagatggaggccctccagcggaagtatggcggagcgctggtgcgcaaccccttatccagaaattcaacacacgagatgtactgggtgtccaacgcaagcggcaatatcgtctccagcgtaaatatgatctcccgcatgctgatcaaccggttcacaatgcgccacaagaaggcgacctacgagccggacgtggacctcgggagcggcacacggaacatcgggattgagtcggaaacgcccaacctcgacatcataggcaagcggatcgagaagatcaaacaggagcacgagacctcatggcattacgatcaagaccacccctacaagacttgggcgtaccacggctcctatgagaccaagcagacggggtccgccagcagcatggtgaatggagtggtgcgcctgcttaccaagccctgggacgtgattccgatggtcacccagatggccatgaccgatacgacacccttcgggcagcaacgggtattcaaggagaaggtggacacccggacccaggaacccaaggagggcacgaagaagttgatgaagatcaccgccgaatggctgtggaaggagctcggcaagaagaagacgcctagaatgtgcacccgcgaggagttcacgcggaaagtgcgctccaatgcggccctgggtgccatcttcaccgatgaaaacaagtggaagtccgcccgggaggcagtggaggactccgggttttgggaactggtcgacaaggaacgtaatctccatcttgaggggaagtgcgagacctgcgtctacaacatgatgggcaagcgggagaagaaactaggcgagttcggcaaagcgaagggaagccgcgccatctggtacatgtggttgggggccaggttcctggagttcgaggccctgggctttcttaacgaagaccactggttctcccgcgagaatagtctgagcggggtagagggcgaaggactgcacaagctcggttatatcctgcgtgacgtcagtaaaaaggagggcggggctatgtacgccgacgacaccgcgggctgggacacgcgcatcacgctcgaggatctcaagaacgaggagatggttacaaaccatatggagggggagcacaagaagctggcggaggccatcttcaagctgacctaccagaacaaagtggtccgggtgcaaagaccaacgcctaggggaaccgtaatggacatcatcagccgccgtgaccagcgcggttcgggccaggtcgtaacctatgggctcaacaccttcacgaacatggaggctcaactgatacggcagatggagggagagggcgtgttcaaaagtattcagcaacttaccgtcaaggaggagatcgccgtgaagaactggctcatccgcgtcggacgcgagcggctgtcacggatggccatcagcggtgacgactgtgtcgtgaaacccctggacgaccgtttcgcttctgccctgaccgccctgaacgacatgggaaaggtccgcaaggacatccagcaatgggagccaagccgggggtggaacgattggacccaagtccctttctgctcccaccatttccacgagctgatcatgaaagacggccgcgtcctagtggtcccctgccggaaccaagacgagctcatcgggcgcgcccgcatcagccagggcgccgggtggtctctgcgcgaaactgcctgtctgggcaagagttacgcacagatgtggtcactgatgtacttccatcggagggacctacggctcgcggccaacgccatctgttctgccgtgccctcccactggatcccgactagccgaaccacctggtccatccacgccacccacgagtggatgacgaccgaggacatgctgaccgtgtggaaccgggtctggatccaggagaacccatggatggaggacaaaacccccgtggagtcttgggaagaaatcccttacctgggcaagagggaggaccagtggtgcgggagcctcattggcctgacgtcccgggcgacttgggccaagaatatccagaccgccatcaaccaggttaggtcgctaatcgggaacgaggagtacaccgactatatgccctccatgaagcgtttccgccgcgaggaggaggaggctggtgtcttatggtga

SEQ ID NO: 24884 - RNA, 9876 nt, synthetic construct
  misc_feature 1..9876: note = derived and/or modified CDS sequence (opt11) from DENV-2__KM279543__SS-prME
  source 1..9876: mol_type = other RNA
accgcagggatcatcattatgatgatccccacagtgatggcctttcacctgaccacgcgtaacggggagccccacatgatcgtcagccggcaggagaagggcaagagcctcctgttcaaaacggagaatggggtgaacatgtgcacccttatggcgatggacctcggcgagctgtgcgaggacaccataacctacaactgccccctacttcgccagaacgagcccgaggacatcgattgttggtgcaactctaccagcacctgggtaacgtacgggacttgcaccgcgaccggcgagcatcggcgcgagaagcggagcgtcgccttagtgccccacgtgggcatgggtttagagacccgcaccgaaacctggatgtcatctgagggcgcctggaagcacgcccagcggatagagacctggatactccgccatcctgggtttacgataatggcggcgattctggcctacaccatcggcaccacctacttccagcgggttcttatcttcattctccttacagccgtgaccccctccatggcaatgcgctgcatcgggatttccaatcgggatttcgttgagggagtctccggcgggagctgggtggacatcgtgctggaacacggttcctgcgtcacaaccatggccaagaataagcccacgctcgacttcgagttaatcaagaccgaggctaagcacctcgccactttgcgcaagtactgcgtggaggccaagttgactaacacgacaaccgcgagccggtgccccacccaaggcgagccctccctgaacgaggagcaggacaagcgcttcgtttgcaaacattcgatggtcgaccggggctggggcaacgggtgcggcctcttcgggaagggcgggatcgtgacttgtgctatgttcacgtgcaagaagaacatggagggcaaggtcgtccagcccgaaaacctggaatacaccatcgtgatcacgccccactccggcgaggagaacgccgtggggaatgacacaggcaaacacgggaaggagatcaaggtcacgccccaatcctccatcactgaggctgagctgaccggctacgggacagtgacgatggagtgcagcccgcgaacgggtctcgacttcaatgagatggtgctactgcagatggagaacaaggcctggctcgtacaccggcagtggtttctggacctgccactcccctggttgccaggcgcggacacgcaggggtccaactggatccaaaaggagaccctggtgactttcaagaatccgcatgccaagaaacaagacgtcgtggtgctcggctcccaggagggggccatgcacaccgccctgacgggcgccaccgagatccagatgagctccggcaacctcttattcaccggccacctgaaatgccgcctgcggatggacaagctgcagctgaagggcatgtcatactccatgtgtaccgggaaattcaaggtcgttaaggagatagcggagacccagcacggcaccatcgtgatccgcgtccagtatgagggtgacggatctccctgcaagattcccttcgagatcatggacttggagaagaggcacgtactcggccgcctgataactgtaaaccccatcgttaccgagaaggactccccggtgaacatcgaggccgagcctcccttcggggatagctacatcataatcggcgtggaaccagggcagctgaaattgtcctggttcaagaagggcagttccatcgggcagatgttcgagaccaccatgcgtggcgcaaagaggatggctatcctgggcgacacggcctgggacttcgggagtctaggagggatgttcacctccatcggcaaagcgcttcatcaagttttcggggccatctatggcgcggccttcagcggagtgtcctggaccatgaaaatcttaattggggtggtaatcacctggatcggcatgaacagccgctcgactagtctgtccgtcagcctggtgctagtcggggtggttaccctgtaccttggcgtcatggtgcaggcggactccgggtgcgtggtctcgtggaagaacaaggagctcaagtgcggtagcggcatattcatcaccgacaacgtccatacctggacggagcagtacaagttccagccggagtccccctcgaaactggcctccgccatccagaaggcccacgaggaggggatctgtggcatcagatcagtgactcgcttagagaacctcatgtggaagcagatcacccccgagctgaaccacatactaaccgagaacgaggtcaagttaacgatcatgaccggggacatcaagggcatcatgcaggccggaaagcggtccctgcgcccccagccgaccgaactgaagtacagctggaaggcgtggggcaaggctaagatgctttccaccgagttacacaatcacacattcctgatcgacggccccgagaccgccgagtgccccaacaccaaccgggcctggaactctctcgaggtggaggactacggtttcggcgtcttcaccacgaacatatggctgaagctgaaggaaaggcaagacgtcttctgcgatagtaagctcatgtccgccgcgatcaaggacaatcgcgccgtgcacgcggacatggggtattggatcgaatccgccctaaacgatacctggaagatcgagaaggccagcttcatcgaggtgaagtcctgccattggcccaagagccacacgctgtggtccaacggcgtcctagagagcgagatgatcatccccaagaacttcgcgggccccgtgtcccagcacaactaccggcctgggtaccacacccagacagccggcccgtggcatctcggccggctggagatggatttcgacttctgcgagggcaccaccgtggtcgtgactgaggactgtggcaaccgcggccccagcttacggaccaccaccgccagtggcaagctgatcaccgagtggtgctgccgctcatgcaccttaccgcctcttcgataccggggggaggacggctgttggtacgggatggagatccggccgctgaaggagaaggaggagaacctggtgaacagcctcgtcacggccggccacgggcagatcgacaacttctccctgggcgtgctgggcatggcgctcttcctggaggagatgctgcgcacccgggtggggaccaagcacgccatcctcctcgtcgccgtgagtttcgtgaccctgatcacgggcaacatgtccttccgcgacctcgggcgagtaatggtgatggtgggcgccacgatgaccgacgacatcgggatgggggtcacctaccttgcactgttagcggccttcaaggtgcggcccacgttcgccgccggcctcctgctccgcaagctgaccagcaaggagctgatgatgaccaccatcgggatcgtcctcctgtcacagagcacgatccctgagtccatcctggagctcaccgacgccctggcactgggtatgatggtcctcaagatcgtgcggaacatggagaagtaccagctggctgtcactataatggcgattctgtgcgtaccgaacgccgtgatcctccagaacgcctggaaggtcagctgtaccacgctggcggtagtgtcagtcagccctctgctcctgacctcaagccagcagaaggctgactggatccccctggccctcactattaaggggctgaacccaaccgccattttcctgacgaccttgtctagaaccagcaagaagcgttcctggcccctgaacgaggctatcatggctgtcggtatggtgagcatcttggcctccagcctcttaaagaacgacatcccgatgaccggcccgctggtcgccgggggcctcctgacggtgtgctacgtcttaacagggcgcagcgccgacctcgagctcgagcgcgcggccgacgtccgctgggaggagcaggctgagatatccggcagctcccccatcctgagcattaccatctccgaagatgggagcatgagcatcaaaaacgaggaggaagagcagaccctcacaatcctaatacggaccggcctgctcgtaatcagcggcctgttccccgtttccatcccgattacagctgccgcgtggtacctgtgggaagtcaagaaacagcgtgcgggggtgctctgggacgtgccctccccgccgcccgtcggcaaggccgagctggaggacggggcctaccggataaagcagaagggcatcctggggtactcacagatcggagccggagtgtacaaggaggggaccttccacaccatgtggcacgtgacccgcggagcggtcctcatgcacaaggggaagcggatcgagccctcctgggcggatgtaaaaaaggatctgatctcctacggcggaggctggaagctggagggcgagtggaaggaaggggaggaggtgcaggtcctcgccctggagccgggcaagaacccgcgagccgtgcagacgaaaccgggtctgttcaaaacgaacaccggcacgatcggggccgtgagccttgacttctcccccggcaccagcggctctccgatcgtcgacaaaaaggggaaggtggtggggctgtacgggaacggcgttgtgacccgcagcggcacctatgtgagtgcgatcgcccagactgagaagtccatcgaagacaacccggaaatcgaggatgacatttttcgcaagaagcggctaaccatcatggacctgcaccccggggccggaaagaccaagcgctacctccccgccatcgttcgtgaggcgatcaagagggggctgaggaccctgatcctcgcccctacgcgcgtggtagcggccgagatggaggaagccctgcgcggcctgccgatacggtaccagacccccgctatccgcgccgagcacactggacgtgagatcgtcgacctcatgtgtcacgcgaccttcacgatgcgactgctgagccccattcgggtgcccaactacaacctgatcatcatggacgaggcgcacttcaccgatccggcctccatagctgcacgtggctacatcagcaccagagttgagatgggcgaggcggccggcatttttatgacggccacgccgccgggctcccgcgacccattcccgcagagcaacgcccccatcatggacgaagagcgggagatcccagagcgatcctggaactccgggcacgaatgggtcaccgacttcaaaggcaagacagtgtggttcgtgccctccatcaaggccgggaacgacatcgccgcctgcctgcggaagaacggtaagaaggtcatccagctgagccgcaagacattcgactccgagtacatcaagacccggaccaacgactgggacttcgtggtgaccaccgacatctcagagatgggcgctaacttcaaggctgaacgcgttattgacccacggcgctgtatgaagcccgtgatcctcacggacggggaagagcgggtgatcctggccggccccatgcccgtcacccactcctcagcggcccaacgtcgggggcgggttggccgcaatcccaagaatgagaatgaccagtatatctacatgggtgagcccctggagaacgacgaggactgcgcgcactggaaagaggccaaaatgctcttggacaacatcaacacgccagagggcatcatcccctccatgttcgagccggagcgggagaaggtggacgccatcgatggcgaatatcgcctgcgcggggaggcccgtaagactttcgtcgaccttatgcggcgcggcgacctccccgtgtggttggcctaccgggtcgctgccgaggggatcaattacgccgaccgccggtggtgcttcgacggagtgaaaaacaaccagatcttagaggagaacgtagaggtcgagatctggacgaaggaaggggagcgcaaaaaactgaagccccggtggctggacgcgcgcatctacagcgacccgctcgccttaaaggagttcaaggaatttgcggccggccggaagtccctgaccctcaatctgatcaccgagatgggccgcctgcccacttttatgacacagaaggcgaagaatgccctcgacaacttagcggtcctgcacaccgcagaggcagggggccgggcctacaaccacgccctcagcgagctgcccgagaccctggagaccctcctgctgctcacgctgctggcgaccgtgactgggggtatcttcctcttcctgatgtccggcaaggggatcggcaagatgaccctagggatgtgttgtatcatcacagccagcatcctcctatggtacgcccaaatccagccccactggatcgccgcctccataatattagagttcttcctcatcgtactgctgatcccagagcccgagaagcaacgcacgccccaggacaaccaactcacctacgtggtgatcgcgatcctgaccgtagtggccgccaccatggctaacgagatggggttcctggagaagacgaagaaggacttcgggctcggaagcatcaccacccagcagcccgagtcaaacatcctggatatcgacttacggccggcctccgcgtggaccctatacgcagtagccacgacctttatcacccctatgctgcggcatagcatcgagaacagcagcgttaacgtctccctgaccgccatcgccaaccaggcgacggtgctcatggggctggggaagggatggcctctttctaagatggacatcggcgtccccctcctggccatcggctgctactcccaggttaatccgattaccctgaccgccgccctactgttgctcgtggctcactatgccatcataggccccggtctgcaggccaaagccacccgggaggcccaaaaacgcgcggccgccggcatcatgaaaaaccccacagtcgacggcatgaccgtaatcgacctggaccccattccgtacgaccccaagttcgagaaacagcttggccaggttatgctgctagtactctgcgtgacccaggtgctgatgatgcgtaccacgtgggccctgtgcgaggccctcaccctggcgacagggcccatcagcaccctttgggaaggcaaccccgggaggttctggaacacgaccatagccgttagtatggcaaacatcttccgcggcagttacctcgccggcgccggactgctgttctccatcatgaaaaacaccgcgaacactcgccgcggcacgggcaacacgggcgagacactcggcgagaaatggaagaatcggctgaacgccctgggcaaaagcgagttccagatatacaagaaatccggcatccaagaggtggaccgcaccctcgcaaaggaagggataaaacggggcgagacggaccaccatgccgtgtcgcgcgggtccgcgaagctgcggtggttcgtcgagcgcaacctggtgaccccggagggcaaggtcgtcgacctcggttgcgggcggggcggttggagctactactgcggtgggctcaagaacgtgaaagaggttaagggcctgaccaagggcgggcccggccatgaggagcccatccccatgtccacctacgggtggaacctcgtcaggctgcagagcggggtggacgtttttttcacgccgccagagaagtgcgacaccctcctgtgcgacatcggggagtccagccccaacccgacggtcgaggccggacggacgctgcgcgtactcaacttagtagagaactggttgaacaacaacacccagttctgcatcaaagtgctgaacccgtatatgcccagcgtgatcgagaagatggaagccctgcagcggaagtacggcggcgccctcgttcgcaaccccctgtccaggaacagcacgcatgagatgtactgggtctccaacgcgagcggtaatatcgtttccagcgtgaatatgatctcgcgcatgctaatcaaccgatttaccatgcggcacaagaaggcgacctacgagccggatgtcgacctcggcagcggcacccggaacatagggatcgaatccgagacccccaatctggacatcatcggtaagcgcatcgagaagatcaagcaggagcacgaaaccagctggcattacgaccaggaccacccctacaagacctgggcctaccacggctcctacgagaccaagcagacggggagcgcctcctcgatggtgaacggcgtggtacgcctgctaaccaagccctgggacgtcattccgatggtgacccagatggccatgaccgacacgacccccttcgggcagcagagagtcttcaaggaaaaagtggatacccgcacgcaggagccaaaggagggcacgaaaaagctgatgaagatcaccgctgagtggctgtggaaagagctcggtaagaagaagacgccccggatgtgcacccgcgaggagttcactcggaaggtccgctccaacgcggctctgggggccatcttcaccgacgagaataagtggaaatccgcccgcgaggccgtggaggactcgggcttctgggagctggtggacaaggaacgtaacctccacctggaggggaagtgtgagacctgcgtctacaatatgatgggcaaacgggagaagaagcttggggaattcggcaaggccaaaggcagccgcgctatctggtacatgtggctcggggcccggttcctggagttcgaggccctgggcttcctcaacgaggaccactggttctcccgcgagaacagcctgagcggggttgagggggaagggctgcacaagctcggttacatccttcgggacgtgtccaagaaggagggcggggctatgtacgccgatgacaccgccgggtgggacacgcgcatcaccctggaggacctcaaaaacgaggagatggtcaccaaccatatggaaggggagcacaagaagctggccgaagcaatcttcaagctgacatatcagaacaaggtggtgcgggtccagcgcccgacgccccggggaaccgtgatggacatcatcagccgccgggaccagcgcggctccggtcaggtcgtaacctacggcctcaacaccttcacgaacatggaggcgcagttaatacggcagatggagggggagggcgtgttcaagagcatccagcagttgaccgtgaaggaggagatcgccgtcaaaaactggctcatccgcgtggggcgcgaacggttgtccaggatggccataagcggcgacgattgcgtggtgaagcccctagacgaccggttcgcctccgcactcaccgcgctgaacgacatgggcaaggtgcgcaaggacatccagcagtgggagcctagccgggggtggaacgattggacccaggtgccgttctgctcccaccacttccacgagctgatcatgaaggacggacgagtcctcgtcgtgccctgtagaaaccaggacgaactgatcgggcgcgcccggataagccagggcgctgggtggtctctaagggagacggcctgcctcggcaaaagttacgcccagatgtggtccctgatgtacttccaccggcgcgacctgcggctcgcggccaatgccatctgcagcgccgtcccgagtcactggatccccaccagccgtacgacctggtccatacacgccacccacgagtggatgacgaccgaggacatgctaaccgtttggaacagggtgtggatacaggagaacccgtggatggaggacaagactcccgtcgagagctgggaggagatcccttacctggggaagcgcgaggaccagtggtgcgggagcctcatcggtctgacgtcccgggcgacctgggccaaaaacatccagacagccattaaccaggtgcgcagcctgatcgggaacgaggagtataccgactacatgccgagtatgaagcggttccgccgcgaggaggaggaagccggggtgctctggtga

SEQ ID NO: 24885 - RNA, 9876 nt, synthetic construct
  misc_feature 1..9876: note = derived and/or modified CDS sequence (opt11) from DENV-2__KM279571__SS-prME
  source 1..9876: mol_type = other RNA
accgcgggcatcatcattatgatgatccccaccgtgatggcattccatctgaccacccgcaacggggaaccccacatgatcgtctcccggcaggaaaagggcaagtccctccttttcaagaccgagaacggggttaacatgtgcaccctgatggcgatggacctaggcgagctatgcgaggataccattacttacaactgccccctgctccgccagaacgagcccgaggacatcgactgctggtgcaacagcacctcaacctgggtgacctatggcacatgcacggcaaccggggagcataggcgcgagaagcgcagcgtcgccctggttccccacgtgggcatggggctggaaacccgcacagagacgtggatgtcctcagagggcgcctggaagcacgctcagcggatcgagacctggatactccgccatcccggtttcaccattatggcggccatcctggcttacaccatcggcacgacctactttcagcgggtcctgattttcattcttctgacggccgtaaccccctccatggcaatgcgctgcatcgggatcagcaatcgcgacttcgtggagggcgtgtccggaggaagctgggtggacatcgtgctggaacacggctcctgcgtcactaccatggccaagaacaagcccacactcgacttcgagctgatcaaaaccgaggccaaacacctggctacactccgcaagtactgcgtggaggccaagttaaccaacacgacgacagcgagccggtgtccgacccagggggagccatccctgaacgaggaacaggacaagcgcttcgtctgtaaacacagcatggtcgataggggctggggcaacgggtgcggcctattcgggaaaggagggattgtgacgtgtgccatgtttacgtgcaagaaaaacatggagggcaaggtggtgcaacccgagaacttagagtacaccatcgttatcacgccccactccggggaggagaacgccgtgggaaacgacacgggcaagcacgggaaagagataaaggtcacgccccagagctccattaccgaagcggagttaaccggctacgggaccgtgacgatggagtgcagcccgcgaaccggcctcgacttcaacgagatggtgctgctgcagatggaaaacaaggcctggctcgtccaccggcagtggttcctggacctgccccttccctggcttcccggcgcggacacccaggggtccaactggattcaaaaggaaactctggtgacgttcaagaaccctcacgccaagaagcaggacgtagtcgttttaggcagccaggagggggccatgcataccgccctgacgggcgccaccgaaatccagatgagcagcgggaacttactcttcactggccacctgaagtgcagactgcgaatggataagctccagctgaaaggcatgagctactccatgtgcacagggaagttcaaggtcgtgaaagagatagcggagacacagcacggcaccattgtgatccgcgtccagtatgaaggtgacggaagcccctgcaagatcccctttgagattatggacctggagaagcggcatgtgctcggtcgcttgatcacagtgaaccccatcgtcaccgagaaggactcccctgtgaatatcgaggccgagccgcctttcggggacagctacatcataatcggcgtggagcccgggcaattgaagctctcgtggttcaagaagggcagctccatcggccagatgttcgagaccaccatgcgcggcgccaaacggatggccattctgggagacactgcatgggactttgggagtctgggaggggtattcacatccataggcaaggcgctccaccaggtgttcggggctatttatggcgcggccttcagtggcgtgtcctggaccatgaagatcttaattggggtggtgataacctggatcggtatgaacagccgctccacaagcctgagtgtgagcctcgtcctcgtaggggtggttaccctatacctgggagtaatggtgcaagccgactccggatgcgtagtgagctggaagaacaaggaactcaagtgcggaagcggtattttcatcaccgacaatgtgcacacctggacagaacaatacaagttccaaccggagtcccccagcaagctggcctccgccatccaaaaggcccacgaagaggggatctgcggcattcggagcgtgacccgcctcgagaacctcatgtggaaacaaattacccccgagttaaaccatattctaaccgagaatgaggtaaagctcactataatgaccggagacataaagggtattatgcaggccgggaagcggaccctgcgcccgcagccgaccgaactgaagtactcctggaaggcgtggggaaaagccaaaatgctcagcacggagctgcacaaccacaccttcctgatcgacggccccgagaccgccgagtgccccaacaccaaccgggcgtggaactccctggaagttgaggactatgggttcggcgtcttcaccaccaacatctggttgaagctgaaggagcgccaggacgttttctgcgacagcaagctgatgtccgcagcgatcaaggacaaccgggccgtgcatgccgacatggggtattggatcgagtccgccctgaacgacacctggaagatcgagaaggcatcgttcatcgaggttaagagctgccattggccgaagagtcacaccctatggagtaacggcgtgctagagtcggagatgataatccccaaaaacttcgccggccccgtgagccagcacaactaccgccccgggtaccatacccagacggccggcccgtggcacctggggaggctggaaatggatttcgacttttgtgagggcaccacggtcgtcgtgaccgaggactgtgggaaccgcggcccctccttgcggacgaccaccgcctccggcaagctgatcacggagtggtgctgccggagctgcacgctaccgcccctccgatacagaggagaagacggctgttggtacgggatggagatccggccgctgaaggagaaggaggagaacctggtcaactctctcgtgaccgccggccacgggcagatcgataacttttccctgggcgtgctgggcatggccttgttcctagaggagatgctgcgcacaagggtcgggaccaagcatgccatcctcttggtggccgtgagtttcgtcacgctgatcactggcaacatgtccttccgcgacctcgggcgcgttatggtcatggtgggggctaccatgaccgatgatattgggatgggtgttacgtaccttgcactgctcgcggccttcaagatccggcccaccttcgccgcaggcctattactccgcaagctgaccagtaaggagttaatgatgactacgattgggattgtgctcctgtcccaatccaccattcccgaaagcatcctggagctcactgacgccctggcccttggcatgatggtcctcaagatcgtgcgcaacatggagaaataccagttagccgtcaccatcatggccatcttgtgcgtgcccaacgccgtgatcttgcagaacgcatggaaagtttcttgcacgaccctagcggttgtatcagtctccccgctgttacttacaagctcccagcagaaagccgactggatccccctggctctcactatcaaggggctgaaccccactgccatatttctcaccacgctctctcgcacctcgaagaagcggagctggcccctaaacgaggcgatcatggccgtggggatggtatccatcctagccagtagcctcctgaagaacgacataccgatgacgggcccactcgtcgcagggggtctcttgaccgtatgctacgtgttaaccgggcgcagcgccgacctcgagttagaacgggcggccgacgtccgttgggaagaacaggccgagatcagcgggtcttcgccaatactgtccatcacaatcagtgaggacgggtccatgtccatcaagaacgaagaggaggaacagacgctcaccatccttatccgcaccggcctgctcgttatctcgggcctgttccccgtgagcatcccgatcaccgccgccgcgtggtatctatgggaggtcaagaagcagcgcgccggtgtgttgtgggacgtacccagtccgccgcctgtcggcaaggcagagcttgaggacggagcgtaccggattaagcagaaaggcattctagggtacagccaaatcggcgcaggcgtttacaaagaggggaccttccacacgatgtggcatgttacccgaggcgctgtcctcatgcacaaggggaagcggatcgagcctagttgggcagacgtgaagaaggacctgataagctatggagggggctggaaattagaaggcgagtggaaagagggggaggaggtgcaagtcctggcacttgagcccggcaagaacccgcgtgccgtgcaaaccaagcctggactcttcaaaacaaatacaggtaccatcggcgccgtcagcctcgacttctcgcccggcacctccgggtctcccatcgtcgacaaaaaggggaaggtggtgggcctgtacgggaacggcgtcgtgacccgttccggcacctacgtgagtgcgatcgcccagaccgaaaagagcatcgaggacaacccggaaatcgaggacgacatctttaggaagaagcggctgacaatcatggacctccatcccggggcaggcaaaaccaagcgctacctcccagccatcgtccgggaggcgatcaagcgagggctgcggacgctgatactagcccctactcgcgtagtggccgccgagatggaagaggccctgcgcggcttacccatccggtaccagacgcccgcgatccgcgctgagcacaccgggcgtgagattgtcgacctcatgtgccacgctacattcactatgcgtctactgagccccatacgggtgcccaactacaacttgatcattatggacgaagcccatttcaccgacccggctagcatcgcggcccgcggttacatttccacccgggtggagatgggcgaagcagccggtatctttatgacggccacaccgcccggtagccgcgatcccttcccgcagagtaatgcgcctattatggatgaggagaaggagatacccgagcggagctggaactccgggcacgagtgggtcactgacttcaagggcaagaccgtgtggttcgtccccagcatcaaggccgggaatgacatcgccgcttgcctgcgcaagaacggcaagaaggtcatccagctgtcccggaagacgtttgacagcgagtacatcaaaacgcgcacaaacgactgggacttcgtcgtgaccacagacatctccgagatgggcgcgaacttcaaggccgagcgggtaatcgacccgagacggtgcatgaagcccgtgatcctcactgacggggaggagcgcgtgatcctggccggtcccatgcccgtcacccactcatccgccgcgcagcggcgagggcgggtcggccgcaacccgaagaacgagaacgaccagtacatctacatgggggagcccttggagaacgatgaagattgtgcgcactggaaagaggcaaagatgctcttagacaatataaatacccccgagggcataatccccagcatgttcgagcctgagcgcgagaaggtcgacgccatcgacggcgagtaccggctgcgcggggaggcccggaagacgttcgtagacctcatgcgccggggcgacctgcccgtgtggctagcctaccgcgtcgcggccgaggggatcaactatgctgaccggcgctggtgcttcgacggcgtcaagaataaccagatcctcgaggagaacgtcgaagtcgagatctggaccaaggagggggagcggaagaagctgaagccccgctggctggacgcacggatatattccgacccgctcgcactgaaagagtttaaggagttcgccgcgggtcgcaaaagcctgaccctcaacctcatcaccgagatgggccggctgcccacgttcatgacccagaaggccaaaaacgccctcgacaacctggcggtgctgcataccgccgaagccggaggccgcgcctataaccacgccctctccgaactgcctgagacactggagacgttgctgctgctaacactgctggcgacagtgaccgggggcatcttcctcttcctgatgtccggtaagggaatcggcaagatgaccctgggcatgtgctgtatcattacggctagcatcctcttatggtatgcccagattcagccccactggattgcggctagcatcatcctggagttcttcctcatcgtcctgctgatcccggagccggagaagcagcgaacgccccaggacaaccagctcacgtacgtggtgatcgcgatcctgactgtcgtggccgccaccatggctaacgagatgggcttcctggagaagaccaagaaggatttcggcctcggctccatcacgactcagcagcccgaaagcaacatcctggacatcgacctgcgcccggccagcgcgtggacgctctatgccgtggccacaaccttcatcacacccatgctgcgccattccatcgaaaacagctccgtcaacgtaagcctcacggccatcgccaatcaggcaaccgtgctcatgggacttgggaagggctggcccctgtccaaaatggacataggggtcccactcctggcgatcggctgttactctcaggtaaacccgattactttaaccgccgccctccttttgctcgtggcgcactacgccattattggacccggcttacaggccaaagcaacacgcgaggcccagaagagagctgccgccgggattatgaagaaccccacggtcgacggcatgaccgttattgacttagaccccatcccctatgaccccaagttcgagaagcagcttggccaggtgatgcttctggttttgtgcgtgactcaggtgttgatgatgaggacgacctgggccctgtgcgaggccctcaccctggccacgggacccatctcgacactgtgggagggcaaccccgggcgcttctggaacacaaccatagccgtcagtatggccaacatcttccgcggctcctatctggccggcgccggactgctgtttagcatcatgaagaacaccgccaacacgcgccggggcaccgggaacaccggcgagacgctcggcgagaagtggaagaacaggcttaatgccctgggcaagagcgagtttcagatctacaagaagtccggcatccaagaggtggaccgcacgctggccaaggaggggattaagaggggcgagaccgaccatcacgccgtgagccgggggtctgcgaagctacgttggttcgtcgagcggaacctggtaactcctgagggcaaggtcgttgatctcggctgcgggcgcggcgggtggtcctactactgcggagggctcaagaacgtgaaagaggtgaaggggctcacaaagggcgggcccggccacgaggagcccatccccatgagcacgtacgggtggaacctcgtgcggctgcagtcgggcgtagacgtgttcttcaccccgcccgagaagtgcgacacattattatgtgacattggagagagctccccgaaccccaccgtggaggccggccgcaccctacgggtgctgaacctcgtggagaactggctgaataacaacactcaattctgcatcaaggttctgaatccgtatatgccatcagtgatcgagaagatggaagccctgcagaggaagtacggaggggccctcgtgcggaacccgctgagccgcaattccacccacgagatgtactgggtttcaaacgccagtggcaacatcgttagctccgtgaacatgatctctcgtatgctgatcaaccgattcaccatgcggcataagaaggcgacatacgagccggacgtggacctcgggtctggcacgcgcaacatcggaatagagagcgagactcccaacctggacatcataggcaaacggatcgagaagatcaagcaggagcacgagacatcctggcactatgaccaggaccacccatacaagacctgggcgtaccacggcagctacgaaacgaagcagaccggttccgccagctccatggtgaacggcgtggtacgccttctcaccaagccctgggacgttatcccgatggtaacccagatggcaatgacggataccacaccgtttgggcaacagcgcgtcttcaaggagaaggtagacacccggacgcaggagcctaaggaaggcaccaagaaacttatgaagatcaccgccgagtggctgtggaaggaactcggcaaaaagaagacgccccggatgtgcacccgggaagagttcacccgcaaggtccgaagcaacgcggccctgggtgcaatctttacagacgagaacaagtggaaaagcgcccgcgaggccgtggaagacagcggcttctgggaactggtggacaaggagcgtaacctccatttagaagggaaatgcgaaacatgcgtctacaacatgatgggaaagcgtgagaagaaactgggagagttcgggaaggcgaaggggtcccgggcaatctggtatatgtggctcggggcccgcttcctggagttcgaggccctgggattcctcaacgaggaccactggttcagccgggaaaattcgctgagcggggttgagggcgaggggctgcacaaacttggctacattctgcgtgacgtgtccaaaaaggagggcggggcgatgtacgctgacgacacggccggctgggacaccagaatcaccttggaggacctcaagaacgaggagatggtcaccaaccacatggagggggagcacaaaaagctggccgaagcgatctttaaactgacttaccagaacaaggtcgtgcgcgtccaacgaccgacgcctcgcggcaccgtcatggacatcatctccagacgcgatcagagagggagtggacaagtggtcacctatggcctcaacaccttcactaacatggaggcacagctaatacgccagatggagggggaaggtgtattcaagtccatccagcagctgaccgtgaaggaggagatcgcggttaaaaactggctaatccgggtggggagggagcgattgagccggatggccataagcggtgacgattgcgtggtgaaacccctggacgaccgctttgccagcgctctcaccgccttgaacgatatggggaaggtccggaaggacatacaacagtgggagcccagccgcggctggaacgactggactcaggtgcctttctgttcccatcactttcacgagctgatcatgaaggacggccgggtcctcgttgtgccttgccgcaaccaggacgagctgatcgggcgggcccgcatatcccagggagccgggtggagcttacgggagaccgcgtgtcttggcaaaagctatgcccaaatgtggagcctgatgtacttccaccggcgggaccttcgtctcgcggccaacgccatctgcagtgccgtccccagtcactggatcccgacgtctcgaaccacatggtcaatacacgccacccacgagtggatgaccaccgaggacatgctgaccgtttggaatcgggtgtggatccaggagaatccatggatggaagacaagacccccgtcgagtcttgggaggagataccctacctaggcaagcgggaggatcagtggtgcgggagccttatcggtctcaccagccgcgcgacatgggcgaagaacatccagaccgccatcaaccaggtgcggtccctcatcgggaacgaggagtacacggattatatgcccagcatgaaaaggttccggcgtgaggaggaggaggcgggcgtactctggtga

SEQ ID NO: 24886 - RNA, 9876 nt, synthetic construct
  misc_feature 1..9876: note = derived and/or modified CDS sequence (opt11) from DENV-2__KM279544__SS-prME
  source 1..9876: mol_type = other RNA
acggcggggataatcatcatgatgatccccaccgttatggcgttccacctgaccacccgtaacggggaaccccacatgatcgtttcccgacaggaaaaggggaaaagcctcctgttcaagaccgaaaacggggtgaacatgtgcacactgatggcaatggacctcggcgagctgtgcgaggacacgatcacgtataactgccccttgctaagacagaacgaacccgaggacatcgactgttggtgcaacagcaccagcacgtgggtgacctacggtacctgcaccgcgacaggcgagcatcggcgggaaaagaggtccgtcgcactggtgccccacgttgggatgggccttgaaacccggacagagacctggatgagcagcgagggggcctggaagcacgcgcaaagaatcgagacctggatcctgcgtcaccccggattcacgatcatggctgccatcttggcctacacaatcggcaccacatattttcagcgggtcctcatttttatcctccttaccgccgttaccccgtccatggcgatgaggtgcattggcacctccaaccgggacttcgtggagggagtcagcggcggctcatgggtggacatcgtgcttgagcacggcagctgcgtcaccacgatggcaaagaacaagcccaccctagactttgagttaatcaagacagaggccaaacacctggctaccctcagaaagtactgcgtcgaagcgaaacttacgaacaccactactgcgtcgagatgtcccacccaaggcgagccatctctgaacgaggaacaggacaagcgctttgtatgcaaacacagcatggtcgataggggctggggcaacggctgcggactcttcgggaagggcgggatcgttacctgcgccatgtttacgtgtaagaagaacatggagggcaaggtggtccagcccgagaacttagagtacacaatcgtgataacaccccactcaggtgaggagaacgctgtggggaacgatacaggcaagcatgggaaggagatcaaagtcacgccccagtcgtccattaccgaggccgagctaacgggctacgggacggtgacgatggagtgctcaccgcgcacaggcctggactttaatgagatggtgttattacaaatggagaataaagcctggctcgtccaccggcagtggttcttggacctgcccctgccatggctacccggcgcggacacgcaggggagcaactggattcagaaggaaacgctggtgacattcaagaacccccacgccaagaagcaggacgttgtggttctcggctcacaggagggggccatgcacactgccctaaccggagccacggagatccaaatgagctctgggaacctccttttcaccggccaccttaagtgccgcctgaggatggacaaactccagctgaaaggcatgagctactccatgtgcaccgggaagtttaaggttgtgaaggaaatcgcggaaacccagcacggaaccatcgtaattcgcgtccaatacgagggggacggctccccctgtaaaatccccttcgaaatcatggatttagaaaagcgccatgtgctcggccgcctgatcaccgtaaatccgatagtcaccgagaaggactccccggtaaacatcgaggccgagcctccgttcggggacagctatatcatcatcggcgtggagccggggcagctgaaactttcttggtttaagaagggctcatccataggtcagatgttcgagactacaatgcgcggagcaaagagaatggccatccttggggacaccgcctgggacttcggttctctgggcggtatgttcacctccattgggaaggcgttgcaccaggtcttcggtgcaatctacggcgccgcttttagcggcgtgtcctggacaatgaagatactgatcggtgttgtcatcacgtggattggcatgaactctcgctccaccagcttgtcagtgagcctggtgctagtcggggtggtgacactgtatttaggcgtcatggtgcaggcggacagcgggtgtgtggtcagctggaagaacaaggagctcaagtgcggcagcggcattttcatcaccgataacgttcatacgtggacggagcagtacaagttccagccagagagtccctctaagctggccagcgcgatccaaaaggcccacgaggaaggaatctgtggcatacgcagcgtgacccggctcgagaatctcatgtggaagcagatcacccccgagcttaaccacatactgacagagaacgaggtaaagctcacgatcatgactggggacattaagggcatcatgcaagccggtaaaaggtccctccgcccccagcccaccgagctgaaatacagctggaaggcgtggggaaaggcgaagatgctgtccacggagctgcacaatcataccttcctcatcgatggccctgagacagccgagtgccccaacaccaaccgggcatggaactcgttagaggttgaggattacgggttcggcgtgtttacgacaaatatctggctgaagctgaaagaacgacaggacgtcttctgcgactccaagctcatgtcggccgctatcaaggacaaccgcgctgtccatgccgatatggggtactggatcgagtccgccctgaacgacacctggaagatcgagaaggccagcttcatcgaggtaaaatcctgtcactggcccaagagccacaccctgtggtcgaacggcgttctcgaaagcgagatgatcatccctaagaactttgccggtcccgtctcccaacacaattatcgccctggatatcacactcagactgccggaccatggcatctggggcgtctggaaatggactttgatttctgcgagggcaccaccgtggtagtgaccgaagactgcgggaatcgtgggcccagcctccggactaccacggcctcgggcaagttgatcaccgagtggtgctgccggtcatgtacgctgccgccgctccggtaccgcggggaggacggctgctggtacggtatggaaatccggccgttgaaagagaaagaggaaaatcttgtaaatagccttgtgaccgcgggccacggccagattgataacttttccctcggcgttttaggcatggctctcttcctggaggagatgctgcgcacaagggttggtaccaagcacgccatcctgctggtggccgtgagcttcgtgacgctgattaccggcaacatgtcctttcgcgatctcggccgagtcatggtcatggttggcgccaccatgacggacgacatagggatgggagtcacatacctggcccttttagcggccttcaaagtgcggcccacattcgccgcgggcctgctactgcgcaaacttacctctaaggaactcatgatgacaacgatcggaattgtcctcttatcgcagagcaccattcccgagtcaatattggagctgaccgatgccctagcgctgggaatgatggtcttgaagatcgtgcggaacatggagaagtaccagcttgccgtcaccatcatggcgatcctgtgtgttccgaatgcggtgatactgcagaacgcctggaaggtaagttgcacgactttagctgtggtctccgtctcgccgttgctcttgacctccagccagcagaaggcggactggatcccactggccttaaccatcaaggggctaaaccccacggccattttcctgaccaccctctcccgcacatccaagaagcggtcctggcccctaaatgaggcgatcatggctgtgggcatggtgagcatcctggcgtccagtttactaaagaacgacataccgatgacgggtcccctggtcgccggtgggttgctcaccgtgtgctacgtactgaccgggcgctccgccgatctcgaactggagagagccgctgacgtgcgttgggaggaacaggccgaaatctccggcagcagtcccatactttctattaccatctcagaggacgggtcgatgtccatcaaaaacgaagaagaggagcagacgctcaccatcctgatccggaccgggcttctcgtgatcagcggcctgttccccgtatccattccgatcaccgccgccgcctggtacctctgggaggtcaagaagcagcgcgccggggtgctatgggacgtgccttccccgcctcccgtcggtaaggccgagctggaggacggggcctaccggatcaagcagaagggaatacttggctactcccagatcggagccggtgtatataaagaggggaccttccacacgatgtggcacgtgacacgcggcgcggtccttatgcacaaggggaagagaatagagcccagctgggctgacgtgaaaaaggacctgatctcctacggagggggctggaagctagagggcgaatggaaagagggggaggaggtgcaggtattagccttggaacccggcaaaaacccccgcgcggtgcagaccaaacccggactgtttaagactaatacgggcacgatcggcgccgtgagcttagacttctcccccggcaccagtggctcccccatagtcgacaagaaggggaaagtggtgggcctgtacggaaacggggtagttacccggagcggcacatacgtatccgcgatcgcgcaaaccgagaagagtatcgaggacaatccggagatagaggacgacatctttcgcaagaagcggctgacaatcatggacctgcatcccggggcgggcaaaaccaaacgttatctaccagccatcgtacgtgaggcaataaagcgaggcctgcggaccctgattctggcgcccacccgcgtcgttgctgcggagatggaggaggctctgaggggcctgccgatccggtaccagacccccgcgatccgggccgagcataccgggcgcgaaatcgtggatcttatgtgccatgcaacattcaccatgcgcctgctgtcacccatccgggtgccgaactataacctcattatcatggacgaagcccacttcaccgatccggcatccatcgcggcccgcggctacataagcacccgggtggagatgggcgaagccgctggaatcttcatgacagccactccgcccggaagtcgcgacccctttccacaatcaaacgcgcccatcatggacgaggagcgggagatccccgagcggtcctggaacagcgggcatgagtgggtcacggatttcaaagggaagaccgtgtggttcgtgccctccattaaggcggggaatgacatcgccgcctgcctgcggaagaacgggaagaaggttatccaactgagccggaagacttttgactctgagtacatcaagacccggaccaatgactgggacttcgtggtgaccacggacatctctgagatgggcgcaaatttcaaagccgagcgcgttattgatccgcggcgctgcatgaagcccgtgatcctcaccgacggtgaggagcgggtaatcctggccggtcccatgcctgttacccactccagcgccgcccagcgaagaggccgcgtaggtcgcaatccgaagaacgagaatgatcaatacatctacatgggggagcccctggagaacgatgaggactgcgcgcactggaaggaagccaagatgctccttgacaacatcaacaccccagagggaatcatcccctccatgtttgagccggagcgggagaaggtggacgccatcgacggcgagtaccgcttaagaggggaggcgcgcaagacgttcgtcgatttaatgcgacgcggcgaccttcccgtgtggctggcgtaccgggtcgcggcggaggggatcaactacgcggaccgccgctggtgctttgacggcgtgaaaaataatcagatcctggaggagaacgtagaggtggaaatctggaccaaagagggagagcgcaaaaagctgaaaccccggtggctggatgctaggatctactcagatcccctcgccctgaaggagttcaaagagttcgcggccggccggaagtcgctgaccctcaacctgatcaccgaaatgggccgactgcctactttcatgacacaaaaagcaaagaacgccctcgacaacctggcggtgctgcacaccgccgaggccggagggcgtgcctacaaccatgccctttcggaactgcccgagactctagagactctcctgctgctaacactgctggcgaccgtgactgggggtatttttctcttcctgatgtccggaaaggggatcggaaagatgacactggggatgtgctgtattattactgcctctatcctcttgtggtatgcccaaatccagccccactggatagccgcctccatcatactggagttctttttgattgtcctgctaataccggagccggagaagcagcgcactccacaggacaaccaacttacctacgtggttatcgcgatcctgactgtcgtggccgcaactatggccaatgagatgggtttcctggagaagaccaagaaggacttcggactaggcagcataaccacccagcaacccgaatcgaacatcctcgacatcgacttacgaccggcatccgcttggacgctatacgccgttgccaccacctttatcaccccgatgttacgacacagcatcgagaactccagcgtcaatgtttccctcacagctattgccaaccaagctacggttctaatgggcctaggtaagggctggccactgagcaagatggacataggggtcccactcctggcaatcgggtgctactcccaggtgaaccccatcacattgaccgccgcactcttgctgctcgtggcgcactacgcaatcatcgggcccggccttcaggccaaagccacacgggaggcccagaagcgcgcagccgccggcatcatgaaaaatcctaccgtggatgggatgaccgtgatcgatttagaccccattccatatgatcccaagtttgagaagcagcttggccaggtcatgttgctagtcctctgcgtgacccaggtgctaatgatgagaacgacttgggccctttgcgaggccctcaccctggcaaccgggcccatctcaacactgtgggagggcaaccccgggaggttctggaatacaaccatcgccgtctcgatggcgaacatcttccgggggagctacctcgccggcgccgggctgctgttctccataatgaagaacaccgcgaacacgcgtcgcggcactggcaataccggagaaaccttgggtgagaagtggaagaaccggctgaacgccctgggcaaaagcgagttccaaatctacaagaagtccggcatccaagaagtggatcgcacgctagccaaggagggaatcaaacggggcgaaaccgaccaccacgccgtttcgagggggtccgcgaaattgcggtggttcgtcgagaggaacctggtaacacccgaaggcaaggtggtagacctcggctgtggtagaggcgggtggtcgtactactgcggcggcctgaaaaacgttaaggaagtgaagggcctgaccaaaggcgggcccggccacgaagaacccatccccatgtccacgtacgggtggaacctcgtccgtctacaaagcggtgtggacgtgttcttcaccccgccggagaagtgcgataccctgctttgcgatattggggagagtagccccaaccccacggtcgaggccggacgaaccctgcgcgtattaaacttggtggagaactggctgaacaacaacacgcagttctgcatcaaggtcctcaacccgtatatgccaagcgtgatcgagaagatggaggcactgcagcgcaagtacggtggggccctcgtgcgcaaccccctctcgcggaatagcacacatgaaatgtactgggtctccaatgcgagcggcaatatcgtgtcttcggtgaacatgatctccaggatgttaatcaaccggttcaccatgcgccacaagaaggctacctacgagccggacgttgacctcgggagcggtacgcgtaacatcggtatcgagtccgaaaccccgaacctggacattatcggcaaacgcattgagaagatcaagcaggaacacgagaccagctggcactacgaccaggaccacccctataagacctgggcataccacggctcttacgagacgaagcagaccgggtcggcatccagcatggtaaacggcgtcgtccgcctcctcaccaaaccctgggatgtgatcccaatggtaacccagatggctatgactgacaccaccccctttgggcagcaacgcgtcttcaaggagaaggtggacacccgcacgcaggagcccaaagagggaacaaagaagttaatgaaaatcactgccgaatggctatggaaggaactcggaaagaagaaaacaccccggatgtgcacgcgggaggagttcacacggaaagtccgaagcaacgcggcattgggggcgatcttcaccgacgagaacaagtggaagtccgcccgtgaggcggtggaagactcaggcttttgggagctggtggacaaggagcgcaacctccacctggagggtaagtgcgagacctgcgtctacaacatgatgggaaagcgtgagaagaagctgggggagtttggcaaagccaaggggtcgcgcgccatttggtatatgtggctgggcgcgcgattcctggagttcgaagccctgggattcctaaacgaggaccactggttttcccgcgagaacagcctgagtggggtggagggggaaggactgcacaagctcggatacatccttcgggacgtaagtaagaaggagggcggggcaatgtatgccgacgacacggccggctgggacacccggatcaccttagaagacctcaagaacgaagagatggttaccaatcacatggagggagagcacaagaagctggccgaagccatattcaagctgacgtaccaaaacaaggtggtccgggttcagcgccccacgcccagaggcaccgtgatggacataatcagccgccgggatcagcgcggttccggacaggtggtaacctacggcttaaacaccttcacgaatatggaggcgcaactcattcggcagatggagggggagggtgtgttcaagagcatccagcagctgaccgtaaaagaagagatcgcggtcaagaattggttgatacgcgtggggcgagagcgcctctcccgcatggcaatcagcggcgacgactgtgtggttaagcccctggacgacagattcgcgtctgccttgaccgccctgaatgacatgggaaaggttcgaaaggacatccagcagtgggagcccagccgggggtggaatgactggacccaggtgccgttttgcagtcaccacttccacgagctgataatgaaggacggccgcgtgttggtagtgccctgccgaaaccaagacgagttaatcgggcgcgcccggataagccagggtgccgggtggtccctgcgcgagaccgcttgcctcggcaagagctatgcacagatgtggtccctgatgtatttccacagaagagaccttcgcctcgcagcgaatgctatctgctccgccgtcccttcccactggatacccacttcacgtaccacctggtccatccatgcgacccatgaatggatgacaaccgaagacatgctgaccgtgtggaatcgggtctggatccaggagaatccgtggatggaagacaagacgctggtcgagagctgggaagagattccatacctggggaagcgagaggaccagtggtgcggcagcctgatcggcctgacttcccgcgcgacttgggccaagaacatacagacagccatcaatcaggtgcgctctctcatcggaaacgaggagtatacagattacatgcccagcatgaagcgctttcgcagagaggaggaggaagctggcgtactgtggtga

SEQ ID NO: 24887 - RNA, 9876 nt, synthetic construct
  misc_feature 1..9876: note = derived and/or modified CDS sequence (opt11) from DENV-2__KM279549__SS-prME
  source 1..9876: mol_type = other RNA
actgcgggcatcattatcatgatgatccccaccgtgatggcgtttcacctaacaactcggaatggcgagcctcacatgatagtcagccggcaagagaagggcaagagcctgctatttaagaccgagaacggggtcaacatgtgtaccctgatggcgatggacctgggcgagctttgcgaggacaccatcacgtacaactgtcccctgctccgccagaacgaacccgaggatatcgactgttggtgcaacagcacgtccacctgggtgacctacggtacatgcaccgccaccggtgagcacaggagagaaaagaggtcggtcgcgctagttccccatgttggcatgggcctggagacccgcacggaaacctggatgtcgagtgagggtgcctggaagcatgcacagcggatcgagacatggattctacgtcacccagggttcacgatcatggccgctatcttggcctataccattggcacaacttactttcagcgggtcctgattttcattcttctgacggcagtgaccccctccatggcgatgaggtgcataggcatatcaaaccgggacttcgtagaaggtgtctccggcggatcgtgggtggacatcgtgttggagcacggctcctgtgtcaccaccatggctaaaaacaagcccacgctcgacttcgagctcatcaagaccgaggccaagcacttggcgaccctccgcaaatattgcgttgaggccaaactgaccaacacgaccaccgcctctaggtgtcctacccagggcgagccctcactgaacgaggaacaggacaagcgctttgtgtgcaagcatagcatggtcgaccggggctggggaaacgggtgcggcctgttcgggaagggcggtatcgtgacgtgcgcgatgtttacctgcaagaagaatatggagggcaaggtggtccaaccggaaaacttggagtacaccatcgttatcaccccccactccggtgaggagaatgccgtggggaacgacacgggcaaacatggcaaagagatcaaggttacgccccagagcagtatcaccgaggccgagcttaccggatacgggacggttacgatggagtgctcaccccgcacaggacttgactttaatgagatggtactgctgcagatggagaacaaggcctggttggtccacagacaatggttcctggacctgcccctcccctggctacccggcgctgacacacaaggcagcaactggatacaaaaggagactctggtaacgttcaaaaacccacacgcaaaaaaacaggacgtcgtggtgttgggcagccaagagggggcaatgcacaccgccctcaccggcgcgaccgagatccagatgagctcagggaacctcttgtttacgggccacttaaagtgtcgcctacggatggacaaactccaattgaagggcatgagctactccatgtgtacgggtaaatttaaggtggtgaaagagatcgctgagacccagcacggcacgattgtgatccgcgtccagtacgagggagacggctcgccttgtaagattcccttcgagatcatggacctcgaaaagagacacgtgctcggccgcctcatcacggttaaccctatcgttaccgaaaaggactccccagtgaacatcgaggccgagccgcctttcggggactcgtacatcatcatcggcgtcgagcccgggcagttaaagctctcctggttcaaaaaagggagctccatcggacagatgtttgagacaaccatgcgcggtgccaaacggatggccatcttgggcgacacggcctgggacttcggaagcctgggcggggtgttcacctccatcggcaaagcgctccaccaggtctttggggctatctacggcgccgcattcagtggcgtgtcctggaccatgaagatcctgataggggtcgttatcacctggattggcatgaacagccgctccacgagcctgtctgtgtctttagtactcgtgggagttgtcaccctgtacctgggggtcatggttcaggcggactcagggtgtgtcgtgtcatggaaaaataaggagctcaagtgcggaagtggaatcttcatcacagacaacgttcatacgtggacagagcagtacaagttccaaccagagtcccccagcaaattagcatccgccatccagaaagcccacgaggaggggatctgcggcatccgatcagtcacacgcttagaaaacctcatgtggaagcagatcacccccgagctaaatcacatcctgaccgagaacgaagttaagttaacgatcatgaccggtgacataaaaggcatcatgcaggctgggaaaaggtccctgcgcccccagccgaccgagctgaagtacagttggaaggcgtggggtaaggccaagatgctctccaccgagcttcataaccatacattcctgatcgacggccccgaaactgccgagtgtcccaacacgaatcgggcttggaatagtctagaggttgaggactatgggtttggcgtcttcacaacgaacatctggctgaaactcaaggagcgccaggacgtcttttgtgacagtaagcttatgagcgccgcgatcaaggacaatcgggccgtccatgccgacatgggttactggatcgagtccgctctgaatgacacatggaagattgaaaaggccagcttcatcgaagtgaagtcctgccactggcccaagagccacaccctgtggtccaacggcgtgcttgagtcggagatgattatacccaagaattttgcgggcccggtgtcccagcataactaccgccctgggtaccacacccagaccgcggggccctggcatctggggcggctggagatggacttcgacttctgcgagggcacgaccgtggtcgtaaccgaggactgtgggaaccgcgggccctctctccgcaccacaaccgccagcggcaagctgatcaccgagtggtgctgcagaagttgtacactgccgcctcttcgttaccgcggtgaggacggctgctggtacggaatggagatccggccgttaaaggagaaggaggaaaacctggtcaacagcctggtgacggccggacacgggcaaatcgacaacttctccctgggcgtactgggcatggcactttttctggaggagatgctgcgcactcgggtcgggaccaaacatgccattctcttagtggccgtgagcttcgtgacgctgatcactggaaacatgagctttcgcgacctcggacgcgttatggtcatggtcggagccaccatgaccgacgacattgggatgggagtgacatatttggcgttacttgcggcattcaaggtgcgtcctacattcgccgccggtctactcctccgcaaacttaccagcaaggagctgatgatgaccactatcgggatagtcctactgtctcagtcaacaatcccggagtccatcctcgagctcactgacgccctggcgctaggcatgatggtgttaaagatcgtccgtaacatggagaaataccagcttgccgtcaccatcatggccatcctgtgtgtgcccaacgcagtcatcctacaaaacgcctggaaggtgtcctgcaccaccctggcggttgtatccgtgagcccgttactcctgacctccagccagcagaaggccgactggatcccgctggccctgacaattaaggggctgaatcccacagccatcttcctgacgaccctctcccgtaccagcaagaaacggtcgtggcccctcaacgaggccatcatggccgtcggtatggtatcaatcctggcctctagcttactgaaaaacgacatcccgatgaccgggcccttagtggccggcgggctcctgacggtctgctatgtcctgaccgggcgctccgcggacctcgaactggagcgagcggccgatgtgcgatgggaggagcaggcagaaatctccggtagcagccctatcttgagcatcacaatatccgaggacgggagcatgagcatcaaaaatgaagaggaggagcagacccttactatcctcatacgtaccggccttctcgtgatcagcggcctgttccccgtctctatcccgattaccgccgcagcgtggtatttatgggaggtgaagaagcagcgagctggggtgctctgggacgtcccgagcccgccgcccgtgggcaaggccgaactcgaggatggggcgtaccgcatcaagcaaaagggcatcctggggtactcccagatcggcgccggtgtgtacaaggaggggaccttccacacgatgtggcatgtcacgcgtggcgccgtgcttatgcacaaggggaaacgtatcgagccaagctgggccgacgtgaagaaggacctaatctcctacggaggtggatggaagctggaaggcgagtggaaggagggtgaggaggtccaagtgctcgcccttgagcccggcaagaatccgcgggccgtgcagacaaagcccggtctgtttaagaccaacactggtacgatcggtgccgtttccctcgacttttcccctggcaccagtggctcacctatcgtcgacaagaaggggaaggtggtcggcctctacgggaacggcgtggtcacccggtcgggcacctacgtctccgcgattgcccaaacggagaaaagtatcgaggacaacccagagatcgaggacgacattttccgcaaaaaacgcctgaccatcatggatctgcaccccggggccggcaaaacaaagcgctatctccccgccatcgtgcgcgaagcgattaagcgggggctacggactctgatcttggcaccaacgcgcgtagtcgccgctgaaatggaagaagcgcttagaggccttccgatccgatatcagacccctgccattcgcgccgagcacactgggagagagatcgtggatcttatgtgccacgccaccttcacgatgcgcctactaagccctatccgggtgccaaattataacctgatcattatggatgaggcccacttcaccgaccccgcctcaatcgcagcgcgcgggtacatcagcaccagagtagagatgggagaagcggccgggatattcatgactgccactccgccgggttctcgagacccctttccccagtcgaacgcgcccataatggacgaggagcgggaaatccccgagcgctcctggaacagcgggcatgagtgggtgaccgacttcaagggcaagaccgtgtggttcgtcccttccatcaaagccgggaatgacatcgccgcctgcctgagaaaaaacggtaaaaaggtgatacagctgagtcgtaagaccttcgactccgaatacataaagacgcggacaaacgactgggacttcgtcgtgactaccgacattagcgagatgggagctaacttcaaggccgagagagtcatagacccccggcgctgcatgaagcccgtgatcctcacggacggagaggagcgtgtgatcctggccgggcccatgcccgtcacgcactcctcggctgctcagcgcagagggcgcgtcggtcgcaatcccaagaatgaaaatgaccaatacatctacatgggagagcccctggagaatgatgaggactgcgcgcactggaaggaagccaagatgcttctggacaacattaacacccccgagggcatcatcccttccatgttcgagccggagcgggagaaggtcgacgcgattgacggcgaataccgcctccgcggtgaggcccgcaagacattcgttgatctcatgagaagaggagacctgcctgtttggctggcctaccgggtggctgccgaagggataaactacgtggaccgccgttggtgcttcgacggcgtcaaaaacaaccagatcctcgaagaaaacgtggaggtggagatttggaccaaggagggagagcgcaagaaactgaaaccccggtggctggacgcccgtatttacagcgacccgctagccttgaaggagttcaaggaattcgccgcgggccgcaagtccctaacgttaaacctgatcacagagatgggacggctacccacatttatgacgcagaaggctaagaatgccctcgataatcttgccgtcctgcacaccgcagaggccggtggcagggcctacaaccacgcgctcagcgagttgccggagacgctggagactctgctgctgctgactctgcttgcgaccgtcaccgggggcatcttcctcttcctgatgtccggcaaggggatcgggaaaatgactctggggatgtgctgtattatcactgcgagcatcctgttatggtacgcccagatccagccccactggatcgccgccagcatcatcctggagttcttcctcattgtgctactcatcccggagcctgagaagcagcgcaccccccaggacaaccaactcacttacgtagtaattgccatactgaccgttgtcgccgccactatggccaacgagatgggattcctggagaagacgaagaaggatttcgggctaggcagcattacgacccagcagcccgaaagcaacatcctggacatcgacctgcggcctgcctccgcctggaccctctacgcggtggccacaacctttattacccccatgctgcgccactccatcgagaattcctccgtgaacgtatccttaaccgccatcgcaaaccaggctacggtgcttatgggcttgggcaagggctggccgctcagcaagatggacatcggagtgccgctcctggcgataggctgttactcccaggtcaatccgatcacgctgacggcagccctcctgctgctcgtcgcccactacgcgatcatcggacctggcttacaggccaaagcgaccagggaggcacagaagcgcgctgcggccgggatcatgaagaatcccacggtggacgggatgaccgtcatcgacctcgaccccattccctacgacccgaagttcgagaagcagttggggcaggtaatgttgttggtcctctgcgtcacccaggtgctaatgatgcggaccacgtgggcgctgtgtgaggccctaacattagccaccggcccgatcagcacattatgggagggcaaccccggacgcttctggaacacgaccatcgctgtgtctatggccaacatcttcagagggtcgtatctcgccggcgctgggctcctgttttccatcatgaagaacacagcaaacaccaggcgcggcacagggaataccggggaaacactcggtgagaaatggaagaaccgtctgaatgcgctaggcaagagcgagtttcagatctacaagaagagtgggatccaggaggtggaccgtaccctcgccaaggagggtatcaagcggggcgagacggaccaccatgccgtgagccgcggatcggcaaagttacgatggttcgtcgaacgcaacctggtcactccggagggcaaagtggtggacctagggtgcggccggggcggatggtcgtactactgcggcgggcttaaaaacgtcaaggaggtgaagggcctgactaagggaggtcccggccacgaagagcccatccctatgtctacttacgggtggaacctcgtgcgcctgcagagcggcgtcgacgtgttcttcacgcctcccgagaagtgcgatacgttgctctgcgacatcggggagtccagccccaaccctaccgttgaggcgggcagaaccttacgtgttctaaaccttgtagaaaactggttaaacaacaatacccaattctgcatcaaggtactcaacccgtacatgccgtcggtaatcgagaagatggaagcactgcagcggaagtacggcggggcactcgttcgtaaccccttatcccggaactccacgcacgagatgtactgggtgtccaacgcttccgggaatatcgtctcttcagtgaatatgatttcccgcatgctgataaaccggtttaccatgagacacaagaaggccacctacgaacccgacgttgaccttgggagcggcaccagaaacatcggaatcgagtccgagacccccaacttggacataatcggcaaacgcatcgagaagatcaagcaggagcacgaaacctcgtggcactacgaccaagaccacccttacaagacctgggcgtatcacggctcctatgagacgaagcagacggggagtgcctcaagcatggtcaacggtgtagtgagactgctcactaagccctgggacgtaatcccgatggtgacccagatggccatgactgatacgacacccttcgggcagcagcgggtcttcaaagaaaaagtggataccagaacccaggagcccaaggagggcacgaagaagctgatgaagatcaccgctgagtggctgtggaaggagctcggcaagaagaagacgccccggatgtgcacccgcgaagagttcacacgaaaggttaggtcaaacgccgcgctgggcgccatcttcaccgacgaaaacaagtggaagagcgcgcgggaggccgtcgaggacagtggcttctgggagcttgtggataaggagcgtaacctccatctggagggcaagtgcgagacgtgcgtgtacaatatgatgggcaagcgggaaaagaagctgggggagttcggcaaggccaagggcagccgtgctatctggtacatgtggctgggggccagatttctggagttcgaggccctgggattcttgaacgaggatcattggttctccagagagaacagcctctcgggtgtcgagggcgagggactacacaagctcggatatatcctgcgcgacgtttccaaaaaagagggcggtgccatgtacgcggacgacacagccggctgggataccagaatcaccctggaagacctcaagaacgaggagatggtgaccaaccatatggagggggaacataagaagctggccgaagccatctttaagctgacttaccaaaacaaggtagtgcgggttcagcgcccgactccccggggtaccgtcatggacataatatcgcgccgagaccagcgtggatctgggcaagtggtaacatacggcctcaacaccttcaccaatatggaggcccagttaatccggcagatggagggtgaaggcgttttcaagtctattcagcaacttactgtgaaagaggagatcgccgtgaagaactggttaatccgagtcgggcgcgaacgactgagtcgcatggcaatctccggcgatgattgcgtggtgaagcccttggacgacagatttgccagtgctctcaccgccctgaacgacatgggtaaggttcgcaaggacatacaacaatgggagcctagccggggatggaacgactggacccaggttccgttctgctcacaccacttccatgagctgatcatgaaggacggtcgcgtgctggtcgtgccctgtcggaaccaagatgaattgatcgggcgcgctaggatctctcagggcgccggatggtccttacgtgagactgcatgcttggggaagtcatacgctcagatgtggtcactgatgtacttccatcggagagacctgcgcctcgccgcaaacgcgatttgcagcgccgttccctcacactggatcccaacgtctcggaccacctggtcgatccacgccacccacgagtggatgactaccgaggacatgctaaccgtgtggaaccgggtatggatccaggaaaatccgtggatggaggacaaaacccccgtggagagttgggaggagataccgtacctcggcaaacgcgaggatcagtggtgcggatccctcatcggcctaacgtccagggccacctgggcgaagaacatccagactgccatcaatcaggtccggtcgcttatcggtaatgaggaatacaccgactacatgccctccatgaaacggttcaggagggaggaagaggaagccggcgttctctggtga

SEQ ID NO: 24888 - RNA, 9876 nt, synthetic construct
  misc_feature 1..9876: note = derived and/or modified CDS sequence (opt11) from DENV-2__KM279552__SS-prME
  source 1..9876: mol_type = other RNA
accgcggggattatcataatgatgattcctacggtgatggccttccaccttaccacccggaacggggagccccatatgattgtcagccggcaggaaaagggcaagtcccttctgttcaagacagagaacggggtgaacatgtgcaccctgatggcgatggatctcggcgaactgtgcgaggatacgattacgtacaattgccccctgcttagacagaacgaacccgaagacatcgactgctggtgcaacagcaccagcacttgggtgacctacgggacttgcaccgcaacaggcgagcaccgccgcgagaagcggagcgttgccctggtacctcatgtgggcatggggctagagacacgaaccgagacctggatgtcaagcgagggcgcatggaagcatgcacagagaatcgagacatggatcctccgccaccccggtttcacaatcatggctgccatattggcgtacaccatcggcaccacctacttccagcgggtgctgatcttcattttactgacggcggtgaccccgtcgatggcgatgcgatgcatcgggatcagcaaccgggacttcgtggagggcgtctcgggcgggagctgggtagacatcgtgctggagcacggctcctgcgtcacgaccatggccaagaacaagcccacgctggacttcgagctgatcaagaccgaggccaagcacttggccaccctccgaaagtactgcgtggaagcaaagctgacaaacaccaccacggctagccgatgccccacccagggggagccctctcttaacgaagaacaggacaagcgcttcgtgtgtaagcacagcatggtcgaccggggctggggcaacgggtgcggtctcttcgggaaaggagggatcgtgacgtgcgccatgttcacgtgtaagaagaacatggagggcaaggtggtccaacctgagaacctagagtacacaatcgtaatcacgcctcactccggcgaagagaacgccgtcgggaatgatacgggcaaacatggcaaggagatcaaggtcacgccgcaaagctcgataaccgaggcggaactcaccggctacggtaccgtgacgatggagtgttccccgcgcaccggcctcgattttaatgagatggtgctccttcagatggagaacaaggcctggctcgtacaccggcagtggtttctggacctgcccctcccctggctgcctggtgcggacacccagggctcgaactggattcaaaaggagaccctggtcacgttcaagaacccgcacgccaagaagcaggacgtcgttgtgctaggcagtcaggaaggggccatgcacaccgccctcacgggagcgacggagatccagatgagctcagggaacctcttgttcacgggccacctgaagtgccgcctacggatggataagttacagcttaagggcatgagctactccatgtgcaccgggaagttcaaggtcgtgaaggagatcgcggagactcagcacggaactatcgtcatccgcgtacagtacgagggggacggcagcccttgcaagatccctttcgagataatggacctggagaagcggcacgtcttaggcaggctgataacggtgaacccaatagtcaccgagaaggactccccggtgaacatcgaggccgagccgcccttcggggacagctacatcattataggcgtggagcctgggcagctgaagctctcctggtttaagaaagggagctccattgggcagatgttcgaaaccaccatgcgcggcgcaaagcggatggccatcctgggcgacacggcttgggacttcgggagcctgggcggtgtcttcacctccattggcaaggcgctccaccaagtcttcggggccatctacggcgccgcctttagcggtgtgagctggaccatgaagatactgatcggtgtcgtgatcacttggataggaatgaacagccgctccacaagtctgtccgtgagcctggtcctcgttggggtagtaaccctttacctgggcgttatggtacaggccgattccgggtgcgtcgtttcctggaaaaacaaagagctcaagtgtggctccggaatcttcatcaccgataacgtgcacacctggacggagcagtacaagttccagcccgagtcgcccagcaagctggcctcagcaatccagaaggcccacgaagaggggatctgcggcattcggtccgtcacgcggctggagaacctaatgtggaagcagatcactcccgagctgaaccacatcctgacagagaacgaagtgaagctcacgataatgaccggggacatcaagggcattatgcaggcggggaagcggtccctgagaccccagccgacagagctgaagtacagctggaaggcgtggggaaaagccaagatgctctccacggagctgcacaaccacacgtttctgatagacggacctgagactgccgaatgtcccaacaccaatcgggcctggaacagcctcgaggttgaagattacggtttcggcgtattcaccacgaacatctggctgaaattgaaagagcgccaggatgtgttctgcgactccaaattaatgagcgccgccatcaaagacaaccgggccgtacatgccgacatggggtactggatcgagagcgccctgaatgacacatggaaaatcgagaaggcctccttcatcgaggtcaagtcgtgccactggccaaaaagccacacactgtggtcaaacggcgtcctcgagtcggagatgatcatcccaaagaactttgcgggacccgtgtcccagcataactatagaccagggtatcacacccagacagccggaccttggcacctgggacgtctcgagatggatttcgacttctgcgagggcacgacggttgtggtaacagaggactgcggaaatcgcggccctagcctcagaacgacgaccgccagtggcaagttgatcaccgagtggtgctgcagatcctgcaccctgccgcccctacggtaccgcggggaggacggctgctggtacgggatggaaatacggccgttgaaggagaaggaggagaacctagttaactcgctcgtaacggcgggtcacgggcaaattgacaacttcagtctaggtgtccttggcatggcactcttcctggaggaaatgctgcgcacccgggtcgggacgaaacacgcaatactgctagtggccgttagctttgtcacgttaatcacgggcaacatgtcgtttcgcgacctcgggcgcgttatggtgatggtcggcgctaccatgaccgacgacattgggatgggcgtcacctatcttgccttactcgccgcctttaaagtccggcccacgttcgccgccggcctcctgctccgcaagctgactagcaaggagctgatgatgaccaccatcggtatcgttctcctaagtcatagtactatcccggagtccattctggagctcactgacgccttggctctgggcatgatggttctcaaaatcgtccgcaacatggagaaatatcagctggcagttaccattatggccatcctgtgcgtccccaacgctgtcatcctccagaacgcctggaaggtcagctgtaccacgctggcggtggtttccgtgagcccgctgctcctgacatcctcccagcagaaggccgactggatcccccttgccttaactattaaaggactgaaccccaccgctatcttcctgacgaccctctcccgcacaagtaagaagcggtcctggcccctcaacgaagcgatcatggccgtggggatggtgagcattctcgccagttcgctactgaaaaacgacatcccgatgaccggccccctggttgccggtggactactaacggtttgctacgtgctgaccgggaggagcgcagacctggaactggagcgggctgcagacgtgcgctgggaggagcaggccgaaatctccgggagctcccccatcctgtcaatcaccatttccgaggatggcagcatgtccatcaagaatgaagaggaggagcaaaccttgacgatcctgatcagaaccggcctgctcgtcatctcaggcttattcccggtctctataccgatcaccgccgccgcatggtacctgtgggaggtgaagaagcagcgcgcgggggtgctctgggacgtccccagcccgcctcccgtgggcaaggcagagctggaggacggggcttatcggatcaaacagaaggggatccttgggtactcccagatcggtgccggagtgtacaaagaagggacattccataccatgtggcacgtgacgcgcggcgcagtgctgatgcacaaggggaagcggatcgagcccagctgggccgacgtcaagaaggacttgatcagctacggaggtggatggaaactggagggcgaatggaaagagggggaggaagtccaggtgctcgccttggagcccggcaagaacccgcgcgccgtccagaccaagcctgggttattcaagacaaacaccggcacgattggagccgtgtccctcgacttttcacccggaactagcggctcccccatcgtggacaagaaaggtaaggtggtaggcctgtacgggaacggcgtggtgacccgtagcggcacctatgtaagtgctatcgcccagacggagaaatccatcgaggacaaccccgagatagaggacgacattttccgcaaaaagcggctaaccatcatggacctgcaccccggagccggcaagaccaaacgatacctacccgccattgtgcgcgaagcgatcaagcgagggctgcggaccctgatactagcccccacgcgggtggtcgccgccgagatggaggaagccttacgtgggctgccgatccggtaccagacccctgctatccgcgcggaacataccgggcgggaaatagtggacctcatgtgtcacgccaccttcacgatgcgcctgctgtcgcccatacgggtacccaactacaacctcatcatcatggacgaggcccactttacagacccggcctccatcgctgcccgcggttacatcagcacccgcgtcgaaatgggcgaggccgccgggatcttcatgaccgctacgccgccgggctcccgcgatccattcccgcagtctaacgctcccatcatggacgaggagcgggagatacccgagcgctcctggaacagcgggcacgagtgggtgacggatttcaagggtaagaccgtctggttcgtcccctccatcaaggcagggaacgacatcgccgcctgcctccggaagaacgggaagaaggtgatacagctgagtcggaagaccttcgactcagagtacatcaagacgcggaccaacgactgggacttcgttgtcaccaccgatatcagcgaaatgggcgctaactttaaggctgagagagttatcgacccgcggcgctgcatgaaacccgtgatcctcacggacggggaggagcgggtaatcctggccggcccgatgcctgtgactcactccagcgccgcccaacggcggggtagagtgggacgcaacccgaagaacgagaacgatcagtacatctacatgggggaacccctggagaacgacgaggattgcgcgcactggaaagaggccaaaatgctcctcgacaatatcaacacccccgagggcatcatcccctccatgttcgagccggagcgggagaaagtcgacgccatcgacggcgagtaccgactacgcggagaggcacgcaagaccttcgtcgacctcatgcggcggggcgaccttcccgtttggctagcctaccgtgtggcggctgagggaattaactacgcggacagacggtggtgtttcgacggcgtgaaaaacaatcagatcctcgaggagaacgtggaggtggagatctggacgaaggagggtgagcgtaagaagctgaagccccggtggctggacgcgcgcatttacagcgacccccttgccttgaaggagttcaaggagttcgcggcaggtaggaagtccctgaccctcaacctgatcaccgagatggggcgcctgccaaccttcatgacgcagaaggccaagaacgctctcgacaacttggcggtcctgcataccgccgaggcagggggccgggcctacaaccatgcgctcagcgagctgcccgagaccctagagaccctcttgctgcttacgttactagcgaccgtaacagggggcatcttcctcttcctaatgtccggtaagggaatcggcaagatgaccctggggatgtgctgcatcattaccgcctcgatcctcctgtggtatgcgcagatccagccccactggatcgccgcctctatcatcctggagttctttctcatcgtgctgttgatcccggagcccgagaagcagagaacgccccaggacaaccagctaacctatgtggtcatcgcgatcctgactgtggtggccgccaccatggctaacgagatgggattcctggagaagacgaagaaggatttcggtctcggctccatcaccacccagcagcctgaaagcaacatcctggacattgatctaagaccggcctcggcttggaccctatatgctgtcgctacgaccttcataactcccatgttgaggcacagcatcgagaactccagcgttaacgtctcactgaccgcgatcgccaaccaggctacggttctcatgggcctggggaaggggtggccgctatcaaagatggacatcggtgtgcccctcctcgccattggctgctacagccaggtgaaccccatcaccttgactgccgccctcctgctgctcgtcgctcattacgcgatcattgggcccggactgcaggccaaggccacccgggaggcccagaagcgcgcggctgcgggcatcatgaagaacccaacggtcgacgggatgaccgtgatcgacctggatcccatcccgtacgaccccaagttcgagaaacagctcggccaagtaatgctgctggtactgtgtgtgacccaggtgctgatgatgcgtaccacgtgggccctgtgcgaggcgcttaccctggcaaccggccccatctccactctttgggagggcaatcccgggcgcttttggaatacgaccatagccgtcagtatggccaatatcttccgcggctcgtacctcgccggagccgggctgctgttctccatcatgaagaacacagcgaacacccggcgcggcacgggtaacaccggagagaccctcggagagaaatggaagaatagattaaatgccctggggaaaagcgagttccagatctacaagaagtccggcattcaagaggtcgaccggaccctcgctaaagagggaatcaagcggggagagacggaccatcacgccgtctcccgcgggtccgcgaagctgcggtggttcgtggagcgcaacctggtgacgccggagggtaaggtcgtggacctaggttgcggtcggggcggctggagttactactgcggcgggctgaagaacgtaaaggaagtaaagggtctgaccaagggcggtccgggccacgaggagcccatacccatgtccacctatgggtggaacctcgttcgcctgcagagtggggttgatgtcttcttcacgccgcccgagaagtgcgacacccttctctgcgacataggggagtccagccctaaccccaccgtagaagccggacgaactctgcgcgtgctaaacctcgtggagaattggctgaacaataacactcaattttgcatcaaggtgctgaacccatacatgccttctgtgatcgagaagatggaggcactgcagcgcaagtatggcggggccctcgttcgcaatcccctgtcccggaacagcacgcacgaaatgtactgggtgtccaatgcatcggggaacatcgtgtccagcgtcaatatgatctcccgcatgctaatcaaccggttcacgatgcgacataagaaggcaacttatgagcccgatgtggacctcggtagcggcaccaggaacattggcatcgagtccgagacgccaaacctggacataatcggcaagcgtatcgagaagattaagcaggagcacgagactagctggcactacgaccaggaccatccctacaaaacgtgggcctaccacggctcatatgagaccaagcagacagggtccgcctccagcatggtcaacggcgtcgtaaggttgttgaccaagccctgggacgtgattccaatggtcacccaaatggctatgaccgatactacccccttcgggcagcagcgggtgttcaaggagaaggtagacaccagaacccaggagcccaaggagggcacgaagaagctgatgaagataaccgccgagtggctgtggaaagagctcggcaagaagaagacgccacggatgtgcacacgcgaggagttcacccggaaggtgcgctccaacgccgccctgggggccatcttcaccgacgagaataagtggaagtccgcccgggaagcggtagaggactccggcttctgggagctggtagacaaggagcgtaatctccacctagaagggaagtgcgagacctgcgtgtacaacatgatgggtaagcgggagaaaaagctgggagagttcggcaaggcgaagggctcgagggccatctggtacatgtggctcggggccaggttcctggagttcgaggctctgggcttcctcaacgaggaccactggttctcccgcgagaatagcctgtcaggggttgaaggcgagggcctgcacaagctaggctacatcctgcgggacgtcagcaagaaggaaggcggggctatgtacgccgatgacaccgcaggctgggacacgcgtatcaccctggaggacctcaaaaacgaggaaatggtgaccaatcacatggagggtgagcataagaagctggccgaggccatcttcaagctcacttatcagaataaggtcgtgagagtgcagcgcccaaccccgcgggggactgtcatggacatcatatcccgccgggaccagcgcggatccggccaagtggtgacctacggcttgaatacatttacaaatatggaggcgcaactgatccgccagatggagggtgaaggagtgttcaaatccatccaacaactgaccgtgaaagaagagatcgccgtgaaaaactggctcatacgggtcggacgcgagcggttatccaggatggcgatcagcggcgacgactgcgtagtgaagccgctggacgaccggttcgcatctgccctcaccgccctgaacgatatgggcaaggtgcgcaaagatatccagcagtgggagccgagccgggggtggaacgactggacccaagtaccgttctgcagccaccactttcacgagctgatcatgaaggacggccgcgtgttagtggtcccctgccggaaccaagacgagctgatagggcgcgcccggatcagccagggcgcggggtggtccctacgggagacggcctgcttaggcaagagctatgcccagatgtggtcccttatgtacttccaccgacgcgacctgcggctcgcggctaatgccatatgcagcgccgtgcccagtcattggatccccaccagccgcaccacatggtccattcacgccacccacgagtggatgaccaccgaagacatgctgaccgtttggaacagggtctggatacaggagaacccctggatggaggacaagacccccgtggagagctgggaggaaatcccctacctgggcaagcgcgaagaccagtggtgtgggagcctcatcggcctgacgtcccgggcaacatgggccaagaacatccagacagcaatcaaccaggtacgaagcctgatcggtaacgaggagtacactgactacatgcccagtatgaagagatttcgccgcgaggaggaggaagccggcgtcttatggtga

SEQ ID NO: 24889 - RNA, 9876 nt, synthetic construct
  misc_feature 1..9876: note = derived and/or modified CDS sequence (opt11) from DENV-2__KM279557__SS-prME
  source 1..9876: mol_type = other RNA
actgccgggatcatcatcatgatgatccccactgtgatggcctttcatctgaccactcggaacggggaaccccacatgatcgtctcacggcaggaaaaaggcaaaagcctcctgttcaagacagaaaacggggttaacatgtgtacactgatggcgatggacctcggcgagctgtgcgaggataccatcacgtataattgccccctgctgcgccagaacgagccagaagacatcgactgctggtgcaacagcaccagcacgtgggtgacctacggaacctgcaccgccacaggcgaacatcggcgcgagaaaaggtcagtcgccctggtgccccacgtgggcatggggctggagacccgcactgagacctggatgagtagcgagggcgcatggaagcacgcccagcggatcgagacctggatcttgcgccaccctgggttcacgataatggcagccatacttgcctacacaatcggcaccacttacttccaacgggtcctgatcttcatactcctgacggccgtgacaccatctatggcgatgcggtgcatcgggatcagtaaccgggacttcgtggaaggtgtctccggcgggtcatgggtggacatcgtcctggagcacggctcctgcgtcaccaccatggcgaaaaacaaaccgaccctcgatttcgaactgattaaaaccgaggccaagcatctggcgaccctccgcaagtactgcgtggaggcaaagctcaccaacacgaccaccgcgagcagatgtcccacccaaggggagccctccctgaacgaggagcaggataagcgcttcgtgtgtaagcacagcatggttgaccggggctggggcaacggttgcggcctattcgggaagggcgggatagtgacgtgtgctatgttcacgtgtaaaaagaacatggaggggaaggtggtacaacctgagaacttagagtacaccatcgtgatcacgccgcactcgggggaggagaacgccgtggggaatgatacggggaagcacgggaaggaaatcaaggtcacaccccagagttccatcaccgaggcggagctgaccggctacggcacagtgacgatggagtgcagcccgcgcaccggcctcgacttcaacgagatggttctgctgcaaatggaaaacaaggcctggttggtccaccggcagtggttcctggacctgcccctaccctggcttcccggcgccgatacacaagggtccaactggatccaaaaggagaccctggttacgttcaaaaacccgcatgccaagaagcaggacgtcgtggtgctcggcagccaggagggggcaatgcacaccgcgctgaccggcgccactgagattcagatgagctccgggaacctcctgttcacgggccacctgaaatgtcgcctgcgcatggacaagctccaactgaagggcatgagttactcaatgtgcaccgggaagtttaaagtcgtgaaggagatcgcagagacccagcacggcacaatagtgatccgggtacagtacgagggggacggcagcccctgcaagatccccttcgagatcatggatttagagaagcggcacgtactcggccgcctgatcactgtgaatccgatcgtcaccgagaaggattccccggtgaacatagaggccgagccgcccttcggggacagctatatcataatcggcgtggagccagggcagctgaaactctcctggttcaagaagggcagctccatcgggcagatgttcgagaccaccatgcgcggcgctaagcgaatggccatccttggcgacacggcctgggacttcgggagcctaggaggggtcttcacctccatcggcaaagcattgcaccaggtgttcggggccatctacggcgccgcattcagtggcgtgtcctggaccatgaagatcctgatcggtgtggttatcacctggatcggcatgaactcacgctccacgtcgctgtccgtaagcctagtcctggtgggggtagtgaccctgtatctgggcgtcatggtgcaggcagactccggatgtgtcgtgagctggaaaaacaaagagcttaagtgcggctcaggaatattcatcaccgacaacgtgcacacgtggacggagcaatacaagttccagccggagtcaccctcgaagctggccagtgccatccagaaggctcacgaggaggggatctgcggcatccggagcgtcacccgtctggaaaacctcatgtggaagcagatcactcccgagctgaaccacattctgaccgagaatgaggtgaaactcacgatcatgactggagacatcaagggcatcatgcaggccgggaagcggtccctgcgccctcaaccgacagagttgaagtactcatggaaggcgtggggcaaggccaagatgttatctacggaacttcacaaccacacgttcctaatcgacggccccgagaccgccgagtgtcccaacaccaatcgggcgtggaacagcctcgaggttgaagactacggattcggcgtcttcaccacgaacatatggctgaagctgaaggagagacaggacgtgttctgtgactccaagctcatgagcgccgcaattaaggacaacagggccgtccacgccgacatggggtactggatcgaatccgcgttaaacgacacctggaagatcgagaaggccagtttcatagaggtcaaatcctgccactggccaaagagccacaccttatggagcaacggcgttctcgaaagcgaaatgatcatccccaagaactttgctggccccgtgtcccagcacaactaccgccccggttaccacacccagaccgccgggccgtggcacctgggccggctggagatggacttcgacttctgcgaaggcacaaccgtggtagtgaccgaggactgtgggaatcgcggcccgagcctccgaaccaccaccgccagcggcaagctgatcacggagtggtgctgccggtcctgtacgctgccgcccctgcggtatcgcggggaggacggctgctggtacgggatggagattcgaccgctgaaagagaaggaggagaacctggtcaattcactcgtaacggccggccacgggcagattgacaacttcagtctgggggtgctgggcatggcactcttcttggaggagatgcttcgtacccgggtcgggaccaagcacgccatcttgcttgtggccgtgagcttcgtcaccctgatcacgggcaacatgtccttccgcgacctcgggcgcgtgatggtcatggtgggcgccaccatgaccgatgacatcgggatgggcgtgacctacctggccctgctcgccgcttttaaagtgcggcctacgttcgccgccggcctcctcctccgcaaactgaccagcaaggagctgatgatgaccaccataggaatcgtcctcctgagccagtccacaatccccgaatccatcctggagctaaccgacgcacttgcactgggcatgatggtactcaagatcgtccggaacatggagaagtaccaactggccgtaaccatcatggccatactgtgcgtgcccaatgccgtaatcctccagaacgcttggaaggtgagctgcaccacgctggcggtggtctccgtgagcccgctactcctgacctcttctcagcagaaggccgactggatccccctggccttaaccatcaagggcctgaatcccaccgccatctttctcacgacactctcccgcacgagcaagaagcggtcctggcccctaaacgaggctatcatggccgtaggcatggttagcatcctggcctctagcttactgaagaacgacatcccgatgacaggccccttagtggccggcgggctgctgacggtgtgttacgtgctcaccggtcgcagcgctgacctcgagctggagcgggcggccgacgtgcgctgggaggagcaggccgaaatatccggctcgtcccctatcctgtctatcaccatctccgaagacggttcaatgtccatcaagaacgaggaggaggagcagacgctcacgatcctcatccggaccggcctgctcgtgatctccggactgttccccgtctcaatcccgatcaccgccgccgcctggtatctgtgggaggtcaagaagcagagagctggggtattatgggacgtcccttccccgcctcccgtgggtaaggccgagctggaggatggcgcctaccggatcaaacagaaaggaatactggggtactcccagataggggcaggggtgtacaaggaggggaccttccacaccatgtggcacgtcacgcgcggcgcggttctcatgcacaaggggaagagaatcgagccctcatgggccgacgtgaagaaagacctgatatcctacggcgggggctggaagctggagggcgagtggaaggagggggaggaggtccaggtgctagccttagagccgggcaaaaacccgcgcgccgtgcaaaccaagcccgggctgttcaaaaccaataccggcacgatcggggccgttagcctcgacttttcccccggcaccagcggctcccccatcgtggacaagaaggggaaggtggtcggcttatacgggaacggagtcgtgacgcggagcggcacctacgtatccgcgatcgcccaaacggaaaagtccattgaggacaacccagaaatcgaagacgacatctttcgtaagaagaggttaacaatcatggacctccaccccggggccggcaagaccaagagatacctacctgccatcgtgcgggaggcgataaagcgcgggcttcgcaccctgattctcgcccctactcgggtggtggctgccgaaatggaagaggccctgaggggcctgccgattcggtatcagacgcccgcgattcgcgccgaacatacggggcgggaaatcgtagacctcatgtgccacgccaccttcacaatgcgacttctgagccccatccgggtgcccaactataacctcatcatcatggacgaggcccacttcaccgatccggcctcgatcgcggctagaggctacatcagtaccagagtcgagatgggagaggccgccgggatcttcatgacggctacgcctcctggctcccgcgaccccttccctcagagcaacgcgcccatcatggacgaggaacgggagatccccgagcgctcctggaacagcgggcacgagtgggtgaccgacttcaagggcaagacagtgtggttcgtcccctccatcaaggccggcaatgacattgccgcttgcctgagaaagaacggcaagaaggttattcagctgagccgcaagacctttgactccgagtacatcaagacgaggaccaacgactgggacttcgtggtcaccacagacatttccgagatgggcgcgaatttcaaggctgagcgcgtcatcgatcctcggcgctgcatgaagcccgtgatcctcacggatggggaggagcgggtcatcctggcaggtcccatgcccgtgacccatagttcagccgcccagcgccgggggagggtgggccgcaacccgaagaacgagaatgaccagtacatctacatgggcgagcccctggagaacgacgaggactgcgcgcactggaaggaggccaagatgctcctggacaacattaatacccccgaaggcattataccatcaatgttcgagccggagcgggagaaggtcgatgccatcgacggagagtaccgcctgcgcggggaagcccgcaaaaccttcgtggacctcatgcggcgaggcgacctgcccgtctggctcgcctaccgggtggcggcagaggggatcaactacgccgaccgacgttggtgcttcgatggtgtgaagaacaaccaaatcctcgaggagaacgtcgaggtggagatctggacgaaggagggagagcgcaagaagctgaagccccgatggctggatgctcgcatctatagcgacccgctcgcgctgaaggagtttaaggagttcgcggccggacggaagtcccttaccctcaacctgatcaccgagatgggccgcttacccacctttatgacgcagaaggccaagaacgccttggacaatctggcggtgctgcacactgccgaggcgggcgggcgggcctacaaccacgcccttagcgaactgcccgaaaccctggaaaccctactgctgctcacgttattggcaaccgtcaccggagggatcttcctcttcctgatgtccggcaaggggatcggaaagatgaccctggggatgtgctgtataatcaccgcgagcatcctcctgtggtacgcgcagatccagccccactggatcgccgcctcgataatcttggagttcttcctcatcgtactgctcatccccgagccggagaagcagcgcacgccccaagacaatcagctcacctacgtggttatcgcgatcctgacagtggtggctgccaccatggctaacgagatgggctttctagagaagacaaagaaggactttggtctgggtagcatcacaacccagcagcctgagagcaatatcctggacattgacctgcggccggcctcagcgtggaccctctatgcagtcgccacgaccttcatcacccccatgttgcgccactctatcgagaactcgagcgtaaacgtgtccctgaccgccattgcgaaccaggccacggtcctcatgggccttgggaagggctggcccctgagcaaaatggacatcggcgtccccctcctggctatcggctgctattcccaggtgaacccgataaccctaactgccgccttactgctgctcgtcgcgcactacgccatcataggacccgggctgcaggcgaaggccacccgggaggcccaaaagcgcgccgccgccgggatcatgaaaaaccccacggttgacgggatgaccgtgatcgacctggaccccataccgtacgatcccaagttcgagaagcagttggggcaggtcatgctgctggtgctctgcgtgacccaggtactaatgatgcgtaccacatgggccctatgcgaggccctaaccctggcgaccgggcccatcagcaccctgtgggagggcaacccggggcgcttctggaataccaccatagccgtgtccatggccaacatctttcgcgggtcatacttagccggggccgggcttctgttttccatcatgaagaataccgcgaacacccgtcgcggcactgggaacaccggggaaacccttggcgagaagtggaaaaaccggctgaacgccctgggcaagtccgagttccaaatctacaaaaagtccggaatccaggaggtggaccgcacgctagccaaggaggggatcaagcgtggcgagactgaccaccatgcggtatctcgcgggtctgcgaaacttcggtggttcgtagagagaaatctggtcacgccggagggtaaggtcgtggacctcggctgcgggcggggcgggtggtcgtactattgtggcgggctgaagaacgtaaaggaggtcaagggacttaccaagggcggtcccgggcacgaagaacccattcccatgtccacctacgggtggaaccttgttcgcttgcagagcggcgtggacgtatttttcacaccaccagagaagtgcgacacgctcctctgcgacattggggagtcaagccccaaccccaccgtggaggccgggcggaccctacgcgtgttaaacctcgtcgagaactggcttaacaataacacccagttctgcatcaaagtgctgaacccgtacatgcccagtgttatcgagaagatggaggcgctgcagcggaagtatgggggagccttagtgcgaaaccccctgtcgagaaattccacgcacgagatgtactgggtgtcgaacgcctccgggaacatcgtttcttcagtcaacatgatatctcgcatgctgatcaacagatttaccatgcgtcataagaaggcgacctacgagccggatgtggacctaggaagcggtacacggaacatcgggatcgaaagcgagactccgaaccttgacatcatcggcaaacgaatcgaaaagatcaagcaggagcacgagacgagctggcactacgatcaggatcacccgtacaaaacgtgggcttaccatggcagttacgagaccaagcagacggggagcgcctccagtatggtgaacggcgtcgtacgcctgctcaccaagccatgggatgtcatcccgatggtcacgcagatggcgatgacagataccacccccttcgggcaacaacgggtgtttaaggagaaggttgacacccgcactcaggagcccaaggaagggacgaaaaagttaatgaaaatcaccgccgaatggctatggaaggagctcggaaagaagaagacgccacggatgtgcacccgcgaagagttcactcgtaaagttcgcagcaacgcagccctgggggccatcttcaccgatgagaacaagtggaagtccgcccgagaggccgtggaggacagcggcttttgggagctggtcgataaggaacgcaacttgcacttggagggcaagtgcgagacctgcgtgtacaacatgatgggcaagcgggagaagaagctgggcgagttcggcaaggcgaagggctcccgcgcgatctggtacatgtggttgggcgcacggttcctggagttcgaggccctgggcttcctcaatgaagatcactggttctcccgtgagaatagcctgagcggggtggagggcgaggggctccacaagctcggctatatcctgcgggacgtatccaagaaagagggcggggcgatgtatgccgatgacaccgccggttgggacacgcgcataacgctggaggatctcaagaacgaggaaatggttaccaaccacatggagggtgagcacaagaagctcgccgaggccatcttcaaacttacctaccagaacaaggtcgtccgcgtgcagcgcccgacgccccggggcaccgtcatggatatcatcagccgccgggaccagcgcggttccggccaagtggtaacttacggactcaacactttcactaacatggaggcccagctgattcggcagatggagggtgagggtgtgttcaagagcatccagcagctgacagtcaaggaagagatcgctgttaagaactggctcatccgcgtgggtagggagagactgagtcgcatggccatctcgggagatgactgcgtcgtgaagcccctggacgaccgctttgcctctgccctcaccgcgctcaacgatatgggcaaggtgcgcaaggacatccaacagtgggagccatcacggggctggaatgactggacacaagtcccgttttgtagccaccattttcacgagctgataatgaaggacgggcgcgtgctcgtggtcccctgccgaaaccaggacgagctgatcggacgcgctcgaatcagccagggcgccggatggtccctgcgcgagacggcctgcctcggcaagagctacgcccagatgtggtccctgatgtacttccaccggcgcgacctgcggctcgcggccaacagcatctgctcagccgtgcccagccactggatccccacctcccgcaccacctggtcgatccacgccacccatgagtggatgacaaccgaagacatgctgaccgtgtggaaccgggtttggatccaagaaaacccgtggatggaggataagacccccgttgaaagctgggaggagatcccgtacctaggcaagcgcgaggaccaatggtgcgggtctctcattggcctgacgtcacgggccacatgggcgaagaatatccagaccgccatcaaccaggtgcgctcactgatcggcaacgaggagtataccgattacatgccttctatgaagagattccgcagggaagaggaggaggccggggtcctctggtga

SEQ ID NO: 24890 - RNA, 9876 nt, synthetic construct
  misc_feature 1..9876: note = derived and/or modified CDS sequence (opt11) from DENV-2__KM279591__SS-prME
  source 1..9876: mol_type = other RNA
accgcaggcatcatcatcatgatgattcccacggtgatggcctttcatcttaccacgcggaacggcgaaccccacatgattgtgagccggcaggagaagggtaagagtctcttgttcaagacagagaatggggtgaatatgtgcactctgatggcgatggatctcggcgagctttgcgaggacaccattacatacaattgccctttgctccgccaaaacgagcccgaggacattgactgctggtgcaacagcacctccacctgggtgacatacgggacctgcaccgccaccggcgaacaccggcgtgaaaagcggtcagtcgcgctggtgccccacgtgggaatggggctggagacccgcaccgagacatggatgagtagcgaaggggcgtggaagcacgcacagagaatcgagacctggatacttcgccaccccggattcaccatcatggccgctatactggcctacactatcggcaccacgtatttccaacgggtcctgatcttcattctcctgactgccgtaacaccgtccatggcgatgcgctgcataggaatatccaatcgggacttcgtggagggcgtctcaggcgggagttgggtggacatcgtgctggagcacggttcctgtgtcaccacgatggccaagaataagcccacgctcgactttgagctgatcaagaccgaggccaagcatctggctaccctccgcaagtactgtgtggaggcgaagctgaccaatacgaccaccgcgtctcggtgccccacccaaggagaaccctccctgaacgaggaacaggacaagcgcttcgtgtgcaagcacagcatggtagaccggggctggggaaatgggtgcggtcttttcgggaagggggggatcgtgacgtgtgccatgttcacgtgcaaaaagaacatggagggaaaggtggtccagcccgagaacttagagtacaccatcgtgatcacgccccactccggcgaggagaacgcagttgggaatgatacgggcaagcacgggaaagagatcaaggtcacaccccagagctccatcactgaggcagagctgaccggttacgggaccgtgacgatggagtgctccccgcgaacaggcctcgatttcaacgagatggtgctgcttcaaatggagaataaagcctggcttgttcaccggcagtggttcttggacctgcctctcccctggctgcctggcgcggatacccagggcagtaattggatccaaaaagagaccctggtgacgttcaaaaacccgcacgcaaaaaagcaggacgtagtagttctcggttcacaggagggggcgatgcacacggcattaaccggcgccaccgagatccagatgagctccgggaatctccttttcactggccacctgaagtgccgcctgcggatggataagctccagcttaagggtatgtcctactccatgtgtaccggaaaattcaaagtggtgaaagagatcgcggagactcagcacggcaccatagtgatccgcgtccaatacgaaggggacggctctccgtgcaagattcccttcgaaataatggacctcgagaagagacatgtactcggccgcttaatcacggtgaatcccatcgttaccgaaaaggactcaccagtgaatatcgaggccgagccgcccttcggtgacagctacataatcattggagtcgagcccgggcagctgaagctctcgtggttcaagaagggcagctccatcggccagatgttcgagaccaccatgcgcggggccaaacggatggcgatcctgggcgacacggcctgggacttcggaagcctgggcggcgtcttcacctctattggcaaggcgctccaccaggtgttcggggccatctatggggcagcgttttccggagtgagctggactatgaaaatcctgatcggggtggtaatcacctggatcggcatgaacagccgtagcacaagcctgtcagtgtctctggtcctcgttggggtagttaccctctacttaggcgtgatggtgcaagcggactccggctgcgtggttagctggaagaacaaggagttaaagtgcggaagcggcattttcatcacagataacgtgcacacctggacggagcaatacaagtttcagccagaatccccaagcaaactggcctcagccatacagaaggcacacgaggagggtatctgtggcatcagaagtgtcacccgcctggagaacctcatgtggaagcagatcactccggaactgaaccacatcctgaccgaaaacgaggtgaagctgacaataatgaccggtgacataaaaggcataatgcaggccggaaagcggacccttcgccctcaacctaccgaactgaaatactcctggaaagcgtggggcaaggccaagatgctctctacggagcttcacaaccataccttcctgattgacggcccggagaccgccgagtgccccaacacgaacagggcctggaactccctcgaggtggaagactacggattcggggtctttacgaccaacatctggctgaagctgaaggagcgccaagacgtgttctgtgatagcaagctgatgtccgccgcgatcaaggacaacagggccgtacacgccgacatgggctattggatcgagtctgccctgaacgatacctggaagatcgagaaggcttcgttcatcgaggtcaagagctgccattggccgaagtcgcacacactgtggagcaacggcgtgctcgagagcgagatgatcataccgaagaacttcgcgggccccgtgagccagcacaactaccgcccaggataccacacacagacggccggcccgtggcacctggggcggctggagatggacttcgatttctgcgagggcactaccgtcgttgtgacagaagactgtggaaatcgcggaccatccctgcggacgaccacagcgtctggcaagctgatcacagagtggtgctgcagaagctgcacgctgccgcccctccgataccgaggtgaggacggatgctggtacgggatggagatccggccgctgaaggagaaggaagagaatctggtaaactccctcgtgaccgccggccacgggcagatcgacaatttctctttgggcgtgctgggaatggccctattcctggaggagatgctgagaacccgtgtaggaaccaagcacgccatcctcctggtcgccgtgagcttcgttacgttgattaccggaaacatgtctttccgcgacttgggacgcgtcatggtaatggtcggcgccacgatgacagacgatatcgggatgggcgtcacttacctggccctgttagcggcattcaaggtgcgccccacttttgcagccggtctgctactccgcaaattgacctccaaggagctgatgatgaccacgatcggtatcgtccttctgagccagtccacgatacccgagagcattctggagctaaccgacgctctagcactggggatgatggtgttgaaaattgtccgcaacatggagaaatatcagctggccgtgaccattatggccatcctgtgcgtgcccaacgcagtgatcctgcaaaacgcctggaaggtgtcctgtacaacgctggcggttgtcagcgtgtccccgctcttactaaccagttcacagcagaaagcagactggatccccctggcactgacaataaaagggcttaaccccaccgccatcttcctgaccacccttagccgcacatccaagaagcgttcttggcccctaaacgaggcgatcatggctgtgggtatggtcagtatactggcctcgtccctcttaaagaatgacatcccgatgactggtccccttgtagccgggggccttctgacggtgtgctacgtcctgacggggcgcagcgccgacctggaactggagcgggcggccgacgttcgctgggaggagcaagcggagatcagcggtagcagccccattctgtcgattaccataagcgaagacggctccatgagcatcaaaaacgaggaggaggagcagacgctaaccatcctaattaggaccgggcttctcgtgatttccggcctattccccgtttcaatcccgatcaccgcagccgcatggtatctgtgggaggttaagaagcaacgcgccggggttctctgggacgtcccaagccctccacctgtaggaaaagccgagctggaggacggcgcctaccggatcaagcaaaagggcatacttgggtacagccaaatcggggcgggcgtgtacaaagaggggaccttccacacgatgtggcacgtaaccagaggcgcagtgctcatgcacaaagggaaaaggatcgaaccgtcctgggccgacgttaagaaggatctgatctcgtacggaggaggctggaagctggagggcgagtggaaggagggggaggaagtccaggtgttagcgctggagcccggcaaaaatccgcgagccgtgcagaccaagcccgggctgttcaagaccaacacgggcactatcggggccgtgtccctggacttcagccccgggacgtccggctcgcccatagttgacaagaaggggaaagtggtaggactgtacgggaatggagtggtgacccggtcaggcacgtacgtcagcgcaatagcacagaccgagaagtccatcgaagacaatcctgagatcgaggacgacatcttccgaaagaaacggctaacaatcatggacctgcacccaggagccgggaaaaccaagcgctacctccccgcaatcgtgcgggaagcgatcaaacgcggtctgcggacgctgatcctcgcccccactcgcgtggtcgccgccgagatggaggaggccctgcgcgggctgccgatccgttaccagacccccgcgatccgcgccgagcataccgggagagagatagtggatttaatgtgccacgccacgttcaccatgaggttactgagcccgattcgggtgcccaactataaccttatcatcatggacgaggcccacttcaccgacccggcaagcattgcggcacggggctacatttccacgcgggtcgagatgggcgaggccgcgggaattttcatgactgccacaccacccggcagccgtgaccccttcccgcagagcaatgcgcccatcatggacgaggagcgggagatcccagagcgcagctggaactccgggcacgagtgggtaaccgacttcaagggaaagactgtgtggttcgtccccagcataaaagccgggaacgacatagccgcatgcctgcggaaaaatggcaagaaggttatccagctgtcccgcaagacgtttgacagcgagtacatcaagacacgaacaaatgattgggacttcgtagtcaccacagatatctccgagatgggcgcaaatttcaaggccgagcgggtcatcgatccacggcgctgcatgaaaccagtcatcctcaccgacggtgaagagcgggtaattctggccggtcccatgcccgtgacccacagctctgctgctcagcgccgggggcgcgtgggccggaacccaaagaacgagaacgatcagtatatctatatgggggagcctcttgaaaacgacgaggactgcgcgcactggaaggaagccaagatgctcttagacaacatcaacaccccagagggtatcatccccagcatgttcgaaccggagcgggagaaggtagacgcaatagacggcgagtaccgtctccggggggaagcccgtaagacattcgtagacttgatgcggcgcggagacctcccagtctggcttgcataccgggtggccgcggagggtatcaattatgtcgatcgccggtggtgcttcgacggcgttaaaaacaaccagatcctcgaggaaaacgtcgaggtggagatctggaccaaggagggggaacgcaagaagctgaaaccccgatggctcgacgctcgcatctactctgacccgctggctttaaaggagtttaaggagttcgccgcgggtcgcaagagcctgaccctcaatctcattaccgaaatgggccggctgcctacattcatgacccagaaggcgaagaacgccctcgataacctggccgtccttcacaccgcggaggctggcggcagagcctataaccacgctctcagcgagctgcccgagactctcgagacgctcctgctgctcaccctgctggccaccgtcaccgggggcattttcctattcttaatgagcggcaaggggatcggaaaaatgaccctggggatgtgctgcatcatcaccgcatctatcctcctgtggtacgcacagattcagccacactggatcgccgcttcgattatcttagagttcttcctcattgtgctgctaatcccggagccagagaagcagagaacgccccaggacaaccagctcacctatgtcgtcatcgccattcttaccgtcgtcgcagccacgatggccaacgagatgggctttctggagaaaaccaagaaggacttcggcctcggctctataacgactcaacagcccgagagcaacatcctagacatcgaccttcgccctgccagcgcctggacgctctacgcagtcgcgaccaccttcatcacccccatgctgcgtcactccatcgaaaacagttccgtgaacgtctctctcaccgccatagccaaccaggccacagtgctcatgggcctcgggaagggctggcccctgtccaagatggatatcggagtgcccctgctggcgattggctgctacagccaggtcaacccgatcacgctgaccgcggccctcctgctgttagtagcgcactacgcgatcatcgggcccggcctgcaggccaaagccactcgggaggcccaaaagcgtgcagccgccgggatcatgaagaaccccaccgtggacggcatgaccgtcatcgatctggatcccatcccgtatgaccccaagttcgagaaacagcttgggcaggtgatgctccttgtgctttgcgtcacccaggtgcttatgatgcgcacgacctgggccctgtgcgaggccctcaccctggccacagggccgatatccacgctgtgggagggcaaccccgggcgtttctggaatactaccatcgcggtcagcatggccaacatcttccgcggctcctatctcgccggcgccggactgctgtttagcatcatgaaaaacacggctaacacgcggcgaggcactgggaataccggggagaccctcggcgagaaatggaagaatcggctcaacgcactggggaagtcggagttccagatctacaagaagtccggcatccaggaagtcgatcgcacgctcgccaaggagggtatcaagcggggagagaccgaccaccacgccgtgtcccgcgggagcgctaaacttcggtggttcgtggagcgaaaccttgtcaccccggagggcaaagttgtggacctcggctgtggacggggcgggtggtcctactactgcggcggtttaaagaacgtgaaggaggtgaagggcctgacaaaaggtgggcccggccacgaagagcccatccccatgagcacgtacgggtggaaccttgtgcgcttgcaatccggtgtcgacgtgttcttcacgccgcccgagaaatgcgatactctgctctgtgacatcggggagagctcccccaatcccaccgtggaggcgggccggacgctgcgcgtcctgaacctcgtggagaactggctaaacaacaacacgcaattctgcatcaaggttctgaacccgtacatgccgagcgtcatcgagaagatggaggccctgcagcgaaagtatggcggtgccctcgtacgaaaccccctctctcggaactctacccacgagatgtactgggtgagcaatgcctccgggaatatcgtcagctccgtgaacatgatcagccgcatgctaatcaaccgattcacaatgaggcataagaaggccacctatgagccggacgtggaccttgggtccggcacgcggaacatcgggatcgagtctgagactcccaacctggacatcatcggcaaacgtatcgaaaagattaagcaggagcacgaaaccagctggcactacgaccaggaccatccctataagacctgggcgtatcacggcagctatgagacaaagcagacggggtccgccagctccatggtaaatggcgtggtccgactgctcaccaagccctgggatgttatcccgatggtaacgcaaatggccatgacggacaccacacccttcgggcaacaaagggtcttcaaagagaaggtcgatactagaacacaggagcccaaagagggcacaaaaaagctgatgaagataactgcggagtggttgtggaaggagctcgggaagaagaagacgccccggatgtgcacccgcgaggagttcacccggaaagttcgatcaaacgctgcgctgggggctatcttcacggatgagaacaagtggaagtcagcccgggaggcagtcgaggacagcggcttctgggaacttgtggataaggagcgcaatctccacctggaagggaaatgtgaaacctgtgtgtacaacatgatgggcaaacgggaaaagaagctgggggagttcgggaaggccaagggctcccgcgcaatctggtacatgtggctcggggcccgcttcctggagttcgaggcactgggttttctgaacgaggaccattggtttagccgcgaaaatagtctcagcggggtcgaaggtgagggtttgcacaagctcggctatattctgcgggacgtctccaagaaggagggcggggccatgtacgcggacgacaccgccggctgggacacccgaatcacattagaagacctcaagaacgaggagatggtcaccaaccacatggagggggagcacaagaaacttgccgaggccatcttcaagttgacgtaccagaacaaagtcgttagggtgcagcggccaacgcccagagggaccgtcatggatatcatctcccgcagagatcagcgcgggagcggtcaagttgtgacctacggcctcaacaccttcactaatatggaggctcagctgatccggcagatggaaggtgagggagtctttaaatcgatccagcagttaaccgtaaaggaggagatcgcggtcaagaattggctcatccgcgtcgggcgcgagcggctgagccgcatggccatcagtggggacgattgcgtggtgaagcccttagacgaccggttcgcaagcgccctcaccgcccttaacgacatgggcaaggtccgcaaggacatccagcagtgggagccctcccggggatggaatgattggacgcaggtgccgttttgctctcaccacttccacgagctgatcatgaaagacggacgcgtgttggtcgtgccctgccgtaaccaagacgagcttatcggccgcgcgcggatttcccagggggccggctggagcctgcgcgagaccgcgtgcctcggcaagtcctatgcccagatgtggagcctgatgtacttccacagacgcgatcttcggctcgctgccaatgctatctgctccgccgtgccttctcactggatccccacctcccgaaccacttggagcatacacgccacgcacgagtggatgaccaccgaagacatgctgacggtttggaaccgggtgtggatacaggagaacccgtggatggaagacaagacgccggtggagtcgtgggaggagatcccgtatctgggcaagcgtgaggaccagtggtgcgggtcgctgatcggactgacctcgcgggccacctgggctaagaacatccaaaccgccatcaaccaggtgcgctccctgatcggtaacgaagaatacacggactatatgcccagcatgaagcggttccgccgcgaggaggaggaagctggcgttttgtggtga

SEQ ID NO: 24891 - RNA, 9876 nt, synthetic construct
  misc_feature 1..9876: note = derived and/or modified CDS sequence (opt11) from DENV-2__KM279558__SS-prME
  source 1..9876: mol_type = other RNA
actgccggtatcatcatcatgatgatacccacagtcatggcctttcacttgacgacccgaaatggggaacctcatatgattgtgagtcgccaagaaaaaggaaaatcgctgctattcaaaacagaaaacggagtaaacatgtgtaccctgatggcaatggatttaggagaactatgtgaagatacaattacatacaactgccccctcttgcgccagaacgaacccgaagatatagactgctggtgcaactcaacctccacatgggtcacgtatggaacatgcacagccacaggagaacaccgaagagagaaaagaagtgtcgcgctagtcccccatgtaggaatggggctggaaacacggacagaaacgtggatgtcgagcgaaggggcctggaaacacgcccaacgcatagaaacgtggatattacgccaccccggattcactataatggcggccatactcgcctataccatcggtaccacatacttccagcgggtactgatatttatactgctcacagcggtcaccccaagcatggctatgaggtgcatcggcatctcaaaccgcgacttcgtcgaaggggtttccggcggatcatgggtggatatagtgctagagcacggatcgtgcgtaacaacaatggccaaaaacaaaccgacgctggacttcgaactaataaagacagaggcaaaacacctggccaccctgcgaaaatactgcgttgaagcaaaactcacgaacacaactaccgcgagtagatgtcctacccagggggagcccagcttgaacgaagaacaagataagagattcgtgtgcaagcattcgatggtggacagaggctggggaaacggctgcgggctatttggcaaaggagggatcgtaacatgtgcaatgttcacctgtaagaaaaacatggaggggaaagtggttcagcccgagaacttggagtacacgattgtgataacaccgcacagcggagaagagaacgcagtgggtaacgatacagggaagcacggcaaagagatcaaaataacaccccagagctcaatcaccgaagcggagctaacagggtacggaaccgtcactatggaatgctcgccacgaacgggattggacttcaatgagatggtactcttacaaatggagaacaaggcgtggttagtacaccgccaatggttcctcgatctccccctgccttggctaccaggggccgacacacaaggatcaaactggatccaaaaggagacccttgtcaccttcaagaacccccacgcgaagaaacaggatgtggtagtcttaggaagtcaagaaggagcaatgcataccgccctaacaggggcgactgaaatccagatgtcctccggaaacctactcttcaccggacaccttaaatgtcgactacgaatggataaacttcagcttaaaggcatgagttactccatgtgcacagggaagttcaaagtggtaaaagagatcgcagaaacacaacacggaacaatcgtaattcgagttcaatacgaaggcgatggaagcccctgcaaaataccattcgagatcatggacctagaaaaacgccacgtactaggacggttaataaccgtaaacccgatagtgactgagaaagacagtcccgtaaacatcgaagcagaaccgccattcggcgatagctacataatcatcggtgtagagccgggccagctcaagctgagctggttcaagaaaggctccagcattgggcaaatgttcgagaccacgatgcggggtgcgaaacgcatggctatccttggggacaccgcgtgggacttcggctcactaggcggggtgttcacatcgatcggaaaagcacttcaccaagtattcggggcaatatacggggccgcgttcagtggagtgagctggacgatgaagatccttataggagtggtaataacctggatcggtatgaacagccgatccacaagcctgagcgtcagtctagtactggttggggtggtaaccctttacttgggggttatggtccaggcagacagcgggtgtgtagtatcctggaagaacaaagaactaaagtgtggatcgggcatcttcatcacagacaacgtgcacacctggaccgaacaatataaatttcaaccagagagcccgagcaaactcgcttcagccatacagaaagcacacgaggaaggaatatgtgggatccggagtgtcacacgcctagaaaacctaatgtggaagcagatcacgccagaactcaaccatatactgacagagaatgaagtaaagctcacaataatgaccggagacataaaggggataatgcaagccggcaaaaggagcctccgaccacagccgaccgagctcaagtacagttggaaggcctggggaaaagccaagatgctaagcacggaactacacaatcacacgtttctgatagacgggccagaaaccgcggagtgcccaaacaccaatcgcgcgtggaacagtctagaggttgaagactatggtttcggtgtgttcacaacgaacatctggctcaaacttaaggaaaggcaagacgtcttctgcgacagcaaactgatgagtgcagcgatcaaagacaaccgggccgtccacgctgacatgggatactggatcgaatccgcattaaatgacacctggaagatcgagaaagccagttttatagaagtgaaatcatgtcattggccaaagagccatactctctggtcaaacggtgttctggaaagcgagatgataattcccaaaaacttcgcggggcccgtttcgcagcacaactaccggccgggataccacacgcaaacagccgggccgtggcacctaggcaggctagagatggacttcgacttctgcgaggggacgacggtggtcgtcacggaggattgcggaaacagagggccatcgctgcgaaccaccacggcgagtggcaaacttatcaccgagtggtgctgccgaagctgcaccctaccacccctcaggtaccggggagaagacggatgctggtacggcatggagataaggccgctaaaggaaaaggaggaaaacctggtaaattcactcgtgacagcgggacatggacagatagataacttctccttgggagtactagggatggcattgttcttagaggagatgctaagaacgagggtagggaccaaacacgccatattgctcgtagccgtctccttcgtaacgctgatcacaggaaacatgtcttttcgcgacctcggacgtgtcatggtgatggttggagcgacaatgaccgacgacattggcatgggagtcacatacctagcgctcctcgcagcgttcaaagtccgccctacattcgcggcaggtttactcctacgcaaacttacatcaaaagagttaatgatgaccacgataggcatcgtactgctatcacagagcacgatcccagagtcaatcctagagctaaccgatgcactagcgttaggaatgatggtactaaaaatagttcggaacatggaaaagtaccagctcgccgtgacaataatggcaatctcatgtgtgccaaatgcggtgatcttacagaacgcttggaaggtgagctgcacgacactggccgtcgtaagcgtcagtccattactactaacctcaagccagcaaaaagctgactggattcctctcgcacttacaatcaagggcctaaaccccacagccatcttccttacgacgctatcgcggacatctaagaaacggagctggcccctcaatgaagcaataatggcagtgggaatggtctcgatactcgccagctccctgcttaagaacgacatacccatgactgggcccttagtcgccggcggcctcctgacggtatgctacgttctgaccggacgatcagcagacctcgaactagagcgggccgctgatgtccggtgggaagaacaggcggaaatatcgggaagtagtccaatcttgagtatcaccataagcgaggacggaagcatgtccatcaagaatgaggaagaagaacaaacccttacgatcctcatccggacaggcctgctagtaatctccggattattccccgtgtcgattccaatcaccgcagcagcgtggtatctctgggaagtaaagaaacagagagccggcgtcttatgggacgtacccagcccgccacccgtaggcaaagccgaactagaggacggtgcctaccgaattaaacagaaaggcattctaggatacagccaaataggagccggagtatacaaagagggtactttccatacgatgtggcacgttacccggggcgccgtactaatgcacaagggcaaacgaatcgaacccagttgggcggacgtcaagaaagacctgatatcatacggcggcggctggaagctcgaaggcgagtggaaggagggggaggaggtccaggtcctcgccctcgaacctggcaaaaatcctcgcgcagtgcagacaaaaccgggactgttcaagaccaacacgggaactatcggcgcggtatctctggattttagtccgggcacgtcaggcagtcccatcgtagacaagaaaggcaaagtggttgggttatatggtaacggcgtcgtcacacggagcggcacgtacgtctcggcaatcgctcaaacagagaaaagtatagaagacaacccggaaattgaggacgacatcttcaggaagaaacgactaacaatcatggacctacacccgggtgccgggaagacaaagcgatatcttccagcaatcgtacgcgaagccattaagcggggcctaaggaccctaatcctagcacccaccagggtcgtggcagcagaaatggaagaggctctaagagggctccccatacgctaccaaactccagcgataagggcagaacatactgggcgcgaaatagtagacctcatgtgccatgccacattcaccatgcgcctcttatcaccgataagggtgcccaactataacctgataatcatggatgaggctcactttaccgacccggcaagcatagcagcccgcggctacataagcacacgagtagagatgggcgaagcagccggcatctttatgaccgccacccctcccggatcgcgagaccctttcccccaaagcaacgcacccataatggacgaagaacgggagattcccgaacgaagctggaactcgggccacgaatgggtgacagacttcaaaggtaaaactgtgtggttcgttccaagcataaaggcaggaaacgatatcgctgcatgcctcagaaagaacgggaagaaagtaatacaactctcacggaagacctttgatagtgagtacatcaagacccgaacgaacgactgggacttcgtggtaaccaccgatataagtgaaatgggagcaaacttcaaagcagaacgggtcatcgacccccgccgctgcatgaagcccgtgatactaacggacggcgaggaacgtgtaatccttgccggaccgatgcccgtcacccattcaagcgcggcgcagcgacgaggaagagtcggacgcaaccccaaaaacgagaacgaccaatatatctacatgggtgagccactggaaaacgacgaagactgtgcgcattggaaggaggccaaaatgttactcgacaacatcaacacgcccgagggaataataccgagcatgtttgagcctgagcgggaaaaagtggacgccatagatggggaatatcggctacgcggggaagcccgtaagaccttcgtagatctaatgcgacgtggagaccttccagtatggctggcataccgtgtcgcagcggaaggaatcaattacgcagatagacgatggtgctttgacggggtcaagaacaaccagattctggaggaaaacgttgaagtcgaaatatggacaaaagaaggcgagagaaagaaattaaagccaaggtggttagatgcgagaatatacagtgatcccctcgcgctcaaggagttcaaagagttcgcagccggtcggaaatcacttacactaaacctaatcactgaaatggggcgtttacccaccttcatgacgcagaaagccaaaaacgcactagacaacctggctgttctccacaccgccgaggccggaggccgggcttacaaccatgcgctctctgaattaccagaaacactggaaacgctactactactgacactgctagcgaccgtcactgggggaatattcctcttcctaatgtcaggcaaaggtatcggtaagatgacattagggatgtgctgcataatcacggctagcatattattatggtacgcccagatccaaccgcattggatcgccgccagcataatacttgagttcttcctgatagtgctactgatcccggaacccgagaaacaacggacacctcaagacaaccagcttacttacgtggtgatagcaatacttaccgttgtcgcggccacaatggcgaacgagatgggcttccttgaaaagacgaagaaagattttggcctcggttccataacaacgcagcagccagaaagtaacatcctggacatagaccttcgacccgcctccgcctggacactctacgctgtagcgaccacgttcataacacctatgctcaggcactcaatagaaaattcatccgtaaatgtctccctaacagccatcgccaaccaagccacagttctcatgggactcggcaaaggctggcctttaagtaagatggacatcggagttccccttctagcgattggctgttacagccaagtaaacccgataacccttacagcggcactactcctcttagtcgctcattacgccatcataggacctggcctacaagccaaagcaacccgagaagcccagaagcgagcagcagcgggaataatgaagaaccccaccgtggacggaatgaccgtcatcgacctggaccccataccgtacgacccaaagttcgagaaacaactagggcaagtaatgttactcgtgctctgcgtgacacaggtacttatgatgcgcacaacttgggcactctgcgaagcattgaccctagcaaccggcccaataagcacgttgtgggagggaaacccaggccgcttttggaatacaacaatcgcggtaagcatggcaaacatcttccggggtagctacctagcaggagctggactgctttttagcataatgaaaaacacagcaaacaccaggcgtggcacgggcaatacaggtgaaaccttgggcgagaagtggaaaaacaggctaaatgccctaggtaaaagcgagttccagatttataagaaaagcgggattcaggaggtggacagaacgcttgcaaaggaggggatcaaacgcggcgagacagatcaccacgcggtaagccgcggtagcgccaagctaagatggttcgtggagcggaatctagtgacgcccgagggaaaggtagtagacctgggctgcggacgagggggatggtcctactattgcggaggtttgaaaaacgtcaaggaggtaaaaggcctgacgaagggcggcccggggcatgaagaacccatcccaatgtccacgtatggctggaacttggtaaggttacaatccggtgtggatgtcttcttcaccccacccgaaaagtgtgacaccctcttatgcgacatcggagaaagcagtcccaacccaaccgtagaagccgggaggacactacgggtgcttaatctagttgaaaattggttaaacaacaacacccagttctgcatcaaagtcctaaacccttacatgccttcggtcatagagaagatggaagcattacaacggaaatacggtggcgcactggttcgcaacccgctcagccgaaactccacccacgagatgtactgggtttcgaatgcgagcggaaacatagtgagctcagtgaacatgatctcaagaatgctgataaatagattcacaatgcgccacaagaaagcgacctacgaaccggacgtggatttgggtagcggcacgagaaacatcgggatagaatctgaaacacctaaccttgatatcattggcaagcgaatagagaaaatcaagcaagagcacgagacaagctggcactatgaccaagaccacccctacaaaacctgggcatatcacggtagctacgaaacgaaacaaacgggaagcgcgtccagcatggttaacggggtggtaaggttgctcacaaaaccttgggatgtgataccgatggtgacgcagatggccatgacggacacaaccccctttggacaacagagggtgttcaaagaaaaggtcgacacacggacacaagaaccaaaagaaggcacaaagaaactcatgaaaataacggcggaatggctctggaaagagttagggaaaaagaaaacacctcggatgtgtacccgcgaggaatttacgcgtaaagtacggtcgaatgcagcactaggggctattttcacggacgaaaacaaatggaaaagtgcaagagaggctgtagaagactctggattttgggaattggtagataaggaacgcaacctacacctagagggtaaatgcgaaacctgcgtatataacatgatgggaaaacgagagaaaaagctcggagagttcggcaaagcgaaaggtagcagagccatctggtatatgtggcttggcgcgagattcctagagttcgaggccctaggattcttaaacgaagatcactggttcagtcgcgagaacagcctgagcggggtggagggggaggggctgcataaactagggtacattctgagggacgttagcaagaaagaaggcggagccatgtacgctgatgatacagcgggatgggacaccaggataacactagaggacctcaaaaacgaagaaatggtcacaaatcacatggagggcgaacacaagaaattggcagaggccatattcaaactgacgtatcagaataaggtggtacgcgtgcagaggccgacaccccgagggacggtgatggatatcatcagtagaagagatcaaagaggatccggtcaggtagtcacgtacggactaaacaccttcactaacatggaggcgcaacttatacgacagatggaaggggaaggggtatttaaatcgattcaacagctgacggtaaaagaagaaatcgcagtgaaaaattggcttataagagtaggaagagagcggctcagtagaatggcaatctccggggatgactgcgtagtcaagccgttagacgaccgcttcgcaagcgccctaacagcactaaacgacatgggaaaagtacgcaaagacattcagcaatgggaaccctctaggggttggaacgactggactcaagtgcccttctgtagccatcacttccacgagctgataatgaaggatggtcgcgtactcgtggtcccatgtaggaaccaggatgaactaatcggacgggccaggattagccaaggggcaggatggagcctaagagagacagcctgcctaggaaaatcctacgcgcaaatgtggtcgctgatgtacttccaccggagagacctccgcttagccgccaacgcaatatgttcagcagtgccgtcacactggataccaacatctagaacaacatggtccatccatgctactcatgagtggatgacgaccgaggatatgctaacagtctggaacagagtgtggatacaagagaacccgtggatggaagataagacccccgtagaatcctgggaggaaataccgtacctgggcaaaagagaggatcagtggtgtgggtctctaatcggccttacgtcgagagcgacctgggcaaagaacatacaaactgcaataaatcaagtgaggagcctcatcgggaacgaagaatacaccgactacatgcctagcatgaagagattccgtcgcgaagaagaagaggcgggcgtactctggtga

SEQ ID NO: 24892 - RNA, 9876 nt, synthetic construct
  misc_feature 1..9876: note = derived and/or modified CDS sequence (opt11) from DENV-2__KM279564__SS-prME
  source 1..9876: mol_type = other RNA
accgcgggtatcatcatcatgatgatcccgacagttatggccttccacctgaccacccggaacggggagccacacatgatcgtcagccggcaggaaaaggggaagagcctcctgttcaagaccgagaacggcgtgaacatgtgtacgctgatggctatggacctcggagagctgtgcgaggacacaattacctacaactgtccgctgctccgccagaatgagcccgaggacatagattgctggtgcaatagcacctccacatgggtaacctacgggacctgcaccgctaccggcgagcaccggcgcgagaagcggagcgtcgccctggtgccccacgtgggcatgggactggagacccgtaccgagacctggatgtccagcgagggagcctggaagcacgcccaacggatcgagacctggatcctccgccacccggggtttaccattatggcggccatcctggcctacaccatcggcaccacttacttccagcgggtcctgatttttatcctcttaacggccgttaccccctccatggcgatgcgctgcatcgggatctctaaccgggatttcgtggagggcgtctccggggggagctgggtggatatcgtgctggagcacgggtcctgcgtcactaccatggcgaagaataagcccacgctagacttcgagttgatcaaaactgaggcaaagcacctggccaccctccgcaagtactgcgtggaagccaagttgacgaacacgaccacagcgtcgcggtgccccacccagggtgaacctagcttaaacgaggagcaggacaagcgtttcgtatgcaagcacagtatggtcgaccggggctggggaaacgggtgcggactcttcggcaagggcgggatcgtgacgtgcgccatgttcacatgcaagaaaaacatggagggcaaggtggtccaacccgagaacctggagtataccatcgtgataacgccacactccggcgaggagaacgccgtgggcaacgacacgggaaagcacgggaaggaaatcaagataacgccccagagcagtatcacagaggcggagctgaccgggtacggtaccgttacgatggaatgcagtccacgcaccggcctagacttcaacgagatggttctgctgcagatggaaaacaaggcctggctcgtgcaccggcagtggttcctggaccttcctctaccctggctgcccggcgcggacacacagggttccaactggatccagaaggagaccttagtcactttcaagaacccgcacgccaaaaaacaggacgtggtcgttctcggcagtcaggagggggctatgcacaccgctctgaccggcgccacggaaattcaaatgagctcagggaatttactgttcacgggccacctgaagtgtcgcctgcgaatggacaagctacaacttaagggcatgagctactccatgtgtaccgggaaattcaaggtggtcaaggagattgcggagacccagcacggcaccatcgtgatcagagtgcagtacgaaggggacggctctccgtgcaagatccctttcgaaataatggacctggagaagcggcacgtgctcggccgtctgatcacggtgaaccccatagtgacggagaaagacagtccggtcaacatcgaggccgagccgcccttcggggacagctacatcatcatcggcgtggaacccgggcagctgaagctctcctggttcaagaagggctcatccattgggcagatgttcgagaccactatgaggggcgccaagagaatggccattcttggggacacggcctgggacttcggtagcctgggcggggtgttcacctccatcggtaaggcgctccaccaggtctttggggccatctacggagccgcgttctccggtgtgtcctggaccatgaagatcctgatcggggtggtcatcacctggattggcatgaacagccgctccacgtcgctgtccgtgtcgctggtgctcgtcggtgtagtgaccctgtacctcggcgtcatggtgcaagcggactccgggtgcgtggttagctggaagaataaggagctgaagtgcggcagcggtatcttcattaccgacaacgtgcacacctggacggagcaatacaagtttcaaccggagtccccttcgaagctggccagtgccatccagaaggcgcacgaggagggcatctgtggcatccggtctgtgacccgcctggagaacctcatgtggaagcagataacgcccgagctgaaccacatcctgaccgagaacgaagttaagctcacaataatgacgggggatatcaagggcataatgcaagcagggaagcgatcgctgcgcccccagccgaccgagttaaagtactcgtggaaagcgtggggtaaggccaagatgctttccactgagctccacaaccacacgttcctgatcgacggccccgagaccgccgagtgccccaacactaaccgggcctggaacagccttgaggtggaagactacgggttcggcgtgttcaccacgaacatctggctcaagctgaaggagcgccaggacgtcttttgcgacagtaagctcatgagcgccgcgatcaaggacaaccgggctgtccacgccgacatggggtactggatcgaatccgcactgaatgacacctggaaaatcgagaaggctagcttcatcgaagtaaagtcctgccattggccgaagagccacaccctgtggtccaacggcgtcctcgagagcgagatgatcatccccaagaacttcgcgggcccggtatcccagcacaactaccgccccggctaccacacccagaccgccggtccgtggcacctggggcggctggagatggacttcgacttctgcgaggggacaactgtggtcgtgaccgaggactgcgggaaccgaggccccagcctccgcactacgaccgcctcgggcaagctaatcacggagtggtgctgccgctcatgcaccctgccgcccctccggtatcgcggggaggacggctgctggtacgggatggagatccggcctctgaaagagaaggaggaaaatctagtgaatagccttgtcaccgccggccacgggcaaatcgataattttagtctgggcgtgctgggcatggccctcttcctcgaggaaatgctgcgcacccgggtggggaccaagcatgccatcctcctggtcgctgtgtctttcgtgaccctaatcacgggtaatatgtccttccgcgacctcgggcgcgttatggtgatggtcggcgccaccatgacggacgacatcgggatgggtgtcacatatctggcactgctcgcggccttcaaggtgcggcctacgttcgccgccggcctgctgctccgcaagctgaccagcaaggagctgatgatgaccacaattggcatagttttgttgtctcagagcacgatccccgagtccatactggaactcactgacgccctggcactgggaatgatggtcctcaaaattgtgcggaacatggaaaagtaccagctggccgttaccatcatggccatcagctgcgtgcccaacgccgtgatcctgcagaacgcctggaaagtttcctgcaccacgctcgcggtggtgagcgtatccccgctgctgctcacctccagtcaacaaaaggccgactggatacccttggccctgaccattaaggggctcaaccctaccgccatcttcctgacgaccctgtcaagaacctccaagaagcggagctggcccctaaacgaggcaattatggccgtgggcatggtgtccatactggcaagctcgctgctcaagaacgatatccctatgaccggccccctggtcgccgggggcctgctcacggtgtgttacgtgctgaccgggaggtccgccgatctggagctcgagcgggcagctgacgttcgctgggaggagcaggctgagatcagcggctcgagccccatcctgtccatcacgatcagcgaggacgggtccatgagcataaaaaacgaggaggaagagcagacactgacgatcctaatacggaccggcctgctggttatctccggcctcttcccagttagcatcccgatcaccgccgcagcgtggtacctgtgggaggtgaagaagcagcgcgccggggtactgtgggacgtgccctctccgccgcccgtcggcaaggccgagctcgaggacggggcctatcggataaagcagaagggcatcctggggtactcgcagattggcgccggcgtgtacaaagaggggaccttccacaccatgtggcatgtcacgagaggcgcggtcctcatgcacaaggggaagcggatcgagccctcctgggccgacgtcaaaaaggacctcattagctatgggggggggtggaagctagagggggagtggaaggagggggaggaggtacaggtcttggccctagagcccggcaagaaccctcgagccgttcaaactaagcccgggctattcaagaccaacacgggcacaatcggggccgtgtccctggatttctctcccggcacctccggctcacccatcgtcgacaagaaggggaaggtggtggggctctacgggaacggcgtcgtgacccgatccggcacctatgtcagcgccatagcccagacggagaagtccatcgaggacaatccggagatcgaggacgacatcttccgcaagaagcgtctgaccataatggacctgcaccccggagcgggcaaaaccaaacgctacctgcccgcgatcgtgcgtgaggccatcaagcgcgggctcagaaccctgatcctggccccaacgcgggtggtggccgccgagatggaggaagccctccgaggcctgcctatccggtaccagacccccgcgatccgcgccgagcacaccgggcgggagatcgtcgacctgatgtgccacgccaccttcacgatgcgcttgctgagccccattagagtgccaaactacaacctgatcataatggatgaggcgcacttcaccgacccggctagcatcgcggcgcgcggatacatctccacccgggtggaaatgggcgaggccgccgggatcttcatgaccgccacgccacccggcagccgcgacccctttccgcagtccaatgcgcccatcatggatgaggagcgagagatccccgagaggagctggaactccgggcacgaatgggtgaccgacttcaagggcaagaccgtgtggttcgtgcccagcattaaggccggaaacgacatcgccgcctgcctccggaagaatgggaagaaggtcattcagctgtcgcgcaagacatttgacagcgagtacattaagacgcggaccaacgactgggactttgtggttaccacggacatctccgaaatgggcgccaacttcaaggccgagcgcgtcatcgacccacggcgatgcatgaaacccgtgatcctgactgacggggaggaacgtgtgattctcgccggtcccatgcccgtcacccacagctccgccgcccagcgccggggccgcgtgggccgaaacccgaaaaacgagaacgaccaatatatctacatgggcgagcccctagagaacgacgaggactgcgcgcactggaaggaggccaagatgctactcgacaacatcaacacccccgagggcatcatccccagcatgttcgagccggagcgtgagaaggtggacgccatcgacggcgagtacagactgcgcggggaggcccgcaagaccttcgttgacctgatgcggcgcggcgatctccccgtatggctggcctaccgggtcgcggcggaggggatcaactacgccgaccggagatggtgcttcgatggcgtcaagaacaatcagatcctggaggagaacgtggaggtcgagatctggactaaggaaggcgaacgtaagaagttgaagcccagatggctggatgcccgaatctattccgaccccctggccctcaaggagttcaaggaattcgcggcgggccgcaagtccctgacactgaacctcatcacagaaatgggccgcctccccaccttcatgacgcagaaagctaagaacgccctcgataacctcgcggttctgcacaccgccgaggcgggggggcgggcctacaaccacgccctgagtgagctccccgagaccctggagaccctgctcctgctgacgctcctggcgaccgtgaccgggggcatctttttgttcctcatgtcaggcaaggggatcggcaaaatgacgctggggatgtgctgcattatcaccgcctcgatcttactctggtacgcacaaatccagccccactggatcgccgcaagcataatcctcgagttcttcttaattgtcctcttgatccccgagccggagaagcagcgcacgccccaggacaaccaactgacctacgtggtgatcgcgatcctcaccgtcgtggctgccaccatggccaacgagatgggattcctagaaaagacgaagaaggacttcgggctgggcagcatcactactcagcagcccgagtccaacatcctcgacatcgatctacggccggcgagcgcatggactctgtacgccgtggccacgaccttcataactcccatgctccggcactccatcgagaactcttccgtcaacgtgagcctgaccgcaatcgccaaccaggcgaccgtgctcatgggactcgggaagggctggcccctgtcaaagatggacatcggggtccccctgctcgcgatcggctgctacagccaggtgaacccgatcaccctgaccgccgccctactcctcctggtggcgcattacgccatcatcgggccgggcctgcaggccaaggccacccgggaggctcagaagcgcgcggccgccggtatcatgaaaaatcccacggtcgacgggatgaccgtgatcgacctggaccccatcccctacgatccaaaatttgagaagcagctgggccaggtaatgctgctggtcctgtgcgtgacccaggtgctcatgatgcgcaccacgtgggccctgtgcgaggccctgaccctcgccacggggcccatcagtaccctgtgggagggcaacccggggcgcttctggaacacgaccatcgccgtcagcatggccaacatcttcagaggctcgtacctggccggcgccggtctcttgttcagcatcatgaagaacactgcgaacaccaggcgcggcacggggaacaccggtgagacccttggggagaagtggaagaaccggctcaacgccctggggaagtccgagttccagatttacaagaagtccggcatccaggaggtggaccgcaccctagccaaggaggggatcaagcggggcgagacagaccaccacgccgtgtcccgcggcagcgcgaagctccggtggttcgtcgagcgcaacctggtgaccccagagggaaaggtggtcgacctcggctgcgggcggggcgggtggtcctattattgcggcgggttaaagaacgtgaaggaggtgaagggcctgactaagggcggacctggccacgaggaaccaataccaatgagcacctacgggtggaatctggtccgtctccagtcgggcgtggacgtgtttttcacgccacccgagaaatgcgacaccctgctgtgcgacatcggggagtcaagccccaatcccaccgtcgaggccggccggaccctccgcgtgctgaacctggtggaaaattggcttaacaacaatacccaattctgcatcaaggtgctgaacccgtacatgccctctgttatcgagaagatggaggccctgcagcgtaagtacggcggcgccctggtacgcaatccgctcagccggaactccacacacgagatgtactgggtcagcaacgcctccggcaacatcgtttctagtgtaaacatgatcagccgcatgctgataaaccggttcaccatgcggcacaagaaggcgacatatgagcccgacgtcgacctggggtctggcacacggaacatagggatcgagagcgaaacgcccaacctcgacatcatcggaaagcgcatcgagaagatcaaacaagagcacgagacctcctggcactacgaccaggaccacccctacaagacctgggcctaccatggcagctacgagaccaagcagacggggtccgccagctccatggtgaatggcgtggtcaggttgttgacaaaaccctgggacgtgatcccgatggtcacccagatggctatgacagataccacccccttcgggcaacagagggtcttcaaggagaaagtggacacacgcacccaggagcccaaagagggcactaagaaactaatgaagattactgcagagtggttatggaaagagctgggcaagaaaaagacgccccggatgtgtacacgcgaggagttcacacggaaagtccgcagcaacgcggccttaggggccatcttcaccgacgaaaacaagtggaagtccgcccgggaggccgtggaggactccggcttttgggagctggtggataaggaacgtaacttacacttagaggggaagtgcgagacctgcgtttacaacatgatgggcaagagggagaaaaaactgggggagtttggcaaggcgaagggctcccgcgccatttggtacatgtggctgggggcccggttcctcgagtttgaggcattgggcttcctgaacgaggaccactggttcagccgtgagaacagcctctcgggtgtggagggcgaggggctgcacaagctaggctacatcctccgggacgtgagcaagaaggagggcggggcgatgtacgccgacgatacagccggctgggacacgcgaatcaccctggaggacctgaagaacgaggagatggtcaccaatcacatggagggggagcataagaagcttgccgaggcaatcttcaaactgacctaccagaacaaggtggtgcgggtacaaaggccgacgccacgtgggacggtaatggacattatctcacgccgggaccagcgggggagcggccaggtggtgacctatggactgaacacgttcacgaacatggaggcgcagttaatcagacagatggagggggagggtgtgttcaagtccatccagcagctgaccgtgaaggaggagatcgccgtcaagaactggctgatccgcgtggggcgcgagcggctaagccgcatggcgatcagcggcgacgactgtgtggtcaagcccctggacgatcggttcgccagcgccttaaccgcgctcaacgacatgggcaaggtgcgcaaggatatccagcagtgggagccctcccgagggtggaacgactggacccaggttccgttctgcagccaccacttccacgagctgatcatgaaagacggacgcgtgctggttgtaccttgccggaaccaggatgagctcatcggtcgcgcccgtatctcccagggcgcagggtggagcctgcgcgagacggcctgtctgggcaagtcctacgcgcagatgtggagcctcatgtatttccaccggcgcgacctgcggctggcggccaacgccatttgctccgccgtcccctcacactggatccccacctcccgcacgacctggagcatacacgcgacccacgagtggatgacgaccgaagacatgctcaccgtgtggaaccgggtgtggatccaggagaacccgtggatggaggacaagacccccgtcgaatcgtgggaagaaatcccctacttgggcaaacgcgaggaccagtggtgcgggtccctcatcggccttacttcgcgggcgacctgggccaagaacatccagacggccatcaatcaggtgcgctccctgattgggaacgaggagtataccgactacatgcctagcatgaagcggttccgcattgaggaggaggaggccggcgtgctgtggtaa

SEQ ID NO: 24893 - RNA, 9876 nt, synthetic construct
  misc_feature 1..9876: note = derived and/or modified CDS sequence (opt11) from DENV-2__KM279595__SS-prME
  source 1..9876: mol_type = other RNA
accgcaggcatcatcataatgatgatacccactgtcatggcctttcacctgaccacacgcaacggggagccccacatgatcgtatcgcggcaagagaagggcaaatccctcttattcaagaccgagaatggggtgaacatgtgcaccctgatggcgatggatctcggcgagctgtgcgaggacaccatcacatacaactgcccgctgctccgacagaacgagcccgaagacatagactgctggtgtaacagcaccagtacctgggtgacctacggaacctgtaccgccaccggtgagcaccggcgcgagaaaagaagcgtggccttagttcctcatgtaggcatgggtcttgagacacgcaccgagacctggatgagcagcgagggcgcttggaagcacgcccagcgaatagaaacctggatactccgccatccagggttcaccatcatggcggccatcctggcatacaccataggcaccacctacttccagcgggtcctaatcttcatccttctaacggccgtgaccccctcaatggcaatgagatgtatagggatcagcaatcgagacttcgtcgagggtgtctccggcggcagctgggtggacatcgtgctagagcacggctcctgcgtcaccaccatggccaagaacaagcccacgctcgacttcgagctgataaagaccgaggccaaacacctggccaccctccgcaagtactgcgtggaggcgaagcttacgaatacgaccaccgcgagccggtgcccgacccaaggggaaccctccctcaacgaggagcaggacaagaggttcgtgtgcaagcacagcatggtggaccggggctggggcaatggctgcggtctcttcgggaagggcggaatcgtaacgtgcgccatgttcacgtgcaagaagaacatggagggcaaggtcgtacagcccgagaatctggaatacactatagtgatcacgccccactctggcgaggaaaatgccgtggggaatgacacaggcaaacacgggaaggagatcaaggtcacgccccagagctccattaccgaggccgagctgacaggatacgggaccgtgacgatggagtgctcacctagaaccggcctcgactttaacgagatggttctgttgcagatggaaaacaaagcctggctagtccaccggcaatggttcctggacttaccacttccatggctgcccggggccgacacccaaggctccaactggatccagaaggagaccctggtgactttcaagaaccctcacgccaagaagcaggacgtcgtggttctcggcagccaggagggggcaatgcacacggccctgaccggcgccaccgagatccagatgtcctccggcaacctacttttcacgggccatttgaaatgtcgactgcgcatggacaagctccagctgaagggcatgagctactccatgtgtaccggtaagttcaaggtagtcaaggagatagcggagacacagcacggcacgatcgtgatccgcgtccaatatgagggggacggcagcccatgcaagatccctttcgaaatcatggacctggagaagcgtcatgtgttggggcgactgatcacggtgaaccccatcgtcaccgagaaggactcgccggtaaatatcgaggccgagccgcccttcggagacagctacatcatcatcggggtcgagcccgggcagctgaagctttcctggttcaagaaggggagctccatcgggcagatgttcgagacgaccatgcgcggtgccaagcgcatggcgattctgggcgacacagcttgggatttcgggagcctgggcggagtcttcacatccattggcaaggcgctccatcaggtgttcggcgccatctacggcgccgcattcagcggcgtgtcgtggaccatgaaaatactcatcggggtggtgatcacctggatcgggatgaacagccgctccacgagcctgtccgtgagcctggtcctcgtgggagtagttaccctgtacctgggagtgatggtgcaggcggactccgggtgcgtcgtctcgtggaagaataaggagctcaagtgcggtagcggtatcttcatcaccgacaatgtgcacacatggacggagcagtacaagttccagcccgaatctccctcaaagctggcatccgccatacagaaggcacacgaggaggggatatgcggcatccgcagcgtcacccgcctggagaacctcatgtggaagcagatcacccccgaacttaaccatatcctgaccgagaatgaggtgaagttgacgatcatgaccggggacatcaagggcattatgcaggccgggaagcggaccctgcgaccccaacccaccgagctgaagtattcctggaaggcctggggcaaggccaagatgctctcgactgagctgcacaaccacaccttcctgattgacggcccagagaccgccgagtgcccgaatactaacagggcatggaatagcctcgaagtggaggattacgggttcggagtcttcacgaccaacatctggctgaagctgaaggagcgccaggatgtgttctgtgattctaagctcatgtcagccgcgatcaaggacaaccgagccgtgcatgccgacatggggtactggatcgagtctgctctgaacgacacctggaagatcgagaaggcttccttcatcgaggtcaagagctgccactggccgaagtcccacacactgtggagcaacggcgtactcgagtcagagatgatcattcccaagaacttcgcgggccctgtgtcgcaacacaactaccgccccgggtaccatacccagacggccggcccgtggcacctgggccggctagaaatggactttgacttctgcgagggcacgacggtcgtggtgacagaagactgcgggaatcgcggcccatccctgcggacgaccacggccagcggcaagctaatcacggagtggtgctgccgctcttgcacactgccgccgctccggtaccgcggggaagatggctgctggtacgggatggagatccggccgcttaaggagaaggaggagaacctcgtcaactccctcgtgaccgccggccacgggcagatcgacaactttagccttggcgtgctgggcatggccctcttcctggaagaaatgctgcgtaccagagtagggaccaagcacgccatcctcctggtggccgtttcctttgtcacgctgatcaccgggaatatgagcttccgcgatctcgggcgcgtgatggtgatggtcggagccaccatgaccgacgacataggtatgggcgtcacttatttggccctactcgcggccttcaaagtgcgtccgaccttcgccgctggcctgctactccgtaagcttacctccaaggagttgatgatgaccactatcgggatcgtcctactgagtcagtccaccattcccgagagcatcttagagctcacagacgccttagcactgggcatgatggtgctgaagatcgtccggaacatggagaagtaccagctggccgttacaatcatggccatcctgtgtgtgcccaacgccgtcattttgcagaacgcctggaaagtgtcctgcacgaccctggctgtggtcagcgtatccccgctgctcctgaccagctcccagcagaaggctgactggatcccgctggcgttaaccatcaaggggctcaaccccacggccatcttcctgaccaccctctcgcgtacctccaagaagaggagctggcccctgaacgaggcgattatggccgtgggcatggtctccatcctggcatcatccctgctaaagaatgacatcccgatgaccggccccttggtggccgggggcctcctgacggtgtgctatgtgctgaccgggcgcagcgccgaccttgagctggagagagcggccgacgtgagatgggaggagcaggccgagatcagcgggtcgagccccatcctctctatcaccatcagcgaggatgggtccatgtcaatcaagaacgaggaggaagagcaaacgctgaccatcctgatccggaccggcttactcgtgatctccggcctgtttcccgtcagcatcccgattacagccgctgcgtggtacctgtgggaggtgaagaagcagcgcgccggggttctctgggatgtcccgagcccgccgcccgttggtaaggctgagctagaagacggggcataccggatcaagcagaagggcatcctcgggtacagccagataggcgcaggcgtgtacaaagagggaaccttccacactatgtggcacgtgacgaggggcgccgtgctcatgcacaagggaaagcggatcgaaccgtcatgggcggacgtgaagaaagacctgatcagctacggcgggggctggaaactggagggcgagtggaaggagggggaggaagtccaggtactcgccttagagccgggcaagaacccccgcgctgtacagaccaagcccgggctattcaagaccaacacgggcaccatcggggccgtatcccttgatttcagtcctggcacgagtggaagccccattgtggacaagaaggggaaggtagtcggcctgtacgggaatggcgtcgttacccggtccggcacgtacgtcagcgcgatcgcgcaaaccgagaaaaacatcgaggataacccggagatcgaagacgacatcttccgtaagaaaaggctgaccatcatggacctgcacccgggggccggcaagaccaagaggtatctccccgccatcgtacgggaggccataaaacgcggactgcggacgctgatactcgcccccacccgagtggtcgcagctgagatggaggaagctctgcgcggcttaccaatccggtatcagacccccgcgatccgcgccgagcacaccgggcgagagatcgttgacttaatgtgtcatgctaccttcaccatgcgcctgctgtccccgattcgggtgcctaactacaacctcatcattatggatgaagctcacttcaccgacccagccagtattgcggcccgcggctacataagcaccagagtagagatgggtgaggccgcggggatcttcatgacggccactccgcccggctcgcgcgaccccttcccgcagagcaatgcgcccatcatggacgaagagaaagagatccccgagcggtcctggaactcagggcacgagtgggttaccgactttaaggggaaaaccgtatggttcgtcccctccatcaaagccgggaacgacatcgccgcctgcttacgcaagaacggcaagaaggtaatccaactgtctcgtaaaacgtttgactccgagtacattaagactcgcaccaacgattgggacttcgtggttaccaccgacatctccgagatgggggcgaacttcaaagcggagcgggtgatcgacccgcggcggtgcatgaaacctgtgatcctcaccgacggggaagaaagggtcatcctggccggccccatgcccgtgacgcactcctctgcggcacagcggcgcgggagggttggccgcaatcctaagaacgaaaacgatcaatacatctatatgggcgagcccctggagaatgacgaggactgcgcgcactggaaggaagccaagatgctactggacaacatcaacactccggagggcatcattccctcaatgttcgagccagagcgggagaaggtggacgccatcgacggcgaataccggctgagaggggaggcccggaagacgttcgtggacctcatgcgacggggcgacctgcccgtctggctggcttaccgcgtggcggccgaggggatcaattacgccgaccggcgctggtgcttcgatggtgtgaaaaacaaccagatcctcgaggagaacgtcgaggtggagatctggaccaaggagggggagcggaaaaagctgaagccccgctggttggacgcccggatctatagtgatccgctcgccttaaaagagtttaaggagtttgcagccggccgcaagtctctgacgctaaacctgataaccgagatgggccggctgcccacgttcatgacccagaaggctaagaacgcccttgacaacctggcagttctgcacaccgccgaggccgggggccgtgcctacaaccacgccctcagcgaactgccggagaccctggagacgctgctgttgctcaccttactggcaaccgttactggtggcatcttcctcttcctgatgtccggcaaggggatcggtaagatgaccttagggatgtgctgcatcatcacggcctctatcctactgtggtacgcgcagatacaaccccactggatcgccgcctccatcatccttgagttctttctcatcgtgctcctgattccggagcccgagaagcagcgtactccgcaagacaaccaactcacctacgtagtcattgcaattctgaccgtggtggccgccacgatggccaatgagatgggtttcctggagaagaccaagaaggacttcggtctcggcagcatcaccacccagcaaccagagtccaacatcctggacatcgacctgcgcccggccagcgcatggacgctctatgcagtggcgaccaccttcatcacgcccatgctgcgacactcaatcgagaactccagcgttaacgtgtcccttacagccattgcgaaccaggcgacggtcctcatgggcttggggaagggctggcccctgagcaagatggacatcggggtccccttactggccataggctgttattcccaggtgaaccccatcaccctaaccgccgcgctcctgctgctcgtcgctcactacgcgatcatcgggcccggactgcaggcgaaagctacgagggaggcccagaagcgggcggccgccggcatcatgaaaaatcccaccgtggacggcatgaccgtgatcgatctggaccccatcccgtacgaccctaagtttgagaagcagctcggccaggtcatgctgctggtgctctgcgtgacccaggttctgatgatgcgcacaacatgggccctgtgcgaggcactaaccttggcgaccgggccgataagcacgttatgggagggcaaccccgggcggttttggaacaccactatcgccgtgtccatggccaacatctttcgcgggtcatacctcgccggggccgggctgctgttcagcatcatgaagaacaccgcgaacacgcgtaggggcaccggaaacactggggagaccctcggtgaaaagtggaagaacagactaaacgccctgggcaagtccgagttccagatctacaaaaagtccgggattcaggaggtggatcggacgctggccaaggaggggatcaagcgcggtgagactgaccaccacgccgtatcgagaggttccgcgaagctgcgttggttcgtcgagcgaaacctggtgaccccggagggcaaagtggtggacctcggctgcgggcgtggggggtggtcttactactgcggcgggctgaagaacgtgaaggaggtgaagggcctgaccaaaggcggacccggtcacgaggaacccatccccatgtccacgtacgggtggaacctcgtgcgtctgcagagcggcgtggacgtcttcttcaccccgcccgagaagtgcgacaccttgttgtgcgacatcggggaatctagcccgaaccccaccgtggaggccggccgcaccctgcgggtgctcaacctggtcgagaactggctgaacaacaatacgcagttctgcatcaaggtcctcaatccttacatgcccagtgtgattgagaagatggaggctctgcaacggaagtatggcggggccttggtccggaacccactgtctcgcaactcgacacacgagatgtactgggtgtccaatgccagcggtaacatcgtgtccagcgtcaacatgatctcccgcatgttgataaaccgctttaccatgcggcacaagaaggcaacttacgagccggacgttgatttaggctcgggcacgcgcaacatcggaatcgaatccgaaacgcccaacctcgacatcatcggcaagcggatcgagaagatcaagcaggagcatgagaccagctggcactacgaccaggaccacccctacaagacctgggcctaccacggctcctacgaaacgaaacagaccgggagcgcctccagcatggtgaatggcgtcgtgcgcctgttaacaaagccatgggacgtgatacccatggtcacccagatggccatgacggacaccacacccttcgggcagcagcgcgtgttcaaggagaaagtcgacacccggacgcaggagcccaaggagggcacgaaaaagctgatgaagatcaccgccgagtggctctggaaggagttaggcaagaagaagacgccccgcatgtgcacgcgggaagagttcacccgcaaggtgcggtccaacgcggccctgggggccatcttcaccgacgagaacaagtggaagtcagcccgagaggccgtggaggactcagggttttgggagctcgtagacaaggaacggaacctccatttagaggggaagtgcgagacctgcgtgtataacatgatgggaaaaagagaaaagaagctgggtgaatttggcaaagcgaagggcagccgggccatctggtacatgtggctcggagcacggttcctagagttcgaggccctggggtttcttaacgaagaccactggttcagtcgggagaactcgctgtctggggtggagggcgagggactgcacaagctcggctacatcctacgcgacgtcagcaaaaaggagggcggggctatgtatgccgacgacaccgccggatgggatacccggatcacgctggaagacctcaagaacgaggagatggtgaccaaccacatggagggggagcataagaagttagcagaggcaatattcaaactgacgtatcagaacaaggtagttcgcgtacaacgaccgactccccgcggcacggtgatggacattatctctcggcgtgaccagagagggtccggccaggtcgtgacctatggcttgaacaccttcaccaatatggaggcgcagctcatacgccagatggaaggcgagggcgtgtttaagagcatccagcagctcacggtaaaggaggagatcgccgtgaaggactggctcatccgggtgggccgtgagcgcctttcccggatggccatcagcggcgacgactgtgtcgtgaagcccctggacgaccgctttgcctccgcactcaccgcgctcaacgacatgggcaaggtgcgaaaagacatccagcagtgggagccctcacgagggtggaacgactggacgcaggtcccattctgctctcaccacttccatgagctgatcatgaaggacggacgggtgctcgttgttccctgccgcaaccaggacgaattgatcgggcgggcccgaatctcccaaggcgccgggtggtccctgcgggagaccgcgtgcctcggcaagtcgtacgcccagatgtggtccctgatgtacttccaccgccgggacctgcgcctagcggccaacgccatctgcagcgccgtaccgtcccactggattcccacctcccggaccacctggtccatccatgccacacacgaatggatgacgaccgaggacatgctgacggtatggaatcgcgtctggatccaagaaaacccgtggatggaggacaaaacgcccgtggagtcttgggaggagattccatacctgggcaaacgtgaagaccagtggtgcgggtccctgattgggctgaccagcagagccacgtgggccaaaaatattcagaccgctatcaaccaggtgcgtagcctgatagggaacgaagagtacacggactacatgccatccatgaagcgcttcagacgggaggaggaggaggccggggtcctctggtga

SEQ ID NO: 24894 - RNA, 9876 nt, synthetic construct
  misc_feature 1..9876: note = derived and/or modified CDS sequence (opt11) from DENV-2__KM279566__SS-prME
  source 1..9876: mol_type = other RNA
accgcgggcatcattatcatgatgatccccaccgtcatggcattccatctcaccactcgcaatggggaaccccacatgatagtctctcggcaagagaagggcaagtcattactgttcaagacggagaacggagtgaatatgtgcaccctcatggcgatggacctcggtgagctgtgcgaagatacgatcacctataactgccccctgctccgccagaacgagcccgaggatatcgactgctggtgtaatagcacctccacctgggtgacctacgggacttgcaccgccacgggcgagcaccggcgcgagaagcggagcgtcgcactggtgcctcacgtggggatggggcttgaaacgcgcacggaaacctggatgtctagcgagggcgcatggaagcatgcccagcggattgaaacctggatcctccgacatcctgggttcaccatcatggcggccatcctggcctacaccatcggaaccacctacttccagagagtcctgatcttcatcctcttaaccgccgtgaccccgtccatggcgatgcgctgcatagggatcagcaaccgtgacttcgtggagggagtatccggtgggtcctgggtagacatagtgttagagcacggctcctgcgttaccaccatggccaagaataagcccactcttgatttcgaattaatcaagaccgaggccaaacacctggccaccctacgcaagtattgcgtggaggccaagctgaccaacacgacgaccgcgagccggtgccccacccagggggagccctccctaaacgaggaacaggacaagcgctttgtatgcaagcacagcatggtcgaccggggctggggcaacgggtgcggtctattcgggaagggtggcatcgtaacttgcgcaatgttcacatgcaagaaaaacatggagggcaaggtcgtccagcccgagaacctggaatacacaatcgtgatcacgccgcactccggcgaggaaaacgccgtggggaacgatactggtaagcacggtaaggagatcaaggtcacgcctcagtcatccatcacggaggccgagctgactggctacgggactgtgacgatggagtgctccccgcgcaccggtctcgactttaatgagatggtgctgctgcagatggagaataaggcctggcttgtccaccggcagtggttcctggacctcccccttccctggctgcccggcgcggacactcaggggagtaactggatccagaaagagaccctggttacgttcaagaacccgcacgccaaaaagcaggacgtcgtggtgctcggcagccaagagggggccatgcataccgccctgactggcgccaccgagatccagatgagctccgggaatttgctttttacgggccaccttaagtgtcgactgcggatggataagctacaactgaagggaatgagctatagcatgtgcaccgggaagttcaaggtcgtgaaggagatcgctgagacgcagcacggcaccatcgtgatcagggttcagtacgagggggatggcagcccctgcaagatccctttcgagattatggatctggagaagcgccatgtgctcggccgcctgatcacggtcaatcccatcgtcaccgagaaggactcccctgttaacatcgaggccgagccgcccttcggggacagctacatcataataggcgtggagcccgggcagctgaagctctcctggttcaagaagggcagctccatcggtcagatgtttgagaccacaatgcgcggcgcaaaacgtatggccatccttggcgacacggcctgggacttcggcagcctgggtggagtcttcacctccatcggcaaggccctccaccaggtgtttggagccatctacggcgccgccttcagcggcgtgtcctggaccatgaagattctgataggggtagtcataacctggatcgggatgaacagccgctccacgtctctgtccgtgagccttgtcctcgtaggggtcgtcaccctgtacttaggagtgatggtgcaggcggactctggatgcgttgtgagctggaagaacaaggagctcaagtgcgggtccgggatcttcatcactgacaacgtgcacacatggacggagcagtacaagtttcagccggagtcccccagcaagctggcgagtgccattcagaaggcccacgaggaggggatctgtggcatccgcagcgtcacccgtctggagaatttaatgtggaagcagatcacccctgagctgaatcacatcctgaccgagaacgaggtgaagctcacaattatgaccggggacattaagggcatcatgcaggctggaaagcgcacgttacgtccccaaccaactgagttaaagtactcatggaaagcgtggggcaaggctaaaatgctcagcacggaactgcataaccataccttcctgattgacggccccgagacggccgagtgcccaaacaccaaccgggcctggaattcactcgaggtggaagactacggatttggcgtcttcacgaccaatatatggttgaagctgaaggagcgtcaggacgtgttctgtgattctaaactcatgtccgccgccataaaggacaaccgggccgtgcacgccgacatggggtattggatcgagagcgctctgaacgacacctggaagatcgagaaggcctccttcatagaggttaagagttgccactggccgaagtcccacaccctgtggagcaacggggtgcttgagtccgagatgattatccccaagaatttcgcgggccccgtgagccagcacaactatcgcccagggtaccacacccagacggccggcccgtggcacctggggcgactggagatggactttgacttctgtgagggcaccaccgtggtggttaccgaggactgcgggaatcgcggccccagtctcagaacgaccaccgccagcggcaagctgatcaccgagtggtgctgccgcagctgcacgctgccgcccttgcggtaccgcggggaggacggctgctggtacgggatggagatccggccgctgaaggagaaggaggaaaacctggttaacagtctcgtgaccgccggccacgggcagatcgacaatttctcactgggcgtcctgggcatggccctcttcctggaggagatgcttcgtacccgggtggggaccaagcacgccatcctcctggtcgccgtatcctttgtcacgctgatcaccgggaacatgtcattccgcgacctaggacgcgttatggtaatggtcggggccaccatgacggacgacataggtatgggtgtgacgtatctggccctgctcgcggccttcaaggtgcggcccacgttcgccgccgggttactgctcagaaagctgactagtaaggagttaatgatgaccacgatcgggatagtcctgctgagccaatccaccatccccgagtctatcctggagctcaccgacgccttagcccttggcatgatggtccttaagatcgtcagaaacatggagaagtaccaactggccgtcacgatcatggcaatcttatgcgttcccaacgccgtcatcctccagaacgcctggaaggtgtcctgcacgaccctagcggtggtcagcgtgtccccgctgcttctgaccagctcccagcagaaggctgactggatccccctggccctcaccatcaagggactgaaccccacggcaatcttcctcaccaccctctcccgtacctccaagaagcggagctggcccctgaacgaagctatcatggccgtgggcatggtttccattctggcaagcagcctcctgaagaatgacatcccgatgacgggccccctagtggccggcggtctcctgaccgtgtgctatgtcctcaccgggcgctcggccgacctcgagctcgagcgggcggccgacgtgcgctgggaggagcaagctgagatcagcggatccagcccgatcctgtctatcaccatcagcgaagacgggtccatgagcatcaagaacgaggaagaggaacagacgctgaccatactgatccggaccggcctgctcgtaatctctggcctgtttcccgtttctattccgatcaccgccgctgcctggtacctttgggaggtgaagaagcaacgcgccggcgtgctctgggacgtccctagcccgccgcccgttgggaaggccgaactggaggacggggcgtaccggatcaagcagaaaggaatcctgggatattctcagataggcgccggcgtgtacaaggaggggaccttccacacgatgtggcacgtcacccgcggcgctgtgctcatgcacaagggaaagcggatcgagccctcctgggccgacgtcaagaaggatctgatcagctatggcggagggtggaagctggagggtgagtggaaggagggagaggaggtccaggtgctcgccttagagccaggcaagaacccccgcgctgtccaaacgaagccagggctgttcaagaccaacacaggcaccattggagccgtctcactcgactttagccccggaacctccggcagccccatcgtggacaagaagggaaaggtggtcggcctgtacgggaacggcgtggtgacccggtccggtacgtacgtcagtgcgatagcccagaccgagaaatccatcgaggacaacccagaaatcgaggatgacatattccgcaagaagaggttaactatcatggatctgcatccaggggctggcaagaccaagcgctacctccccgccatcgtacgggaagcgatcaagcgcgggctgcggacgctgatcctcgcccccacccgcgtggttgccgccgagatggaggaggcactgcgaggcctgccgatccggtaccaaacgccagcgatccgcgccgagcacaccgggcgggaaatcgtggatctcatgtgccacgccacgttcaccatgcggctcctgagccccatccgggtgcccaactacaacttgatcatcatggatgaagcccacttcactgacccggcaagcatagcggcccgcggctacatctccacccgggttgagatgggcgaagccgccgggatattcatgacggccacgccgccgggcagcagggaccccttcccgcagtccaacgcgcccattatggacgaggagaaggagattcccgaacggagctggaactccggccacgagtgggtgaccgacttcaagggcaagaccgtgtggttcgtcccctcgatcaaggccgggaatgacatagccgcctgtttgcgcaagaacggcaagaaggtgatccagctgtcacgaaagacgttcgacagcgagtacataaagacccggaccaacgactgggatttcgtagtcaccacggacatctccgagatgggcgcgaacttcaaggctgagcgggtgatcgatccgcgccgatgcatgaaacccgtcatactcaccgacggggaggagcgcgtgatcctcgctggccccatgccggttacccacagctccgccgcccagcggcgcggtagggtcggacgcaatccgaagaacgagaatgatcagtacatctacatgggggagcccctggagaacgacgaagactgcgcgcactggaaggaggccaaaatgctcctcgacaatatcaacacgccggaaggcatcatcccaagcatgtttgagccggaacgagagaaggtcgacgcgatcgatggcgagtaccggctgcgaggggaagccagaaagacgttcgtggatctcatgcgccggggcgacctgcccgtctggctggcctaccgtgtggctgcggaggggatcaattatgccgaccggcgctggtgtttcgacggcgtgaagaataaccagatcctcgaggagaacgtcgaggttgagatctggaccaaagagggggagagaaagaagcttaagccgcgctggctggacgcccggatctactccgacccgctcgccctgaaggagttcaaggagttcgccgccggccgcaagagcctgaccctcaacctgatcaccgagatgggccggctgccaacgttcatgacacagaaggccaagaacgcgctcgataacttagcggtactgcacaccgccgaggctgggggccgcgcctacaaccacgccctctccgagctgcccgagactcttgaaacgctcctgttactcactctgctggctacggtaactgggggcatcttcctattccttatgagcggcaaggggatcgggaaaatgaccctggggatgtgctgcatcatcacggcctccatccttctatggtacgcccagatccagccccactggatcgccgcctcaataatcctggagttcttcctaatcgtgctgctgattccggagcccgaaaagcagcggacgccccaggacaaccaactcacatacgtggtcatcgccatcctgacggtggtggccgccactatggccaacgaaatggggtttctggagaagactaagaaagacttcgggctcggctccataacgacccagcagcccgagtctaacatcctggacattgacctgcgccccgccagcgcgtggacgctctacgccgtcgcaaccaccttcatcactcccatgctgcggcactccatcgagaacagcagcgtcaacgtgtccctgacggccatcgctaaccaggctactgtcctcatgggcttggggaaggggtggcccctgtccaaaatggatatcggggtccccctcctggccatcggctgctacagccaggtgaacccgatcaccctgacagccgccttactcttactcgtagctcactacgccatcatagggcccggcttacaggccaaggccacacgagaagcgcagaagagagcggcagcgggcatcatgaagaaccccactgtggacgggatgaccgtcatcgatctcgaccccatcccttacgaccccaagttcgagaagcaactcggacaggtcatgctgcttgtcctctgcgttacccaggtcctgatgatgcgcacgacctgggccctgtgcgaagcgctaacactggcgacaggtccgatctccacgctatgggagggcaaccccggccggttctggaataccaccatcgctgtgagcatggccaacatattccgcggctcatacctggccggggccgggctgctgttctctatcatgaaaaacactgcgaacacgcgtcggggcaccggtaataccggcgagaccctgggtgagaagtggaaaaatcgcttgaacgccctggggaagtcagagttccagatctacaagaaaagtggcatccaggaagtggaccggacgctcgccaaggaaggcatcaagcgcggcgagacagaccaccatgctgtcagccggggaagcgccaagcttcgttggttcgtggagaggaacctggtcaccccggagggcaaggtagtggacttgggctgcgggcgcggcggttggtcctactactgtggcgggctgaagaacgtgaaggaggtcaagggcctgaccaagggcgggcctggacatgaagaacccatccccatgagcacgtacgggtggaacctcgtgcggctgcagtccggcgtggatgtcttctttacgccgccggagaaatgcgacacccttctctgcgacatcggggaatcatcccccaacccgacggtggaggccggtaggaccctgagggtgctgaacttagtcgaaaactggctgaacaataacacgcagttctgcatcaaggtactgaacccatacatgccctccgtaattgaaaagatggaggccttacagcgaaagtacggcggtgccctcgtacgaaacccactctctcgcaatagcactcatgagatgtactgggtaagcaacgcatccggcaacatagtgagctccgtaaatatgataagccgaatgctgatcaacaggttcaccatgcgtcacaagaaggcgacatacgagcccgacgtcgacctggggtccgggacaaggaatattgggatcgagagcgagacgccaaaccttgacatcatcggcaagcggatcgagaagatcaagcaggagcatgagacaagttggcactacgaccaggaccacccctataagacctgggcctaccacgggagctatgagacaaaacaaaccgggtccgccagttccatggtgaacggcgtcgtgcgcctgttaaccaagccttgggacgtgatacctatggtaacccagatggcgatgaccgacaccacccccttcgggcagcagcgcgtgttcaaggagaaggtcgacacccgtacccaggagccgaaagagggcaccaagaagctgatgaagatcaccgccgaatggctgtggaaggagctcggcaagaagaagacgccccgcatgtgcacacgcgaagagttcactcgtaaggtgcggagcaacgcggcccttggggcaatctttaccgatgagaacaagtggaaaagtgccagggaggccgtagaggacagcggcttctgggagcttgtcgacaaagagcggaacttgcacctggagggcaagtgcgaaacctgcgtatacaacatgatgggcaaacgcgagaagaagctgggagagttcggcaaggcgaaaggctcccgtgccatctggtacatgtggctaggggcgcgctttctggagttcgaggctctgggtttcctcaatgaggaccactggttctcgcgtgagaactcactaagcggggttgagggcgaaggtttacacaagctgggctacatcctgcgcgacgtctccaagaaggagggaggcgcgatgtacgccgacgatacggccggctgggatacgcggatcactcttgaggacctaaagaacgaggaaatggtgacgaaccacatggagggcgagcataagaagctggccgaagccatcttcaagctgacctaccagaacaaggtggtccgcgtgcagcggccgacgccccggggcaccgtgatggacatcatatcccgccgcgaccaaaggggaagcggccaggtcgtgacctacggtctcaacacatttacaaacatggaggcgcaactgatccgccagatggaaggtgagggcgtgttcaagtccatccagcaactgaccgtaaaggaagaaattgccgttaagaactggctcatccgggttgggcgcgagcgcctgagccgtatggctatctccggcgacgactgcgtcgtgaagcccctggacgacaggttcgcttcagccctcacggcgctaaacgacatggggaaagtgcggaaagacatacagcagtgggagccaagccgcgggtggaacgactggacgcaggtccccttctgcagtcatcacttccacgagctgatcatgaaggacggccgggtgttagtggtgccatgccgcaaccaggacgagttaattggtcgagcccgcatctcgcagggcgcagggtggtcactgcgagagaccgcctgcctgggcaagtcctacgcccagatgtggagcctgatgtacttccatcgcagggacctacgcctagcggcgaacgcgatctgctccgccgtgcctagccattggatccccacgagtcgtacgacctggagcatccacgccactcatgagtggatgactaccgaggatatgctgaccgtgtggaacagagtctggatacaggagaacccgtggatggaggacaagacgcccgtggagtcttgggaggagatcccctacctgggcaagcgggaggaccagtggtgtgggagcctcatcggcctgaccagcagagcgacctgggccaagaacatccagaccgccatcaatcaggtgcggagcctgatcggcaacgaggagtacactgattacatgcccagcatgaaaaggttccgccgcgaggaggaggaggccggcgtattatggtaa

SEQ ID NO: 24895 - RNA, 9876 nt, synthetic construct
  misc_feature 1..9876: note = derived and/or modified CDS sequence (opt11) from DENV-2__KM279574__SS-prME
  source 1..9876: mol_type = other RNA
accgcgggcatcatcatcatgatgatccccaccgtgatggcctttcacttaaccacgcggaatggggaaccccacatgattgtgagccggcaggagaagggcaagtccctcctgttcaagaccgagaatggggtcaacatgtgcaccctgatggctatggacttgggcgagctatgtgaggacaccatcacctacaattgcccgctgctccgccagaacgagcctgaggacatcgactgctggtgcaacagcaccagcacctgggttacctacggtacctgcaccgccaccggcgagcaccggcgcgagaagcgtagtgtcgccctggtgccgcacgtgggcatgggactggagacccgaacagagacctggatgagctccgagggtgcttggaagcacgcccagcgtatcgaaacctggatcctacgacaccccgggttcaccatcatggctgcaatcctggcctacacgatcgggaccacctactttcaacgggttctgattttcatactcttaacagccgtgaccccctccatggcaatgcgctgtatagggatatcgaacagggactttgtggaaggcgtctccggcgggtcatgggttgacatagtactggaacacggctcgtgtgtcactaccatggccaagaacaagccgactcttgacttcgagctcatcaagaccgaggccaaacacctcgccaccttacggaaatactgcgtggaggccaaacttaccaacacgaccaccgcgagccggtgccctacccaaggggagccctccctgaacgaggagcaggacaagcgctttgtgtgtaagcatagcatggtagaccggggctggggcaacgggtgcggcctcttcgggaagggcgggattgtaacctgcgctatgttcacatgcaagaagaacatggagggcaaagtggtccagcccgagaacctggaatacaccatcgttatcacgccccacagcggggaggagaacgccgtggggaatgacactggtaagcacgggaaggaaatcaaggtcactccccagagcagcatcaccgaggccgagctgaccggctacgggaccgtaacaatggagtgcagcccgaggaccggtcttgatttcaacgagatggtgttactgcaaatggagaataaggcctggctcgtccaccggcagtggttcttagacttacccctcccctggctaccgggcgccgacacccaggggagtaactggatccaaaaggagacactggtgactttcaagaacccgcatgccaaaaagcaggacgtcgtggtgctcggctcgcaggagggggccatgcacaccgcgctgaccggcgcaacagagattcagatgagctccgggaacctcttgttcacgggccacctcaagtgtaggttacggatggacaagctccaactgaagggcatgagctacagcatgtgtacgggtaagttcaaggtcgtcaaggagatcgctgagacccaacacgggaccatcgtgatccgcgtccaatacgagggggacggcagtccctgcaagatcccctttgagataatggacctggagaagcggcatgtcctcggccgcctaatcacggtaaaccccatcgtcacggaaaaggactccccggtgaacatcgaggccgaaccgcctttcggtgactcatacatcatcataggcgttgaacccgggcagttaaaactctcctggttcaagaagggaagttccatcggtcagatgttcgagacaacgatgcgcggcgccaagcggatggccatattaggtgacacggcctgggacttcgggtccctgggcggcgttttcacctccatcggcaaggcgctccaccaggtgttcggggccatctacggggcggcattcagcggtgtgtcctggactatgaagatcttaatcggggtcgtgattacctggatcggcatgaactccaggtccacgagcctgtccgtcagcctggtcctcgtgggggtggtcaccctgtacctgggagtgatggtacaggccgactccgggtgcgtagtttcttggaagaacaaagaactaaagtgcggcagcggcatcttcatcaccgataacgtgcacacttggacggagcagtacaagtttcagccggagtcccccagcaagctggcttccgccatccagaaggcccacgaggaaggtatctgcggaatccgtagcgttacccgcctggagaacttaatgtggaagcagatcacccccgagctaaaccacatactgaccgagaacgaggtgaagctcacgataatgacaggagacattaagggtatcatgcaggccgggaaacggactctgcgcccccagccgaccgaacttaagtactcctggaaggcgtggggcaaggccaagatgctcagcacagagctgcacaaccacaccttcttgatcgatggccctgagaccgccgaatgccccaataccaaccgggcctggaactccctggaggtcgaggattacgggttcggcgtattcacaaccaacatctggctgaagttgaaggaacgccaggacgtgttctgcgactctaagctcatgtccgccgcgatcaaggacaaccgcgccgtgcacgccgacatggggtactggatcgagagcgccctaaacgatacctggaagatcgagaaggcctcgtttatcgaggtcaagagctgtcactggccgaagtcccacaccctgtggtcgaacggtgtgttagagtccgagatgatcatacccaagaacttcgcgggccccgtgagccaacacaattaccgccccggatatcacacccagacggccggcccttggcatctggggaggcttgagatggacttcgacttctgcgagggtacaacggtcgttgtgaccgaggactgcgggaaccgcgggccctccctacggacgactactgcaagcggcaagctgatcaccgagtggtgctgtcgctcctgcactttgcctcctctacggtataggggcgaggacgggtgctggtacgggatggagatccggccgctgaaagagaaggaggagaacctggtcaactccctcgtcacggcgggccacggtcagatcgataactttagcctgggcgtattaggcatggccctctttctggaggagatgttaagaacccgggttgggaccaaacatgccatcctcctggtcgcagtgtctttcgtcacgctaatcaccggaaacatgtcattccgcgacctcgggcgcgtgatggtgatggtgggcgccaccatgaccgacgacatcggcatgggcgttacatacctggccctgctagcagccttcaagattcgccccacctttgccgcaggcctgctgctccgtaagctgacgtccaaggagctgatgatgacgacgatcggtatcgtcctcctgtcacagtccaccatccccgagagtatccttgagctcacagacgccttagctctgggcatgatggtcttaaaaattgtgcggaacatggaaaagtaccaactggccgtcacgattatggcgatactttgtgtcccgaatgcggtgatcctccagaacgcctggaaggtctcttgcacgaccttagcggtggtgagcgtctcccctctgctcctgacctcgtcccagcaaaaagccgactggatccccttggccctcaccatcaaggggctaaatcccacggctattttcttaaccaccctcagccgcacttccaagaaacggagctggccactgaacgaggccatcatggcggtggggatggtttccatcctggcctcttccttgcttaagaacgacatcccgatgacgggtcccttggtcgccgggggcttgctgaccgtgtgctacgtgctgacagggcgctcagccgatttagagttggagcgtgcggccgacgtcagatgggaggagcaagccgagatctcaggctcctccccaatcttaagcatcaccatcagcgaagacggatccatgagcatcaagaatgaagaggaggaacagactctcacaatattgattcggaccggtctgctcgtgatctcgggactgtttcctgtgagtatcccgattaccgccgccgcctggtacttgtgggaggtcaagaagcaacgggctggggtgctctgggacgtgcccagccctccacccgtcggcaaagccgaactggaggacggtgcctaccggataaagcagaagggcatcctggggtactctcagatcggcgccggcgtttacaaggaggggaccttccacaccatgtggcacgttaccagaggcgcggtgttaatgcacaaagggaagcggatcgagccttcctgggcagacgtgaagaaggacctgatcagctatggcgggggctggaagctggagggcgagtggaaagaaggggaggaggtacaggtcctcgccctggagcccggcaagaaccctagggctgtgcaaaccaagccagggttattcaagaccaacacaggcaccatcggtgccgtgtccctagacttcagccccggaacctccggcagccccatcgttgataagaaggggaaggtggtgggcttgtatgggaatggcgtcgtaacccgctctggcacctacgtgagcgctatcgcccagaccgaaaaatcgatcgaagacaacccggagatcgaggacgatatctttcgcaaaaagcggctgaccatcatggatcttcaccccggcgccggcaagaccaagcgatacctccctgcgatcgtccgggaagcgattaaacgcggtctgcggacattaattctcgctcccacacgcgtggtagccgccgagatggaggaggccctgcgcggcctgccaatccggtaccagactccagcgatccgcgcagagcacacggggagagagattgtggacctcatgtgccacgccacgttcaccatgcgtttactgagtcccatccgggtgcccaactacaacctcatcataatggacgaggcccacttcaccgaccccgcgtctatcgccgcccgcggctatataagtacccgcgtggagatgggggaggccgcggggattttcatgacggccacgccgcccggaagcagggatcccttccctcagtccaacgcgcccatcatggacgaggagaaagagatcccagagcggagctggaactccgggcacgagtgggtcaccgactttaagggcaagaccgtttggttcgtgcccagcatcaaggccgggaacgacatcgcggcctgcttacgcaagaatgggaagaaggtaatccaactgtcccggaagacgttcgacagcgagtacatcaagacccgcacgaatgactgggacttcgtggtgacaacggacatctctgagatgggcgcgaacttcaaggccgagcgggttatcgacccgcgccggtgtatgaagcctgtgatactcaccgacggcgaggagcgcgtcatattagccggccccatgcccgtcacccacagttctgccgcccaacggcgcggacgggtgggccgcaatccgaagaacgagaacgaccagtacatctacatgggggagcccctcgaaaacgacgaagactgcgcgcactggaaggaggccaagatgctcctggacaatatcaacactcccgagggaatcatccccagtatgttcgagcctgagcgcgagaaggtagacgccatcgacggcgagtacaggttgagaggggaggcccggaagacgttcgtcgatctcatgcgccgtggcgacttacccgtttggctggcttaccgggtcgcggccgaggggattaactatgccgaccggcgctggtgctttgatggggttaagaataatcagatcctcgaggagaatgtggaggtcgagatctggaccaaggagggggagcggaagaagttaaagcctagatggctcgatgcccggatttacagtgatccgctcgccctgaaggagttcaaggagttcgcagccggcagaaagagcttaaccctcaacctgataaccgagatggggcggctgcccacgtttatgacccaaaaggcgaagaacgccctcgacaacctggcggtgctgcacaccgccgaggccggaggccgagcctacaatcacgctctctctgagctgcctgagaccctggagacgctcctcctgcttaccctgctggcgaccgtgaccggaggcatcttcttattcctgatgtcgggcaagggcatcgggaagatgaccctgggaatgtgctgcatcatcacggcctcaatcttgttatggtacgcccagatccagccacactggatcgcagctagcatcattctggagttcttcctcattgtccttctgatcccggagccagagaagcagcggacaccccaagacaaccagctcacttatgtggtgattgcgatccttaccgtcgtggccgccacgatggcgaacgagatgggcttcctggagaagaccaagaaggacttcggactcggttccataaccacccagcagcccgagagcaatattctggacatcgacctgcgcccggccagcgcgtggacactctacgcagtggcaacgacattcatcaccccaatgctccggcactccatcgagaacagctccgtcaacgtgagcctgaccgccatagcgaaccaggcgacagtactcatgggcctggggaagggatggccattgtccaagatggacataggggtcccactcttagccatcggctgctacagccaggtaaaccccataactttaaccgcagccctcctgctgctcgtggcgcattatgccatcatcggtcccgggctgcaggccaaggccacgcgcgaggcccagaagcgggcggccgccgggatcatgaagaatcccactgtcgacgggatgacggtgatcgacttagaccccatcccgtacgaccccaagttcgagaagcagctcggccaggtgatgcttctggttctctgcgtgacccaagtactgatgatgcgcacgacctgggccctgtgcgaggccctcactctagctaccggacccatctccacgctgtgggaaggcaaccccgggcggttctggaacaccaccatcgccgtcagcatggccaacatattccgcggcagttacctcgctggggccgggctactgttcagcatcatgaagaacacggcgaatacgcgcagaggcacggggaacaccggcgaaaccctcggtgagaagtggaagaatcgcctgaacgccttggggaaatccgagttccagatctacaagaagtccggcatccaggaggtcgatcggactctcgccaaagagggaatcaagagaggggagaccgatcaccacgccgtgagcagaggtagcgcgaagctacgctggtttgtcgagcggaacctggtaaccccggaaggcaaggtggtggacctcggctgcgggcgcggagggtggtcatattactgcggcgggctgaagaatgtgaaggaggtcaaaggcctgaccaagggcggacccggacacgaggagcccattcccatgagcacgtacgggtggaacctcgtgagactgcagtccggtgtggacgtgttcttcaccagcccggagaagtgtgatacgctgctctgtgacattggcgagtcctcccccaaccccaccgtcgaggccggaagaaccctgcgggtgctgaacctcgtcgagaactggctaaacaacaatacacagttctgtatcaaggtcctgaacccctacatgccgtccgtgattgagaagatggaggccctgcagcgcaagtacggaggggccctcgtccggaatcccctgtccagaaacagcacacacgaaatgtactgggtctcgaacgccagcgggaacatcgtctccagcgtgaacatgatcagtcggatgctgatcaaccgctttacgatgcggcacaagaaggcgacctacgaacccgacgtcgacctcgggagcggcacgcgaaacattggcatcgagtccgaaaccccgaatctggacataatcggcaagcgcatcgagaagatcaagcaggagcacgagaccagctggcactacgaccaagaccatccctataaaacctgggcctaccacggctcttacgagacgaagcagaccgggagcgcttccagcatggtgaacggcgtcgtccggttgctcactaagccctgggacgtgatccccatggtgactcagatggccatgactgacacgaccccgttcgggcagcagcgagtcttcaaggagaaggtggacactcgaacacaggagcccaaggaggggaccaagaaactgatgaagatcacggctgagtggctttggaaggagctgggaaagaagaagactcctcgtatgtgtacgcgggaggagttcacccgcaaggtccgctccaacgcggccttgggtgccatcttcaccgacgagaacaagtggaagtccgcccgcgaggccgtggaggactccggcttctgggagcttgtggataaggagcggaacttgcacctggaggggaagtgcgaaacctgtgtctacaacatgatgggtaagcgcgagaagaagctgggggagtttgggaaggcgaaggggagccgggcaatttggtacatgtggctcggggcccgcttcctggaatttgaggccctcggattcctcaatgaagaccactggttcagtcgggaaaattcactgagcggcgtggagggcgaggggctgcacaaactcggttacatcctgcgtgatgtgtctaagaaagaaggaggggcgatgtacgccgacgacacggccggttgggacacccggataaccctggaggacctcgagaacgaggagatggtcacgaatcacatggagggagaacacaaaaagctggccgaggctatcttcaagctcacgtaccagaacaaagtggtgcgcgtccagcggccgacacccagaggtaccgttatggacatcatcagtcggcgcgatcagcgggggtccggccaggtcgtgacctacgggctaaatacgttcacgaatatggaagcgcagctgatccgccagatggaaggggagggcgtgttcaagagcatacagcagttaactgtcaaggaggagatagccgtaaagaactggctcacccgggtggggcgggaacggctgtcccggatggccatcagtggtgacgattgcgtggtaaagcccctggacgaccgcttcgcctccgccctcacagcgctgaacgacatgggcaaagtgcgaaaggatatccagcagtgggagccaagccgcggttggaacgactggacccaagtgccattctgcagccaccacttccacgaactgataatgaaggatggccgggtcctcgtggtgccgtgccgcaaccaggacgagctgatcggacgggcccgcatcagccagggcgcggggtggagtctgcgggagaccgcctgcctgggcaaatcatacgcacagatgtggtccctgatgtattttcaccgccgggacctgcgcttggcggccaatgccatctgcagtgccgtcccctcccattggattccgacgagccggaccacgtggagtatccacgccacccatgaatggatgaccaccgaggatatgctgacggtgtggaaccgcgtgtggatccaggagaacccatggatggaggacaaaaccccggtcgaatcttgggaggagatcccctacctgggcaagagagaggaccagtggtgcgggagcttgatcggcttaacctccagagcgacctgggccaagaacatccagacggccatcaaccaggtgcggagcctgatcgggaacgaggagtacacagactacatgccatccatgaagcgtttcagacgcgaggaggaggaggccggcgtgctctggtga

SEQ ID NO: 24896 - RNA, 9876 nt, synthetic construct
  misc_feature 1..9876: note = derived and/or modified CDS sequence (opt11) from DENV-2__KM279568__SS-prME
  source 1..9876: mol_type = other RNA
accgcgggcatcatcatcatgatgattcccaccgtgatggcgtttcacttgaccacccggaacggggagccccacatgatcgtgagccggcaagaaaaggggaagtcactcctgttcaagaccgagaacggcgtgaacatgtgcaccctgatggcgatggaccttggggagctgtgcgaggacaccatcacatacaactgcccactgctccgccagaacgagcccgaggatatcgattgctggtgcaactcaacctccacctgggtgacctacgggacctgcaccgcaaccggcgagcaccggcgggagaagcggagcgtcgccctggtgccccacgtgggtatggggctggagactcgcaccgagacttggatgtccagcgagggcgcctggaagcacgcacaacggatcgagacctggattctccgccaccccggattcacaatcatggcggccatccttgcctataccattggcacaacgtacttccagcgggtcctgatctttatcctcctgacggcagtgaccccctccatggcgatgcgctgcatcggaatcagcaaccgggacttcgtcgagggtgtgtccggcgggtcgtgggtggacatcgtactggagcacggcagctgtgtcacaaccatggccaaaaacaagcccacgctcgacttcgagctgatcaaaaccgaggccaagcacctggcgaccttacgcaagtactgcgtggaggccaaactgaccaacacgaccaccgcgagccggtgccccacccagggggagccctccctgaacgaggaacaggacaagcgcttcgtttgcaagcactccatggtcgaccggggctggggaaacgggtgcggcctattcgggaaaggcggcatcgtgacgtgcgccatgtttacttgcaagaagaacatggaagggaaggtggtacaacccgaaaacctggagtacacaatcgtaattacgccgcactccggcgaggagaacgccgtggggaatgacacgggcaagcatggaaaggaaatcaagatcactccccagagctccatcaccgaggccgaattaaccggctacgggaccgtcacgatggagtgcagcccaagaaccggcctcgacttcaacgagatggtgctactgcagatggagaacaaggcctggctcgtccaccggcagtggttcctggacttacccctcccctggttacccggcgccgacactcaggggtccaattggatccagaaagaaaccctggtgacgttcaagaatccgcacgcgaagaagcaggacatcgtggtcctcggcagccaggagggggcaatgcacaccgccctgacaggcgccacagaaatccagatgagctccggaaacttgctgtttaccggccatctgaagtgccggctacgtatggacaagctccagctgaaaggcatgtcgtactcgatgtgcaccgggaagttcaaggtggtgaaggagatagcggaaacccaacacggcacgatcgtcatccgcgtgcagtatgagggggacggaagcccctgcaaaatccctttcgagatcatggacctggagaagcggcacgtgctgggtcgcctgatcactgtcaaccccatagtaactgagaaggactccccggtcaacattgaggctgaaccgccgttcggagacagctacatcatcattggtgttgagccagggcagctaaaactctcctggttcaagaagggctcgtccatcgggcagatgttcgagaccaccatgcgaggcgccaagcggatggccatcctgggcgacaccgcctgggacttcgggagcctgggcggggtgtttacgagcatcggcaaggcgttacaccaggtattcggggctatctacggcgccgcctttagtggcgtcagctggaccatgaagatccttataggggtggtgatcacctggatcggcatgaacagccgctccacgagcctgtccgtcagcctggtgctcgtgggggtggtgaccctatacttgggcgtgatggtccaggccgattccgggtgcgtggtcagctggaagaacaaggagctaaaatgcggaagcggcatcttcatcacggacaacgtccacacgtggacggagcagtacaagtttcagccggagtcccccagcaagctggccagtgccatccagaaggcccacgaggaagggatctgcggcatccggagcgttacccgcctggagaacctcatgtggaagcagatcaccccggagttgaaccacatcctgactgagaatgaggtgaagctcacgatcatgacgggggacatcaaaggcatcatgcaggccggcaaacgatccctgcgcccccagcctaccgagctcaagtactcgtggaaggcctggggcaaggcgaagatgctatccacagagctgcataatcacacgttcttaatcgacggccccgagaccgctgagtgccccaacacgaaccgggcctggaacagtctagaggtggaggactacgggttcggcgtattcaccacgaacatctggctgaagctgaaggagcgacaggacgtgttttgcgattccaagctcatgagcgccgcgatcaaggacaaccgcgccgtccatgcagacatggggtattggatcgagtcggctctgaacgatacctggaagatcgagaaagccagcttcatagaggtgaaatcctgtcattggccaaagtctcacactttatggtccaacggcgtactcgagtccgaaatgatcattcccaaaaacttcgcgggcccagtcagccagcacaactaccgccccgggtaccacacccaaactgccggcccgtggcacttaggtcggctggagatggacttcgacttctgcgagggcacgaccgtggtggtcaccgaggactgcgggaaccgcggccccagcctccggaccacgacagcaagtggcaagttaatcaccgagtggtgctgccgcagttgcaccctgccgcccctacggtaccgcggcgaggacggctgttggtacggaatggagatccggccgcttaaggaaaaggaggagaatctggtgaacagcctcgtaacagccggccacggtcagatagacaacttttcgctgggcgttctgggcatggccctgttcctggaggagatgcttcgcacccgggtggggaccaagcacgctatcctcctggtggccgtctcattcgtgaccctgataacgggcaacatgtccttccgcgacctcgggcgcgtaatggtcatggtgggcgctactatgaccgacgacatcgggatgggggtgacatacctggccttgctcgctgccttcaaagtccggcccacgttcgccgccggcctgctgctccgcaagctgaccagcaaagagctgatgatgaccactatcggtatcgtcctcctgtcccagagcacgatccccgagtccatactggagctgaccgacgccctggcgctggggatgatggtactaaaaatcgtccggaatatggagaagtaccaactggcggtgaccatcatggccatcagctgcgtccccaacgccgtgatcctgcagaacgcttggaaggtatcctgtaccacgctggcggtcgtaagcgtgtccccgctgctgctcaccagctcacagcagaaggccgactggatccccttggccctcaccatcaaggggctcaaccccacggccatcttcctgacgacccttagccgtacctccaagaaacgctcatggcccctcaacgaggcgatcatggccgtcggcatggtgtccatcctggcctcgagcctgctcaagaacgacatccctatgaccggacccttggttgccggtggcctgctcacggtctgctacgtgctaaccgggcgctccgccgacttagaactcgagcgggccgccgatgttcgctgggaggagcaggccgagattagcggcagtagcccaatcctgtccatcactatcagcgaggacgggtccatgtccatcaagaacgaggaggaggagcagaccctgacgatcctcatccggaccggcttactggtcatctccggtctattccccgtgtcgatcccgattaccgccgccgcgtggtatttgtgggaggtgaagaaacagcgcgccggggtcctgtgggacgtgcccagcccaccgcccgtgggcaaggccgagctcgaggacggggcctaccggatcaagcaaaagggcatcctagggtacagccagatcggggccggtgtctacaaagagggaaccttccacaccatgtggcacgtgacgcggggtgcagttctgatgcacaaggggaagcggatcgagccctcctgggccgacgtcaagaaggacctcatcagctacggcgggggctggaagctggagggcgagtggaaggagggggaggaggtccaggtccttgccctcgagcccggcaagaacccgcgcgccgtccagactaaacccgggctgttcaagaccaataccgggacaatcggggccgtttccctggacttctcacccggcaccagtggctctcccatcgtggacaagaaggggaaggtagtgggcctctacgggaacggggtcgtcacgcgctccgggacctacgtaagcgcgatcgcccagacggagaagtccatcgaggataacccggagattgaggacgatatcttccgcaagaagcggctgactatcatggacctgcaccccggggccggcaagaccaagcgatacctgcccgccatcgtgcgagaggctatcaaacgcgggctccggaccctgatcctagcccccacgcgcgtcgtggccgccgaaatggaggaggccctcaggggcctgccgatccggtaccaaaccccggcgattcgcgccgagcacaccgggcgggaaatcgtggacctgatgtgtcacgcaactttcacgatgcgcctcctgagtcccattcgggtccccaattacaacctgatcatcatggacgaggcccatttcaccgacccggccagcatcgcggcgagaggatacatctctacccgggtagagatgggcgaggccgccgggatcttcatgaccgccacgccgcccggcagccgcgaccccttcccgcagtccaacgcgcccatcatggacgaggagcgcgagatccccgaacgcagctggaacagcgggcacgagtgggtgaccgacttcaagggtaagaccgtatggttcgtgcccagcattaaggccgggaacgacatcgccgcctgcctccgaaagaatggcaagaaggttatccagctgtcccgcaagacctttgacagcgaatacatcaagacgcggacaaatgactgggattttgtcgtgactaccgacatctcagagatgggcgccaacttcaaggccgagcgcgtgatagacccgcggcgctgtatgaagcccgtcattctgacagacggggaggagcgggtgatcctcgccggacccatgcccgtgacccacagctccgcagcacagcgccgggggagagtaggtcgcaacccgaaaaacgagaacgaccagtacatctacatgggcgagccactggaaaacgatgaagactgcgcgcactggaaggaggctaagatgctattggacaacatcaacacccccgaggggataatcccctcgatgttcgagccggagcgggagaaggtggacgccatagacggagagtatcgcctgcgcggggaagcccgcaagaccttcgtggacctgatgcggcgcggcgacctccccgtttggctggcttaccgggtggcggccgaggggatcaactatgccgaccgcaggtggtgcttcgacggcgtcaagaacaaccagatcctggaggaaaacgtggaggtggagatctggacgaaggagggggagcgcaagaagctcaagcccagatggctggatgccaggatctactccgacccgctggccctcaaggagttcaaggagtttgcggccggccggaagtccctgacactgaacctcataaccgagatgggccgcctgcccaccttcatgacgcagaaggccaagaatgccctggacaatctcgcggtcctgcacaccgccgaggccgggggccgggcctacaaccacgccttgtctgagttgcccgaaaccctggagaccctcttactgctgacgctcctggcgaccgtgaccggtgggatttttctgttcctcatgagcggcaagggtatcggcaaaatgaccctggggatgtgctgtataatcaccgcctccattctgctctggtacgctcagatccagccccactggatcgccgcctcgattatcctggaattctttctcatcgtgctccttatccctgagccggagaagcagcgcacgccccaggacaaccagctaacctacgtagttatagcgatcctaaccgtagtagcagccactatggccaacgagatgggcttccttgagaagacgaagaaggacttcgggctgggcagtataaccacacagcagccggagtccaatatactggatatcgacctacggcctgccagcgcgtggactctgtatgccgtggccactaccttcatcacccccatgctccgccacagtatcgaaaactcatccgtgaacgtctcgttgactgctatcgccaaccaggcgacggtactgatgggcttgggaaagggctggccactatccaagatggacatcggcgttcccctgttagcgatcggctgttacagccaggtcaacccgattaccctgaccgccgccctgctcctgttggttgcgcattacgccatcatcgggcccggcctgcaagccaaggctacccgggaagcccagaagagggcggctgctggcatcatgaaaaaccccaccgtggacgggatgaccgtcattgatctggaccccattccgtacgacccaaagttcgagaagcaactgggccaggtgatgttactggttctctgtgtcacgcaggtactgatgatgcggacgacgtgggcattgtgcgaggccctgaccctcgcgaccgggcccatatccaccctgtgggagggcaaccccgggcgcttctggaacacgaccatagccgtaagcatggccaatatcttccgtggctcttacctggccggcgccgggttgctgtttagcatcatgaagaacactgcgaacacgcggcgcggaaccgggaacaccggcgaaaccctgggcgagaagtggaagaaccggcttaatgccctggggaagtccgagttccagatctacaagaagtcgggcattcaggaggtcgatcgcaccctggccaaagagggcatcaagcggggcgagacggaccaccatgccgtgtctcgcggaagcgcgaagttgcgatggtttgttgagcgcaacctggtgacccccgagggcaaggtggtagacctgggctgcggacggggcgggtggtcctactactgcgggggtctcaaaaacgttaaggaggtgaagggcctgaccaagggtgggcctggccacgaggagcccatccccatgagcacctacgggtggaacctggtacggctccagtccggggtcgacgtgttcttcaccccgcctgagaagtgcgacaccctgctctgcgacatcggggagagcagccccaaccccacggtggaggccggccggaccctccgcgtcctgaacctggtggagaactggctcaataacaacacccagttttgcatcaaggttctcaacccgtatatgccgtccgtcatcgagaaaatggaggccctgcaacggaagtatggcggggccttggtgcgcaaccccctcagccggaactccacgcacgagatgtactgggtgagcaacgccagcggcaatatcgtctcgagtgtgaatatgatcagccgcatgctcatcaaccggttcacaatgcgccataagaaggcgacctacgagccggacgtggacctaggatccggcacacggaatatcgggatcgagagcgagacccccaacctcgacattatcggcaagcgcatcgagaagatcaaacaagaacacgaaacttcatggcactatgaccaagaccacccctacaagacctgggcctaccacggtagctacgagaccaagcaaacggggtccgcaagttccatggtgaacggcgtggttcgcctgctgactaagccctgggacgtcatcccaatggtgacccagatggctatgacggacacaactcccttcggccagcagcgggtgttcaaggagaaggttgacactagaacacaggaacccaaggagggcacgaagaagctgatgaagatcaccgccgagtggctgtggaaggagttgggcaagaagaagacaccccggatgtgtacccgggaagaattcacgcggaaggttcgctccaacgcggccctcggagcgatctttaccgatgagaacaagtggaagtccgcccgggaggccgttgaggatagcggcttctgggagttggtggacaaggagcgcaacctgcacttagaggggaagtgcgagacctgtgtgtacaacatgatgggcaaaagagaaaagaagctgggggagttcggcaaggccaagggctcccgcgcgatctggtacatgtggctgggggcccggttcctcgagttcgaggccctgggcttcctgaatgaggaccactggttctcacgcgagaattctctctccggggtcgagggagaagggctgcacaagctgggctacatccttcgggacgtctcaaagaaggaaggcggtgcaatgtacgccgacgacacggcgggctgggacacgcgcataaccttagaggacctgaaaaacgaagagatggtgaccaaccatatggagggtgagcacaagaaactcgccgaggccatcttcaagctgacctatcagaacaaggtcgtacgggtacagcgcccgacgccccgggggactgtcatggacatcatttcccgccgggaccagcgagggagcggacaggtggtgacctacggcctaaacaccttcacgaacatggaagcgcagctcatccggcagatggagggggagggcgtcttcaagtccatccaacaactcaccgtaaaggaggagatcgctgtgaaaaattggttaatccgtgtcgggcgcgagcgtttgagccgcatggccatctccggggacgactgtgtggtgaagccactggacgaccggttcgcatccgctctgaccgcgctcaacgacatgggcaaggttcgcaaggacatccaacagtgggagccatctagagggtggaatgactggacccaggtgcccttctgctcccaccacttccacgagttgatcatgaaagacggccgcgtgctggtcgtgccatgccggaaccaggacgagctcatcgggcgggccaggatcagccagggcgccgggtggtccttgcgcgagacggcttgcctggggaagagttacgcccagatgtggtccctcatgtacttccaccggcgcgacctgcggctggcggctaacgccatctgcagtgcagtgccctcacactggatccccacatcccgcaccacctggtcaatccacgccacccacgagtggatgacgaccgaggacatgctaactgtctggaaccgggtgtggattcaagagaatccgtggatggaggacaagacacccgtggagagctgggaggagatcccctatctcggcaagcgagaggaccaatggtgtggatcactgatcggcctcaccagccgtgcgacctgggccaagaacatacaaaccgccatcaaccaggtccgctccctgatcgggaacgaggagtataccgactacatgcccagcatgaaacgtttccgccgagaggaggaggaggccggtgtgctgtggtga

SEQ ID NO: 24897 - RNA, 9876 nt, synthetic construct
  misc_feature 1..9876: note = derived and/or modified CDS sequence (opt11) from DENV-2__KM279569__SS-prME
  source 1..9876: mol_type = other RNA
accgccggcatcatcatcatgatgatccccaccgtcatggccttccacctgaccacccgcaatggggaaccccacatgatcgtctcccggcaggaaaagggcaaatccctcctgttcaagaccgagaacggggtgaacatgtgcaccctgatggcgatggacctcggcgagctctgcgaggacacaatcacctacaactgccccctgctccgccagaacgagcccgaggacatcgactgctggtgcaacagcacctccacctgggtcacctacgggacatgcaccgccaccggcgagcaccgccgcgagaagcggagcgtcgcactggtgcctcacgtgggcatggggctggagaccaggaccgagacttggatgtccagcgagggcgcctggaagcacgcgcagcggatcgagacttggatcctccgccaccccgggttcaccatcatggctgcaatcttagcttacaccatcggcaccacctacttccagcgggtcctgatctttatcctccttaccgccgtgaccccctccatggcgatgcgatgcatcgggatcagcaacagggactttgtggagggcgtttccggcgggtcatgggtggatatcgtgctggagcacggcagctgcgtcaccaccatggccaaaaacaagcccacgcttgacttcgagctgatcaagaccgaggccaagcacctggccaccctccgcaagtattgcgttgaggccaaactgaccaacacgaccaccgcgagtaggtgccccacccaaggggagccctccttgaacgaggagcaggacaagcgcttcgtgtgcaagcacagcatggtcgacagagggtggggcaacgggtgcgggctgttcgggaagggcgggatcgtgacgtgcgccatgttcacgtgcaagaagaacatggagggtaaggtggtccaacccgagaacctcgagtataccatcgtgatcactccccactccggcgaggagaatgccgtgggtaacgacacgggcaagcacgggaaggagataaaggtcacgccccagagctcgatcaccgaggccgagcttaccggctacggtaccgtgacgatggagtgcagcccgcgcaccggcctcgacttcaacgagatggtgctgctgcagatggagaacaaggcctggctcgtccaccggcagtggttcctggatctgccgctcccctggctgcccggcgcggacacgcagggatccaactggatccagaaggagaccctcgtgacgttcaagaacccgcacgccaaaaagcaggacgtcgtggtgctcggcagccaggagggggccatgcacaccgccctgactggcgccaccgagattcagatgagctccggaaacctcctgttcacgggccacctgaagtgccgcctgaggatggacaagctccagctgaagggcatgagttactccatgtgcaccgggaagttcaaggtcgtgaaggagatcgcagagacccaacacggcaccatcgtgatccgcgtacagtacgagggggacggctccccatgcaagatccccttcgagatcatggacttggagaagcggcacgtgcttggccgcctgataacggtgaaccccatcgtcacagagaaggactccccggtaaacatcgaggccgagccgcccttcggggatagctacatcatcatcggcgtggagccaggccagctgaagctctcttggttcaagaagggcagtagtatcgggcagatgttcgagaccaccatgcgcggggccaaacggatggccatcctgggcgacaccgcctgggacttcgggagcctgggcggcgtcttcacctccatcggcaaagcgctccatcaggtgttcggggcaatctacggcgccgccttctcaggagtctcctggacaatgaagattctgatcggtgtcgtgatcacctggattgggatgaacagcaggtccacgagcctgtctgtgagcctggtcctagtgggggtggtaaccctgtacttaggggtgatggtgcaggcagactccggctgcgtcgtgtcgtggaagaacaaggagctcaagtgcggatcgggcatcttcatcaccgacaacgtccacacctggacggagcaatacaagttccagccggagtcccccagcaaacttgcctcggccatccaaaaggcgcacgaggaggggatctgcggaatccggagcgtcacccgcctggaaaacctcatgtggaagcagatcacgcccgaactgaatcacatcctgaccgagaacgaggtaaagctcacgatcatgaccggcgacatcaagggcattatgcaggccgggaaacggacactgcgcccccagccgaccgagctgaagtactcctggaaggcgtggggcaaggccaagatgctctctacggagttacacaaccacaccttcctgattgatggccccgagaccgccgagtgccccaacaccaaccgggcttggaactccctcgaggtggaggactacgggttcggcgtcttcactaccaacatctggctcaagctgaaggagcgccaggacgtgttctgcgacagcaagttaatgtccgccgcgatcaaagacaaccgggccgttcacgccgacatggggtattggatcgagtcggccctgaacgacacgtggaagatcgaaaaggcctccttcatcgaggtcaagagctgccactggccgaagtcccataccctgtggagcaacggggtgctcgagtccgagatgatcatccccaagaactttgcgggccccgtgagccagcacaactaccgccccgggtaccacacccagacggccggcccgtggcacctggggcggctggagatggatttcgacttctgcgagggcaccaccgtcgtggtcaccgaggactgcgggaaccgcggcccctccctccggacgaccaccgccagcggcaaactgataactgagtggtgctgccgcagctgcacgctgccgcccctccggtaccgcggtgaggatggctgctggtacgggatggagatcaggccgctgaaggagaaggaggagaacctggtgaactccctcgtgaccgccggccacggacagatcgacaacttcagcctgggcgtgttaggcatggccctcttcctggaggagatgctgcgcacaagagtcgggaccaagcatgccatcctcttagtggccgtgagtttcgtaacgctgatcaccggcaacatgagcttccgcgacctcggtcgcgtgatggtaatggtcggcgccacaatgaccgatgacatcgggatgggcgtgacgtatctggccctgttggctgccttcaaggtgcggcccacgtttgccgccggcctgttactccgcaagctgacctcaaaggagctgatgatgacgacgatcgggatcgtgctgctgagccaatccaccatcccagagagcatcctggagctcacagacgctctggcgctgggcatgatggtactcaagatcgtccgaaacatggagaagtaccaactggccgtgactatcatggccatcctgtgtgtgcccaacgccgtcatcctccagaatgcctggaaggtatcctgcacgacgctagcggtggtaagcgtgtccccgctgctcctgaccagctcccagcagaaggccgactggatccccctggccctcaccatcaaggggctgaaccccactgccatctttctgaccaccctctcgcgcacctcaaagaagcggagctggcccctgaacgaggcgatcatggcggtgggcatggtatccatcctcgcaagctccctcctgaagaatgacatccccatgacgggccccttggtggccggtggcctcctgaccgtgtgctacgtcctgaccgggcgctccgccgacctcgagctggagcgggcggccgacgtacgctgggaggaacaggccgagattagcggctcctctccgatcctgtccataaccatcagcgaggacggaagcatgagcatcaagaacgaggaggaggagcagacgctgaccatcctgatccggaccggcctgctggtgatctccggcctgtttcccgtgtcgatcccgatcaccgccgcggcgtggtacctgtgggaagtgaagaagcagcgcgccggggtgctctgggacgtcccctccccgccgcccgtcggcaaggccgagctggaagacggggcctaccgcatcaagcaaaagggcattctggggtacagccagatcggcgcaggcgtctataaggaggggaccttccacacgatgtggcacgtcacgcgcggcgcggtcctcatgcacaaggggaagcggatagagccatcatgggccgacgtgaagaaggacctgatcagctatggcgggggctggaagctggagggcgagtggaaagagggggaggaagtccaggtgctcgctctggagcccggcaagaacccccgcgccgtgcaaaccaagcctggtctgttcaagaccaacacgggcacgatcggggccgtctccttggactttagccccggaacctccggcagcccgatcgtggacaagaaggggaaggtggtcggcctgtacgggaacggagtggtgacccgttccggcacctacgtcagcgccatcgctcaaaccgaaaagtccatcgaggacaaccctgagatcgaagacgacatcttccgcaagaagagactgaccattatggacctgcaccccggggccgggaagaccaagcgctacctccccgccatcgtgcgggaggcgatcaagcgcgggctgcggacattgatcctcgcccccacgcgcgtggtcgctgccgagatggaggaggccttacgcggcctgccgatccggtaccagacccccgccatcagagccgagcacacgggtcgggagatcgtcgacctcatgtgccacgccacgttcaccatgagacttctgagccccatacgggtgcccaactacaacctgatcatcatggacgaggcccacttcaccgacccggctagcatcgccgcccgcggctacatatccacccgggtcgagatgggagaggccgccgggatcttcatgacggccacgccgcccgggagccgcgaccccttcccgcagtccaacgcgcccatcatggacgaggagaaggagattcccgagcggagctggaacagcgggcatgagtgggtaaccgacttcaaaggcaagaccgtgtggttcgtccccagcatcaaggcagggaacgacatcgccgcatgcctgcgcaagaacggcaagaaggtgatccagctgtctcggaagacgttcgacagcgagtatatcaagacccgcaccaacgactgggatttcgtggtaaccactgacatctccgagatgggcgcgaactttaaggccgagcgtgtgatcgacccgcgccggtgcatgaagcccgtcattctcaccgacggggaggagcgcgtcatcctggccggccccatgcctgtcacccacagctccgccgcccaaaggcgcgggcgggtgggtcgcaacccgaaaaacgagaacgaccagtacatctacatgggggagccactggagaacgacgaagactgcgcacactggaaggaggccaaaatgctcctggataacatcaatacccccgagggcatcatccccagcatgttcgaaccggagagggagaaggtcgacgccatcgacggcgagtaccgactgcgaggcgaggcccgcaagacgttcgtcgacctcatgcgccggggcgacctacccgtctggctagcctaccgcgtggcggccgaggggatcaactacgccgaccgtcgctggtgcttcgacggagtgaagaacaaccagatcctggaggagaacgtcgaggtggagatctggacaaaggagggggagcggaagaagctgaagccccgctggctggacgcccggatttactccgacccgctcgccctgaaggagttcaaggagttcgcggccggccgcaagagccttaccctcaacctaatcacagagatgggccggctgcccacgttcatgacccagaaggctaagaacgccctcgacaacctagcggtgctgcacaccgccgaggccgggggccgcgcttataaccacgccctctccgagctgccagaaaccctggagacgttgcttctgctcaccctgctagcgacggtcacagggggtatcttcttattcctgatgagtggcaaagggatcggcaagatgactttagggatgtgctgcatcatcacggcctccatcctcctgtggtacgcccagatccaaccccattggatagccgctagcataatcctggagttcttcctcatcgtgctgctgatccccgagcccgaaaagcagcggactccccaggacaaccagctcacctacgtggtcatcgctatcctaaccgtggtggctgcgacgatggctaacgagatgggcttcctggagaaaaccaaaaaggacttcggcctcggctccatcaccacccagcagcctgagtcaaacatcctggacatcgacctgcgcccggccagcgcgtggacgctttacgccgttgccaccaccttcatcacccccatgttgcggcactccatcgagaacagctccgtgaatgtgagcctgacggccattgccaaccaggctactgtccttatgggcctggggaagggctggcctctgtccaagatggacatcggggtgcccctcctggccataggctgctacagccaggtcaacccgatcaccctgaccgccgccctcctgctgttagtcgcgcactacgccatcatcgggcccggcctgcaggccaaggccacccgtgaggcccagaagcgggcggctgccgggatcatgaagaatcccaccgtagacgggatgaccgtgatcgacttagaccccattccgtacgatccaaagttcgagaagcagctcggccaggtcatgctgctggtactctgcgtgacccaggtcttaatgatgcgcacgacctgggccctatgcgaggccctaaccctggcgaccgggcccatatccacgctatgggagggcaaccccgggcggttctggaacaccaccatcgccgtgagcatggccaatatcttccggggctcctacctggccggtgccggtttgttattcagcatcatgaagaacaccgcgaacacgcgccggggcaccgggaacaccggggagaccctcggcgagaagtggaagaaccgcttgaacgccctgggcaagtccgagttccagatctacaagaagtccggcatccaggaggtggaccggacgctcgccaaggaggggatcaagcgcggcgagacggaccaccacgctgtcagccgggggagcgcgaagctgcgctggttcgtggagagaaacttggttacaccggagggcaaggtcgtggacttggggtgcgggcgcggcgggtggtcctactactgcggcgggctaaagaacgtgaaggaggtcaagggcttgaccaaaggagggcccgggcacgaggagccgatccccatgtcgacgtacggttggaacctagtgcggctgcagtccggcgtggacgtgttcttcaccccgcccgaaaagtgcgacaccctgctctgcgacatcggggagagctccccaaaccccaccgtggaggccggacgtacactccgggtgctgaacctcgtcgagaactggctgaacaataacacgcagttctgcatcaaggttctaaatccctacatgcctagcgtcatagagaagatggaggccctgcagcgcaagtatggcggggccctcgtccggaaccccctgagccgcaactccacccacgagatgtactgggtgagcaacgcctccggcaatatcgtgagcagtgtcaacatgataagccggatgctaatcaaccgcttcaccatgcggcacaagaaggcgacctacgagccggacgtggacctcgggtccggtacgcgcaacatcgggatcgagagcgagacccccaacttagacataatcggcaagcggatcgagaagatcaagcaggaacacgagacttcctggcactacgaccaggaccacccctacaaaacctgggcctaccacggaagctatgagacgaagcagaccgggtccgccagctccatggtgaacggcgtcgtgcgcctgctcaccaagccctgggatgtgatccccatggtaacccagatggccatgactgataccacccccttcgggcagcaaagagtatttaaggaaaaggttgacactcggacgcaggagcccaaggaaggcaccaagaagctgatgaaaatcaccgccgagtggttgtggaaggagctcggcaagaagaagacgccgcgcatgtgtacgcgggaggagttcacgcgcaaggtgcggagcaacgcggctctgggtgccattttcaccgacgagaacaagtggaagtccgcccgcgaggccgtggaggacagcggcttctgggagctggtcgacaaggagcggaacctccacctggaggggaagtgtgagacctgcgtgtacaacatgatgggcaagcgggagaagaagttaggggagttcggcaaagcgaagggctcccgtgcgatctggtacatgtggctcggggcccgcttcctggagttcgaggccctgggcttcttgaacgaggaccactggttcagccgggaaaattccctgagcggggtggaaggcgaggggctgcacaagctcggctacattctgcgcgacgtctccaagaaagaaggcggggcgatgtacgccgacgacacggccggctgggatacccggatcaccttagaggacctcaagaacgaggaaatggtaaccaaccatatggagggtgagcacaagaagctggctgaggccatcttcaagctgacgtaccagaacaaggtggtccgagtgcagcggccgacgcccagaggcaccgtgatggatatcatttcccggcgcgaccagcgggggagcgggcaggttgtgacctacggcctcaataccttcaccaacatggaggcccagctgatccgccagatggagggggagggcgtgttcaagtccatccagcagctcaccgtcaaggaggagatcgcggtgaaagactggctcatccgggtggggcgcgaacgcttaagtcgcatggccatctccggcgacgattgcgtagtgaagcccctggacgaccgcttcgccagcgccctcactgcgctgaacgacatgggcaaggtgaggaaggacattcagcagtgggaaccctcccgcgggtggaacgactggactcaggtcccgttctgcagccaccacttccatgaactgatcatgaaggacggccgggtgctcgtggtcccatgccgcaaccaggacgaactgattgggcgggcccgcatctcccagggtgccggttggagcctgcgggagacggcctgcctcggcaagtcctacgcccagatgtggagcctgatgtacttccaccgccgggacctgcgcctcgcagccaacgccatatgctccgccgtgccctcccactggattcccacctccaggaccacttggtcgatccacgccacgcacgagtggatgaccaccgaggacatgctgaccgtgtggaaccgcgtctggatccaggagaatccctggatggaggacaagacccccgtagagtcctgggaggagatcccctacctgggcaagcgggaggaccagtggtgcgggtccctcatcggcctgaccagccgcgcaacttgggcaaagaacatacagacggccatcaaccaggtgcggtccttgatcgggaacgaggagtacacagactacatgcctagcatgaagcgcttccggcgcgaggaggaggaggccggtgtcctctggtga

SEQ ID NO: 24898 - RNA, 9876 nt, synthetic construct
  misc_feature 1..9876: note = derived and/or modified CDS sequence (opt11) from DENV-2__KM279570__SS-prME
  source 1..9876: mol_type = other RNA
accgccgggatcatcatcatgatgatccccacagtcatggcgttccatctgaccaccagaaacggggagccacacatgatcgtcagccggcaggagaagggtaagagtctcctgttcaagacggaaaacggggtaaacatgtgcaccctgatggcgatggacctgggcgaactatgcgaggacaccatcacctacaactgcccactgctccgccagaacgagcccgaggacatcgactgctggtgcaacagcacaagcacctgggtgacctacgggacctgtaccgccacaggcgagcacaggcgcgagaagcggagcgtcgcgctggtgccacacgtgggcatggggctggagacccgcacggagacctggatgagcagcgaaggcgcctggaagcacgcgcagcggatcgagacgtggatcctccgccaccccgggttcacgatcatggcggccatcctggcttacacaatcggcaccacctacttccagcgggtcttaatcttcatcctcctgacggcagtgactccctccatggcgatgcgttgcatagggatctccaaccgcgacttcgtggagggcgtctccggcgggagctgggtggacattgtgctggaacatggctcctgtgtcaccaccatggccaagaacaagcccacgctcgacttcgaactgatcaagaccgaggccaagcacctggccaccctccgcaagtactgcgtggaagccaagctgaccaacacgaccaccgcgagcagatgccccacccagggggagccctccctgaacgaggagcaggacaagcgctttgtgtgcaagcattcaatggtcgaccggggctggggcaacgggtgcggtctattcgggaagggggggatcgtgacgtgcgccatgttcacgtgcaagaagaatatggagggcaaggtggtccagcccgaaaacctcgaatacaccatcgtgatcacgccccactccggcgaggagaacgccgtggggaacgacacgggcaagcacggcaaagagatcaaggtcacgccccagtcctccatcaccgaggctgagctgaccggctacgggaccgtgacgatggagtgcagcccgcgcaccggcctcgatttcaacgaaatggtactgctgcagatggagaacaaggcctggctcgtccaccggcagtggttcctggacctgccccttccctggctgcccggcgcggacacccagggttccaactggatccagaaggagaccctggtgacgtttaagaacccgcacgccaagaagcaggacgtcgtggtgctcggcagccaggagggggcaatgcacaccgccctgaccggcgccactgaaatccagatgagctctgggaacctcctcttcacgggccacctgaagtgccgcctgcggatggacaagctccagttaaagggcatgagctattccatgtgtaccgggaagttcaaggtcgtgaaagagattgcggagacccagcacggtaccatcgtgatccgcgtccagtacgagggggacggcagcccctgtaagatcccatttgagatcatggacctggagaagcggcacgtgttgggccgcctaatcacggtcaaccccatcgtgaccgagaaggactcccccgtgaacattgaggcggagccgccgttcggggacagctacatcatcatcggcgtggagcccgggcagctcaagctctcctggttcaagaagggcagctccatcgggcagatgttcgagaccaccatgcgcggcgccaaacggatggccattcttggcgacacggcatgggacttcgggagcctgggcggcgtcttcacatccatcggcaaggcgctccaccaggtgttcggggccatctacggcgccgccttcagcggcgtgtcctggaccatgaagatcctgatcggggtcgtgatcacctggatcggcatgaattcgcgctccacgagcctgtccgtgagcctagttctcgtgggggtagtcaccctgtacctgggcgtgatggtccaggctgactccgggtgcgtcgtgagctggaaaaacaaagagcttaagtgcggtagcggcatcttcatcaccgacaacgtgcacacgtggacggagcagtacaagtttcagccggagagtcccagcaagctggcctcagccatacagaaggcccacgaagaggggatctgcggcatccggagcgtcacccgcctggagaacctcatgtggaagcagatcacccccgaactgaaccacatcctgaccgagaacgaggtgaagctaacgataatgaccggcgatatcaagggcatcatgcaggccgggaagcggtccctgcgcccccagccgaccgagctgaagtacagctggaaggcgtggggcaaagccaagatgctctccaccgaactgcacaaccacacattcctgatcgacggcccggagaccgccgagtgccccaacaccaaccgcgcctggaatagtctcgaggtggaggactacgggttcggcgtcttcaccacgaacatctggctgaagctgaaggagcgccaggacgtgttctgcgactctaagctcatgagcgccgcgataaaggacaaccgggcggtgcacgccgacatggggtactggatagagtccgccttaaatgacacctggaaaatcgagaaggccagcttcatagaggtgaagtcctgccactggcccaagagccacaccctgtggtccaacggcgtgctcgaaagcgagatgatcatccccaagaacttcgcgggacccgtgtcccagcacaactaccgccctgggtaccacacccagaccgcgggcccgtggcacctggggagactggagatggacttcgacttctgtgagggcacgacagtcgccgtgaccgaggactgcgggaaccgcggcccctcgctccggacaacgaccgccagcggaaagctgatcaccgagtggtgctgtcgctcctgcacactgccgcccctccggtaccgcggggaggacggctgttggtacgggatggaaatccggccgctgaaggagaaagaggagaacctcgtgaacagtttagtcacggcgggccacgggcagatcgacaacttctccctgggcgtgctgggtatggccctcttcctggaagagatgctgcgcacccgggtggggaccaagcacgctatcctcctggttgcggtgagcttcgtgacccttatcacgggcaacatgtccttccgcgacctcgggcgcgttatggtgatggtgggtgcaaccatgacggacgacatcggaatgggcgtcacctacctagcgttactcgctgctttcaaggtgcggcccacgttcgccgccggcctgctgctcaggaagctgaccagcaaagagctgatgatgactaccatcgggatcgtgctcctgtcccagagcacgatccctgagtccatcctggagctcaccgatgcgctggccctgggcatgatggtcctcaagatcgtgcggaacatggagaagtaccagctggccgtcaccatcatggcgatcctgtgcgtgcccaatgccgtgattctccagaacgcgtggaaagtctcgtgcacaacgctggccgtggtgtccgtctcccctctgctcctcacctccagccagcagaaggcggactggatccccctggcccttaccatcaaggggctgaatcccacagcgatcttcctgacgaccctcagccgcacaagcaagaaacggtcctggcccctgaacgaggccataatggcggtgggcatggtgagcatcctcgcctccagcctcctgaaaaacgacattccgatgaccggccccctggtcgccgggggcctcctgacggtgtgctacgtgctgaccgggcgcagcgcggacctcgagctggagcgggccgcggatgtcaggtgggaggagcaggccgagatcagcggcagctccccgatcctgagcatcaccatctccgaggacgggagcatgtccatcaagaacgaggaggaggagcaaacattaacgatcctgatccggaccggcctgttggttatctccggcttatttccagtgtccatcccgatcaccgccgccgcctggtatctttgggaggtcaagaagcagcgcgccggggtgctctgggacgtgcccagtccgccgcccgtgggcaaggccgagctggaggacggggcttaccggatcaagcagaagggcattctcgggtactcccagatcggcgcgggggtgtacaaggaggggaccttccataccatgtggcacgtgacgcggggcgccgtcctcatgcacaaggggaagcgtatcgagcccagttgggccgacgtgaagaaggacctgatctcctacggcgggggctggaagctcgaaggcgagtggaaggagggggaggaggtccaggttctagccctcgagccaggcaaaaatccgcgcgccgtgcagaccaagcccgggctgttcaagaccaacactggcacgatcggggcggtgtccctcgatttttcccccggcaccagcggctcccccatcgttgacaagaaggggaaggtggtgggcctctacgggaacggcgttgtgacccgcagcggcacgtacgtgtccgccatcgcccagacggagaagtccattgaggacaaccccgagatcgaggacgatatatttcgcaagaaacggcttaccatcatggacctgcaccccggggctggcaagacgaagcgctacctccccgcgatagtcagggaggccatcaagcgcgggcttcggaccctcatcctcgctcccacgcgcgtggtggccgccgagatggaggaggccctgcgcggcctgccgattcggtaccagaccccagccatccgcgccgagcataccgggcgggagatcgtagacctcatgtgtcacgccaccttcacgatgcgcttattaagccccattagggtccccaactacaacctcatcatcatggacgaggcccactttactgacccggcttccatcgcggcccgcggctacatcagcacccgagtggagatgggggaagctgccgggatcttcatgaccgctacgccgcccggaagccgcgaccccttcccgcaaagcaacgcccccatcatggacgaggagcgggagatccccgagcgctcctggaacagcggtcacgaatgggtcaccgacttcaaagggaagacagtatggtttgtcccctccatcaaggccgggaacgacatcgccgcgtgtctgcggaagaacggcaagaaggtcatccagctgtcaaggaaaacattcgactccgagtatatcaagacgcggaccaacgattgggacttcgtggtgaccaccgacataagcgagatgggcgccaacttcaaggctgagcgcgtcatcgacccgcgccgctgcatgaagcccgttatactcacggacggggaggagcgggtaatcctggcaggccccatgcccgtcacccactccagcgctgcgcagcgccgggggcgcgttggacgcaaccccaagaacgaaaacgaccagtacatctacatgggagagccccttgaaaacgacgaagactgcgcgcactggaaagaggccaagatgttgttagacaacatcaatacacccgagggaatcatcccatccatgttcgagccggagagggagaaggtcgacgccattgacggcgagtacaggctgaggggtgaggcccgcaagaccttcgtcgacctcatgcggcgcggcgatcttccggtgtggctggcgtaccgagtagcagcggaggggatcaactacgccgatcgacggtggtgtttcgacggcgtgaagaacaaccagatcctcgaggagaacgtcgaggtcgaaatatggacgaaagaaggggagcgcaagaagctgaagccccgttggctggacgcacgcatctatagcgacccgctcgcgctgaaggagttcaaagagttcgccgccggccggaagagcctgaccctcaacctgatcaccgagatgggccgcctccccaccttcatgacgcagaaggccaagaacgcgctagataacctggccgtactacacaccgccgaagccgggggccgcgcctacaaccacgcgctcagcgagttacccgagacgctagagaccctcctcctgttaacgctgctggccaccgtgaccgggggcatcttcctcttcctgatgtccggcaaggggatcggcaagatgaccctggggatgtgctgtatcattaccgccagcatacttctgtggtatgcccagatccagccccactggatcgccgcgtccatcatcctggagttcttcctcatagtcttgctgatcccggagcccgagaagcagcgcacgccccaggacaaccagctcacctacgtggtgatcgccatcctgaccgtagtggccgccaccatggccaacgagatgggctttctcgaaaagacgaagaaggactttgggctcggcagcatcaccacccagcagcccgagagcaacatcctggacatcgatctgcggccggcgtccgcctggaccctctacgccgtggccacgaccttcataacccccatgctgcgccactcaatcgagaacagttctgtcaatgtgtccctgaccgccatcgcgaaccaggctaccgtactcatgggactggggaagggctggcccctgagcaagatggacatcggagtcccactcctggccatcggctgctactcccaagtgaacccgatcaccctgacagccgctcttctgctgctcgtggctcactacgccatcatcgggcccggcctgcaagccaaggccacccgggaggcacagaagcgcgccgccgccggcatcatgaagaaccccacggtagacgggatgaccgtgatcgatctggaccccatcccgtacgaccccaaattcgagaagcagctgggccaggtgatgttactggtcctttgcgtgactcaggtgctgatgatgcggaccacgtgggccctctgtgaggcgctcaccctggccaccgggcccattagcaccctgtgggagggcaatcccgggcgcttctggaacacgaccatcgccgtctccatggccaatatcttccgcggcagttacctcgccggcgcgggtctcctgttctccatcatgaagaacaccgccaacacccgtcgcggcacggggaacaccggcgagaccctcggtgagaagtggaagaaccggctgaacgccctgggcaagagcgagttccaaatctataagaagtccggcatacaggaggtggaccgtaccctggccaaggaggggataaagagaggcgagacggaccaccacgcggtgagccgcgggtctgccaagctgcggtggtttgtcgagcgcaacctggtgaccccggagggcaaggtggtcgacctcggatgcgggcggggagggtggagctattattgcggcgggctgaagaacgtgaaggaggttaagggccttaccaagggcgggcccggccacgaagaaccgatccccatgtccacctacgggtggaatctcgtccgcctgcagagcggggtagacgtgttcttcacgccgcccgagaagtgcgacactctgttatgcgacattggtgagtccagccccaaccccacagtcgaggccggccggacactgagggtgctgaacctcgtggagaactggctcaacaacaacactcagttctgcatcaaggtcctgaacccgtacatgccaagcgtgatcgagaagatggaggccctgcagcggaagtacggcggggccctagtgcgcaaccccctgtcccggaacagcacacacgagatgtactgggtctctaacgcgtcaggcaacatagtgtctagcgtgaacatgatctcccgcatgctgatcaaccggttcaccatgcgccacaagaaggcgacctacgaaccggacgttgacctcgggagcggcacccggaacattggcatcgaatccgagactcccaacctggacatcatcggcaagcggatcgagaagatcaagcaagagcacgagaccagctggcactacgaccaggaccacccctacaagacctgggcctaccacggctcctacgagacgaagcaaacggggagcgccagtagcatggtgaacggcgtggtgcgcctgctcacaaaaccctgggacgtgatcccgatggtgacgcagatggccatgacggacacgaccccgttcgggcagcagcgggtcttcaaggagaaggtggatacccgcacccaggagcccaaggagggcacgaagaagctgatgaagatcaccgcagagtggctatggaaggagctcggcaagaagaagacaccccggatgtgcacccgcgaggagtttacgaggaaagttcgttccaacgcggccctgggggccatctttaccgacgagaacaagtggaagtccgcccgggaggctgtagaggactccggcttttgggagctggtggacaaagagcgcaacctccacctggaggggaagtgcgagacctgcgtgtacaacatgatggggaagcgcgagaagaagctgggggaatttggcaaggccaagggcagccgcgccatctggtacatgtggctcggggcccggtttctggagttcgaagcgctgggcttccttaatgaagatcactggttctcccgcgagaacagcctgagcggggtagagggcgaggggctacataagctcggctatattctgcgggacgtttcaaaaaaggagggcggggctatgtacgccgacgacaccgccggctgggacacccgcatcaccctggaggacctcaaaaacgaggaaatggtcacgaaccacatggaaggagagcacaagaagctggccgaggcgatcttcaagctgacataccagaacaaggtggtgcgggttcagcgcccgaccccccgggggaccgtgatggacatcatcagccgccgggaccagcgcgggtccggccaggtggtcacgtacggcctcaacaccttcaccaacatggaggcccagctgatacggcagatggagggggagggcgtgttcaagagcatccagcagttaaccgttaaggaggagatcgcggtcaaaaactggctcatccgcgtcgggcgcgagcggttatcccgcatggccatcagcggcgacgattgcgtggtcaagcccttagacgacaggttcgcctccgcgctcaccgccctgaacgacatgggaaaggtgagaaaggacatccagcagtgggagcccagcaggggttggaacgactggacccaggttccgttctgctcccaccacttccacgagctgatcatgaaggacggccgcgttttggtggtgccctgccggaaccaggacgagttgatagggcgcgccaggatcagccagggagccgggtggtccctgcgcgagacggcctgcctcggcaaaagctacgcccaaatgtggtccctgatgtacttccaccggcgcgacctgcggctcgccgcaaacgccatctgcagtgcggtcccctcccactggatccccaccagccgcaccacctggtcgatccacgcgacccacgagtggatgaccaccgaggatatgttgaccgtgtggaaccgggtgtggatccaggagaacccgtggatggaggacaaaacccccgtggagagctgggaggagatcccgtacctggggaagagggaagaccagtggtgcggcagcctcatagggctgacgtctcgggccacctgggccaaaaatatccagaccgccatcaaccaggtgcgcagcctgatcgggaacgaggagtacaccgactacatgccctccatgaagcggtttcgccgcgaggaggaggaggcgggcgtactctggtga

SEQ ID NO: 24899 - RNA, 9876 nt, synthetic construct
  misc_feature 1..9876: note = derived and/or modified CDS sequence (opt11) from DENV-2__KM279596__SS-prME
  source 1..9876: mol_type = other RNA
accgccggtattatcataatgatgattcccactgttatggcttttcacttaaccacgcgtaacggggaaccccacatgatcgtcagcaggcaggagaagggcaagagcctcctattcaagaccgagaacggtgtgaacatgtgtaccctgatggcgatggacctcggcgagctgtgcgaggacacaatcacctacaattgccccctgctcagacaaaacgagcccgaggacatcgactgctggtgcaacagcacgagtacctgggtgacctacgggacttgcaccgccaccggcgagcatcggcgcgagaagcggagcgtcgccctggtgccccacgtaggcatgggtctggagacccgcaccgaaacctggatgagctccgagggcgcctggaagcatgcacaacggatcgagacctggattctccggcacccaggtttcaccatcatggcggcaatccttgcctataccattggaacgacctacttccagcgggtcctgatctttatcctcctgacggccgtaaccccatccatggcgatgcgctgtatcggaatcagcaaccgggatttcgtggagggcgtctcaggggggagctgggtggacatcgttctcgagcacggatcatgcgtgaccaccatggccaagaacaagcccacgctggatttcgaactgatcaagacggaagcgaagcacctggccaccctgcgtaagtactgcgtggaggcaaagctgaccaacacgaccacagcgtctcggtgccccacacagggggagccctccctgaacgaggaacaggacaagcgcttcgtatgtaagcacagcatggtagaccggggctggggcaacgggtgtggcctattcggcaaaggagggatcgtgacatgcgccatgttcacgtgtaaaaagaacatggagggcaaggtggtccagcccgaaaacctggagtacactatcgtgataacgccccactccggcgaagagaatgccgtgggtaacgacacgggcaaacatggaaaggagataaaggtcacaccccagagcagcataaccgaggccgagctgaccggatatgggaccgtgaccatggagtgcagcccacgcaccggactcgacttcaatgaaatggtgctgctgcagatggagaacaaggcctggctcgttcaccgccagtggttcctcgaccttcctctcccctggcttccgggcgcggacacgcagggctccaactggatccagaaagagaccctggtcacgttcaagaatccgcacgccaaaaagcaggacgtcgtggtactgggcagccaggaaggggcaatgcacaccgctttgaccggtgccacagagatccagatgagctccggaaatctactgttcaccggccacctgaagtgccgcctgcggatggacaagctccagctgaaaggcatgtcttactccatgtgcaccggaaaattcaaagtcgtgaaggagatcgccgagacccagcacggaaccatcgtgatccgcgttcagtacgagggggacggcagcccctgtaagatcccgttcgaaataatggatttagagaagcggcacgttctcggccgcctgatcacggtcaaccccatcgttacagagaaggattcgccggtgaacatagaagccgaaccgccattcggagacagttacatcattattggcgtcgagcccgggcagctgaagttatcctggtttaagaaaggatcaagtatcgggcagatgttcgagactaccatgagaggcgccaagcgtatggccattctgggcgacacagcctgggactttgggagcctgggcggagttttcacctccatcggcaaggctctccaccaggtttttggggcgatctacggcgccgctttcagtggggtgagctggacgatgaagatcctgataggggtcgtgatcacctggatcggcatgaatagccgctccacgagcctatccgttagcctggtcctcgtgggcgtcgtcacactgtatctgggggtgatggtgcaggccgattccggatgtgtagtgagctggaagaacaaggagctcaagtgcggcagcggcattttcataacagacaacgtgcacacctggacggagcagtacaagttccagccggaatccccctccaagttagcctccgccatccagaaggcccacgaagaggggatctgcggtatccggtctgtcacccgcctggagaacttaatgtggaagcaaattacacctgagctaaaccatatactgaccgagaacgaagtcaaactcacaataatgaccggggacatcaaagggatcatgcaggccgggaagcggtcactgagaccgcagcctaccgagttgaagtacagctggaaggcgtggggcaaggccaagatgctctccaccgaactgcacaatcacacgtttctgatcgacggtcccgagaccgccgagtgccccaacaccaatcgtgcctggaactctctcgaggtagaggactacgggttcggcgtcttcaccaccaacatttggttaaagctgaaggagcgccaggacgtgttttgtgattccaagctaatgagcgcagcgattaaggataatcgggccgttcacgccgacatgggttactggattgaatccgcactgaacgacacgtggaagatcgagaaggcaagcttcatcgaggtgaagtcctgtcactggcccaagagccacacactttggtccaatggcgtactcgagagcgagatgataatcccgaagaactttgcgggccccgtatcgcagcacaactatcgccccgggtatcacacccagaccgctggcccgtggcacctggggcggctggagatggatttcgacttctgcgaaggcacgaccgtcgcggtgaccgaggactgcgggaaccgcggccccagcctcagaacaacgaccgctagcggcaaactgataaccgagtggtgctgccgctcctgcaccctgcctcctctccggtaccgcggggaggatggctgctggtacgggatggagatccggccactgaaggagaaggaggagaatctagtaaacagtttagtcaccgctggccacgggcagatcgacaatttctccctgggcgtattaggtatggccctcttcctggaggagatgctgcgcaccagagtaggtacgaagcacgccatactcctggtcgccgtgtcgttcgtaactctgatcacgggcaatatgtcctttcgcgacctcggcagggtcatggtaatggtgggcgccaccatgaccgacgacatcgggatgggcgtcacctacctggcgctgttggccgccttcaaggtgcggcccacgttcgccgctgggctcttgttgaggaagctgaccagcaaggagctgatgatgactaccatcgggatcgtgctcctgtcccagagcacgatcccagagtccatactggagctgacagacgcattggccctggggatgatggtcttaaagatcgtgcggaacatggagaagtatcagctggcagtcaccatcatggccatcctgtgcgtaccgaacgccgtcatcctccagaacgcgtggaaggtcagctgcacaacccttgcggtggtgtccgtcagcccgctattactcacctcgtcccaacaaaaggccgactggatcccattggcgctgactatcaaaggcctgaaccctacagcgatcttcctgacgaccttatccagaacaagcaagaaacggtcctggcccctgaacgaagcgataatggcggtgggcatggttagcatactggccagctccttattgaagaacgatatcccgatgaccggccccctggtcgccggcggtctcctgaccgtgtgctacgtgttgactgggcgcagcgcagacctggagctggagcgggctgctgacgtccgctgggaggagcaggcagagatatccggctcatcacccatcctgagtatcaccatctccgaggacggatcgatgtccatcaagaacgaggaggaagagcagacgctcacgatactgatccgcactggccttttagtgattagcggcttatttcccgttagcatcccgatcaccgccgcggcctggtatctctgggaggtaaagaagcagcgcgcgggcgttctctgggatgtgccctccccgccgccggtcggcaaggccgaactggaggacggggcgtaccgtataaagcagaaaggaattctgggttattcccagatcggcgcgggggtgtacaaggaggggaccttccatacaatgtggcacgtcactcggggcgccgtactcatgcacaagggcaagcggatcgagccgtcgtgggcggacgttaagaaggacctcatctcctacggcgggggctggaagctggagggcgagtggaaagagggagaggaggtgcaggtactcgcccttgagcccggaaagaacccgcgcgctgtgcagactaagcccgggctgttcaagaccaacaccgggacgatcggggcggtgagtctcgacttttcccccggcaccagcgggtcccctattgtggacaagaagggtaaggtagtcggcctgtacgggaatggcgtcgtgacccggtccggcacctacgtgtctgccatcgcccagacggagaagagcattgaagacaacccggagatcgaggacgacattttcagaaaaaagcggcttaccatcatggatcttcaccccggtgctggcaagaccaagcgctatttaccagcgattgtccgagaggcaatcaaaagggggctcagaaccctgatcctcgcgcccacgcgcgtggtggccgccgagatggaagaggcgctgcgcggcctgccgataagataccagacccccgccatccgcgccgagcacaccgggcgagagattgtcgatctcatgtgccatgccaccttcacgatgagactgttgagccccattcgggttcccaactacaatctcatcatcatggacgaggcacactttaccgaccctgcgagcatcgccgccagaggctatatctcaacccgtgtagagatgggcgaggccgccggcatcttcatgactgcgaccccacccgggtcgcgcgacccgttcccgcagtctaacgcacccatcatggacgaggagcgagagatccccgagcgctcgtggaacagcgggcacgagtgggttacggacttcaaggggaagaccgtatggttcgttccctccattaaggcggggaacgacatcgccgcgtgcctccggaagaacggcaaaaaggtcatccagctgagccgcaagacgttcgactccgagtacataaagacgcggaccaacgattgggatttcgtggtaacaaccgacatcagcgagatgggcgccaacttcaaggccgagcgcgtgatagacccgcggcgctgtatgaagcccgtaatcttaaccgacggggaagagagagtgatactggccggccccatgccagtcacccattcaagcgcggcacagcgaagagggagggtaggccgcaaccctaagaacgagaacgaccagtacatctatatgggggagccactggagaacgatgaggactgtgcccactggaaggaggccaaaatgttactggataacataaacacccccgaaggcatcatcccttctatgttcgagccagaacgggagaaggtggacgccatcgatggcgagtatcgattgcgcggggaggcccgcaagaccttcgtcgacctcatgcgtcgcggtgatctgccagtgtggctggcctaccgggtcgccgccgaagggatcaactatgccgatagacggtggtgcttcgatggcgtgaagaataatcaaattctcgaggagaacgtcgaagtcgagatctggactaaggagggggaacgaaagaagctaaagccccgttggctggacgcgcggatctactccgacccgctcgccctgaaggagttcaaggaattcgcggccggaagaaagtccctgaccctcaacctgataaccgagatgggtcgcctgcccacgttcatgactcagaaggccaagaacgcgctcgacaacctggccgtgctgcacactgccgaggccgggggccgtgcctacaaccacgcgctcagcgagctgcccgagacgcttgagacactgctgctgctgacactgctggcaaccgtgaccgggggcatctttctcttcctgatgtccggaaagggtatcgggaagatgaccctcgggatgtgttgcatcatcacagcctcgatcctcctctggtacgcccagatccagccacactggatcgccgcgtccatcatcctcgagttcttcctaatcgttttgctgataccggagccagaaaaacaacgcacgccacaggataaccagctcacctacgtagtgatcgccattttgaccgttgtggcggccaccatggcaaacgagatgggctttttggagaagacgaaaaaggattttggactcggctccatagcgacccagcagccggagtctaatatcctggacatcgacctgcgccccgcgtccgcatggacactctacgccgtggccactacgtttatcaccccgatgcttcgccatagcatcgagaactcgagtgtcaacgtgtcgctaactgcgattgctaatcaggcaaccgtattgatgggcctggggaaaggctggcccctttccaagatggacatcggggtccccctcctggccatcggatgctactcccaggttaacccaatcacgctgaccgccgcactcctgttactggtagcgcactatgccatcatcgggcccggtctgcaagccaaagcgacccgggaggcccagaagcgcgccgccgccggcatcatgaagaaccccacagtcgacgggatgacggtgatcgacctggacccgatcccatacgacccgaagttcgagaagcagctcggccaggttatgttactggtactctgcgtgacccaggtgctaatgatgcggaccacctgggctctgtgcgaggctctgacgctggcaaccgggcctatctcgacgctctgggagggaaaccccggccgtttctggaacaccactattgcggtctccatggccaatatcttccggggtagctatctcgcaggcgcagggcttctgttctccatcatgaagaacaccgctaacacccggcgcggtaccgggaacacgggtgagaccctcggcgaaaagtggaaaaaccggctgaacgccctcggtaagagcgagttccagatctataagaagtccggcatacaggaggtggatagaacgctcgcgaaagaggggataaaacggggcgagaccgaccatcacgctgtttcccggggctccgccaagctgagatggttcgtcgagcgcaacctcgtgacgccggagggcaaggtagtggatcttggctgcgggcggggcgggtggagctactactgcggcggtctgaaaaatgtaaaagaggtgaagggcctgaccaagggcgggccaggacacgaggagccaatccccatgagtacctatgggtggaacctcgtgagactgcagtctggcgtggatgtgttcttcactccgccagagaagtgtgacactttactctgcgacattggggagtcttcgcccaaccccaccgtagaggccgggcggaccctgagggtgctgaacttagtggagaactggctgaataacaacacgcagttctgtataaaggtgctcaacccgtacatgccctctgtcatcgaaaagatggaggccctgcagcggaaatacggaggggcgttggtgcgcaaccccctgagcaggaacagcacgcacgaaatgtactgggtctcaaatgccagcggtaatatcgtgtcgtcagtgaatatgatctcccgcatgctgattaaccgtttcacgatgcgacacaagaaagctacctacgaacctgacgtcgacctcgggagcggcacgcgaaacatcgggatcgagtcagagactcccaacttagacatcatagggaagcgcatcgagaagatcaagcaggaacatgaaacgagctggcactacgaccaagatcacccctacaagacatgggcataccacggctcctacgaaaccaaacaaacagggagcgcaagttcgatggttaacggggtggtccgcctgttaacaaaaccctgggacgtcatccccatggtgacccagatggcgatgaccgacacaaccccattcgggcagcagcgggtcttcaaggagaaggtggatacaagaacccaggaacctaaggagggcaccaagaaactgatgaagatcactgccgagtggctgtggaaggaactcggcaaaaagaagaccccccgtatgtgcacgcgcgaggagttcacccggaaggtgcgctccaacgccgccttgggggccatcttcaccgacgaaaacaagtggaagtccgcacgggaggccgtggaggattctggcttctgggaactcgtggacaaagagcgcaacctccacctggaaggaaagtgcgagacgtgcgtgtacaacatgatggggaagcgggagaagaagcttggggagttcggcaaagctaagggctcaagggccatctggtatatgtggctcggggcgcggttcttagagttcgaagccctgggatttttgaacgaggaccactggttctcccgcgagaatagcctgagcggcgtcgaaggcgaggggctacacaagctcggctacattctgcgggacgtatccaagaaggagggcggggccatgtacgccgacgataccgcaggatgggacacccgcatcacgttggaggacttgaagaacgaggagatggtcaccaatcacatggaaggggagcataagaagttagcagaggccatcttcaagctaacgtaccagaataaggtggtgcgggtccagcgtccgacgccccgtggcaccgtgatggatatcatatcccgccgcgaccagagggggtccgggcaagtggtcacctacggcttgaacacctttacaaatatggaggcccaattgatccggcagatggagggcgagggagttttcaagagcattcagcagttgacggtgaaggaggagatcgccgtaaagaactggcttatccgagtcggtagagaacggctaagccgcatggccataagcggcgacgactgtgttgtgaagccgctggacgatcggttcgcatccgccctcacagcactcaatgatatgggaaaagtgcgcaaggacatccagcagtgggagccttcccgggggtggaacgactggacccaggtgccattttgctcccaccatttccacgaactgatcatgaaggacggcagagtcctcgtggtcccatgccggaaccaggacgagttaataggtcgcgcccgaattagccagggcgctgggtggtccctacgcgagaccgcgtgtctcgggaaatcttatgctcaaatgtggtcgctaatgtatttccacagacgcgacctgcggctcgcagccaacgcgatctgcagcgcggtcccttcccactggatccccacgagccgcaccacctggtccatccatgccacccacgagtggatgaccacggaggacatgctcacggtctggaacagggtctggatccaagagaacccgtggatggaggacaagacgcccgtcgaaagctgggaggagatcccatacctcggaaagcgcgaggaccagtggtgcggcagtctcatcggcctaacctcccgggcaacttgggccaagaacattcagaccgcgattaaccaggtgagaagcctaatcgggaacgaggaatataccgactacatgccatcaatgaaacggtttagacgcgaggaggaggaagccggcgttctctggtga

SEQ ID NO: 24900 - RNA, 9876 nt, synthetic construct
  misc_feature 1..9876: note = derived and/or modified CDS sequence (opt11) from DENV-2__FJ850072__SS-prME
  source 1..9876: mol_type = other RNA
actgcgggggttatcatcatgttgatccccaccgcaatggcattccacctcacgacccgcaacggggaacctcacatgatcgttgggcgccaggagaagggcaaatctctcctgttcaagaccgaggacggcgtgaatatgtgcactctcatggcaatggacctgggtgagctgtgtgaggacacgatcacctacaagtgccccctcctccgtcagaatgaacccgaggatatcgactgctggtgcaactccaccagcacatgggtgacctacgggacatgtacaacgacgggcgagcaccggcgggagaagaggtccgtggcactggtgcctcatgtggggatggggctcgaaaccaggaccgagacgtggatgagcagcgagggggcgtggaagcacgtgcaaaggatcgagacctggatcttacgccacccgggattcgcgatcatggccgccatcctggcatacacaatcgggacaacacatttccagcgggccctaattttcattcttctgaccgcggtggccccgagcatgaccatgcgctgcatcggcatctcaaaccgggacttcgtcgagggagtatctgggggctcctgggtcgacatagtgctagagcacgggagctgcgtaaccacaatggccaaaaacaagcccacgctagacttcgagctgatcaagaccgaggccaagcagcccgccaccctccgcaagtactgcatcgaggcgaaacttacaaacacgacaaccgagtcacggtgcccgacccagggcgagcccagcctgaacgaggagcaagacaaaagattcatctgcaagcactcaatggtggaccggggctgggggaacggctgtggcctctttggcaagggaggtattgtgacctgtgccatgtttacttgtaaaaagaacatggagggcaaggtggtactgcccgagaacctagaatacactatcgttataaccccgcacagcggagaagaacacgccgttggcaatgatactgggaagcatggggaggagatcaagataacaccccagtcttctatcaccgaagctgagctaacagggtatggcaccgttacgatggagtgcagcccccgaaccggactcgacttcaacgagatggtgttgctccaaatggaagagaaggcctggctggtccacaggcaatggttcctcgacctacccctgccttggctgcccggggcggatacgcagggcagcaactggatccagaaggaaaccttagtgacgttcaagaacccccatgccaagaaacaagacgtagtcgtgctggggagtcaggagggggcgatgcacaccgcgctgaccggagcgaccgagatccagatgagcagcggcaatcttctgtttactggacacttaaaatgccgcctccgcatggacaagctgcagcttaaggggatgtcctacagcatgtgcacaggcaaattcaagatcgttaaggagatcgctgagacccagcatgggaccatagtgatcagagtgcagtacgaaggggatggctccccctgtaaaataccatttgagattatggacctcgagaagcggcatgcccttggacgcctgatcacagtcaacccaatcgtgaccgaaaaagactcaccggtgaatatcgaggccgaaccacccttcggcgattcctacatcatcatcggggtcgaacccggccagcttaagctcaactggttcaagaaaggtagctccattggccaaatgttcgagaccaccatgcgtggcgcgaagcggatggccattttgggggacacggcctgggacttcggctcgcttggcggcgtgttcacgtccatcggtaaggcgctgcaccaggtttttggcgccatctacggcgccgcgttctcaggggtctcgtggactatgaaaattctgataggcgtgatcataacgtggatcggaatgaacagccgatcgacgagcctgtccgtgtcgctagtgctggtcggcgtagtaaccctctacttaggcgccatggtgcaggcagactccggctgcgttgtgagctggaagaataaggaactcaagtgtggctcggggatcttcatcacagacaatgtgcacacatggacggagcaatacaagttccaacctgagagcccgtcgaagctggcctccgccatccagaaggcgcacgaggaaggtatctgcgggatcagaagcgtgacccgactagaaaacctaatgtggaaacaaatcacccccgagttgaaccacatcttgtccgagaacgaggttaagctgaccatcatgaccggcgacataaaggggatcatgcaggccggcaagcgaagtctgcgcccccagccgactgaactcaaatacagttggaagacctggggcaaagcaaagatgctaagcaccgaatctcataatcagacctttctcatagatgggcctgagaccgccgagtgtccgaacactaaccgggcctggaacagcttggaggtggaggattacggctttggcgtctttaccactaatatttggctcaagctccgcgaaaagcaggacgtattctgtgattcaaaactgatgtccgcggccataaaggacaaccgggccgtgcacgccgacatgggttactggatcgagtccgcgcttaatgacacatggaagatggaaaaggcgtctttcattgaggttaagtcctgccactggccaaagagtcacaccctttggtccaacggcgtccttgagtcagagatgataatccccaaaaactttgccgggcccgtctcccaacacaactaccgcccgggctaccatactcagaccgccgggccctggcatctgggcaaactggaaatggactttgacttctgcgaggggacgaccgttgtcgttaccgaagactgcggcaacagggggccatcattgcgcaccacaaccgccagcgggaaactgataaccgagtggtgctgtagaagctgcaccttacccccactccggtaccggggagaggacggctgctggtacggcatggagatccgccccctgaaggagaaggaggagaacttggtgaactcactcgtcacggcagggcacggccaaattgacaacttctccctgggggtgctaggtatggcgctttttcttgaagagatgctgcgcacgcgggtgggaacgaagcatgcgatcctcctggtcgcggttagcttcgtgaccctgatcacggggaacatgagtttccgggacctcggccgcgtcatggtaatggtgggggtcgcgatgactgacgacatcggtatgggtgttacctatctggccctgctagccgccttcaaagtacgccccaccttcgccgcggggctgttactccggaaacttacaagcaaggagctgatgatggccaccatcggcatcaccctcctatcccagagtaccattcccgagacaatcttggaattaacggacgctctggccctcgggatgatggtccttaaaatcgtgcgcaatatggagaaatatcagctcgccgtcactattatgaccatctcctgcgtccctaacgccatgatcctgctaaatgcgtggaaggtgtcttgtacaatcctggccgtggtctccgtgagccctctgcttctgacctccagccagcaaaagaccgattggatcccattagcgctcacaataaagggcctgaaccccactgcgatctttctgaccaccctcagccggaccagcaaaaagcgatcgtggccgctgaacgaagctgtcatggccgtggggatggtgagcatcctcgcttcaagcctcctgaagaacgatatcccgatgactggcccgctggtcgccggtgggctgcttaccgtgtgctatgtgctgaccggaaggagcgcagacctcgaactggaaagggcaactgacgtgaagtgggaggatcaggctgagatttccgggagctcccccatcttatccatcacgatctctgaggacggaagcatgtccatcaagaatgaggaggaagaacagacgcttaccatacttatccggaccggcttgctcgtcatttcgggtgtgttcccggtctctattccaatcacggcggccgcgtggtacctgtgggaggttaagaagcaacgcgcaggcgtgttatgggacgtgccttccccacccccggtggaaaaagccgagctcgaggatggggcctaccggatcaagcagagaggtatcctgggttactcccagatcggagccggagtttacaaagaggggacattccacaccatgtggcacgtcacccgtggcgccgtactcatgcaccgcgggaagaggatagagccgtcctgggcggacgtgaagaaagacctcatctcctacggagggggctggaagctggaaggcgagtggaaggagggggaggaggtacaggtactggccctcgagcccggaaagaaccccagggccgtgcaaaccaaacctgggctattcaaaacgaacaccggcaccattggggccgtatcactggacttcagccccggtacctctggctctccaatcgtggaccgcaaggggaaggtggtgggtttatacgggaacggcgtggtgacgcgcagcggggcctacgtcagtgccatcgcccagaccgagaagtccatagaggacaaccccgagattgaggacgatattttccggaagaaacgcctaacaatcatggacctccaccccggcgccgggaagacgaaacggtacctacccgccatagtgcgcgaggcgattaagcggggcctccgcacgttaatcttagccccaacgagagtggtcgccgccgaaatggaggaggctctccggggcctgcccatccgttaccagacccccgcgatccgggccgagcacaccggaagagaaatcgtggacctgatgtgccacgcaacgttcacgatgaggctgctgagccccgtccgtgtccccaactataacctgataatcatggatgaagcgcatttcaccgaccctgcctccatcgctgccagaggctatattagcacgcgcgtagagatgggcgaggccgccggaatctttatgacggcgaccccgcctggctcccgggacccttttccccaaagcaatgcgcccataatggacgaggagcgcgaaatccccgaaaggagctggaacagcgggcatgagtgggtgaccgacttcaagggcaagaccgtatggttcgtgccctccataaaagccgggaacgatatcgcggcctgcctcagaaagaatgggaagaaggtcatccagctgagccggaagacgtttgactccgaatacgtaaaaactcgcgcgaatgactgggacttcgtggtcaccaccgatatctctgagatgggcgcaaactttcgggccgagagggtcatcgatccccgacgctgcatgaagccagtaatcttgacagacggggaggagcgggtgatcctcgccggcccaatgccggtaacccactccagcgcagcgcagagacgtgggcgggtaggccggaaccctaagaacgagaacgaccagtatatatatatgggcgagcccctggagaacgacgaagactgcgcccattggaaggaggccaagatgctgctagacaatattaacacccccgagggcatcatccctagcatgttcgagcccgaacgggaaaaagtggatgcaatcgacggggagtaccgcctgcgcggcgaggcccgcaagacctttgtcgaccttatgcggaggggtgacctccccgtgtggctggcgtaccgcgttgccgcggaggggatcaactacgcggatcgccggtggtgcttcgacggaatcaaaaacaaccagatcttggaggagaacgtcgaggtggagatatggaccaaagagggggagcggaaaaagttgaaaccgcgctggttagacgcccgcatctacagcgacccactggcgcttaaagagttcaaagagttcgcggccggccggaagtccctgaccctgaacttgatcaccgagatgggacggttgcccaccttcatgacgcaaaaggcccgtaacgcgctggacaacctcgctgtactgcataccgccgaggccgggggccgcgcgtataaccacgctctgagcgagttgcccgagaccctggagacgttgctattactgacgctcctcgccacagtgaccggaggcattttcctgttcctaatgagcggcaaggggattggcaagatgaccctggggatgtgttgcataatcaccgccagcatcctgctatggtatgcccaaattcagccgcattggatcgcggcgtccatcatactggagtttttcctgatcgtcctccttatacccgagcccgagaagcaaaggacgccccaggacaaccagctgacttatgtcgtaatcgctattctcaccgtggtcgccgcaaccatggccaacgagatgggcttcctagagaagacgaagaaagatctgggcctcggctcgatcactacccaggagagcgagtccaacatcctggatatcgatctgcggccggcctcggcgtggaccctctacgcagtcgcaacgaccttcatcaccccaatgttgcggcattccatcgagaatagctccgtgaatgtatctctgaccgctatcgcgaatcaggccacggtcctcatggggctgggaaagggctggccgctgtcaaagatggacataggtgtgccactactagcaatcggatgctactcccaggtaaacccgatcacgctgactgccgcgttgctatcactggtagcacactacgccataatcgggcccggcctccaggccaaggccacccgtgaggcgcaaaagcgagcggccgccggcatcatgaagaatccgacggtggacgggataacagtcatagacctggagcccatcccgtacgatcccaaattcgagaaacagctgggccaggtaatgctcctgatcctgtgcgtaacccaagtcctcatgatgagaaccacgtgggcgctgtgcgaggcgctgacgctggcaaccgggcccatcagcaccttatgggaaggcaacccagggcgattttggaacacgacaatcgcggtctccatggccaacatctttcgcggcagctacctggccggcgctgggctcctcttctccatcatgaagaacaccaccaacacgcgccggggtaccgggaacatcggcgaaaccttaggcgaaaaatggaagtcccgcctcaacgccttggggaagtccgagttccaaatctataagcggagcggaatccaagaggtggatcgtactctggcaaaggagggcatcaagagaggtgaaacagaccaccacgccgtctccagggggagcgcgaagctcagatggttcgtggagagaaacatggtgaccccggagggcaaggtcgttgacctgggctgcgggcggggtgggtggtcatattattgcggcggcctgaagaacgtgcgggaggtcaagggactgaccaaaggagggcccggacacgaggagcccatcccaatgtccacatacggatggaacctggtgcggctgcagagcggcgtggatgtctttttcacgcctcccgagaagtgcgacaccctcttgtgcgacatcggggagagctctcccaaccctacgatcgaggcaggccgtacccttcgtgtgttaaacctggttgaaaactggcttaataacaacacgcagttttgcatcaaggtcttgaacccgtacatgccctccgtcatcgagaagatggaaaccttgcagcggaaatacggcggagctctggttcggaatcccctgtcgcgcaactccactcacgagatgtactgggtgagcaacgccacaggcaatatcgtcagctcagtgaacatgatctcccgcatgctcataaaccgattcactatgaaacataagaaggccacgtacgaaccggacgttgacctggggtcgggcacccgcaacatcggcatcgaaagtgagatcccgaacctggacatcatcggcaaacggattgagaagatcaagcaagagcacgaaaccagctggcactacgaccaagaccatccatataagacctgggcgtaccacggctcctatgaaacaaaacagaccggaagcgcgtcctccatggtgaatggagtggtccgcttgctcacaaagccctgggacgttgtgccgatggtaacgcagatggccatgacggacaccacccccttcgggcagcagcgggtgttcaaagagaaagtggataccagaacccaggagcctaaggaaggcaccaagaaattaatgcggatcaccgccgaatggttatggaaagaactgggaaagaaaaagacgccccgcatgtgtactcgagaggagttcacccgcaaggtccgatcgaatgccgcactaggagccatttttacagatgagaacaagtggaagtccgcgcgcgaggccgtggaagattctcggttctgggaactcgtggaccgcgagcggaacctgcacctcgaaggaaagtgtgagacttgcgtgtacaatatgatgggaaaacgcgagaagaagctcggagagttcgggaaggctaagggctcccgcgcgatatggtacatgtggctcggcgcccgatttctagagttcgaggctttggggttcttaaacgaagaccactggttcagccggggcaactctctgagcggggtagagggtgaagggctacatcgccttggctatatcctgcgggacgtaagtaaaaaggagggtggggccatgtacgcggacgacacggccggctgggatacccgcataacacttgaggacctcaagaacgaggaaatggtgacaaaccacatgaagggcgaacacaaaaagctggccgaagccgtattcaaactcacgtaccagaacaaggtcgtgcgcgttcaacgaccgacgccccgcggcacagtcatggatattattagtcggcgagatcaacgcgggtccggccaggtgggaacctacggtttgaacacgttcacaaacatggaggcccagctgatccgacagatggagggcgaggggatcttcaagtctatccagcaccttaccgtgactgaggagatcgctgtgcagaattggttagcccgggtgggtcgagaaaggctgagcaggatggccatcagcggcgacgactgtgttgtcaagcccctcgacgacaggttcgccagcgccctgacggcgttgaacgacatggggaaggtgaggaaggacatccagcagtgggaacctagccggggatggaacgactggacccaggttccgttctgctcccaccacttccacgagctcgtcatgaaagacgggcggatgctggtggtgccctgtcggaaccaggacgagctgatcgggcgtgcacggataagccagggggccggttggtccctcaaggagactgcatgcctaggtaaatcgtacgctcagatgtggacgctgatgtactttcaccgccgggatctccgcttagcagccaatgccatctgttccgcggtcccaagccactgggtacccacctcccgcacgacctggagcatacacgccaagcatgagtggatgacaacggaggatatgctagccgtgtggaaccgggtctggatccaggagaacccgtggatggaagataaaacgcccgtggagtcgtgggaggaggtcccttacttgggtaagcgcgaagatcagtggtgtggcagcttgatcggactgacctcccgggccacatgggcgaaaaatatccagaccgccataaaccaggtgagaagcctcatcggaaacgaggaatatacggattacatgccctcgatgaagcggttccgccgggaggaggaggaagctggtgtgttgtggtga

SEQ ID NO: 24901 - RNA, 9876 nt, synthetic construct
  misc_feature 1..9876: note = derived and/or modified CDS sequence (opt11) from DENV-2__JN819419__SS-prME
  source 1..9876: mol_type = other RNA
accgccggcgtgatcgtcatgctgatccccacggccatggccttccacctcaccacccggaacggggagcctcacatgatcgtgggccgacaagagaagggcaagtccctgctgttcaagacagaagacggagtcaacatgtgcacgctcatggcgattgacctgggggagctgtgcgaggacaccatcacttacaagtgccccctcttacgccaaaacgagccagaggacatcgattgctggtgcaacagcacgagcacctgggtcacctacgggacatgcaccaccacgggcgaacaccggcgcgaaaaacggtccgtggccctggtgccccacgtcggcatgggcttggagacacgcaccgaaacctggatgtcatccgagggggcctggaagcacgtgcagcgaatcgagacctggatactgagacacccgggcttcaccatcatggccgcgattttagcctacactatcgggaccacgcacttccagcgggccctcatctttattctgctcaccgccgttgcgccctctatgacgatgcgctgcatcgggatatccaaccgggacttcgtagagggggtgagcggtggctcatgggtggacatagtcctggagcacgggagctgcgtgaccacgatggccaaaaacaagcccaccctggacttcgagctcatcaagaccgaggccaaacagcccgcgaccctccgcaaatactgcgtggaggccaagctgacgaacaccaccaccgaatcccggtgtccgacgcagggtgaaccatctttaaacgaagaacaggacaagcgcttcatttgcaagcactccatggtagataggggctggggtaatggctgcgggctattcggtaaaggcgggatcgtaacctgcgcgatgttcacctgtaagaagaacatggagggcaaggtggtacaaccagagaacctggagtacaccatcgtgatcacgccccatagcggggaggaacacgccgtcggcaacgacaccgggaaacatggaaaggagatcaagatcaccccgcagtctagcatcaccgaggccgagctgaccgggtacggaacggtcaccatggagtgcagcccccgcacgggcctagacttcaatgagatggtgctcctgcagatggaggacaaggcctggttagtgcaccggcagtggtttctggacctccccctcccttggctgcctggagccgacacccagggcagtaactggatacagaaggagacgctggtcaccttcaagaacccccacgcgaagaaacaggacgtggtcgtgctcggttcccaggagggcgccatgcacaccgccttgaccggggccacggagatccagatgagcagtgggaacctcctgttcaccggccacctgaagtgccgcctgcgcatggacaagctccagttgaaggggatgagctacagcatgtgcaccggcaagttcaaaatcgtgaaggagatcgctgagacccaacacgggactatcgtaatccgcgtgcagtatgagggcgacggcagcccgtgcaagatccccttcgaaatcatggatttagaaaagcggcacgtgctcgggcgcttaattaccgtaaacccaatcgtgaccgagaaggacagccccgtgaacatcgaggcggaaccgcccttcggggactcctacatcataatcggggtagagccggggcagctgaagctgaactggttcaagaaagggagctccatcggccaaatgtttgagaccacgatgcgcggcgccaagcggatggccatcctgggggacaccgcctgggactttggctcgctaggtggggtgttcacttccattggtaaggccttacaccaagtcttcggggcgatctacggggccgccttcagcggggtctcctggaccatgaagattctgataggtgtgatcatcacgtggatcgggatgaacagccgctccaccagcctgtccgtgagccttgtactcgtgggcgtggttacgctgtatctgggagccatggtccaggccgactccggttgcgtggtgagctggaagaacaaggagctgaagtgcggatcggggatctttattaccgacaacgtgcacacgtggaccgagcagtacaagttccagcccgagagcccaagcaagctggccagcgccatccagaaggcccacgaggagggaatctgtgggatccggagcgtgacccgcctggagaacctcatgtggaagcaaatcactcccgagctgaaccatatactgagtgagaacgaggtcaagctcacgatcatgacgggtgatatcaaggggatcatgcaggcgggcaagaggagcttaagaccgcagcccaccgagctgaagtattcctggaagacctggggcaaggcaaagatgctttcaacggagagccacaaccagacctttctgatcgacggtcccgagacggcagagtgtccgaacaccaaccgggcctggaacagcctggaggttgaagactacggcttcggggtgttcacgaccaatatctggctaaagctgcgcgagaagcaggacgtcttctgcgactccaagctgatgagcgccgccatcaaggacaaccgggcggtgcacgccgacatgggctactggatagagtcagccctcaatgacacctggaagatggagaaagccagctttatcgaggtgaaaagctgccactggccaaagagccacaccctgtggtccaacggcgtcctggagagcgaaatgatcatccccaagaacttcgcgggccccgtctcccagcacaactaccgcccgggttaccacacccagaccgcggggccctggcatctcggcaagctggagatggacttcgacttttgcgaggggacaaccgtggttgtgacagaggactgcggaaaccggggccccagcctgcgcacgaccaccgccagcgggaagctcataaccgagtggtgttgccggtcctgcacgctacccccgctgcgctacagaggggaggacggatgctggtacggcatggaaatccgccccctcaaggagaaagaggagaacttagtaaactcactggtcaccgccgggcacggccagatcgacaacttttccctcggcgttttaggtatggccctgttcttggaggagatgctgcggacccgcgtgggaaccaagcacgcgatcctgcttgtcgcagtgagctttgtgacgctgatcaccgggaacatgtcctttcgggacctgggtcgcgtcatggtgatggtgggggccaccatgaccgacgacatcggcatgggagtcacatacctcgctctgctggctgcgttcaaggtgcgccccaccttcgcagccgggctcctgctgcgtaagctcaccagcaaggagctaatgatggcgaccatcggggtggccctgctctcccagagcacgatccctgagaccatcctggagctgaccgatgcgctcgccctggggatgatggccctgaaaatcgtcaagaacatggagaagtaccagctcgctgtgaccattatggctatctcctgcgtgccgaacgcggtcatcctgcagaacgcctggaaggtgagctgtaccatcctggcagccgtctccgtgagccccctcctgctgacatccagccaacagaaagcggactggattcctttagccctgaccatcaaaggactgaaccccaccgccatcttccttacgacactctcccgcaccagcaagaagcggtcctggccgctgaacgaggccattatggccgtgggcatggtgtcaatcctggcatccagcctgctgaagaacgatattcccatgaccggtcccctcgtggccggcgggctgctaacggtgtgctacgtcctcaccggcagaagcgcggacctggagctggagcgggccgccgacgtgaagtgggaggaccaggctgagatctccgggagctcccccattctcagcatcaccatttccgaggacggcagcatgtccatcaagaacgaggaagaagaacagaccttaacaatcctgatccgcacgggcctcctggtgataagcggggtctttccggtttccattcccatcactgccgccgcctggtatctatgggaggtgaagaagcagcgagccggcgttttgtgggacgtaccctcacctccacccgtggggaaagcggagttggaggacggcgcctaccgcataaagcagcgggggatcctgggctactcccagattggcgccggggtctacaaggagggcacattccataccatgtggcacgtaacacggggtgctgtcctcatgcacaggggcaagcgaatagagcccagctgggccgacgtcaagaaagacctggtgtcctacgggggcggctggaaactggagggggagtggaaggaaggcgaggaggtgcaggtcttggcgctcgagcctggaaagaaccccagggccgttcagactaaaccgggcatctttaagacaaacacagggaacatcggtgccgtcagcctggacttctcccccggcactagcgggtcccccatcgtcgatcgcaaaggcaaagttgtgggactctacgggaacggcgtcgtaacccggagcggggcctacgtgtcggcgatcgcgcagaccgagaagtccatcgaggacaaccccgaaatagaggacgacatattccgcaagaagcggctgaccataatggatttgcaccccggcgccggaaaaacgaagcgctacctccccgccatcgtccgggaggccatcaagcgaggcctgcggaccctgatcctggccccgacccgcgtggtggcagccgaaatggaagaagccctacgagggctgccaattaggtaccagacccccgccatccgcgctgagcacaccggccgggagatcgtcgacctgatgtgccacgcgaccttcaccatgcgcctcctgtcaccggtgcgggtgcctaactacaacctgatcatcatggacgaggcccacttcacagatcccgcctccatagccgcgcgcggctacatcagcacgcgggtagagatgggggaggccgccggcatcttcatgaccgcgacgccgcccgggtcccgcgacccgttcccccagagcaacgcgcccatcatggacgaggagagggagatccctgagcggtcctggaactcaggacacgagtgggtcacagacttcaaggggaagacggtgtggttcgtcccatccatcaaggccggcaacgacatcgccgcctgtctgcggaagaatggcaaaaaggtgatccagctgagccgcaagaccttcgactccgagtacgtgaagacacgggcaaacgactgggatttcgtcgtgaccacggacatcagcgagatgggggcgaacttcaaggcggagcgcgtgatcgacccccggcgctgcatgaagcctgtcatcctgaccgacggcgaggagcgggtgatcttggccggtcctatgccagtgacccactccagcgccgcccagcgtcggggccgcattgggcgtaatccgaagaacgagaacgaccagtacatttacatgggcgagccccttgagaacgacgaagactgcgcgcactggaaagaggccaaaatgctgctcgacaatatcaacaccccggagggcatcatcccgtccatgtttgagcccgagcgggagaaggtcgacgccatcgacggggagtaccgcctccggggagaggctcgcaagacgttcgtggacctgatgcggcgcggggatctccccgtgtggctggcctacaaggtggcggccgagggcatcaactatgccgaccggagatggtgtttcgacgggatcaagaacaaccagatccttgaggagaacgtggaagtcgaaatctggaccaaggagggggagcgcaagaagctcaagccgcgctggctggacgcccggatctacagcgaccccctggcgctcaaagaatttaaggagttcgccgccggccgcaaatccctgaccctgaacctcatcaccgaaatggggaggctgcctactttcatgacgcaaaaggctcgcaacgccctggacaacctcgcggtgcttcacaccgccgaagcaggcgggaaggcttacaaccacgccttaagcgagctccccgagaccttagagacgctgctcttactgaccctcctggcgaccgtgactgggggcatcttcctgtttctaatgtccgggaagggcatcgggaagatgacgctgggtatgtgctgcatcatcacagcctcaatcctgctctggtacgcccagatccaaccacactggattgctgcctccatcatcctcgagttctttctgatcgtcttgctgatccccgagcccgagaagcagcggacgcctcaggacaaccagttaacctacgtggttatcgcgattcttaccgtcgtggccgccacgatggccaatgagatggggttcctggaaaagaccaagaaggacctgggtcttggcagcatcaccacccaggagagcgagtccaatatcctggacatagacctgcgcccggcgagcgcgtggacactctacgccgtggccaccacattcgttacccccatgctgcggcattccatcgaaaacagctccgtgaacgtcagcctgacagccattgcgaaccaggcaaccgtcctcatgggcctgggcaaggggtggcctctatccaagatggacatcggcgcgcccctcctggccatcgggtgttatagccaggtgaatccgatcacgttgaccgcagcgctcctgctgctcgtcgcccattacgcaatcatcgggcccggcctgcaggccaaggcaacgcgcgaggcgcagaagcgggccgccgccgggatcatgaagaacccaaccgtcgacggcataacagtgattgaccttgaaccgatcccatacgaccccaaattcgagaaacagctcggccaggtgatgttactgatcctctgcgtaacccaggtgctgatgatgcgcacgacctgggctctgtgcgaagcgctcaccctggccaccggccccatctccacgctctgggaggggaaccccggccggttctggaacactaccatcgctgtgtctatggccaacatctttcgcggctcctacttagcgggggccggactgctgttcagcataatgaaaaacaccacgaacacccgccgggggaccggcaacatcggcgagaccctaggggagaagtggaagtcgcgcctgaacgcccttggcaagagcgagttccagatttacaaaaagtccgggatccaggaggtcgaccggacgctcgcaaaggagggcatcaagcgaggggagaccgaccaccacgccgtaagtcgaggctccgcaaagctgcgctggttcgtggagcggaacatggtgacgcctgagggcaaggtggtggaccttgggtgcggacgcgggggctggagctactactgtggcggcctcaagaacgtccgggaggtgaagggcctgaccaaaggtgggcccgggcacgaggagcctatccccatgtccacttacggttggaacctggtgcggctccagagtggggtcgacgtcttcttcaccccgcccgagaaatgcgataccctactgtgtgacatcggcgagagctcccccaaccccacgatcgaggccggccggacgctccgcgtgttgaacttggtcgagaactggctcaacaacaacactcagttttgcatcaaggtgctgaacccgtatatgccctcagtgatagagaagatggagaccctgcaacgtaagtacgggggagccttagtccgcaacccgctgtccagaaattccacccacgagatgtattgggtctccaatgcaactgggaacatcgtcagctccgtcaacatgatcagccgcatgctgatcaaccgattcacgatgaaacataaaaaggctacctacgagccggacgtggaccttggctccggtacccgcaacatcggcatcgagtccgaaatccctaacctcgacatcattggcaagcggattgagaagataaagcaggagcatgagacctcctggcactacgaccaggaccacccctacaagacgtgggcgtaccatgggagctacgagaccaagcaaaccggttctgccagctccatggtgaacggcgtcgtacgcttgctgaccaaaccatgggacgtggttccgatggtaacgcagatggccatgaccgacaccaccccatttggccaacaacgcgtgttcaaagagaaagtcgacacgcggacccaggagcccaaagagggcaccaagaagttaatgaagatcaccgccgagtggttgtggaaggagctggggaagaagaagatcccccgcatgtgcacccgggaggagttcacccgcaaggtgcggagcaacgcggcgctcggcgcaatattcaccgacgagaacaagtggaagtccgcccgcgaggccgtggaggacggtcggttctgggaactggtcgaccgggagcgaaatctgcacctcgaaggcaagtgcgagacctgcgtatacaacatgatggggaagcgcgagaagaagctgggcgagttcggcaaggcgaaagggagccgggccatatggtacatgtggctgggtgcccgctttctcgagttcgaggccctgggattcctgaacgaagaccactggttctcccggggcaacagcctctccggggtcgagggcgaggggcttcaccgcctggggtacatactccgtgacgtgtccaaaaaggagggcggggccatgtatgcggacgacacggcgggctgggacacccgaatcaccctggaggacctgaagaacgaggagatggtgaccaaccacatgaagggagagcacaagaagctcgccgaggctatcttcaagttgacgtaccaaaacaaggtcgtgcgggtgcagcgcccgacgccccggggtaccgttatggacatcatcagccgccgtgatcagcgcggctccggccaggtgggcacctacgggctgaacaccttcacaaatatggaagcccagctcatccgccagatggaaggcgagggtatcttcaagagtatccagcaccttaccgtgacggaagagatcgcggtccaaaactggctggcccgcgtggggcgcgagcgcttgacgagaatggccatctccggggacgactgcgtagtgaaacccatcgacgatagattcgcgaacgccctaaccgcgttaaatgacatggggaaggtgcgcaaggacatccaacagtgggagcccagccggggctggaacgattggacccaggtgccgttctgttcccaccacttccacgagcttgtcatgaaggacgggcgtgtcctggtggtcccctgccggaaccaagacgagctgatcggccgcgcccggatctcccagggcgccgggtggtccctcaaggagaccgcctgcctgggcaagtcgtacgcccagatgtggacactgatgtacttccataggcgggacttgcgcttggcggccaacgctatctgctccgccgtgcctagccactgggtgcccacctcccggaccacctggagcatccacgcgaagcacgagtggatgaccacagaagatatgctggccgtctggaaccgcgtgtggatccaggagaacccttggatggaggacaagacacccgtggagagttgggaggaggtcccatacctcgggaagcgggaggaccagtggtgcggctcactgatcgggctgacctcccgcgccacatgggctaagaacatccagacagccatcaatcaggttcggagcctcatcggcaatgaggagtacacagactatatgcccagcatgaagcgcttccgacgtgaggaggaggaggcgggtgtgctgtggtag

SEQ ID NO: 24902 - RNA, 9876 nt, synthetic construct
  misc_feature 1..9876: note = derived and/or modified CDS sequence (opt11) from DENV-2__FJ850074__SS-prME
  source 1..9876: mol_type = other RNA
actgccggtgtcatagtaatgctgatccccaccgtcatggccttccatctcaccaccaggaacggggaaccccatatgattgtggggcggcaagagaaagggaaatccctattattcaagaccgaggacggcgtcaacatgtgcaccctcatggcgatcgacctgggtgagctgtgcgaggatactatcacctacaagtgccccttgcttagacagaacgaacccgaggacatagattgctggtgtaactccacttccacctgggtaacctacgggacctgcaccaccacgggcgagcatcggcgggagaagcggtccgtagcactggttccgcacgtggggatgggcttagaaacccgcaccgagacatggatgagctccgagggggcctggaagcatgtgcagcggatcgagacgtggatcctgaggcaccccggcttcaccatgatggccgccatcctcgcgtacacaatcggtacgacgcacttccagcgagcccttatattcatcctgctgaccgccgtcgcccccagcatgaccatgcgctgtattggcatctccaaccgggacttcgtggagggcgttagcggtggcagttgggttgacatagttctcgagcacgggagctgcgtgaccacgatggcgaaaaataagcccaccctggacttcgagctgatcaagaccgaggcgaaacagcccgcaaccctccgaaagtactgcgtcgaggcgaagctgactaacaccaccacagagtcccggtgcccgacacagggagagcccagtttgaacgaagaacaggacaagaggttcatctgcaaacactccatggtggaccggggctggggcaacggctgcggactgttcgggaagggcgggatcgtgacatgtgcaatgttcacgtgtaagaagaacatggagggaaaggtcgtccagcccgagaacctggagtacaccattgtgatcacgccccacagcggggaagaacacgccgtcggcaacgacaccggcaagcacggcaaggagataaagatcacaccccagtccagcatcaccgaggccgagctgactgggtatggcaccgtgaccatggagtgctcaccccgcaccgggcttgactttaacgagatggtgctgctgcagatggaggacaaggcctggttggtccaccggcagtggttcctggacctgcccctcccgtggttacctggggccgatacccagggcagcaactggatccagaaggagacgctggtgacgttcaagaatccccacgccaagaagcaggacgtggtggtacttgggtcacaggagggcgcgatgcacaccgccctaacaggagccactgagatccagatgagcagcggcaatcttctgttcaccggccacctgaagtgccgactgcggatggacaagctccaactcaaggggatgtcctacagcatgtgcaccggcaaattcaagatcgtaaaggagatcgcagagacccagcacgggacaatcgtgatccgcgttcaatatgagggcgacggctctccctgtaaaatccccttcgagatcatggacctggagaaaaggcacgtcctcgggagactcatcaccgtcaaccctatcgtgaccgagaaagactcgcccgtcaatatcgaggcagagccacccttcggcgattcctacatcatcatcggggttgagccgggccagctgaagctcaactggtttaagaaagggagctccatcggccagatgttcgagaccacgatgcgcggcgccaaacgtatggccatcctgggcgacaccgcctgggacttcggcagcctaggcggggtgttcaccagtatcgggaaggccctccaccaagtatttggagccatctatggcgcggccttcagcggggtctcctggacgatgaagatccttataggcgttatcatcacttggatcgggatgaacagccgctcgaccagcctgtctgtgagcctggtcctcgtgggggtcgtcaccctgtacttaggggccatggtgcaggccgactccggctgcgtcgtgagctggaagaacaaagaactcaagtgcggatccgggattttcatcaccgataacgtgcatacgtggactgaacagtacaagttccagcccgagagcccgagcaaactggcgagtgccatccagaaggcccacgaagagggaatctgcgggatccgaagcgtcactcgcctggagaacctaatgtggaagcagatcacccccgaactgaatcacatcctgtccgagaacgaggtcaaactcacgattatgacgggtgacattaagggtattatgcaggccggcaagcgaagcctgcgcccgcaacccaccgagctgaagtactcctggaagacctggggcaaggccaagatgctacccacggagagccacaaccagacgtttctaatcgatggtcccgagacagcggaatgcccaaacaccaaccgtgcctggaacagcctcgaggtggaagactatggcttcggggtctttacgaccaacatctggctcaagctgcgagaaaagcaggacgtgttctgcgacagcaagctgatgtctgctgctataaaggacaaccgggccgtgcatgcggacatgggctattggatcgagagcgccctaaacgacacctggaagatggagaaggcttccttcatcgaggtcaagagctgccactggcccaaatcccacaccctgtggagcaacggtgtgctggagtctgagatgattatcccaaagaacttcgccgggccggtcagccagcacaactaccgccccggctaccacacccagacggccgggccctggcacctaggtaagctggagatggacttcgacttctgtgagggcaccaccgtagtggttaccgaagactgcggcaaccggggtccctccctgcgaacaactacagcgagcgggaagttaatcacggagtggtgctgtcggtcttgcacgctgccgccgctgcgctaccggggcgaggatgggtgctggtacggcatggaaatacgacccctaaaggagaaggaagagaacctcgtaaattctcttgtgaccgccgggcacggtcagatcgataacttctccctgggcgtgctaggaatggccctgttcctcgaggagatgctgcggacccgcgtaggcaccaaacatgccatcttactcgtggcggtgagttttgtcacgctgatcaccgggaacatgagcttccgggatctgggccgagtgatggtgatggtcggtgccaccatgactgacgacatcggcatgggggtgacttaccttgccctgttagccgctttcaaggtgaggcccaccttcgcggccgggctcttacttcggaagctcacctccaaggaactgatgatggccaccatcggagtcgccttactcagccagtccacgatccctgaaacaatcttggagctgacagacgccctcgcgctgggcatgatggccctgaagatcgtgaagaacatggagaagtaccagcttgccgtgaccattatggccatcagctgcgtacccaacgccgtgatcctgcagaatgcgtggaaggtatcctgtacgattctcgccgctgtgagcgtaagccctctgctcctgaccagctcccaacagaaagccgactggatacctttagcgctgaccataaagggcctgaaccctaccgcaatcttcctcactacactgagccgcacctcgaagaagagaagctggcccctgaacgaggcgatcatggccgtcggcatggtctccatacttgccagctccctgctgaagaacgacatacccatgaccggccccctcgtggcgggagggctgctgacggtctgctacgtgttgaccggacgcagcgctgacctggagctcgaacgggccgccgacgtgaagtgggaagaccaggccgagatcagcggctccagcccgatcctctccataacgattagcgaggacggctccatgtccatcaagaacgaagaggaggagcaaactctgacgattctgatacgcaccggcctgctggtcatatcgggggtgtttcccgtgagcatacctatcaccgcggccgcatggtacctgtgggaggtcaagaaacagcgggctggggtgttgtgggatgtgccctcgccgccacccgtagggaaggccgagctggaagacggtgcgtatcggataaagcaacgggggatcttgggctacagccagatcggcgccggcgtgtataaggagggtacgttccacaccatgtggcacgtgacccgcggagccgtcctcatgcaccggggcaagcgcatcgagccgtcgtgggccgacgtgaagaaggacctggtgagctatggtggcggatggaagctggagggggagtggaaggagggggaggaggtccaggtgctcgcattggagccgggcaagaacccccgggcagtacagaccaagcctggcatcttcaagacgaacaccgggacgataggcgccgtctccctggacttcagccctggaacctccggttccccgatcgtggaccgcaagggcaaggtggtcgggctctacggcaacggcgtggtgacccggtccggcgcgtatgtgagcgccatcgcgcaaaccgagaagtccatcgaggacaaccctgagatcgaggacgatatcttccgcaagaaaagactgacgatcatggacctgcaccccggcgcagggaagaccaagagatacctaccggccatcgtgcgggaggccattaagcgcggcctgaggacccttatcctcgcgcccaccagggtggtcgcggcggagatggaggaggccctccggggactgcccatccggtatcagacgcccgccatccgggccgagcacaccggacgggagatcgtggacctgatgtgccacgcgaccttcactatgcgactactgagcccggtgcgggtccccaactacaacctgatcattatggatgaggcacacttcacggacccggcaagtattgccgcccgcggctacatctccacccgggtggagatgggggaagctgccggcatcttcatgaccgcgacgccgccagggagcagggacccctttccccagtccaacgcgcccatcatggacgaggaacgggaaatccccgaacgcagctggaactccggccacgagtgggtgacggactttaaagggaaaaccgtctggttcgtgccaagcataaaggcgggcaacgacatcgccgcctgcctcagaaagaacggcaagaaagtaatccagctgtcaaggaagaccttcgacagcgagtatgtcaagacccggtctaacgactgggacttcgtggttactaccgacatcagcgagatgggggccaattttaaagcggagcgcgttatcgacccccggcgctgcatgaagcctgtgatcctgaccgatggcgaggagcgggtgatcctcgcggggccgatgcccgtcacccactccagcgccgcccagcgccggggccgcattggccgcaaccccaagaacgagaacgaccaatacatctacatgggtgagcccctagaaaacgatgaggactgtgcccattggaaggaagccaagatgctgctcgataacataaacacgccggagggtatcataccctccatgttcgagcccgaacgcgaaaaagtagacgcgatcgacggagagtaccgcttgcggggtgaagcccgcaagacctttgtggacctgatgcggcgcggggacctgccggtctggctggcctacaaggtggccgccgagggcattaattatgcggatcggcgttggtgctttgacgggatcaaaaacaaccaaatcctagaggagaacgtcgaggtggagatctggaccaaagagggggaacgaaagaagttgaaaccacgctggctggatgcccgaatctacagcgaccccctggccctgaaggagtttaaggagttcgccgccggccggaagtccctgacactgaatcttatcacggagatgggtaggctgccaaccttcatgacccagaaggcacgcaacgccctggacaacctcgccgttctgcacaccgctgaggcgggcgggaaggcgtacaaccacgccctaagtgagctcccggagacgctggagaccctgttattgttaacattactggccacagtaacgggcgggattttcctgtttcttatgtccgggaaggggatcggaaagatgaccctgggcatgtgctgcataatcaccgctagcatcctgctctggtatgcgcagatccagccccactggatcgcagcatccataatcctggagttcttcctaatcgtgttactgataccagagcccgagaagcagcggacccctcaggacaaccagctgacctacgtagtcatcgccatcctcacggtcgtggcagccacgatggccaacgagatgggtttcctcgagaaaacgaagaaggaccttggcctcggtagcataacaacgcaagagtcggagagtaatatcctcgacatcgatctgcgacccgcctctgcctggaccctctacgccgtcgcgacaacatttgtgaccccgatgctgcgccactcgatcgagaacagctctgtgaacgtctccctgaccgccatcgctaaccaggccaccgtgttgatggggttgggcaagggatggcccctgtccaaaatggacatcggcgtgccgctcctcgcgatcgggtgctacagccaggtcaaccccattaccctaacggcggccctcctgctgctcgtagcgcactacgccatcataggccccgggctgcaggcgaaggccacccgcgaggcccagaagcgagctgctgcaggtatcatgaagaacccaacggtggacggcatcaccgtaatcgatctggagccgatcccctatgaccctaaatttgagaagcagctcggccaggtgatgctgctgatcctctgcgtaacgcaggtcctgatgatgcgcactacctgggccttatgcgaggccctcacgctggccacgggccccatctccaccctgtgggagggaaacccgggccggttctggaatactacgatcgccgtgagcatggcgaacatcttccgcggttcctacctggccggcgccggtctgctgttctcaattatgaaaaatacgaccaacacccggcgggggaccggcaatatcggcgagacgctcggcgagaagtggaagtcccgcctgaacgccttaggcaagagcgagttccagatctacaagaagtcggggattcaagaagtggaccggaccttagctaaggaggggatcaagcgcggggaaaccgaccatcacgcagtctcgcgtggctccgctaaactccgctggttcgtggagaggaacatggtgacccccgagggcaaggtcgtggacttagggtgcggccgcggagggtggagctactactgtgggggactgaagaacgtgcgggaggtgaaaggcttaaccaagggcggcccgggacatgaggagcccatcccgatgtccacatacggctggaacctcgtgcggctccagagcggcgttgacgtcttcttcacgccgcctgagaaatgcgacaccctgctgtgcgacatcggggaaagctcccccaacccgacaatagaggccggtcggaccctccgcgtgctgaacctggtagagaactggctcaataataacacgcagttctgcataaaggtcctgaatccctacatgccctcagtgatcgagaaaatggagaccctgcagcggaagtacggaggcgcactcgtccgcaatccgctgtcccggaacagcacccacgaaatgtattgggtcagtaacgcaacggggaatatcgtctcatcggtgaacatgatcagccgcatgttaatcaacaggtttaccatgaagcacaaaaaggccacctacgaacccgacgtagacctgggcagcgggacccgcaacattggcatcgagagcgaaatccccaacctcgacatcattggcaagcggatcgagaagatcaagcaggagcacgagacgtcatggcattacgaccaggaccacccctacaagacctgggcctaccacggcagctatgagaccaagcagaccggatcggctagctccatggtgaatggggtggtccgcctgctgacgaagccgtgggacgtggtacccatggtcacccaaatggccatgaccgacactacgcccttcggccagcagcgcgtgttcaaggaaaaggtggatacccggacccaggagcccaaagagggcaccaagaaattaatgaagatcacggcagagtggctgtggaaggagctgggaaagaagaagaccccacgcatgtgcacccgggaagagtttacccgtaaggtccgttcaaacgccgccctcggagccatcttcacggacgaaaacaagtggaagtccgctcgggaggcggtggaggatgggcggttctgggaactggtcgaccgcgaacggaatctgcatttggagggcaagtgcgagacctgcgtgtacaacatgatgggaaagcgcgagaagaagctgggcgaatttggcaaagcgaaggggagccgggccatctggtatatgtggctgggcgcacgcttcttggagttcgaagcgttagggttcctgaatgaagaccactggttttcccggggcaactccctcagcggggtggaaggggagggcctgcatcgtctgggttacatactccgcgacgtctctaagaaggagggcggggccatgtacgccgacgacaccgccggatgggacacccgcattacgctggaagacttgaaaaacgaggagatggtcaccaaccacatgaagggggagcacaagaagctcgccgaggcgatctttaagctgacctaccagaataaggttgtacgggtacagcgccccacgccgagaggtacggtgatggacatcattagccgccgcgaccagcgcggatccgggcaggtcggcacctacgggctgaacaccttcaccaatatggaggctcagctcatccgccaaatggagggcgagggcatattcaaaagcattcagcacctgacggttaccgaggagatcgccgtgcagaactggctggcccgggttggtcgcgagcgcctaaccagaatggccatctctggcgatgactgtgtggtgaagcccattgacgacagattcgcgaacgccctgaccgccctgaacgatatgggcaaagtccgtaaggacatccaacagtgggagccctctcggggctggaacgactggacccaggtacccttctgctcccaccacttccacgagctcgtgatgaaagacggtcgagtcctcgttgtaccttgccgtaaccaggacgagctgatcggccgcgcccggatcagccagggagctgggtggtccctcaaagagacagcctgcctgggaaagtcgtatgcccagatgtggaccctgatgtacttccaccgccgagacctcagactggcagctaatgcgatctgcagcgcggtgccaagccactgggtaccgaccagccgtaccacgtggagcatacatgccaagcacgagtggatgaccaccgaggacatgctggccgtttggaacagagtctggatccaggaaaacccctggatggaggacaagacccccgtggagtcctgggaggaggttccctatctcggaaagcgagaggatcagtggtgcggctcactgattggcctgacttcccgcgcaacatgggcgaagaacatccaaaccgccattaaccaggtgcggagcctcataggtaacgaggaatacaccgactacatgccgagcatgaagcggttcaggcgggaagaagaagaagccggcgtcctgtggtga

SEQ ID NO: 24903 - RNA, 9876 nt, synthetic construct
  misc_feature 1..9876: note = derived and/or modified CDS sequence (opt11) from DENV-2__FJ850076__SS-prME
  source 1..9876: mol_type = other RNA
accgccggcgccatcgtgatgctgataccgaccgtcatggcgttccacctaaccaccaggaacggggagccccacatgatagtggggcggcaggagaagggtaagtccctattattcaagactgaggacggcgtgaacatgtgcaccttaatggccatcgacttgggagagctgtgcgaggacaccatcacctacaagtgcccgttgctccggcagaacgagcctgaggatatcgactgctggtgtaactccacgtccacctgggtcacctatgggacctgcaccaccactggcgagcatcggcgcgaaaagcgaagcgtggccctcgtgccccacgtcgggatgggcctcgagacgcgcaccgagacttggatgagctccgaaggggcctggaagcacgttcaaagaatcgagacgtggatcctgcgccacccgggctttaccatgatggccgcgatactggcatacactattgggaccacacacttccagcgggccctcatcttcatactgctgaccgccgtcgcgcccagcatgaccatgcgctgcatcggcatatcgaaccgggacttcgtcgagggcgtgagtgggggctcctgggtagatattgtcctagagcatgggagctgcgtaaccacgatggccaagaacaagccaaccctggacttcgagctgatcaaaactgaggccaaacaacccgctacactccgcaagtactgcgtcgaagcgaaactgacgaacactaccacggagtcacggtgcccgacgcaaggcgagcccagcctgaacgaggagcaggacaagcgcttcatctgtaagcactccatggtcgaccgtggctggggaaacggctgcgggctattcggcaagggagggatagtgacctgcgcgatgttcacgtgcaagaaaaatatggaaggaaaggtggtccagcccgagaatctggagtataccatagtgattacgccccactctggagaggagcacgccgtggggaatgatacagggaagcatggtaaggagataaagatcactccgcagtccagcatcacggaggccgagctgaccgggtacggcacagtcaccatggagtgcagcccccgcaccggcctcgatttcaacgagatggtgctgcttcagatggaggacaaggcgtggctcgtgcaccgccagtggttcctggacctgcccctaccctggcttccgggggccgacacgcagggcagcaactggatccagaaggagactctggtcactttcaaaaatccccatgctaaaaaacaggacgttgtcgtccttggctcccaggaaggggccatgcacaccgctctgactggggccacggaaattcagatgagcagcggcaacctcctattcacgggccacctgaagtgtcgcctgagaatggacaagttgcagctgaaggggatgtcctacagtatgtgtaccggcaaattcaaaatcgtgaaggagatcgccgaaacccaacacggtacgatcgtcatccgcgtgcagtacgagggggatggctccccctgcaagatacccttcgagatcatggacctggagaagcggcacgtgttagggcggttaataactgtcaatccgatcgtgaccgagaaggactcaccggtaaacatagaggcggagccacccttcggcgactcctacataataatcggggttgagccgggccagctgaagctcaactggttcaagaaggggtcatccatcggccaaatgttcgagaccaccatgcgcggcgccaaacggatggccatcctgggtgacaccgcctgggacttcggcagcctcggtggggtgttcacctccatcgggaaggctctgcaccaagtgttcggggcaatctacggcgcggcattcagcggggtctcctggacgatgaagatactcatcggcgttatcatcacttggatagggatgaacagccgcagcacctcactgtccgtgagcctggtcctcgtgggcgtcgtcacactgtatctaggtgccatggtgcaagcggactccggctgcgttgtcagctggaagaacaaggagttgaaatgtggcagtgggatcttcatcaccgacaacgtacacacgtggaccgagcaatacaagttccagcccgaaagcccgtcaaagctggcttccgccatacagaaggcgcatgaggaaggcatctgcgggattcggtctgtgaccagattggagaatctcatgtggaagcagatcacccccgagctgaaccacatcctttcagagaatgaggtcaagcttacgattatgaccggcgacattaagggaattatgcaggccgggaagcggagcctgagacctcagcccaccgagttaaaatactcctggaagacgtggggcaaggcgaagatgctccccaccgagagccacaaccagacgttcctgatcgacgggcccgaaaccgccgagtgccccaataccaaccgagcctggaactcactggaggtggaagactatggtttcggggtgttcacgacgaatatttggctcaaactgcgcgaaaagcaggacgtcttctgtgacagcaagcttatgtcggccgccatcaaggacaaccgcgcggtgcacgccgacatgggctactggatcgaatccgccctcaacgatacctggaaaatggagaaagcctccttcattgaggtcaagagctgccattggcccaagtcccacactctttggtccaacggcgttctggagtccgaaatgatcattcccaaaaacttcgccgggccggtctcgcagcataactaccgcccgggataccacacccagacggcggggccgtggcacctcgggaaattggaaatggatttcgacttctgcgaggggacaaccgtggtggtgaccgaggactgcggcaaccggggcccctccctgaggacgaccacggccagtggaaagctcatcaccgagtggtgctgccgctcttgcacgctgcctcccctgcgctatcgaggggaggatgggtgctggtacgggatggagatccgccccctcaaggagaaggaggagaacctagtcaacagtctggtgaccgcagggcatggtcagatagacaacttcagtctcggcgtgctggggatggctttgttcctcgaggagatgctgagaacccgcgtgggcacaaagcacgcgatactgctcgtcgccgtgtccttcgtgacgcttattaccggtaacatgagctttcgggacctgggccgcgtcatggtgatggtgggggcgaccatgaccgacgacataggcatgggcgtcacgtacctggccttgttggccgcgttcaaagtgcgccccaccttcgccgccgggctactgcttcggaaactcacctccaaagaactgatgatggccaccataggcgtggctctgctctctcagtccacgatcccggagaccatcctagagctgaccgacgcgctcgctctggggatgatggcactgaagatcgtcaagaacatggagaagtatcagctcgccgtcaccatcatggccatcagctgcgtgccaaacgcggtaatcctgcaaaacgcctggaaggtctcctgcacgatactggccgccgtcagcgtgagccccctactgctgacaagctcacagcaaaaggcggactggatcccccttgcgctgaccatcaagggcctgaacccgaccgccatcttcctcacgaccctgagccgcacctccaagaagagaagctggcccctgaatgaggctataatggccgtcggcatggtctccatactcgcgagcagtctgctgaagaatgatgttcccatgactgggcccctggtggcgggtggcctgctgacggtctgctacgtgctgaccgggcgcagtgccgacttagagctggaaagagccgccgatgtgaaatgggaggaccaggccgagataagtgggtccagcccgatcctctctattaccataagcgaggacggctccatgagcatcaaaaacgaggaggaagagcagacgctgacgatcctgatccgcaccggcctcctggtcataagcggagtgtttcccgttagcattcccatcacggccgccgcatggtatctgtgggaagttaagaagcagcgggccggcgttttatgggacgtaccctccccgccgcccgtcgggaaggctgagctcgaggacggcgcctaccgcatcaagcagcgggggattctcggctatagccagatcggagccggggtctacaaggagggcaccttccacaccatgtggcacgtgacgagaggtgccgtccttatgcacaggggtaagcgcatcgagccgtcctgggcagacgtgaagaaggacctggttagttacgggggcggctggaagctagagggggagtggaaggagggggaggaggtccaggtcctcgcgttagagcccgggaagaacccccgggccgtgcaaacgaaaccaggcatattcaagaccaacacgggcacgatcggcgcggtctcactggacttctcaccgggcacatccgggtccccaatagtggaccgtaagggaaaggtggtcgggctctacggcaacggtgtggtaacgcggtccggggcttacgtcagcgcgatcgctcagaccgagaagtccatcgaggacaaccccgagatcgaggacgacattttccgtaagaagcggctgacgatcatggaccttcaccccggcgccgggaaaaccaaacgatatctccccgccatcgtgagggaggccatcaagcgcggccttcggaccctgatcctggcgcctacccgcgtggtcgccgccgagatggaggaggcccttcgcgggctgcccatccgctaccagacgcctgcaatcagggcggagcatactggccgcgagatcgtggacctgatgtgccacgctacgtttaccatgagactcctgagcccggtgcgggtcccaaactacaacctgatcatcatggacgaggcccacttcacggaccccgccagcattgccgcgcgaggctacatctccacccgggtggagatgggggaggcagccggcatcttcatgaccgccacgcctcccgggtcccgcgaccccttcccccagtccaacgcccccatcatggacgaggagcgggagatcccggaacgctcgtggaactctggccacgagtgggtgaccgacttcaaggggaagactgtctggttcgtgcccagcatcaaggctggaaacgacatagccgcgtgcctccgtaagaacggcaaaaaggtgatccagctgtcccgcaagaccttcgacagtgagtatgtgaaaaccagatcaaacgactgggatttcgttgtgactaccgacataagcgagatgggtgctaatttcaaagcggagcgcgtgatagatccccggcgctgtatgaagccagtgatcctgaccgacggcgaagaacgggtgatcttagccgggccgatgcccgtcacgcactccagcgccgcgcagcgccgaggacgaatcgggcgcaaccccaagaacgagaatgaccagtatatctacatgggcgagccactggagaacgacgaagactgcgcccactggaaagaggcgaagatgctgctcgataacatcaacacgccggagggtatcatcccctccatgttcgagccggaacgtgaaaaggtggatgccattgacggggagtaccgcttacggggcgaggctcgtaagaccttcgtggacctaatgcggcgcggggatctacctgtgtggttagcctacaaggtagcagcggagggcataaactatgccgatcggcgctggtgcttcgacggcatcaagaacaaccagatcctggaggagaatgtcgaggttgagatctggaccaaggagggcgagcgaaagaagcttaagccacgctggctggacgccaggatttacagcgaccccctggccctcaaggagttcaaggaattcgcggccggccgcaaatcccttaccctgaacctaataacagagatggggcgcctgcccacattcatgactcagaaggcgcgcaatgccctggacaacctagccgtgctacacaccgcagaggccggcggcaaggcatacaaccacgccttgagcgagctccctgagacgctggagaccctgctgctgttgaccctactggccaccgtcacgggcggaatctttctgttcctcatgtccggaaagggcatcgggaaaatgaccctggggatgtgttgcatcatcaccgcgagcatcttgctctggtacgcgcaaattcagccccactggatcgccgcctccatcatattagagttcttcttgatcgttctcttaatccccgagcccgagaagcagaggaccccgcaagacaaccagctcacctacgtggttatcgccatccttactgtggtggcggccaccatggccaacgagatggggttcctggagaaaactaagaaggaccttgggctcggcagcatcaccacgcaggaaagcgaatccaacatcctagatatcgacctgcgccccgcgagtgcctggactctctacgctgtagccaccacgtttgttacgcccatgctgcggcactccatcgagaatagctcagtgaacgtcagcctgaccgccatagccaatcaggcgacagtgctcatggggctgggcaagggatggcccctgtccaagatggacataggcgttcctctactggccatcggttgttactcgcaggtcaacccgatcaccctgacggccgcacttttattactcgtcgcccactacgcgatcatcggcccgggcctgcaagccaaggccactcgcgaggcgcagaagcgtgccgcggcgggcataatgaaaaaccccactgtggacggtatcaccgtcattgacctggagccgataccctacgaccccaagtttgagaagcagctcggccaggtgatgctgctgattctctgcgtgacgcaggtcctgatgatgcgcaccacctgggccctgtgcgaagccctcaccctggccactggtcccatctccacgctctgggaggggaacccgggccggttttggaacaccaccatcgcggtgagcatggccaacatctttcggggctcatacctcgccggggcgggattactgttcagcatcatgaaaaacacgaccaacacccggcggggaactggtaacataggcgaaacgctcggggagaagtggaagtcccgcctgaacgcgctgggcaagagcgagttccagatttacaagaagtccgggattcaggaggtggaccggaccttagccaaggaaggtataaaacgcggggagaccgaccaccacgccgtcagccggggttcagcaaagctgcgctggttcgtggagcggaacatggttacccccgagggcaaggtcgtggacctgggatgcggacgcgggggctggagctactactgcgggggcctcaagaacgtgcgggaggtgaagggcctgacgaagggcgggcccggccacgaagagcccatcccaatgtccacctatggttggaatctggtgcgtcttcagtcgggggtggacgtcttcttcacgccccccgaaaagtgcgacaccctgctgtgcgacatcggggagtcttcccccaacccgacgatcgaggcgggccggaccctccgggtgctcaacctggttgagaactggctcaacaacaacacccagttctgcatcaaagtcttgaacccctacatgcctagtgtgatcgaaaaaatggaaacactgcagcggaagtacgggggcgcactcgtgcgaaacccgctgtccagaaacagcacgcacgagatgtactgggtgagcaacgccacgggtaacatcgtcagctccgtgaacatgatcagccgcatgctgattaaccgcttcactatgaagcacaaaaaggccacatacgaacccgacgtcgacctcggctccgggactcgcaacataggcatcgagagcgaaatacccaatttagatatcatcggcaagcggatcgagaagatcaaacaggaacacgagacgagctggcactacgatcaggaccacccgtacaaaacctgggcttaccacggaagctacgaaaccaagcaaaccggatccgccagctccatggtgaacggggtagtccgattattgacgaaaccgtgggatgtggtgcccatggtcacccagatggcaatgaccgacaccacgcccttcggccagcaacgcgtgttcaaggaaaaggtggacacccggacccaggagcccaaggagggcaccaagaaactcatgaaaatcaccgccgagtggttgtggaaggagttgggcaagaagaagactccgcgcatgtgcacccgggaagagttcacccgcaaggtccggagcaatgccgctctcggcgccatcttcacggacgagaacaagtggaagtccgcgagagaggccgtcgaggatgggcggttctgggaattggtcgaccgcgagcgcaacctgcacctcgagggcaagtgcgagacctgcgtgtacaacatgatggggaagcgtgagaagaaactgggcgagtttggcaaggcgaaggggagccgggctatctggtacatgtggctgggtgcacgcttcctcgagtttgaagctctggggtttctgaacgaagaccactggttctcgcgaggcaacagcctgtctggggtggaaggcgagggcctgcaccgccttgggtatatactccgtgacgtctccaagaaggaaggtggggccatgtacgccgacgacaccgccggctgggacacccgcatcaccctggaggacctgaagaacgaggagatggtgactaaccacatgaagggggagcacaagaagcttgcggaggccatcttcaagctaacctaccagaacaaggtggtccgggtgcagcgcccaacgcccagaggcaccgtgatggacattatctcacgccgggaccagcgcggctccgggcaggtcggcacctacgggctgaacacattcaccaacatggaggcgcagctcatccgccagatggagggcgagggcattttcaagagcatccagcacctgaccgtgacagaagagatcgccgtccagaactggttagcccgggtagggcgcgagcggctcacccgcatggcgatctccggcgacgactgcgtggtgaagcccatcgatgaccgcttcgccaacgccctcaccgccctgaacgacatggggaaagtgagaaaagacatccagcagtgggaaccgagccgcggctggaacgactggacccaggtgcccttctgctcccaccactttcacgagctcgtgatgaaggacggccgcgtactggttgtgccctgccggaaccaggatgagctgatcggccgtgcccggatcagtcagggggcggggtggtcactcaaggagaccgcctgcctgggcaaatcatacgcccagatgtggacccttatgtatttccaccgccgggacctccgcctcgccgcaaacgcgatctgctcagccgtcccctcacactgggtgccgacctcgcgtaccacgtggagcatccacgccaaacacgagtggatgaccaccgaggatatgttggctgtgtggaaccgcgtctggatccaggagaacccctggatggaggataagacgcccgtggaatcctgggaagaggtgccctatctggggaagagagaggatcagtggtgcggcagcctgatcggcctgacatcgcgcgcgacctgggccaagaacatacagaccgccatcaaccaggtccggagccttattggtaacgaggagtacaccgactacatgcccagcatgaaacgcttccgcagagaagaggaggaggctggcgttctgtggtaa

SEQ ID NO: 24904 - RNA, 9876 nt, synthetic construct
  misc_feature 1..9876: note = derived and/or modified CDS sequence (opt11) from DENV-2__GQ868640__SS-prME
  source 1..9876: mol_type = other RNA
accgcaggcgccatagtcatgctgattcccactgtaatggcgttccacctcacgacccgcaacggggaacctcacatgattgtgggacggcaagagaaggggaagtccctgctgttcaaaaccgaggacggggtgaacatgtgcaccctcatggccatcgatctgggtgagctgtgcgaggacaccattacctacaagtgccccctgctgcgacagaacgagcccgaagacattgactgctggtgcaacagcacctccacctgggttacttacgggacctgcaccactactggtgagcaccggcgcgagaagcgatccgtggccctggtgccccatgtcggaatgggattggagacgcgcaccgaaacctggatgagctccgaaggggcttggaagcacgtccagcggatcgagacttggatactgaggcaccctggtttcaccatgatggccgctatactggcatacacaattgggaccacccatttccagcgggctctgatcttcatcctcctaaccgccgtagcaccgagcatgaccatgcgctgcatcggcatatctaatcgtgactttgtcgagggcgtctctggtggctcctgggtcgacatcgtccttgagcatgggtcctgcgtgaccaccatggccaagaacaagcccacactggatttcgagctgatcaaaacggaggccaaacaacccgccaccctgcgcaagtactgcgtggaggctaagctgacgaataccaccaccgagagtcggtgcccgacgcagggggagccatcgctgaacgaggagcaggacaaacgcttcatatgcaaacactctatggtcgatagaggttgggggaacgggtgcggtctcttcggtaagggtgggatcgtgacctgcgctatgttcacctgcaaaaagaacatggagggcaaggtggtacagcccgaaaacctggagtacaccatagtgattactccccattcaggggaagagcacgcagtaggcaacgacaccgggaagcacggcaaggagatcaagattaccccccaatccagcataacagaggccgagctcactgggtatgggacggtcaccatggagtgcagcccccgcaccgggttggacttcaacgagatggtgttgttacagatggaggataaggcctggctcgtacaccggcagtggttcctcgaccttcccctaccttggttaccgggggccgatactcagggctccaactggatccagaaggagacgctagtgaccttcaagaacccccacgcgaagaagcaggacgtggtcgtactagggtcccaggagggtgctatgcacaccgctctgacgggggccacggagatccagatgtccagcggcaatctcctcttcaccggtcatctgaagtgtcgcctgcggatggacaagttacagctgaaggggatgtcctatagtatgtgcacaggcaagttcaagatcgtaaaggagatcgcggagacccagcacggcacgatcgtcatccgggtacagtacgaaggcgacgggagcccctgcaagattcccttcgaaatcatggatctagagaagaggcacgtgttgggacgcctaatcaccgtcaacccgattgtgactgagaaggacagccccgtgaacatcgaggcggagccgcccttcggtgactcttacatcatcatcggtgtcgaaccaggccagctgaagctcaactggttcaagaagggctctagtattggccagatgttcgaaaccacgatgcgcggcgcgaagcggatggccatccttggggatacggcctgggacttcggtagcctcggaggtgtattcacttccatcggaaaggcccttcaccaggtgttcggggctatatacggagcggccttcagtggggtctcctggaccatgaaaatcctgatcggcgtaatcattacgtggattggaatgaacagccgctccaccagcctgtccgtatcgctggtgctcgtgggtgttgtaaccctctaccttggggcgatggtgcaggcagactcaggttgcgtggtcagctggaagaacaaggagcttaagtgcggctccgggatattcattacggacaacgttcatacgtggacggagcagtacaagtttcagccggaaagcccttcgaagctggccagtgccatccagaaggcccacgaggagggcatctgcgggatacggagcgtgacccgcctggagaacctcatgtggaagcagatcacccccgagctgaatcacatcttgtcggagaacgaggtcaagctcacgatcatgacgggcgacatcaaagggattatgcaggccgggaagcgcagcctgcgaccccagcctaccgagctaaaatattcttggaaaacctggggtaaagcgaagatgctccctactgaaagccataaccagacctttctaatagatgggccggagacggccgagtgccccaacaccaaccgagcgtggaactctctggaggtggaggactacgggtttggggtattcacgacaaacatctggctcaagctgcgcgagaagcaggatgtcttctgcgacagcaagctgatgtccgctgcgatcaaggacaacagggcggtgcacgctgacatgggctactggattgagagcgccctcaacgatacgtggaagatggagaaagcctccttcatcgaggttaagagctgtcactggcccaagtcccacaccctatggagtaacggcgtgctggagtccgaaatgatcatccccaagaatttcgccgggccggttagccagcataactaccgccccggctatcacacccagacggcggggccgtggcacctcggcaaactcgagatggatttcgacttctgcgaagggactacagtcgttgtcaccgaggattgcggcaaccggggcccaagcctgaggacgaccacggcctctggcaagctcatcacggagtggtgctgtcggagctgtacgttacctcctctgcgctaccggggcgaggacgggtgttggtacggtatggagatcagacctctcaaagagaaggaggagaacctggtcaattcgctagtaactgccgggcatggtcagatcgacaacttctctctcggcgtgctggggatggcgctgttcctagaggagatgctgcgtacacgcgtgggcaccaagcacgcaatcctactcgtcgctgtttccttcgttacactgatcacggggaacatgtcgttccgagacctaggacgcgtcatggtcatggtgggggccactatcacagacgacataggcatgggcgtaacgtacctcgcgctcttggcggcgttcaaagttcgaccaaccttcgccgccgggctactgctgcgcaagctcacgtccaaggaactcatgatggctaccataggtgtggccttgttaagccaatcaactatcccagagaccatcctggagctaactgatgccctcgcgttgggtatgatggcactgaaaatagttaagaacatggagaagtaccaattggcggttaccatcatggccatcagctgcgttccgaacgcggtaattctgcagaacgcttggaaggtgtcgtgcacgatactggcagccgtatccgtgagcccactcctgctgacgagctcccagcagaaggccgattggatcccactcgcattgacaataaaaggtctgaacccgacagccattttcctcacgactctctcgcgcacgagtaagaaacgaagctggccattgaatgaggccatcatggctgtgggcatggtgtccatacttgcctcttcccttttgaaaaacgacgtacccatgaccgggcccctcgtggctggcgggctgttaacagtttgctacgtgctcaccggccgcagcgccgatttagagctggagcgggccgccgatgtgaagtgggaggaccaagcggagatcagcgggtcctccccaattctctccataaccatctcagaggacggttccatgagcataaagaacgaagaggaggagcagacactgaccatcctgatccgaaccggcctgctggtcattagtggggttttccctgtaagcatacccatcaccgccgccgcctggtatttatgggaggtcaagaagcagcgggccggggtgctctgggatgttccctccccacctcccgttggcaaggcggagctggaagatggcgcctacaggatcaagcaaagaggaatcctgggctacagccagataggtgcaggggtttataaggagggcacattccacactatgtggcacgtaacgcgcggggctgtcttaatgcacagaggcaagcgcattgagccgtcctgggccgacgtgaaaaaggacttagtgtcctacgggggcggctggaagctagagggggagtggaaggagggcgaagaggtacaggtgttagccctggagcccgggaaaaacccacgggccgtgcagacgaaacccggcatctttaagaccaacaccgggactatcggcgccgtctccctagacttctcacccggcacctccgggagccccattgtggaccgaaagggcaaagtagtcggattgtacggtaacggtgtagtgacgcggagtggcgcgtacgttagcgctatcgcccaaactgagaagtccattgaggataatcccgagatcgaggacgacatcttccgcaagaagcggctgacaatcatggacctgcaccctggagccgggaagaccaaacgttacctcccagccattgtgcgggaggccatcaaaaggggacttcgaaccctgatcctagcgcccacccgcgttgtcgccgcggagatggaggaggccttacgcgggctgcccattcggtaccagacacccgccatccgcgccgagcataccggcagagagatcgtggacctgatgtgccatgcaacattcactatgcgcttgctgagccctgtgcgggtgcccaactacaatctgattatcatggacgaggcccatttcacggaccccgcaagcatagccgctcggggctacatatccacccgggtggagatgggggaagccgccggcatctttatgaccgccacgccgcccgggtcgcgcgacccttttccccaaagcaacgccccgattatggacgaggagcgggagatacccgaaaggagctggaattccggccatgagtgggttacggacttcaagggcaagaccgtctggttcgtaccgtcaattaaggccggcaacgacatcgccgcctgcctgcggaagaacggcaagaaagtgatccagctgtcccggaagacctttgacagtgagtacgtcaagacgcggtccaacgactgggacttcgtggtgacgaccgacatcagtgagatgggcgcgaatttcaaagcggagagggtcattgatccccggcgctgcatgaaacccgtgatcctgactgacggcgaggaacgagtcatcctcgccggccccatgcccgtaacgcactcctctgccgcccagcgccggggcagaatcgggcgcaaccccaaaaacgagaacgatcagtacatttatatgggtgagcccctggagaatgacgaggactgcgcgcattggaaggaagcgaaaatgctgctcgacaacatcaatacgcctgaaggaatcatccccagcatgttcgagcccgagcgggaaaaagtggacgctatcgacggggaatacagactgcgtggtgaggcccgcaaaacatttgtggaccttatgcgccgcggggacctccctgtctggctggcttataaggtcgctgcggagggcattaattacgccgatcggcgatggtgcttcgatgggattaagaacaaccaaattttggaggagaatgtagaggtggagatctggaccaaggaaggggaacgcaagaagctcaagccacgctggctggatgcccggatttacagcgatccccttgccctcaaagagttcaaggaattcgccgccggccgcaaatccctgaccctgaacctcatcacggaaatggggcggctgcccaccttcatgacccagaaagcacgtaacgctctggacaaccttgcagtgttacacaccgctgaggccggcgggaaggcatacaaccacgctctaagtgagttaccagaaaccctggagaccctgctcctgcttactctcctggcaacggtcaccggcggcatttttttattcctcatgtcaggcaagggaatcgggaagatgaccctgggtatgtgctgcattataaccgccagcatcctgctctggtacgcccagatccagccccactggatcgcggcctccatcatcttagagttcttcctgatagtccttttaattcccgagcccgagaaacagagaacaccgcaagacaaccagctgacctacgtggtcattgccatcttgacggttgtggcggccaccatggcaaacgagatgggcttcctggaaaagactaaaaaagacctgggactcggtagcatcacgacccaagagtctgagtccaatatcctggatatagatctgcgtccggcctccgcctggaccctctatgctgttgcgaccaccttcgtaacgcctatgcttcggcactccatagagaactcgtcggtgaacgtcagtctgacggctattgccaaccaggctaccgtgctcatggggctgggcaaaggctggcccctctccaagatggacatcggcgtgccgctcctggccattgggtgctactcgcaggtcaacccaattaccctgacggccgcgctcctgctgctcgtcgcacactacgcgatcattggtcctggcttacaggccaaagctacccgggaggcacaaaagcgagctgccgccgggatcatgaagaaccccaccgtggacggaatcaccgtcatcgacctggaaccaatcccctatgaccccaagttcgagaaacagttaggccaggtgatgctgctgatcctttgcgtgacgcaggtcttaatgatgaggaccacatgggccctgtgcgaggctctcaccctggccacaggtccgatctccaccctgtgggagggcaaccctggccggttctggaacactaccatcgcggtgagtatggccaacatattccgcggctcctacctcgccggtgccggcctgttattttccatcatgaagaatacgaccaatacccgccgcgggacgggtaacatcggcgagacgctcggagagaagtggaagtcccgcctgaacgcgctgggtaagagcgagttccagatctacaagaaatccggcattcaggaagtagacaggaccctcgccaaggagggaatcaaaagaggggagacagatcaccacgccgttagtcggggctccgctaaattgcgatggttcgtagagagaaacatggtcacccctgagggcaaggtcgtggatctgggttgcggccgagggggctggagctactattgcggtggcctcaagaacgtgcgggaagtcaaaggcctgacgaagggcggccccggtcacgaagagcctattccaatgtccacttacgggtggaacttggtccgcctgcagagtggggtggacgtcttcttcacgccccccgaaaaatgcgacaccctgctctgcgacattggcgaaagttctcccaacccaacaatcgaagcaggacggacgctccgcgtgctaaaccttgtggagaactggctcaacaataatacgcagttttgcatcaaagttctgaacccctacatgcccagcgtgattgagaagatggagaccctacaacgtaaatatgggggcgctcttgtacggaatccgctatcgcgaaatagtacccacgagatgtactgggtcagcaacgccacaggcaatatagtgtcctccgtgaacatgatcagcagaatgctgatcaaccggttcaccatgaagcataaaaaggccacctacgagccggatgtagacctgggctctggcacccgcaacattggtatcgagagcgagatcccaaacctcgacataataggcaagagaatcgaaaagatcaaacaagagcacgagacttcctggcattacgaccaggaccacccttacaaaacctgggcctaccatgggagctacgaaaccaagcagaccggatccgccagctcaatggtgaatggtgtggtcaggctcctcaccaagccgtgggacgtagtgcccatggtcacacagatggcgatgacagacaccacgcccttcggccaacagcgcgtattcaaggaaaaggtcgacaccaggacccaggaacccaaggagggcaccaagaaactcatgaagatcacggccgagtggctgtggaaagaacttgggaagaagaagaccccgcggatgtgcacgagagaggaattcactcggaaggtccggtctaacgcggcgctcggcgcaattttcacggacgaaaataagtggaagtccgcgagagaggctgtggaggacgggcggttttgggaactcgtcgacagggagcgtaacctgcacctcgaaggtaagtgcgagacctgcgtgtacaacatgatggggaagagggagaagaagctgggcgagttcggcaaagccaagggcagccgggccatctggtacatgtggttaggcgcgcgctttctcgaatttgaggccttagggttcctgaacgaagaccactggttctcaaggggcaacagcctctccggagttgagggcgagggcctacatcgcctggggtacattttacgggatgtctctaagaaagaagggggggccatgtacgcggatgacaccgcaggctgggacacgagaattacgctggaagacttgaagaacgaagagatggttaccaaccacatgaagggggagcataagaagcttgctgaggcaatcttcaagctgacctaccaaaacaaggtggtccgggtgcagcgccctacccccagaggaactgtgatggacataatctcgagacgggaccaacgaggcagtggacaagtcgggacctatgggcttaatacctttaccaatatggaggctcagctcatacgccagatggagggggaggggatcttcaagagcatccagcatctgacggtgacggaagagatcgccgtgcaaaactggctggcccgggtcggccgagagcggctcaccaggatggcgatctccggcgacgactgcgtcgtgaagcccatcgacgaccggtttgccaacgccctcaccgccctaaacgacatgggtaaggtccgcaaggacattcaacaatgggaaccgagccgcggctggaacgactggacgcaggtgcccttctgttcccaccacttccacgaactcgtgatgaaggacgggcgtgtcttggtggtgccgtgccggaaccaggacgagcttatcggccgcgcgagaatcagtcaaggcgccgggtggtccctcaaggagaccgcctgtctgggtaagagctacgcgcagatgtggacgcttatgtacttccaccgccgcgacctcagacttgccgccaacgcgatttgctctgccgtcccctctcactgggtgcctacctcccggaccacgtggagcatacacgccaaacacgagtggatgaccaccgaggatatgcttgccgtatggaaccgcgtctggatccaggaaaatccgtggatggaggataagacccccgtggagagctgggaggaggtcccctacctagggaagcgggaagaccagtggtgcggcagcttaatcgggctgacgtcccgcgccacctgggccaagaacatccagaccgcaatcaatcaggtacggagcctcataggcaacgaagagtacacagattacatgccaagcatgaaacgcttccgtcgtgaggaggaggaggccggtgtgttatggtag

SEQ ID NO: 24905 - RNA, 9876 nt, synthetic construct
  misc_feature 1..9876: note = derived and/or modified CDS sequence (opt11) from DENV-2__FJ850078__SS-prME
  source 1..9876: mol_type = other RNA
actgccggcgtgatcgtcatgctgatacctaccgtgatggctttccacctcaccacccgaaacggggagccccatatgatagtaggccggcaggagaagggtaaatccctgctattcaagacggaggacggcgtaaacatgtgcaccctcatggcgatagacctgggagaactgtgcgaggataccatcacatacaagtgcccgctcctgagacaaaacgagcccgaggacattgactgctggtgtaacagcaccagtacctgggttacctacgggacctgcaccaccacgggggaacaccggcgcgagaagcggtccgtggcccttgtcccccatgtggggatgggcctggagacacgcaccgagacttggatgagctcggagggggcctggaagcacgttcaacggatcgagacctggatcctccgccaccctggcttcaccatgatggctgccatcttggcgtacaccatcgggaccacgcacttccagagggcactcatattcatcctgctgaccgccgtcgctcccagcatgaccatgcgctgcatcgggatctctaaccgggactttgttgagggcgtgagcggggggtcctgggtcgacatagtgctcgagcacgggagctgtgtgaccacgatggcaaaaaacaagcccaccctggatttcgagctgatcaaaaccgaggccaaacagcccgcaacactcaggaagtactgcgtcgaggccaagctcacgaacaccaccaccgagtcccgttgcccgacacagggtgagcccagcctaaacgaagagcaagacaagcgcttcatttgcaagcactccatggtggaccggggctggggtaacggctgcgggcttttcggaaagggcggaatcgtaacctgcgccatgttcacttgcaaaaagaatatggaagggaaagtggtgcagcctgagaacctcgaatacactatcgtgatcacaccccacagcggagaggagcatgcggtcggcaatgacactggaaagcacggtaaggagatcaagatcactccgcagagttccataaccgaagctgagcttaccggttacggcacggtgaccatggagtgctctccccgtaccggcctggacttcaatgagatggtgctgttacagatggaggacaaggcctggctcgtgcaccggcaatggttcctggacttgccgcttccctggcttccgggggccgacacgcagggcagtaactggatacagaaggagacgctggtgaccttcaagaacccacacgctaagaagcaggacgtggttgtgctcggatcccaggagggcgcgatgcacaccgccctgacaggggcaacggagatccagatgagcagcggcaacttgctgttcaccggccatctgaagtgtcgcctgagaatggacaagctgcagctcaaagggatgtcctacagcatgtgcactggaaaattcaagatcgtcaaggaaattgccgagacccagcacggtacgatcgtcatccgagtgcagtacgagggcgacggatccccatgcaagatcccatttgagatcatggatctggagaagcggcacgtcctggggcgcctgataacagtaaacccgatcgtaaccgagaaggattcacccgtcaacatcgaggccgagccgcccttcggtgactcctacatcatcgtgggggtggaaccgggccagctgaaactcaattggttcaagaaaggatcttctatcggccagatgttcgagaccacgatgcgcggggctaagcggatggccatcctgggtgacacagcctgggatttcgggagcctcggaggtgtcttcacctccattggcaaggccctccaccaggtattcggtgcaatttacggtgcagccttcaatggagtgagctggaccatgaagatccttataggtgtcatcatcacttggatcgggatgaactccaggagcacctccctgtcagtgagcctggtactcgtcggagtcgtgaccctgtacctgggggccatggtacaagcagatagtggctgtgtggtgtcctggaagaacaaggagctcaagtgcggaagcggtatcttcataaccgacaacgttcatacgtggaccgagcagtacaagttccagcccgagtcccccagcaaactggcaagcgctattcagaaggcccatgaggagggcatatgtggtatccggtccgtcacgcgccttgaaaacttgatgtggaaacagatcaccccagagctaaatcacatcctgtctgagaatgaggtaaagttaacgatcatgactggcgacatcaaggggatcatgcaagccgggaaacggtccctgcgcccgcagcctacggagctcaagtactcttggaaaacctggggtaaggccaagatgctccccacggagtcccacaatcagacctttctcatcgatggcccggaaaccgcggaatgccccaacgccaaccgggcctggaacagcctggaggtcgaggactacggcttcggggtgttcaccacgaatatctggctcaagctgagggagaagcaggacgtattctgcgacagtaaattgatgagcgcagctattaaggacaaccgtgcggtccatgccgacatggggtactggatcgagtccgccctcaacgacacctggaagatggagaaggcctctttcatcgaggtcaagtcatgccattggcccaagtcacataccctgtggtccaacggcgtgctggagagcgagatgatcatccccaagaacttcgccgggcccgtctcccagcacaactacaggcccggctaccacacccagacagcggggccctggcacctcggcaaactggagatggatttcgatttttgtgaggggactactgtggtggtcacagaggactgcggcaaccggggcccctctctcaggacaacaaccgcctcagggaagttaataacagagtggtgctgccggagctgcaccctgccgcccctgcgctaccggggcgaggatgggtgttggtacgggatggagatccgccccctcaaggagaaggaggagaacctggtcaacagtctggtgactgccgggcacggccagattgataacttcagtctaggcgtgctggggatggccctcttcttagaagagatgctgcggaccagggtgggcacgaagcacgcgatcctgctcgtggccgtgagcttcgtgaccctcataacgggtaacatgtccttccgggatctgggcagggtaatggtcatggtgggggccaccatgaccgatgacatcgggatgggcgtgacctacttggccctgctagctgcgttcaaggtacggcccacgttcgccgcagggctcctgctgcgaaaactcacaagcaaggagctgatgatggccactatcggcgtggcccttctctcccagtcaacaataccggagaccatcctggagctgaccgacgcgctcgccctcgggatgatggcgttaaagatcgtaaagaacatggaaaagtaccaattggccgtcaccatcatggccatctcctgcgtgccaaatgctgtaatcctgcagaacgcctggaaggtgtcgtgcaccatcctggccgccgtgtccgtcagccccctcttgttaacgtcatcacagcagaaggccgactggatccccctcgccctgacgatcaagggtctgaatcccaccgcgatcttcctcaccacgctgtcccgcacaagtaagaaaaggagctggcccctgaatgaggccgtgatggccgtcggcatggtcagcatcctggcaagtagcctgctgaagaacgatatccccatgacggggcccctcgtggctggcggactgctgaccgtgtgctacgtcctcacgggccgctcggcagacctggagctcgagagagccgctgacgtgaagtgggaggaccaggctgaaataagcgggtcctccccgattctctccatcactatctctgaggacggctcgatgtcaatcaagaacgaggaggaggagcagacgctgaccattctcatcaggacgggtttgttggtgataagtggagtgttccccgtttccatccccattaccgccgccgcctggtacctttgggaggtgaaaaagcagcgggctggcgtcctctgggacgtgcctagcccgccgcccgtggagaaggcggagctggaggacggggcctatcgcattaagcagcggggcatcttagggtacagccagatcggagctggcgtctacaaggaagggaccttccacaccatgtggcacgtgacccgcggcgcggtgttaatgcaccggggtaagcgaatcgagccgtcctgggccgacgtcaagaaggacttggtgtcgtacggcgggggctggaagctggagggagagtggaaggagggggaggaagtgcaggtcctcgcgctggaacccggtaaaaaccccagagccgtccaaacgaaacccgggatcttcaagaccaacactggcaccatcggagcagtctcactggacttttccccgggtacgagcggcagtcccatcgtcgaccgcaagggaaaggtcgtgggcctatacggcaacggcgtcgtgactagaagcggagcctacgtgtccgctatcgcgcagaccgaaaagtccatcgaggacaaccccgagatcgaggacgacatcttcagaaagaagcgcctgaccatcatggacctgcacccaggggcgggaaagacgaagcgttacttaccggctatcgtccgggaggccattaagcgcggattaagaaccttgatcctggcgccgacacgcgtggtcgccgccgagatggaggaggccttgaggggccttcccattcggtaccagacccccgccatacgcgcggagcacacggggagggagatcgttgacttgatgtgccacgcaacgttcaccatgcgcttactgtcacccgtgagggtgcccaactacaacctgatcataatggacgaggcccactttacggaccccgccagcatcgccgcgcgcgggtacatctctactcgggtcgagatgggggaagccgctgggatctttatgacagccacgccgcccgggtcccgcgacccctttccccagtctaatgcgccgatcatggacgaagagcgggagatacccgagcgctcctggaacagcgggcatgagtgggtcaccgacttcaagggcaagacggtgtggttcgtcccctctataaaagccgggaacgacatagcggcttgcctccgtaagaacggcaagaaggtgatccagttatcgcgcaagactttcgattccgagtacgtgaagactcggagcaacgactgggatttcgtcgtgaccaccgacatcagtgagatgggtgcaaacttcaaggccgagagggtgatcgaccccaggcgctgcatgaagcccgtcatactaaccgatggggaggagagagtgatcctcgccggaccgatgccggtgacccacagctccgccgctcagcgccggggtcgcattggccggaatcctaaaaatgaaaacgaccagtacatctacatgggcgagcccctggaaaatgatgaagactgcgcccactggaaggaagctaagatgctactcgacaacatcaacacaccggaaggcatcatccctagcatgttcgagcccgagcgggaaaaggtcgacgccatcgacggcgagtaccgactgcgcggggaggcccggaagacgtttgttgacctgatgcggagaggcgacctcccggtttggctggcctacaaggttgccgcggaggggatcaattacgccgatcgacgatggtgctttgacggcatcaagaacaatcagatcctggaagagaacgtggaggtcgagatatggaccaaggagggagagcggaaaaagctgaagccccgctggctggacgcgagaatatactcagaccctctggccctcaaggagtttaaggaattcgcggccggccgcaaaagcttgaccttgaacctcatcaccgagatgggtcggctgcccacgttcatgacccagaaggccagaaatgcattagacaacctcgccgtgctccacactgcggaggctgggggcaaggcttacaatcatgctctttccgagcttcctgagaccctggagacgctgctcttgctgacgcttctggccacagtgaccggtggcatattcctctttttaatgtctggcaaggggatcggcaaaatgacgctggggatgtgctgtatcatcacagcgtccatcttactgtggtatgcccaaatccagccccactggatcgccgcctcgattatccttgaatttttcctgatcgtcttactgatccctgagcccgaaaagcagcgcacaccgcaagacaaccagctgacctacgttgtcatagccatcctcaccgtagtggcggccacgatggctaacgaaatgggtttcctggagaagaccaagaaggacctgggtttaggcagtatcaccacccaagagtcggagagcaacatcctggacattgacctgcgccccgcatccgcctggaccctgtacgcggtagccaccaccttcgtcacacccatgctacggcactcaatcgagaattccagcgtcaacgtatcgttaacggcaatcgccaaccaagcgaccgtccttatgggcctggggaagggttggccactgagcaagatggacatcggcgtgccgctcctggctattggctgctactcccaggtgaacccgattaccctgacggcggcgctcctgctgctcgtcgcccactacgcgattattggccccggcttgcaggccaaggccacgcgcgaggcgcaaaagcgggccgcggcagggattatgaaaaaccccaccgtagacgggatcaccgtgatcgacctggagccgattccctacgacccgaagttcgagaagcagctcgggcaggtcatgctcctaattctttgcgtgacccaggtactcatgatgcgcacgacctgggccctgtgcgaggccctcactctggccacagggcccatctcgacgctctgggagggcaatccggggagattctggaataccaccatagctgtctccatggcgaacatatttagagggtcttacctcgctggggcagggttgctgttctctataatgaagaacaccaccaacacccgccggggcaccgggaacatcggtgaaaccctcggcgagaagtggaagagccgcctgaatgctctgggtaagtccgagttccagatctataaaaagtccggcatccaggaggtagaccgaacgctcgccaaggagggaattaagcgcggcgagactgaccaccatgccgtttcacggggttcagccaagttacggtggtttgtcgagcggaatatggtgacacccgagggcaaggttgtcgacctgggatgcgggcgtggcggttggtcctactactgcggcgggcttaagaacgtgagggaggtgaagggcctcacccgcgggggccccggccatgaggagccgatccctatgtccacgtatgggtggaacctggtcagactccagtccggcgtcgacgtctttttcacgccccccgagaaatgcgacaccctgctgtgcgacatcggggagtcctcccccaaccctacgatcgaggccggccgaaccctccgagtcttaaacctagtggagaactggctcaacaacaacacgcagttctgcataaaggtgctgaacccgtatatgccctccgtcatcgagaaaatggagaccctgcagcgcaagtacggcggggcgctggttcggaacccgctgagccgcaactccacgcacgaaatgtattgggtgagcaacgccaccggcaacatcgtatcgagcgtgaacatgatctcacggatgctgatcaatcgcttcactatgaagcacaagaaggccacctacgagcccgacgtggacctggggagcggcacccgaaatattgggatcgagtccgagatcccaaacttggatatcataggcaagcgcatcgagaagatcaagcaagagcatgagacgtcttggcactatgatcaggaccacccatacaaaacatgggcttatcacggatcgtacgagaccaagcaaaccgggagcgcgtccagcatggtcaacggcgtggtgcgcctgctgaccaaaccttgggatgtcgtacccatggtgacgcagatggcaatgaccgacacaacccccttcggccaacagcgcgtctttaaagaaaaggtcgacacccgcacccaggagcccaaggagggtaccaaaaagctcatgaagatcaccgcagagtggctgtggaaggaactgggcaagaagaagacgccgcggatgtgcacccgcgaggagttcacccggaaggtccgctccaacgccgcattgggggccatattcaccgatgagaacaaatggaagtccgcgcgtgaggccgttgaggacggacgcttctgggagctcgtggaccgggagcgcaacttacacctcgaggggaagtgtgagacgtgcgtttataatatgatgggtaagcgggagaagaagctgggggaatttggtaaggccaagggctcccgcgccatatggtacatgtggctgggagcgcggttcctcgagttcgaggcgctgggcttcttgaatgaggaccactggttcagccgcgggaactccctaagcggcgtggagggggagggcctgcaccggctgggctacatcctccgcgatgtaagcaagaaagagggcggcgcgatgtacgccgatgacaccgccgggtgggacacgagaatcaccctggaggacctgaagaacgaggagatggttactaaccacatgaagggagagcacaagaagctggcggaggcgattttcaagctgacctaccagaataaagtggtcagggtgcagcggcctacgccccgtgggaccgtgatggacataatttcccggcgcgatcaaagaggaagcggccaggtgggcacttatggcctgaacacgttcactaatatggaggctcagctcatccgacagatggagggcgaaggaatattcaagtccattcagcacctgaccgtaaccgaggagatagcagtgcaaaactggcttgcccgcgtcgggcgggagcgcctgactaggatggcaatcagtggggacgactgcgtcgtgaagcccatcgatgaccgcttcgcaaacgccctgacggccctgaatgacatgggcaaagtgcggaaggacatccagcagtgggagccgtcccgtgggtggaatgactggacccaagtccccttttgcagtcaccacttccacgagctcgtgatgaaggacggccgggtgctagtcgtgccctgccggaatcaggatgagctgattgggagagcccgcatctcccagggcgccggatggagcctcaaagagaccgcctgcctagggaagtcttatgcacaaatgtggaccctgatgtacttccaccggagagaccttcggctggcagccaatgcaatctgcagcgccgtgccctcccactgggtcccgactagcagaaccacctggtctattcacgccaaacacgaatggatgacgaccgaggacatgctcgcagtatggaaccgggtgtggatccaggaaaacccctggatggaggataaaacccccgttgagagctgggaggaggtgccctacctcgggaaacgcgaggaccaatggtgcgggtccctgatcggtttaacgagccgggcgacctgggccaagaacatacagaccgccatcaaccaggtgcgatcccttatcgggaacgaggagtacaccgactacatgccatctatgaagcgcttccggcgagaggaggaggaggccggcgtcctgtggtaa

SEQ ID NO: 24906 - RNA, 9876 nt, synthetic construct
  misc_feature 1..9876: note = derived and/or modified CDS sequence (opt11) from DENV-2__FJ850082__SS-prME
  source 1..9876: mol_type = other RNA
accgtgggcgtaattgtgatgctcattcccacggccatggctttccacctcaccacccgcaacggtgagccccacatgatcgtgggccggcaagagaaggggaagtccctgctgttcaagaccgagaacggcgtgaacatgtgtaccctcatggcgatagacctgggggaactgtgtgaggacacgatcacgtacaagtgcccgctcctgagacagaacgaacccgaggacatcgattgctggtgcaactccaccagcacctgggtgacctacgggacctgcaccaccacgggcgagcaccggagggagaagcggtcagtggccctggtcccccacgtggggatgggcctcgagacccgcaccgagacctggatgagctccgagggggcctggaagcacgtgcagcggatcgagacatggatcctgcgccacccagggtttaccatcatggctgccatcttagcgtacaccatcgggaccacgcatttccagcgggccctcatcttcatcctgctgaccgccgtcgcccccagcatgaccatgcgctgcatcggcatctccaatcgggacttcgtggagggcgttagcgggggctcttgggtggatatcgtcctcgagcacgggtcttgcgtgaccacgatggcaaagaacaagccaaccctggacttcgagctgatcaagaccgaggctaagcagccagccacactccggaagtactgcgtcgaggccaagctgacaaacaccaccaccgagtcccggtgccccacgcagggtgagcccagcctgaacgaggagcaggacaagcgcttcatctgcaagcactccatggtggaccggggctgggggaacggctgcgggctgttcggcaagggcgggatcgtgacgtgcgccatgttcacgtgcaagaagaacatggagggcaaggttgtgcagcccgaaaatctggagtacaccatcgtgatcacgccccacagcggggaagaacacgcggtcggcaacgacacgggaaagcacggcaaggaaatcaagatcacaccccagtccagcatcacggaggcagagctgacagggtacggtacggtcaccatggagtgctcgccccgcaccggcctcgacttcaacgagatggtgttactgcagatggaagacaaggcctggctggtccaccggcagtggttcctggacctgcccctcccctggttgccgggtgccgatacccagggcagcaactggatccagaaagagacgctggtgaccttcaagaacccccatgccaagaagcaggacgtcgtggtcctagggagccaggagggggcgatgcacaccgccctgaccggggccacggaaatccaaatgagttctggcaacctcctgttcaccggccacctcaagtgccgcctgcggatggacaagctccagctgaaggggatgtcctactctatgtgcaccgggaagttcaagatcgtcaaggagatcgccgagacccagcacggaacgatcgtgatccgcgtgcagtacgaaggcgacggctccccctgcaagatccccttcgagatcatggacctggagaaacggcacgtcctagggcgtttgatcaccgtgaacccgatcgtgaccgagaaggatagccccgtcaacatcgaggccgagccgccgttcggcgactcctacataatcatcggagtggagccgggccagctgaaactcaactggttcaagaaagggtcatccatcggccagatgttcgagactacgatgcgcggcgcgaaacggatggcgatcctgggggacaccgcctgggactttggaagcctcggcggggtgttcacttccatcggcaaggcccttcaccaggttttcggggccatctacggcgcggccttcagcggcgtgtcctggactatgaagatcctgatcggcgtgatcataacttggatcgggatgaatagccgctccaccagcctgtctgtcagcctggtattagtgggcgtcgtgaccctgtacctgggggccatggtgcaggccgactccggctgcgtcgtgagctggaagaacaaggagctcaagtgcggcagtggaatcttcatcaccgacaatgtccatacgtggaccgaacagtacaagttccaacccgagagccccagcaagctggcgtccgcaatccagaaggcccacgaggagggcatttgcgggatccggagcgtgacccgcctggagaatcttatgtggaagcagattacgcctgagctgaaccacatcctgtccgagaacgaggtgaagctcacgatcatgaccggagacatcaagggaatcatgcaggctgggaagcggagcctgcgcccgcagcccaccgaactgaagtatagctggaagacgtggggcaaggccaaaatgctctctacggaatcccacaaccagaccttcttgatcgatgggccggagaccgcggaatgccctaataccaaccgtgcatggaatagcctggaggtggaggactacggcttcggggtcttcacgaccaacatatggctcaaactgcgcgaaaaacaggacgtgttctgcgactccaaactgatgagcgccgccgtcaaggacaaccgggccgtccacgcggacatgggctactggatcgagtccgccctcaacgatacatggaaaatggaaaaggccagcttcatcgaggtgaagtcctgccattggcctaagagccacaccctgtggtccaacggggtgctggagagcgagatgatcatccccaagaacttcgccgggccggtctcccagcataactaccgccctggctaccacactcagactgccggtccctggcaccttggcaaactggagatggacttcgacttctgcgagggaactaccgtcgtggtcaccgaggactgcggcaaccggggcccatccctgcgcacgaccaccgcgagcgggaagttaatcactgagtggtgctgccgctcgtgcacgctgcccccgctaaggtaccggggcgaagacgggtgttggtacggcatggaaatccgacccctcaaggagaaggaagaaaacctggtgaacagcctggtgaccgccgggcacggccagatcgataacttctccctgggcgtccttgggatggccctgttcctcgaggaaatgctgcggacccgcgtggggaccaagcacgccattctgctcgtggcggtcagcttcgtaactctgatcaccgggaacatgtccttccgggacctagggcgcgtgatggtgatggtgggggccaccatgaccgacgacattggcatgggcgtcacgtacctcgccttgctggccgccttcaaggtacgccccaccttcgctgccgggctcctgctgcggaagctcaccagcaaggagcttatgatggctaccatcggcgtggccctgctctcccagtcgacgatccccgagaccatcttggaactgaccgacgctctcgcgctggggatgatggccttgaaaatcgtgaagaacatggagaagtaccagctcgcggtgaccatcatggccatctcatgcgtgcccaatgccgtcatccttcagaacgcgtggaaggtcagctgcaccatcctggccgccgtgtccgtcagccccctgctgctgacctcctcccagcagaaggccgactggatccccctcgcgctgaccatcaagggcctgaaccccacagccatcttcctcactactctgtccaggactagcaagaagcggtcctggcctctgaacgaggccatcatggccgtcggtatggtgagcatcctcgcctccagccttctgaagaacgacatcccgatgaccgggcccctagtcgcgggcgggctgctgacggtatgctacgtgctcaccggccgctccgccgacctggagctggagcgtgccgccgacgtcaagtgggaggaccaagccgagatctccgggagctcacccatcctatcgatcaccatctccgaggacggcagcatgtccatcaaaaacgaggaagaggaacagaccctaacgatccttatccgcaccggcctcctggtgatcagcggagtgttccccgtctccatccccatcactgcggccgcctggtacctgtgggaggtgaaaaagcagcgggccggcgtgttatgggatgtccccagcccgccgcccgtgggcaaggccgagctggaggagggcgcgtacagaatcaagcagcggggtatcttaggctattcccaaatcggcgccggggtctacaaagagggcactttccacaccatgtggcacgttacgcgcggcgccgtgttaatgcaccggggcaagaggatcgagcccagctgggccgacgtgaagaaagacttggtctcctacgggggcggatggaagctggagggggagtggaaggagggcgaggaggtccaggtgctcgcactggagcccgggaagaacccccgggcggtccagaccaagcccggcatcttcaagaccaacaccggcacgatcggggccgtcagcctcgacttctcccccggcactagcgggtcccctatcgtggaccgcaagggcaaggtcgtggggctctacggcaacggagtggtcacccggagcggcgcttacgtgagcgcgatcgcgcaaaccgacaagagcatcgaggacaaccccgaaatcgaggacgacatcttccgcaagaagcggctgacgatcatggatctgcaccccggcgccgggaagaccaagcgctacctccccgccatcgtgcgggaggccatcaagcgcggcctgcggaccctgatactggccccgacccgtgtcgtggcggccgagatggaggaggccttgcgcgggcttcccatccgatatcagacgccggccatccgggccgaacacaccggccgggaaatcgtcgacctgatgtgccacgcgaccttcaccatgaggcttctgagccccgtgcgggtaccgaactacaacctgataatcatggacgaggctcacttcactgaccccgcctccatcgccgcccgcggttacatcagcacccgggtggagatgggggaggcggccggtatcttcatgaccgccacgccacccggctcgagagatccgttcccccagagcaacgcgcccatcatggacgaggagcgggagatccccgagcgctcctggaactctggccacgagtgggtaacggattttaaggggaaaacggtgtggtttgtaccgtccatcaaagcgggcaacgacatcgccgcctgcctccgaaagaacgggaagaaggtcatccagcttagccgcaagaccttcgactccgagtacgtgaaaacccgggccaacgattgggacttcgtggtcaccaccgacatcagcgagatgggggccaacttcaaggcggagcgcgtgatcgatccccggcgctgcatgaagcccgtgatcctgaccgacggcgaggaacgggtcatcctcgcggggcccatgccggtcacccactccagcgcggcccaacgccggggccgcatcgggcgcaaccccaagaacgagaacgatcaatacatctacatgggcgagcccctggagaacgacgaggactgcgcccactggaaagaggcaaagatgctgctcgacaatatcaacacacccgagggcatcatcccgtccatgttcgaacccgagcgggagaaagtggacgccattgacggcgagtaccgcctgcggggcgaggcccgtaagaccttcgtcgacttaatgcggcgcggagacctccccgtgtggctggcttataaggtcgccgcggagggcatcaactacgccgaccggcgatggtgcttcgacggcatcaagaacaaccaaatcctggaggagaacgtggaggtggagatctggaccaaagagggcgagcggaagaaactaaagccgcgctggctggacgccagaatctacagcgaccccctcgccctcaaggagttcaaagagttcgcggcgggccgcaaatcactgaccctgaacctcatcacggaaatgggccggctgcccaccttcatgacccagaaagcccgcaacgccctcgacaacctcgccgtactgcacaccgcggaggccggcgggaaggcctacaaccacgccttaagcgagctacccgagacgctggagaccctgctcctgctgaccttactggcaactgtgacaggcggcatcttcctgttcctcatgtccgggaagggtatcgggaagatgaccctgggcatgtgctgcatcatcaccgctagcatcctgttgtggtacgcgcagatccagccgcattggatcgccgcctccatcatcctagagttctttctgatcgtgctcctaatcccagaacccgagaaacagcgaacgccacaagacaaccagctgacctacgtcgtgatcgcaatcctcaccgtggtcgcggccaccatggccaacgagatggggttcctggagaagaccaagaaggacctggggctcggcagcatcacaactcaggagagcgaatccaacatcctggatatcgacctgcgcccggccagcgcctggaccctctacgcggtggccaccaccttcgtcacgcccatgctgcggcactccatagagaacagcagtgtcaacgtgagcctgaccgcgatcgccaaccaagcgaccgttctcatggggctgggcaaggggtggcccctgtccaagatggacatcggtgtccccctcctggccatcgggtgctacagccaggtgaatccgatcaccctgacggccgccctcttacttctcgtcgcccactacgcgatcatcggcccgggcctacaggctaaagccacccgcgaggcccagaagcgggccgcggccgggatcatgaagaatccaaccgtcgacggcatcaccgtgatcgacctcgagcccatcccgtacgaccccaaattcgagaagcagctcggccaagtgatgctgctgatcctctgcgtcacccaggtgctgatgatgcgcacgacctgggcgctctgtgaagccctcaccttggcaaccggacccatctccaccctgtgggaagggaaccccggcagattctggaacaccacgatcgcggtatcgatggccaatatctttcgcggctcctacctcgccggggcaggcctgctgttcagcatcatgaagaacacgaccaacacccgccgggggacaggcaatataggagagacgctcggggagaagtggaagtcccgcctgaacgcgttgggcaagagcgagttccagatctacaagaagtccgggatccaagaggtcgaccggaccctcgccaaggagggcatcaagcgcggcgagaccgatcaccacgccgtgagccgaggctccgccaagctgcgctggttcgtggagcggaacatggtcaccccagagggcaaggtggtagacctggggtgcggccgcgggggctggagctactactgcgggggcctcaagaacgtccgggaggtgaagggcctgacgaagggcgggcccgggcacgaagaacccatccccatgagtacgtacggctggaaccttgtgcgactccagagcggggtggatgtgttctttaccccgcccgagaaatgcgataccctcctgtgcgatattggcgagagctcacccaaccccacgatcgaggccggccggaccctccgcgtactgaacttggtagagaactggctcaacaacaacacccagttctgcatcaaggtgctgaacccatacatgcccagcgtgatcgagaagatggagaccttgcagcggaagtacgggggcgcgctcgtccgcaacccactgtcccggaacagcacccacgagatgtactgggtgtccaacgcaacggggaacatagtgagcagtgtcaatatgatcagccgcatgctgataaatcggttcaccatgaagcataagaaagccacctacgagccggacgtggacctgggttccgggacgcgcaacatcggcatcgagagcgaggtgcccaacctcgacatcatcggcaagcggatcgagaagatcaagcaggagcacgagacatcctggcactatgaccaggaccacccctacaagacctgggcctaccacgggagctatgagaccaagcagaccggctccgccagcagcatggtcaacggagtcgtgcgcctgctgacgaagccctgggacgtcgtgccgatggtgacccagatggcgatgacggacacgacgccgttcggccagcagcgcgtcttcaaagagaaggtggacacccggacccaggagcccaaggagggcaccaagaaacttatgaaaatcacggccgagtggctgtggaaggagctcgggaagaagaaaatcccccgcatgtgcaccagggaggagttcaccaggaaggtacggagcaacgccgccctcggtgccatcttcaccgatgagaacaagtggaagtccgcgcgagaagccgtggaggacgggaggttctgggagctggtggacagggagcggaacctgcatctcgaggggaagtgcgagacgtgcgtctacaacatgatggggaagcgcgagaagaagctgggtgagttcggcaaggccaaggggagccgggccatctggtacatgtggctgggcgcgcgtttcctcgagttcgaagccctggggttcctgaacgaggaccactggttctcccggggcaacagcctcagcggcgtagagggcgagggcctgcaccggctggggtacatactccgggacgtgtccaagaaggagggcggcgccatgtacgccgatgacaccgccggatgggacacccgcatcaccctggaggatctgaagaacgaggagatgatcacgaaccatatgaagggggagcacaagaagctcgcggaagccatcttcaaactgacctaccagaataaggtcgtgcgggtgcagcgcccaacgccccgtggcaccgtcatggacatcatcagccgccgggaccaacgcggctccggccaggtgggcacgtacgggctgaacaccttcaccaacatggaggcccagctcatcagacagatggagggcgagggcatcttcaagagcattcagcacctgaccgtgacggaggagatcgccgtccagaactggctggcccgggtggggcgcgagcggttaactcgcatggcgatttccggcgatgactgcgtggtcaagcccatcgatgatcggttcgccaacgcattgaccgccctgaacgacatggggaaggtgcgcaaggacatccagcagtgggagccaagccggggctggaacgactggacacaggtgccgttctgctcccaccacttccacgaactcgtcatgaaggacgggcgcgtactggtggtcccatgcaggaaccaagacgaactgatcggccgcgcccggatcagccagggcgcggggtggtccctcaaggagacggcctgtctaggaaagagctacgctcagatgtggaccctgatgtacttccaccgccgggacctccgcctggcggcgaacgcgatctgctccgcagtgcccagccactgggtgcccacctcccgaacgacctggagcatccacgccaagcacgagtggatgacgaccgaggacatgctggccgtgtggaatcgcgtgtggatccaggaaaacccatggatggaggataagaccccggtggagtcctgggaggaggtcccctatctcgggaagcgggaggatcaatggtgcggcagcctcattgggctaacctcccgagctacgtgggccaagaacatccagacagccatcaaccaggtgaggtccctcatcggcaacgaggggtacaccgattacatgcccagcatgaaacgattccgccgggaggaagaggaggccggggtgctatggtga

SEQ ID NO: 24907 - RNA, 9876 nt, synthetic construct
  misc_feature 1..9876: note = derived and/or modified CDS sequence (opt11) from DENV-2__FJ850085__SS-prME
  source 1..9876: mol_type = other RNA
accgtcggagtgatcgtgatgcttatacccaccgcaatggccttccacctcaccacccgcaatggggagccccacatgatcgtgggcaggcaggagaaggggaagtccctcctgttcaagaccgagaacggcgtcaacatgtgcaccctcatggcgatcgacctgggggagctgtgcgaggacaccatcacctacaagtgcccccttctgcgccagaacgagcccgaggacatcgactgctggtgtaactccaccagcacctgggtgacctacgggacctgcaccaccacgggcgagcaccggcgcgagaagcggtccgtggccctggtcccccacgtggggatgggcctcgagacccgcaccgagacctggatgtcttccgagggggcgtggaagcacgtgcagcggatcgagacctggatcctgcgccacccagggttcaccatcatggccgccatcctcgcatacacgatcgggaccacccactttcagcgggccctcatcttcatcctgctgaccgctgtcgcccccagcatgactatgcgctgcatcgggatctccaatcgggatttcgttgagggcgtgagcgggggctcctgggtcgacatcgtactcgagcacggcagctgcgtgaccacgatggcgaagaacaaacccacgttggactttgaacttatcaagaccgaagcaaagcagccagccaccttacgcaagtactgcgtcgaggccaagctgacgaataccaccaccgagtcgcgatgcccgacccagggcgagcccagcctgaacgaggagcaggacaagcgcttcatttgcaagcattcgatggtagaccggggctgggggaacggctgcggtctgtttggcaagggcgggatcgtgacgtgcgccatgttcacgtgcaagaagaacatggaaggcaaggtcgtgcaacccgaaaacctggagtacaccatcgtgatcacgcctcacagcggggaagaacacgcggtcggcaacgacactggtaagcacggcaaggagatcaagatcaccccgcagtccagcatcaccgaggcagagctgaccgggtacggcacggtgaccatggagtgcagcccccgaaccggcctcgacttcaacgagatggttctgctgcagatggaggacaaggcctggcttgtccaccggcagtggttcctggacctgcccctcccctggctgccgggggccgacacccagggcagcaactggatccagaaggagacgctggtgaccttcaagaacccccacgccaagaagcaggatgtcgtggtgttggggtcccaggagggcgcgatgcacaccgccctgacaggggccacggaaatacagatgagcagcggcaacctcttgttcaccggccatctgaagtgcagactgcggatggacaagctccagctgaaggggatgtcctacagcatgtgcacgggaaagttcaagatcgtgaaggaaatcgccgagacccagcacgggacgatcgttatccgcgtgcaatacgagggcgacggctccccctgcaagatccccttcgagatcatggaccttgagaagcggcacgtgctcgggcgcctgatcaccgtcaacccgatcgttgccgagaaggacagccccgtcaacatcgaggcggaaccacccttcggcgactcctacatcataatcggggtggaaccgggccagctgaagctcaactggtttaagaaagggagctccattggtcagatgtttgagaccaccatgcgcggcgccaagcggatggcgatcctgggcgatacggcctgggacttcggcagcctcggcggggtattcacgtccatcgggaaggccctccaccaggtcttcggggcaatctacggcgccgccttcagtggggtctcctggaccatgaaaatcctgatcggggtgatcatcacctggatcggaatgaacagccgctctacgagcctttccgtctctctggtactcgttggggtcgtgaccttatacctgggggccatggtgcaggcggactccggctgcgtcgtgagctggaagaacaaagagttaaagtgcgggtccgggatcttcatcaccgacaacgtgcacacatggactgagcaatacaagttccagcccgaaagccccagcaagctggcctccgccatacagaaggcgcacgaggagggcatctgcgggatccggagtgtcacccgcctggagaacctcatgtggaagcagataaccccggagctgaatcacatcctgtccgagaatgaggtgaagctcaccatcatgacgggcgacatcaaggggatcatgcaagccggcaagcggagcctccgcccacagccaactgaactgaagtattcgtggaagacctggggcaaggcaaaaatgctcagcaccgaatcccacaaccagacgttcctgatagacggccccgagactgccgagtgcccgaatacaaaccgggcctggaacagcctggaggtggaggactacggcttcggggtcttcaccacgaacatctggctcaagctgcgcgagaagcaggacgtattctgtgactccaagctgatgagcgccgctgtgaaggataatcgggcggtccacgctgacatgggatactggatcgaatccgcccttaacgacacctggaagatggagaaggccagcttcatcgaggtgaagtcctgccactggcccaaaagccacaccctgtggtccaatggcgtgctggagagcgagatgattatccccaagaacttcgccgggccggtctcccagcacaactaccgcccgggttaccacacccagaccgctgggccctggcacctcggcaagctggagatggactttgacttctgcgaagggaccacagtggtggtcaccgaggactgcggcaaccggggccccagcctgcgaaccacgaccgccagcggcaagctcatcaccgagtggtgctgccggtcctgcaccctgcccccgctacgctacaggggcgaggacgggtgctggtacggcatggagatccgcccgctcaaggagaaggaggagaacctggtcaattctctggtgactgccgggcacggccagatagacaacttctccctcggcgtactggggatggccctcttcctcgaggagatgcttcggacccgcgtggggaccaagcacgcgatactgctcgtggccgtcagcttcgttacccttataactgggaacatgtccttccgggatctgggccgcgttatggtcatggtgggggcgaccatgaccgacgatataggcatgggcgtgacctacctcgcgctgctggccgcgttcaaggtccgccccacatttgccgccgggctcctgctgcggaagttgaccagtaaagagctgatgatggccaccatcggcgtagccctgctatcccagagcaccatccccgagacgatcttagagctgactgacgcgctcgccctggggatgatggccctgaagatcgtgaaaaacatggagaagtaccagttggccgtcaccataatggctatctcatgcgtgccgaacgcggtgatcctgcagaacgcctggaaggtgagctgcaccatcctggcagccgtgtccgtcagccccctcctgcttacaagtagccagcagaaggcggactggatcccactcgccctcaccatcaagggcttaaaccccaccgccatcttcctgaccactctgtcccgcaccagcaagaagcggagctggccgcttaacgaggcaataatggccgttgggatggtgagcatcctcgcgtccagtctgctgaagaacgacatccccatgaccgggcccctcgtggccggcgggttgctgaccgtgtgctacgtgctgacgggccgcagcgccgacctggagctggagcgggccgccgacgtcaagtgggaggatcaagcggaaatctctgggagctccccaatcctctcgatcaccatttccgaggacggcagcatgagcatcaagaacgaggaggaggagcagaccctgaccatcctgatcaggacgggcctcctggttatcagcggggtgttccctgtgtccatccccatcacagccgccgcctggtacctgtgggaggtgaagaagcagcgggccggcgtgctctgggacgtccctagcccgcctcccgtggggaaagcggagctagaggagggcgcctacaggatcaagcaacggggcatccttggctactcccagattggcgccggtgtgtacaaggagggcaccttccacaccatgtggcacgtcacccgcggcgccgtgctcatgcaccggggcaagagaatcgagccctcatgggccgacgtgaagaaggacctggtctcctacgggggcggctggaagctggagggcgagtggaaggagggcgaggaggtacaggtgctcgcgctggagcccgggaagaacccccgcgctgtccagacgaagcccggcatcttcaaaaccaacaccgggaccataggagctgtgagcctggacttttctcctggcacgagcgggtcccccatcgtcgaccgcaaggggaaggtcgtggggctctacggcaacggcgtggtcacccggagcggggcctatgtgtccgcgatcgcacagacagataagagcatcgaggacaaccccgagatcgaggacgatatcttccgcaaaaagcggctgaccatcatggacttacaccccggggccgggaagacgaagcgctatctccccgcaatcgtgcgagaggcgatcaagcggggcctgagaaccttaattctggcgccgactcgcgtcgtggccgccgagatggaggaggcactccgtgggctgcccatccggtaccagacccccgccatccgggcggagcacacgggccgggagattgttgacctgatgtgccacgccaccttcaccatgcgtctccttagccccgtccgggtgcctaactataacctgattatcatggacgaagcccacttcaccgaccccgcctccatcgccgcgcgcgggtacatctctacgagggtggagatgggagaagccgctggtatcttcatgaccgccacgcctcctgggtcccgcgacccgttcccgcaaagcaacgcgcccataatggacgaggaacgggaaatccccgagcgctcctggaacagcggccacgagtgggttaccgacttcaaggggaagacggtgtggttcgtgccgtccatcaaggccggcaacgacatcgccgcatgcctccgtaagaacggcaagaaggttatccagctgagccgcaagaccttcgattccgagtatgtgaagaccagggccaacgactgggacttcgtggtcaccacagacatcagcgagatgggggcgaacttcaaagccgaacgcgtgatcgaccctcggcgctgcatgaagcccgtgatcctgaccgacggcgaggagcgagtcatcctcgccggccccatgccggtgacacactcgagcgccgcccagcgccggggccgcatcgggcgcaacccgaagaacgagaacgaccagtacatctatatgggcgagcccctggagaacgacgaggactgcgcgcactggaaggaggccaagatgctgctcgacaacattaacaccccagagggcatcatcccgtccatgttcgagcccgagcgagagaaggtggacgcaatcgatggcgagtaccgcctacggggcgaggcccgcaagacgttcgtcgacctgatgcggcgcggggacctccccgtgtggctggcctacaaagtcgcggccgagggcattaattacgccgacaggcgctggtgcttcgacgggatcaagaacaatcagatcctcgaggagaacgtggaggtggagatctggaccaaggagggcgaaagaaagaagctgaagccgcgctggctggacgcccggatctacagcgatcccctggcgctcaaggagttcaaggagttcgccgccggccgcaagtccctgaccctgaacctcatcaccgagatgggaaggctgcccacgtttatgacccagaaggccagaaacgcactggacaacctcgcggttttgcacaccgcggaggccggagggaaggcctacaaccacgccctaagcgagctccccgagaccctggagacgttactcctgctgaccctcctagcgacagtgaccggcggcatattcctgttcctcatgtccggcaagggcatcggcaagatgacgctgggcatgtgttgcatcatcaccgccagcatcctgctctggtacgcccagatccagccacactggatcgccgcctccatcatcctggagttcttcctgattgtgctcctgatacccgagcccgagaagcaacggacgccacaggacaaccagctgacctacgttgtgatcgcgatcctcactgtggtcgccgccacgatggccaacgagatggggttcctggagaagacaaagaaggacctgggcctcggctccatcactacccaggagtccgagtctaacatcctggatatagacctgcgcccggccagcgcgtggactctctacgccgtggccaccacgttcgtaacccccatgctgcggcactccatcgagaacagctccgtcaacgtgagcctgacagctattgctaatcaggcgaccgtgctcatgggcctgggcaaggggtggccactgtccaaaatggacatcggcgtccccctcctggcgatcgggtgctacagccaagtgaacccgatcaccctgaccgccgccctcttacttttggtggcgcactacgctatcatcggccccgggcttcaggccaaggccacgcgcgaggcccagaagcgggcggccgcggggattatgaaaaacccaaccgtcgacggcatcaccgttatcgacttggagcccatcccgtacgaccccaagttcgagaagcagctcggccaggtgatgctgcttatcctctgcgtcacccaggtgctgatgatgcgcacgacgtgggccctgtgcgaggctctcaccctagcgaccggccccatctccacgctgtgggaggggaaccccggtcggttctggaacacaaccatcgccgttagcatggccaatatcttccgagggtcctaccttgccggggcaggcttactgttcagcataatgaagaacaccacgaatacccgccgggggaccggtaacattggtgagacactcggggagaaatggaagagtcgcctgaacgccctggggaagtcggagttccagatctacaagaaatccgggatccaggaggtcgaccggacgctcgccaaggagggcattaagaggggagaaaccgaccaccacgcggtgagcagaggtagtgccaagctccgatggttcgtggagcggaacatggtcaccccggagggcaaggtggtggacctggggtgcggccgcgggggctggagttactactgcgggggcctcaagaatgtccgggaggtgaaggggttaacaaagggcgggcccgggcacgaggagcccattcccatgagcacctatggctggaacctggtgcgccttcagagcggggtcgatgtgttcttcaccccgcccgagaagtgcgacaccctgctgtgtgacatcggggaaagcagccccaaccccaccatcgaggcgggccggacgttgcgcgtgctgaacctggtcgagaactggctcaataacaacacccagttctgcatcaaggtgctaaacccgtacatgccaagcgtcatcgagaagatggagaccctgcagcggaagtacgggggcgccctcgtccgcaaccccttgtccagaaacagcactcacgagatgtattgggtgtccaacgccaccgggaacatcgtgagctcagtcaacatgatcagccgcatgctgatcaaccggttcacaatgaagcataagaaggcaacctacgagccggacgtggacttgggctctgggacccgcaacatcggcatcgagagcgaggtgcccaacctcgacatcatcggcaagcggatcgagaagatcaaacaggagcacgagacctcctggcactatgaccaggaccacccctacaagacgtgggcataccacgggtcatacgagaccaaacaaaccggttccgcgtcatccatggtcaatggggtggtgcgcctgctaaccaagccctgggacgtcgtgccgatggttacgcagatggccatgaccgacaccacccccttcggccagcagcgagtcttcaaggagaaggtggacacgcggacccaggagcccaaggagggcaccaagaaacttatgaaaatcaccgccgagtggctgtggaaggagctggggaaaaagaagatcccccgcatgtgcacgcgggaggagttcacccgaaaggtccggagcaacgccgccctcggcgcaatcttcaccgacgagaacaagtggaagtccgcgcgcgaggccgtcgaggacgggcggttttgggagctggtggatcgagagcggaaccttcacctcgagggcaagtgcgagacctgcgtttacaacatgatgggaaagagggagaagaaactgggcgagttcggcaaggccaaggggagccgggcgatctggtacatgtggctgggcgcccgattcttagagttcgaggccctagggttcctaaacgaggatcactggttctcccggggcaacagcctcagcggggtggagggcgaaggcctgcacagactggggtacatcctccgggacgtgtccaagaaggagggcggtgccatgtacgccgacgacacggcgggctgggacacccgcatcaccctggaggacctgaagaacgaggagatgatcaccaatcacatgaagggggagcacaagaagctcgccgaagcaatcttcaaacttacgtaccagaataaggtcgtgcgggtgcagcgaccgactccccgggggacagtcatggacatcatcagccgccgtgaccaacggggctcaggccaggtgggcacttatgggctgaacacgttcaccaacatggaggcccagcttatacgacagatggagggcgagggcatcttcaaaagcatccagcacctgaccgtgaccgaggagatcgccgtgcagaactggctggcgcgggtggggcgcgagcggttaacgcgcatggccatatccggcgatgactgcgtggtcaagcccatcgacgaccggttcgcaaacgccctgacggcactgaacgacatggggaaggtgcgcaaagacatccagcagtgggagcccagcaggggctggaacgactggacccaagtgccattttgctcccatcactttcacgaactcgtcatgaaggacgggagagtgctggtggtcccctgccggaaccaggacgagttaatcggtcgcgcgcggatcagccagggcgccgggtggagtctcaaggagaccgcctgtcttggcaagagctacgcccaaatgtggacgctgatgtacttccaccgccgggatctccgcctggccgcaaacgccatctgctccgccgtgcccagccactgggtgcccacctcccggaccacctggagcatccatgccaagcacgagtggatgaccacggaggacatgctggcggtctggaatcgcgtttggatccaggagaacccgtggatggaagacaagacgccggtggaatcctgggaggaggtcccctacctagggaagcgggaggaccaatggtgtggcagcctgatcgggctgacgtcccgcgccacatgggctaaaaacatccaaacggccatcaaccaggtgcgcagcctcatcggcaacgagggctacaccgactacatgcccagcatgaagcgcttccgccgcgaggaggaggaggccggggtgctatggtga

SEQ ID NO: 24908 - RNA, 9876 nt, synthetic construct
  misc_feature 1..9876: note = derived and/or modified CDS sequence (opt11) from DENV-2__FJ850088__SS-prME
  source 1..9876: mol_type = other RNA
accgccggcgtgatagtgatgcttatacccacggtgatggccttccacctcaccacccgcaacggtgaaccccacatgatagtgggccggcaagagaaagggaagtccctcttgttcaagactgaggacggtgtcaacatgtgcacgctcatggcgatagacctcggcgagctgtgcgaagacaccatcacctataagtgcccgctgctgcgccagaacgagcccgaggatatcgactgctggtgtaacagcaccagcacctgggtgacctacggtacttgtaccaccacgggggagcataggcgcgagaaacggtccgtggcactggtgccccatgtggggatgggcctagagactcgcaccgagacctggatgtctagcgagggggcatggaaacatgtgcagcggatagagacttggatcttacgccaccccggcttcaccatgatggccgctatcttggcgtacaccattgggactacgcacttccagagggccctcatcttcatcctccttaccgcggtcgccccctctatgaccatgcgctgcatcggaataagcaacagagacttcgttgagggcgtgtccgggggcagctgggtcgacatagtgctcgagcatggaagctgcgttaccacgatggcgaagaacaaacccaccctggacttcgaactgatcaagacggaggccaagcagccagctaccctcaggaaatactgcgtcgaggcaaagctgacgaacaccacaaccgagagccggtgcccaacgcaaggcgaacccagccttaacgaggagcaggacaagcgcttcatctgcaagcattccatggttgacagggggtggggaaacggctgcggtctgttcggcaaaggagggatcgtgacttgcgcaatgtttacctgcaagaagaacatggagggcaaggtggtccaacctgagaacctagagtatacgatcgtaatcacgcctcacagcggagaagaacacgcggttggcaacgacactgggaagcacggcaaagaggtcaaaattacgccgcagtccagcattaccgaggccgagttgaccgggtatggaacggtgacaatggagtgtagcccccggacaggcctcgacttcaacgagatggtactgctccagatggaggacaaggcatggttagtgcatcggcaatggtttctggacttgccgttgccctggcttccaggtgcagacacgcagggcagcaactggatccagaaggaaacgctggtaaccttcaagaacccacacgccaagaagcaggatgtggttgtcctaggttcccaggagggcgctatgcataccgccttgacaggcgcaacagagatacagatgagctcgggcaatctcttgttcacaggccacctgaaatgccgcctgcggatggacaagctccaactaaaggggatgtcctacagcatgtgtaccgggaagttcaagatcgtgaaggagatcgccgagacccagcacggtacgatcgttattcgcgtgcagtacgaaggagatggcagtccctgcaagattcctttcgagatcatggaccttgagaagcggcacgtgctggggcgtctaattacagtcaacccgatagtaactgagaaagatagccccgtaaacatcgaggccgaaccgccttttggcgactcctatatcattgtcggcgtcgagccgggccagctgaaactcaattggttcaaaaagggcagcagcattggccaaatgtttgaaaccacgatgcgtggcgcaaagcggatggccatcttgggcgataccgcatgggacttcgggagcttaggaggcgtgttcacatccatcgggaaggcgctccaccaggtctttggcgccatctatggtgcggccttcaacggggtcagctggacaatgaagatcctgatcggcgtgatcatcacgtggataggtatgaactcccggagcacctcacttagcgtttccctggtcctcgtgggcgtcgtaaccctgtacctcggtgctatggtccaggccgattccggctgcgtagtatcctggaagaacaaggaactcaagtgcggtagcgggatcttcatcacagataacgttcacacgtggaccgaacaatataagttccagcccgagagccccagcaaactggctagcgcgatccaaaaggcgcatgaagagggcatctgcgggatccggtccgtgactcgcctggagaatctgatgtggaagcagatcacgccggagttaaaccatattttgagcgagaatgaagttaaattaacaatcatgacaggcgacatcaaggggataatgcaggccggcaagcggtcactgcgcccacagccgacggagttaaagtactcgtggaaaacctggggcaaagctaaaatgcttcccacggagtcacacaatcaaaccttcctgatagacggaccggaaaccgcggaatgccccaatgccaatcgagcctggaactcattagaagtggaggattatgggttcggtgtgttcacgacgaacatatggctcaagctgagggagaagcaggacgtattttgcgactccaagctcatgtccgccgccatcaaggacaaccgggccgtgcatgcagacatggggtattggatcgagtcagccctaaacgacacttggaagatggaaaaggccagcttcatcgaggtgaagagttgtcactggcccaagtcacacaccctgtggtcgaacggtgtgctcgagagcgagatgatcattcctaagaacttcgccgggcctgtttcccagcacaactaccgccccgggtaccacacccagaccgcggggccctggcacttgggcaagctggaaatggatttcgacttctgcgaggggacgaccgtcgttgtgaccgaggactgcggtaaccggggcccgtcgctacgaacgacgaccgcgtctgggaaactcatcaccgaatggtgctgccgtagctgcactctgccgccgctacgctatagaggggaggacgggtgctggtatggcatggagatccgccccctcaaggagaaggaggagaacttagtaaattcattagtcaccgcagggcacggccagatcgacaacttttcactcggcgtattgggaatggccctgttcctcgaggaaatgctgaggacgcgcgtgggcaccaagcacgcgatcctgctcgtcgcagtgtctctagtgaccttaatcacggggaacatgtctttccgagatttggggcgcgtcatggttatggtgggggcaaccatgaccgatgatatcgggatgggcgttacgtatctggccctattagccgcgtttaaggtgcgccccaccttcgccgcggggctactgctgcggaagctgacctcaaaagaactgatgatggccacaatcggagtggccctcctgtcccagagcaccatccccgagacgattctggagctcaccgacgcactagcattggggatgatggccttaaaagtcgtgaagaacatggaaaagtatcagctggccgttacaatcatggccatctcctgcgtcccaaatgcggtcattctgcagaacgcatggaaggtaagctgcaccatcctagctgccgtgagtgttagccccctattgctaacgtcaagccagcagaaggcggattggatccccctggcattgacgatcaagggcctgaacccgaccgccatcttcctgaccacgctatcccgcaccagcaagaagcggtcctggcccctaaacgaggccgttatggcagtgggaatggtatcgattctggcttcctccctgctcaagaacgacatccccatgactgggcccctggtcgcgggtgggctgctcaccgtgtgctacgttttaacgggccgttccgctgacctagagctcgagagagccgccgacgtcaagtgggaggaccaggctgaaatcagcggatctagtccgatccttagcataaccatctcggaggacgggagcatgtccatcaaaaatgaggaggaggaacagactctgaccatcctaatccgtaccggccttctggtgatctcgggggtatttcccgtctcgatccctattaccgcggccgcatggtacttatgggaagtgaagaagcagagggccggcgtgctgtgggacgtgcccagcccgccgcccgtggagaaggcggaacttgaggacggagcgtacaggataaaacaacgtgggatcctcgggtactcccagatcggcgctggcgtgtacaaggaagggacctttcacactatgtggcacgtcacgcgcggcgccgtgttgatgcatcgggggaagcgcatagagccgagctgggccgacgtgaagaaagacctggttagttacggcggtggctggaaactcgaaggtgagtggaaggaaggagaggaggtccaggtcctggcactggagcccggcaagaacccccgagccgtccagacgaagcccgggatctttaagactaacaccggaaccataggggcggtgtctctggacttctcccctggaacgagtggctccccaatcgttgaccgcaagggaaaggtggtgggtctgtacggaaacggcgttgtcacccggagcggcgcctacgtgtccgcgatcgcacagaccgagaaatccatcgaggacaatcctgagatcgaggatgacatcttcaggaagaaacggctaaccataatggacctccaccccggggccggcaaaactaaacgctacttgccggcgatcgtgcgggaggccattaagcgcggactgaggaccctaatccttgcgcctacacgcgtcgtagctgccgaaatggaagaggccctgcgcggcctgccgattcgttaccagacccctgccatcagggcagaacacacggggcgagaaatcgtggacttgatgtgtcacgccaccttcaccatgcgcctgctgagcccggttcgcgtgcccaattacaatctcattataatggacgaggcgcacttcaccgaccccgcttctatcgccgcgcgcggctatatcagcacccgcgtagagatgggcgaagcggcaggcatcttcatgaccgccacgccgcccggatcaagggaccccttcccccagagcaatgcgcccatcatggatgaagaacgggaaataccagagcgctcctggaacagcggccacgagtgggtcacggacttcaaaggcaagactgtgtggtttgttccttccatcaaggccggtaacgacatcgccgcatgcctgcgaaagaatggcaagaaggtaatccaactgtctagaaagacctttgactctgaatacgtgaagacccggagcaacgattgggacttcgtggtcacgacggacatctccgagatgggcgccaacttcaaggcggaacgcgttatcgatccacggcgctgtatgaaaccggtgatcctcaccgacggggaggaacgggtcatcctagccggaccgatgcccgtcacccacagcagtgccgctcagcggcgggggagaatcggacgtaaccccaagaatgagaatgatcagtacatatacatgggggagcccttggaaaatgacgaagactgcgcccactggaaggaggcgaagatgctactagacaacatcaacaccccggagggcatcatcccctctatgttcgaacccgaacgggagaaagtcgatgccatcgacggggaataccgcctgagaggcgaggcccggaagacgttcgtggacctcatgcgccgcggcgacctaccagtatggctggcctacaaagtcgccgccgagggaatcaactacgccgaccggagatggtgctttgacggcatcaaaaacaaccagatcttagaggaaaacgtggaggtggaaatttggactaaggagggggagcgtaagaaactgaagccccgctggctggacgcccggatctactccgaccccctcgccttaaaggagttcaaggagttcgcggccggtcggaaaagcctgaccttaaacctgatcaccgagatgggccgtctgccgactttcatgacgcaaaaagcccgaaacgccttagacaacctagcagtcctgcacaccgcggaggcagggggcaaggcatacaatcatgccctgagtgagctgccggaaaccctggaaactctactgctgctggcactgctggcaaccgtcaccggcggcatcttcctcttcctaatgtctggcaaggggatcggcaagatgaccctggggatgtgctgtatcattacggcttccatcctcctgtggtacgcccagatccaacctcattggatcgcagccagtatcatcctggagttcttccttatcgtcctgctgatacccgagccggagaagcaacggactccgcaggacaaccaactcacctacgtggtgatagccatcctgaccgtcgtcgccgccaccatggccaacgaaatgggcttccttgagaagacgaagaaggatctcgggctgggttctatcaccacccaggagtcggagtctaacatcctggacatagacctcaggccagcctctgcgtggactctgtacgccgtggccacgacctttgtcacgcccatgctgcggcactctatcgaaaattcctcggtcaacgtgagcctaacagctatcgccaaccaagccacagtactaatgggcctgggtaagggttggccgttaagcaagatggacatcggcgtcccgctgctggccataggttgctactcccaggtgaatcctatcacgctcacagccgcgctgctgctcctggtggcgcactacgcaatcatcgggcccggcttgcaggccaaggcgacccgtgaggcgcagaagcgagcggccgctggtatcatgaagaaccccacagtcgacgggattacggtgatcgacctcgaaccgataccctatgaccctaagttcgagaagcagctgggccaggtgatgctgcttattctgtgtgtaacccaggtcctgatgatgcgcaccacttgggcgctctgcgaggcattgaccctggcgactgggcccatcagcaccctctgggagggcaacccggggcggttctggaacacgaccattgccgtgtccatggccaacatattccgcggaagctacttggccggagctgggctcttattctccgtaatgaagaataccactaacacgcgccggggcaccgggaacatcggcgaaacattgggtgagaagtggaagtcccgcctgaacgccctgggtaaatccgagttccagatctataaaaagtccggcatccaggaggtagaccggaccctggcgaaggaggggatcaaaagaggcgagacagaccaccatgccgtatctcgagggtcggcaaaactgcgctggttcgtcgagagaaatatggtaacccccgaggggaaggtagttgacctcggttgtgggcggggcgggtggtcctactactgtggagggctgaaaaatgtgagagaagtcaaaggtcttacgcgcggcgggcccggtcatgaggaacctatcccaatgagcacttacgggtggaacctcgtcaggctgcaatcgggagtagatgtgtttttcacgccgcccgagaagtgcgacactcttctatgcgacataggggagtccagccccaaccctaccatcgaggcaggtcgcactttgcgggttctaaacttggtggagaactggttgaacaacaacacgcagttctgcatcaaggttcttaacccgtacatgccctccgtcatagagaagatggagaccctccagcgtacgtatggcggagccctggtgaggaacccgctgagccgaaatagcacccacgaaatgtactgggtaagcaatgccactgggaacatagtatccagcgtaaatatgatcagcaggatgctgatcaaccgtttcacgatgaagcacaagaaggccacttacgagcccgatgtggacctcggaagcggcacgcgcaacattggcatcgagagtgaaattcctaacctggatattataggcaagcgcattgagaaaattaagcaagagcacgaaaccagctggcactacgatcaggaccacccatacaagacgtgggcctaccacggcagttacgagaccaaacagaccggcagcgcgagcagcatggtcaacggcgtggtccgcctactgaccaagccttgggacgtcgtcccgatggttacgcagatggctatgacagacaccacccccttcgggcagcaacgtgtatttaaggagaaagtcgatacgcgcacccaggagccaaaggaaggcaccaaaaagctgatgaaaataacggcagagtggctgtggaaggaactcggcaagaagaagacgccgagaatgtgcacccgagaggagtttaccaggaaggtccggagtaacgccgcactgggagcaatctttaccgacgagaacaaatggaagtctgctcgggaagcagtggaggacggccgcttctgggagctggtggaccgggagcgcaacctccaccttgaggggaagtgtgaaacttgtgtctacaacatgatgggcaagcgcgagaagaagctaggtgagttcgggaaggccaaggggtcgcgcgcgatatggtatatgtggctcggcgcacggttcctcgagttcgaggctctgggcttcctcaacgaagatcattggttcagccgcgggaatagtttgagcggcgtagagggagaggggttgcaccggttaggctacatcctgcgagacgtaagcagaaaggagggcggcgccatgtatgccgacgataccgctggttgggacactcgcatcaccttagaagacctgaagaacgaggagatggtgacgaaccacatgaagggggagcataagaaactcgccgaggctattttcaagttgacctaccagaacaaggtagtgcgggtgcagcgccccacgccccgggggaccgtaatggatataatctcccgccgcgaccagcggggcagcggccaggtgggaacgtacggcctcaacaccttcacgaacatggaggcccaactgatccgccaaatggagggcgagggcatttttaagtccatccaacacctgaccgttaccgaggagattgccgtacagaactggctcgctcgcgtgggcagagagcggctgacccgcatggccataagcggcgacgactgcgtcgtgaaacccatcgacgataggttcgccaacgccctgacagctctcaacgatatgggaaaagttcgcaaggatatacagcagtgggagccgagccggggctggaacgactggacgcaggtccctttctgttcgcaccacttccacgaacttgtgatgaaagacggccgcgtgttagtcgtcccctgccggaaccaagacgagttgatcgggcgggcccgcatctcccaaggagccggttggagcctgaaggagacggcatgcctggggaaatcctacgcccaaatgtggaccctcatgtacttccaccgccgggacctgcgcctcgccgcgaacgcgatatgctcagccgtgccatcccactgggtcccaaccagccggaccacgtggtccatccatgctaagcacgaatggatgacgactgaagatatgttggcggtttggaaccgcgtctggatccaggagaacccatggatggaggacaaaacccccgtcgagagctgggaagaggttccgtacctgggcaagcgggaggaccagtggtgtggatccttgatcggcctcaccagccgcgctacgtgggccaagaacatccagaccgcgatcaaccaagttcgctccctaatcggtaacgaagagtacacggattacatgcctagcatgaagcgtttccggcgggaggaggaggaggccggagtcctttggtga

SEQ ID NO: 24909 - RNA, 9876 nt, synthetic construct
  misc_feature 1..9876: note = derived and/or modified CDS sequence (opt11) from DENV-2__FJ850091__SS-prME
  source 1..9876: mol_type = other RNA
actgcgggagtgatcgtcatgctgattcccaccgccatggccttccatctcaccacccgcaatggggaaccccacatgatcgtgggacggcaggagaaagggaagtccctgctgttcaaaaccgaggacggcgtaaacatgtgcacactcatggccatggacctgggtgagctgtgcgaggacaccataacctacaaatgcccactcctgcgccaaaacgagccggaggacatagactgctggtgcaactcgacctctacctgggtcacctacgggacgtgcaccactacgggtgagcatcggcgcgagaagcgtagcgtggccctggtgccccacgtcgggatggggctcgagacccgcaccgagacctggatgagctcggagggggcctggaagcacgtgcaacggatcgagacctggatcctccgccatcctggcttcactatcatggccgcgatcctcgcttacactatagggacaacgcactttcagcgtgccctcatcttcatccttctgacagcggtggcgccaagcatgaccatgcgttgcataggcatctccaaccgggacttcgtagaaggcgtatctgggggctcctgggtggacatcgtgctcgagcacgggagctgtgtgaccacgatggccaagaacaagcccaccctggacttcgagctgatcaagacagaggccaagcagcccgctacactccgcaagtattgcatcgaggcgaagttaacgaacacaaccaccgaatcccgttgcccgactcagggcgagccttcactgaacgaagagcaggataagcgcttcatctgcaagcactccatggtggaccggggttgggggaatggctgcgggctgttcggcaagggcgggatcgtgacatgcgcgatgttcacgtgcaagaagaacatggaggggaagatcgtgcagcccgaaaacttggagtacaccatcgttatcacgccccacagcggcgaggagcatgccgtcggcaacgacaccgggaagcacggaaaggagatcaagatcacaccgcagtcctcaacgaccgaagccgagctgacggggtacggcaccgtgacaatggagtgcagccctcgtactggcctagacttcaacgagatggtgttattgcagatggaggacaaggcctggttagtccacaggcagtggtttttggacctgcccctaccttggttacctggtgcggacacgcagggctcaaactggatccagaaggagacgctggtgaccttcaagaacccccacgcaaagaagcaagacgtggttgtgcttgggtcccaggagggtgccatgcatacagccctgacgggggccaccgagatccagatgagcagcggcaatctcctgttcaccggccacctgaagtgccgcttacggatggacaaactccagctgaaggggatgagttactcaatgtgcaccgggaagttcaagatcgtcaaggaaatcgctgagacgcaacatggcaccatcgtgatacgtgtgcaatacgagggcgacggatccccctgcaagatccccttcgagatcacggacctggagaagcggcacgtactcgggcgcctgatcacagtgaatccgatcgtcacggagaaggatagccccgtcaacattgaggcggaaccgcctttcggcgactcctacatcatcgtgggggtggaaccgggccagctgaaactcaattggttcaaaaaggggagttccatcggccagatgttcgagacaactatgcgcggtgccaagcggatggctatcctgggcgataccgcctgggacttcggctcgttgggcggtgtcttcacgtccatcgggaaagcactccaccaggtcttcggtgcgatctacggagccgccttcagcggggtgtcctggaccatgaagatactgatcggcgtcataattacctggatagggatgaacagccgctccacatcgctgtccgtgagcctggtgctcgtcggcgtggtgactttgtacctaggtgccatggtgcaggcggactccggctgtatcgtaagttggaagaacaaggagttaaagtgcggctcagggatattcatcaccgacaacgtccacacctggaccgagcagtacaagtttcagcccgaaagccccagcaagctggcctccgccatacagaaggctcacgaggaggggatctgtgggattcgcagcgtcacgcgcctggaaaacctcatgtggaagcaaatcaccccagagctgaaccacatcttatccgagaacgaggttaagttaaccattatgaccggagatatcaaggggatcatgcaggctgggaagcgcagcctgaggcctcagcccacggagctgaaatactcctggaagacttggggtaaggcgaagatgttgagcaccgagagccacaatcagacctttcttattgatggacctgagacggccgagtgcccgaacaccaatcgggcctggaatagcttagaggtggaggactacggcttcggggtcttcaccacaaacatctggctcaagctgcgcgagaaacaggacgtgttctgtgattcaaagctgatgagcgcggccatcaaggacaaccgcgcggttcacgcggacatgggctactggatcgagtccgccctcaacgacacctggaagatggagaaggccagcttcattgaggtcaagtcctgtcactggcccaagagtcacaccctgtggtcaaacggtgttctggagagcgagatgatcatccccaagaacttcgccgggcccgtgtcccagcataactataggcctggctaccatactcagaccgcggggccctggcacctaggcaagctggagatggacttcgacttttgcgagggaaccacggtcgtggtgaccgaagactgcggcaaccgaggccccagcttacgcacgaccacggccagtgggaagctcataaccgagtggtgttgtagaagttgcaccctgcccccgttgcgctaccggggagaagacggatgttggtacgggatggagatccgccccctcaaagagaaggaggaaaatctggtcaacagcctcgtgaccgctggccatggccagatcgacaacttttccctaggcgtgctgggaatggcgctgttcctagaggagatgctgcggacgcgcgtgggaaccaagcatgcgatcctgctcgtggccctaagctttgtgaccctgatcaccgggaacatgtctttccgggacctcggccgagtcatggtgatggtgggggcgacgatgaccgacgacatcggcatgggagtcacctatctagcgctcctcgccgcgttcaaggtgcgtcccaccttcgccgccgggctgctgctgcgaaaacttacgagcaaggagctaatgatggccaccataggcatcgccctcctgagtcaaagcacgttgcccgagaccatcctcgagttgacggacgcactggccctggggatgatggccctcaagatcgtacgaaatatggagaagtatcaactggccgtcaccattatggccatatcatgcgtgcccaacgcggtgatcctccagaacgcgtggaaggttagctgtaccatcctggccgccgtatccgtaagccccctactcttaacttccagtcagcagaaggcggactggatccccctggccctcacgattaagggcctgaaccccacggccatcttcctgacgaccctcagccggacctcgaagaagcgctcctggcccctgaacgaggccataatggccgtcggcatggtctcgatactggcgtccagcctcttaaagaacgacatccccatgaccgggcctctggttgccggtgggttactgactgtgtgctacgttctgaccggccgggccgccgacctagagctggaacgcgccgcggatgtgaagtgggaggaccaggccgagatcagcgggtcaagccccatcctgtccattacgatctccgaggacggctccatgagcatcaagaatgaggaggaagagcagaccctcaccatcctgatccggaccggcctactcgtgatctccggggtgttcccggtaagcatacccataaccgcagccgcatggtacctgtgggaggtgaaaaagcagcgcgccggcgtgctgtgggacgtcccaagccccccgcccgtcgggaaggcggagctcgaggacggagcctaccgaatcaagcagcgcgggatccttggttacagccagataggcgccggggtatacaaggaaggtacgttccacactatgtggcacgttacccgcggcgccgtgctgatgcaccggggcaagcggatagaaccctcctgggcggacgtgaagaaagatctcatcagctacggcggcggatggaaactggagggtgagtggaaagagggcgaggaggtccaggtgctcgccctcgagcccgggaagaacccccgcgccgtgcagacgaagcccggcatctttaagacgaataccggaaccatcggcgccgtgtccctcgacttcagcccgggcacgtcggggagccccatcgtggaccggaaaggcaaggtggtgggcctgtatggcaacggcgtggtgacgcgttcgggggcttatgtctcggccatcgcccagaccgagaagtccatcgaggacaaccccgagatagaagacgatatcttcagaaagaagcgcctcaccatcatggacctgcaccccggcgccgggaagacgaagcggtacctgcccgccatcgtgcgtgaggcaatcaagcgcggcctgcgcacgctaatcctggctccaacccgcgtggttgccgctgagatggaggaggccctgcgcggtctccccatccgctaccagacccccgcgattcgggctgagcacacagggcgcgaaatcgtggatctgatgtgccacgccacatttaccatgcggctactcagccccgtgcgcgtcccgaactacaacctaatcataatggatgaggcacacttcaccgaccccgctagcatcgcggcccggggttacatctccacccgcgtggagatgggggaggccgccggcatcttcatgacggcaacgccgcctgggagccgcgacccgttcccccagagtaacgctccgatcatggacgaggagagagagattcccgagcggagctggaactccggccacgaatgggtcaccgactttaaggggaagaccgtgtggttcgtcccgagcatcaaagctggcaatgatatcgcagcatgcttacgcaagaatggcaagaaggtgatacagctctccaggaagacgtttgacagcgagtacgcgaaaacacgcgctaatgactgggacttcgtcgtgaccaccgacatctccgagatgggagccaacttcaaggccgaacgggtgatcgacccgagaagatgtatgaagccagtcatcttaacggacggcgaggagcgcgtgatcctggcggggcccatgccggtaacccacagctccgcggcgcagcggcgcggtaggatcgggcggaaccccaagaacgaaaacgaccagtacatctacatgggcgagcccctcgagaacgacgaggactgtgcccattggaaggaggccaagatgttgctggacaacataaacaccccggagggtatcatccccagcatgttcgagcccgagcgcgaaaaggtcgacgcaatcgacggggagtaccggctcagaggcgaggcacggaagaccttcgtggacctgatgcgccgcggcgacctgcccgtgtggctcgcctataaggtagcagccgagggcatcaactacgcggaccgcaagtggtgcttcgacggaataaaaaataatcagattctggaggagaacgttgaggtggagatatggacgaaggagggcgaacgaaagaagctaaagccccgctggcttgacgccaggatctactccgacccgttagcactaaaggagttcaaagagttcgctgccggacgcaagtccttgaccctgaacctgatcacggaaatggggcggctccccaccttcatgacacagaaagcgcgcaacgccctggacaacctggcggtcctccacaccgccgaggtgggcggaaaagcctacacccacgccctatccgagctgcccgaaaccctcgagacactcctcctcctgacactgttggccgccgtgacaggaggtatattcctgttcctgatgagcggaaagggcattggtaagatgactttgggcatgtgctgtatcataaccgcctccatcctgctgtggtatgcccaaatccagccgcactggattgcggccagcatcatcctggagtttttcctcatcgtcttgctcatccccgagcctgagaagcagcgcacgcctcaagacaaccagctaacctatgtggtcatagccatactcaccgtggtggcggccaccatggcaaatgagatgggttttctcgagaagacgaagaaggaccttggctttggctccataaccactcaggagagcgagagcaacattctcgacatcgacctccgcccggcctccgcctggacactgtacgccgtggcgacgacgtttgtgactcccatgctgagacacagcattgagaactcctcagtgaacgtctcgctcaccgccatcgcaaaccaggccacagttctgatggggctcggaaaggggtggcccttgagcaagatggacatcggggtgcccctgctggccatagggtgctacagtcaggtcaacccgataaccctgaccgcggctctgctgctcctagtagcccattacgccatcatcggtcctggcttacaggccaaagcaacccgcgaggcccagaagagggcggctgccggcatcatgaagaatcccacggtggacggcataaccgtcatcgacctagagcccatcccgtacgaccccaagttcgagaagcagctggggcaagtaatgctgctcatcctgtgcgtgactcaagtcctgatgatgcggaccacgtgggccctctgcgaggccttgaccctggccaccggacccatcagcaccttatgggaggggaacccgggccggttctggaacactaccatcgccgtatcgatggcgaacatcttccgcggcagctacctggccggggccggcctactgttcagcatcatgaagaacacaaccaacacgcggcgggggaccggaaacgtaggagagaccctgggcgaaaaatggaagtcacggctaaacgctctcggcaagtcagagttccaaatctacaaaaagtccggcatccaggaggtcgaccggaccctggccaaagaaggcattaagcggggagaaacggaccaccacgctgtgtccagaggctcagccaagctgcgctggttcgtggagcggaacatggtcaccccggagggcaaggtggttgacctcgggtgcggacgtggtggatggagctactactgtgggggcctgaagaatgtacgggaggtaaagggcctgaccaagggcggtccgggccatgaggagccaatccccatgagcacctacggttggaacctcgtcaggctgcagtccggggttgacgtgttcttcactccgcccgaaaagtgcgacactctgctctgcgatatcggtgagagcagccccaatcccaccatcgaggccggccggactttacgcgttcttaatctagtcgagaactggctaaacaataacacacagttttgcattaaggtgctgaacccgtacatgccctcggtgatcgagaagatggagacgctccagcggaaatacggcggcgcactagtccgcaaccccctgtcacggaactccacccatgagatgtactgggtgtcaaacgctaccgggaacattgtgtcaagcgtcaacatgatcagccgcatgctgatcaaccggttcaccatgaagcacaagaaggcgacgtacgaaccggacgtggatctcggctccggaaccaggaatatcggcatcgaatccgagatccccaacctagacatcatcggcaagcgaatcgagaagatcaagcaggagcacgagacgtcgtggcactacgaccaggatcacccctacaaaacctgggcctaccacgggtcatacgaaacgaagcagactggaagcgcctccagcatggtgaacggcgtcgtgcgcctgctcaccaaaccgtgggacgtggttccgatggtgacccagatggccatgacggacaccactccgttcggccagcagcgcgtgtttaaggagaaggtcgatacccggacgcaggagcccaaggagggtaccaagaaactgatgaagatcaccgcggaatggctgtggaaggaactcgggaaggagaagaccccccggatgtgcacacgcgaggagttcacccgcaaggtgcggtccaatgcggccctgggagccgtgttcaccgacgagaacaagtggaagtccgcccgcgaggctgtcgaggatgggcgattctgggagcttgtggacagggagcggaatctccatctggaaggcaagtgcgagacctgcgtttacaacatgatggggaagcgcgaaaagaagctgggagagttcggcaaggccaaagggtcccgtgccatatggtacatgtggttaggcgctcgctttctggaattcgaggcgctggggttcctgaacgaggaccattggttcagccggggcaactccctgagcggggtcgagggcgaggggctgcatcgacttggttacatcttgcgggaggtcggcaagaaagaagggggtgcgatgtacgccgacgacactgccggttgggatacccgcatcaccctggaggacctcaagaatgaggagatggttaccaaccatatgaagggtgaacacaagaagctggccgaggcgatcttcaagcttacgtaccagaacaaggtcgtgcgggtgcagcgcccgacgccccggggcaccgtgatggacatcatcagccgcaaggaccagcgggggagtggccaggtgggtacctacggcctcaacacgttcacgaacatggaggcgcagctgatccgccagatggagggcgaggggatcttcaagagcatccaacatttgaccgccaccgaggagatcgccgtgcagaactggctcgcgcgcgtgggtcgggagcgactgagtcggatggccatcagcggggacgattgcgtggtcaagcccattgacgaccgcttcgcgtccgctctgacggcccttaatgatatgggcaaggtgcggaaggacatccagcaatgggagcctagccgcgggtggaacgactggacccaggtgccgttttgctcccaccacttccacgagttagtaatgaaggacggccgtgtcctggtcgttccctgccgaaatcaggacgagctcatcgggcgggcccgcatcagccagggggccggctggtcactcaaggagaccgcgtgcctgggcaagagctacgcccagatgtggaccctcatgtacttccaccggcgcgacctgcggcttgccgccaacgcaatctgttcagctgtgccaagccactgggtgcctacatcccggaccacttggtccatccatgctaagcacgagtggatgaccacggaggacatgctcgcggtatggaaccgggtgtggatccaggagaacccgtggatggaagacaagacaccggtggagtcctgggaggaggtcccctacctgggaaaacgcgaggaccagtggtgcgggagcttaatcggcctaacgtcccgagccacctgggccaaaaacatccagacagccatcaaccaggtccgctccctgatcggcaacgagggttacacggattatatgcccagcatgaagcggtttcgccgcgaggaggaggaggctggggtgctatggtga

SEQ ID NO: 24910 - RNA, 9876 nt, synthetic construct
  misc_feature 1..9876: note = derived and/or modified CDS sequence (opt11) from DENV-2__GQ199890__SS-prME
  source 1..9876: mol_type = other RNA
accgccggcgtgatcgtgatgctcatacccaccgccatggcgttccacctcaccacccggaacggggagccccacatgatcgtgggccggcaggagaaggggaagtccctgctgttcaaaaccgaggacggcgtgaacatgtgcaccctcatggccattgacctgggggagctgtgtgaggacaccatcacctacaagtgccccctcctgcggcagaacgaacccgaagacatcgattgctggtgtaactccacctcgacctgggtcacctacgggacctgcaccaccatcggcgagcaccggagagagaagcggtccgtggccctggtgccacacgttggaatgggcctggaaacgcgcactgagacctggatgagcagcgagggggcctggaagcacgtgcagcggattgaaacctggatcctgagacacccgggcttcacgatcatggcagcgatcctagcctacaccatcgggaccacccacttccagagagccctcattttcatcctgctgacggctgtggcgcccagcatgaccatgcgctgcattggcatcagcaaccgggacttcgtggaaggtgtgagcgggggctcctgggtggacatcgtcctagagcacggctcctgtgtgaccaccatggccaaaaacaagcccaccctcgatttcgaactaatcaagaccgaggccaagcagccagccacgctccgcaagtactgcatcgaggccaagctgactaacacgaccactgaatcccggtgtccgacccaaggcgaaccatcgttaaacgaggagcaggacaagcgcttcatctgcaagcactctatggttgaccggggctggggaaacggctgcggcctgttcggcaagggcggcattgtgacgtgcgcgatgttcacgtgcaagaagaatatggagggcaagatagttcagcccgagaacctggagtacaccatcgtgatcacgccccactcgggtgaagagcgagccgtgggcaacgacacggggaaacacggcaaggagatcaagatcaccccgcaatcctcgaccaccgaggccgaattaacagggtacggcacggtgaccatggaatgctcgccccggaccggtctcgacttcaacgagatggtgctgctgcaaatggaagataaggcctggcttgtacaccgccaatggttcctggaccttcccctcccctggctgccgggggccgacacccaggggagcaactggatccagaaggaaacacttgtgaccttcaaaaacccccacgcgaagaagcaggacgttgtcgtactcgggtcccaggagggcgccatgcacacagccttaacgggggccacggagattcagatgagcagcggcaacctcctgttcactggccacctgaagtgcaggctgcgcatggacaagctccagctgaaggggatgtcctacagcatgtgcaccggcaagttcaagatcgtcaaagagatcgccgagacccagcatgggacgatcgttattcgggtgcagtacgagggcgacgggtcaccctgcaagatcccattcgagattaccgacctggagaagcgccacgttctagggcgactgattaccgtgaacccgatcgtgaccgagaaggacagccctgtaaacatcgaggcggagccgccattcggtgactcctatatcattgtgggggttgagccgggccagctgaaattaaattggttcaagaaggggagctcaatcggtcagatgttcgagacgacgatgcggggcgcaaagcgcatggccatactgggcgataccgcctgggacttcggcagcctcggcggggtcttcaccagcattgggaaggcactccaccaggtgttcggggcaatctatggcgccgccttcagcggggtgtcctggacgatgaagatcctgataggcgttatcatcacctggatcggcatgaacagccggtccacaagcttatccgtgagcctggtgctcgttggcgtagtgaccctgtacctgggtgcaatggtccaggcagactccggttgcatcgtaagctggaagaacaaggagctcaagtgcggctctggaatctttatcacggacaatgtgcacacctggaccgagcagtacaagttccagcccgagagccccagcaagctggcctctgcaatccagaaggctcacgaagagggaatctgcgggatccgtagcgtcactcggctggagaacctcatgtggaagcagatcacgccagagttaaatcacatcctgagcgagaatgaggtgaagctcaccatcatgaccggcgacattaaggggatcatgcaggcaggcaagcgcagcttgcggccgcaaccaaccgaactgaagtacagctggaagacgtggggcaaggcgaagatgctaagtaccgagtcccacaaccaaaccttcctgatcgacgggcccgagaccgccgagtgcccgaatactaaccgggcctggaatagcctggaggtggaggactacggattcggagtcttcaccaccaacatttggctcaagctgcgggagaagcaggacgttttctgcgactcgaaactgatgagcgccgccatcaaggataaccgcgcggtgcacgccgacatgggctactggattgagtccgcattgaacgacacatggaagatggaaaaggcgagctttattgaagtcaagtcatgccactggcctaagtcccacaccctgtggtcaaacggtgtactggagagcgagatgatcatccccaagaacttcgccgggcccgtgtcccagcacaactaccggccggggtaccatacgcagaccgcaggcccctggcacctaggcaagctggagatggacttcgacttctgcgaggggaccacagtcgtggtgaccgaggactgcggcaacagaggccccagcctgcggaccaccaccgccagcgggaagctcatcactgagtggtgctgtcgctcctgcaccctgcccccgttgcggtaccgcggcgaggacgggtgctggtatggaatggagatccggcccctcaaagaaaaagaggagaacctggtcaatagcctggtgacagccgggcacgggcagatcgacaatttcagtctcggcgtgttggggatggccttattcttagaggaaatgctgcgcacccgggttggaacaaagcacgcgatcctgctcgtggccctgtcttttgtgaccctgatcaccgggaacatgagtttccgcgacctcgggcgcgtcatggtgatggtgggggccaccatgacggacgacattgggatgggcgtcacttacctggccctgctcgccgcgttcaaagtgcggcccacgttcgcggcggggctgttactgcgaaagctgaccagcaaggagctgatgatggccacaatcggcatcgcactactgagccagagcaccctgcctgaaacgatcctcgagctaacagacgcgctggccctaggtatgatggccctgaagatagtccgaaacatggagaaataccagctggccgtaacgatcatggcaatctcctgcgtgccgaacgcagtgatcttgcagaacgcctggaaggtcagctgcactatcctggccgctgtctccgtgtctcccctcttactcaccagcagccagcagaaggctgactggatccctctcgcactcaccatcaagggcctgaacccaacggcgatcttcctgaccactctctcccgcaccagtaagaagcggtcctggccgctgaacgaggccatcatggccgtaggcatggtgagcatcctggcgtccagccttctgaaaaacgacatccccatgacgggtccgctggtcgccggcgggctcctgactgtgtgctacgtgctgactggccgcagcgccgacctcgagctagagcgggccgccgacgtcaagtgggaggatcaggccgagatctccgggagctcccccatcttaagcatcaccatctccgaggacggtagcatgtctattaagaacgaggaggaggagcaaacgcttaccatcttgatccgcactggcttactcgtgatcagcggagtgttcccggtcagcatccctatcacggctgccgcctggtacctgtgggaggtgaaaaaacagcgggcaggggtcctatgggacgtccccagtccgccgcccgtggggaaagctgagctcgaagacggcgcctatcgcatcaaacagcgggggatcctcggttacagtcagatcggcgccggggtctacaaggagggcaccttccacacgatgtggcacgtcacccgcggggctgtgctgatgcaccgtggtaagcgcatcgagcctagctgggccgacgtgaagaaagacctcatctcctacggaggcggctggaagcttgagggggaatggaaggagggcgaggaggtccaagtgctggcgctcgaacccgggaagaacccgcgggcagtgcagactaagcccggcatcttcaagaccaacacggggaccataggcgccgtcagccttgacttctcccccgggaccagcgggtctcccattgtggaccgcaagggcaaggttgtcggtctgtacggcaacggcgtagtcaccagaagcggggcctacgtctccgcaatcgctcagacggagaagtccatcgaggataaccctgaaatcgaggacgatatcttccgcaagaagcggttgactatcatggacctgcaccccggcgccgggaagaccaagcgctacctgcccgccatcgtccgggaggctatcaaacgcggcctgcgcactctcatcctggctccgacgcgggtggtcgcagccgagatggaggaggccctgcgcgggcttcccatccggtaccagaccccggccatccgcgcggagcacactggtcgggagatcgtagacctgatgtgccacgcaacgttcacgatgcgcctgctcagccccgtgcgggtcccgaactataacctgatcatcatggatgaggcccacttcacagacccggcctccatcgccgcccgcggttacatcagcactcgggtcgagatgggggaggccgccggcatcttcatgacagccacgccgcccggatcccgtgacccgttcccacagtcgaacgcgccgataatggacgaggagcgggagatccccgagcgatcctggaatagcggacatgaatgggtgaccgacttcaaggggaagaccgtctggttcgtgccctccatcaaggcgggcaacgacatcgcagcatgcctgcggaaaaatgggaagaaagtaatccaactcagccgcaaaaccttcgactccgagtatgttaagacgcgggcaaacgactgggacttcgttgtgaccacagacatcagcgaaatgggggcgaacttcaaggcagagcgcgtcattgaccctcggagatgcatgaaacctgtgatcctgaccgacggagaggagcgggtgatcttagccgggccaatgccggtaacgcattcatctgccgcccagcgccgcggccggattgggcgcaacccgaagaacgagaacgaccagtacatctacatgggcgagcccctcgagaacgacgaggactgtgcgcattggaaggaggccaagatgttactggataacatcaatacccccgagggcatcatcccgtccatgttcgagcccgagcgggagaaggtggacgccattgacggggagtaccgcctccggggcgaagcccgcaagacattcgtggacctgatgcgacgcggggacctgcccgtatggctcgcttacaaggttgcggccgagggcatcaactacgcagaccggaagtggtgcttcgacgggattaaaaataaccaaatactggaggagaacgtggaggtcgagatctggaccaaggagggcgagcgcaagaagctgaagccgcggtggttagacgctcggatctactcggatcccctggccctgaaggagttcaaggagtttgccgccggccggaagtccctcacgctgaacctgatcaccgagatggggagactccctacctttatgacccagaaagccaggaacgccctggacaacctggcggtactccatacggcagaagtgggcgggaaggcctacacccacgccctgagcgaactgcctgagaccctcgaaaccctgctgttgctgactctgcttgcgaccatcaccggcggcatctttttattcctgatgtccgggaagggcatcgggaagatgaccctcggcatgtgctgcatcatcaccgcgagcatcctgctgtggtacgcccagatccaaccgcactggatagccgcctccatcatcctcgagttcttcctcatcgtcctcctcatccccgagcccgagaaacagcgcacaccccaggacaaccaactgacctacgtggtcatcgccatcctgaccgtggttgcggccactatggccaacgagatgggattcctcgagaaaacgaagaaagacctggggttcggcacgatcaccactcaggagagcgaaagcaacatactggacatcgaccttcggcccgcctccgcctggacgctttacgcggtggccaccaccttcgtgacccccatgctgcgccacagcatcgagaactcctcagtcaacgtctccctcacggccatcgccaaccaagccaccgtgctaatgggtttaggcaaggggtggccactaagcaagatggacattggcgtgcccctactggccatcgggtgctactcccaggtaaacccgataaccctcaccgccgccctgctgctcttagtggctcactacgcgataataggcccagggctgcaagccaaggccacgcgtgaggcccagaaacgagcggctgctgggatcatgaagaacccgaccgtggacggcatcaccgtaatcgacctcgagccgatcccgtacgatcccaagttcgaaaagcagctgggccaggtgatgctgttgatcctgtgtgtgacccaggtcctgatgatgcggacgacctgggctctgtgcgaggccctgaccctggccaccggcccgatcagcacgctctgggaggggaaccccggccggttctggaacaccacaatcgccgtgtccatggccaacatcttccgcggcagctatctcgccggcgctggtcttctgttctccatcatgaaaaacactactaacacacggcgcgggacaggcaacgtgggcgagacccttggggagaagtggaagtcacggctgaacgcgctcggcaagtccgagttccagatctacaagaaatccgggatccaggaggtcgaccgtacgctggcgaaagagggcatcaagcgcggggagacagaccaccacgccgtgtcccgcggctccgcaaagctgcggtggttcgtggaacgcaacatggtcacaccggaaggcaaggtggtggacctcggctgcggccggggcgggtggtcctactactgcggtggtctgaagaacgtcagggaggtcaaggggctgaccaagggcgggcccgggcacgaggagcccatccccatgagcacgtacggttggaacctcgtgagactgcagtccggggtcgacgtgttcttcacgccgcccgagaagtgcgacaccctgctctgcgatatcggcgagagcagccccaaccccacaatcgaggccggccgcaccctgcgggtgttaaacctagtagagaattggctgaataacaacacgcagttctgcatcaaggtgctcaacccgtatatgccctccgtgatcgaaaagatggagaccttacagcgcaaatatgggggcgcgctggtccggaaccctctgagccgcaactccacccacgagatgtactgggtgagcaatgccaccgggaacatcgtgtcaagcgttaacatgatctcccggatgctgattaatcgcttcacgatgaagcataagaaggccacctacgaaccggacgtggatctcggcagtgggacccggaatatcggcattgaatccgagatccctaacctggacataatcggtaagcgcatcgagaagatcaagcaggagcacgagacctcatggcactacgaccaggaccacccgtacaagacgtgggcctaccacggctcctatgagaccaagcagacgggcagcgcctccagcatggtaaatggggtcgtgaggcttctcaccaagccctgggatgtggtaccgatggtgacgcaaatggcgatgaccgacaccaccccattcggccagcagcgggttttcaaggagaaggtcgacacccgcacccaggagccgaaggagggtaccaagaagctgatgaagatcaccgcagagtggctgtggaaggagctcgggaaggagaaaacgcccaggatgtgtacgagggaggaattcacccggaaggtgcgctccaacgcggccctgggcgccatcttcaccgacgagaacaaatggaagtccgcgcgcgaggctgtggaggacgggcgtttctgggagctggtcgaccgggagcgcaacctccatctggagggcaaatgcgagacgtgcgtgtataacatgatggggaagagagagaagaagctgggcgagttcgggaaggcgaagggttcccgcgccatctggtacatgtggctcggcgctcggtttctggagttcgaggccctggggttcctcaacgaggaccactggttcagccgcggcaattccctgagcggggtggagggcgagggccttcacagactcgggtacattcttcgcgaggtcgggaagaaggagggcggtgccatgtacgccgacgacaccgccggctgggacactcggatcacactggaggacttgaagaacgaggagatggtgaccaaccacatgaagggggagcacaaaaagctggcggaggcaatcttcaagctgacctaccagaataaggtagtgcgcgtgcagcggccgacgcccaggggcaccgtcatggacataatatctcggaaagaccagcgcgggtccggccaggtgggcacctacggcctcaacaccttcaccaacatggaggcacagctgatacgccagatggagggagaggggatctttaaaagcatccagcacctgaccgccacggaggagatcgccgtgcagaactggctcgcgcgagtcggcagggagcgattatcccgcatggcgataagcggggacgactgcgtggtgaagcctatcgacgaccggttcgccagtgcgctgactgccttaaacgacatggggaaggtccgtaaggacattcagcagtgggagcccagccggggctggaacgactggacccaggtaccgttctgcagtcaccatttccacgagttagtgatgaaggacggccgcgtcctggtagtgccttgcagaaaccaggacgaactcatcggccgcgcacggatcagccagggggccggctggtctctgaaggagaccgcctgcctgggcaagagctacgcgcagatgtggaccctaatgtatttccaccgccgggatcttcgcctggccgcgaacgccatctgcagtgcggttcccagccactgggtgcccacgtcccgaacgacctggagcatccacgcaaagcatgagtggatgacgacagaggatatgctcgcggtatggaaccgagtttggatccaggagaacccgtggatggaggacaagacccccgtggagagctgggaggaggtgccctacctggggaagcgggaggaccagtggtgcgggagcctgatcggcttgacctcccgagccacctgggccaagaacatccaaactgccatcaaccaggttcggagcctgatcggcaacgaggggtacaccgactacatgcctagtatgaagcgctttcgcaaggaagaagaggaggccggcgtgctgtggtga

SEQ ID NO: 24911 - RNA, 9876 nt, synthetic construct
  misc_feature 1..9876: note = derived and/or modified CDS sequence (opt11) from DENV-2__GQ868549__SS-prME
  source 1..9876: mol_type = other RNA
accgccggagtgatcgtgatgctgatccccaccgccatggcgttccacctcaccacccgcaacggggagccccacatgatcgtgggccggcaggagaaggggaagtccctgctgttcaagaccgaggacggcgtgaacatgtgcacgcttatggcaatcgacctgggggagctgtgcgaggacaccatcacctacaaatgtcccttgctccgccagaacgagcccgaggatatcgactgctggtgcaactcgacctcaacctgggtcacatacggaacctgtacgaccaccggcgagcaccggcgcgagaaacggtcggtggctctggtgccccacgtcggcatgggtctcgagacccgcaccgagacctggatgagctccgagggtgcctggaagcatgtgcagcggatcgagacctggatcctccgccacccgggcttcacaatcatggccgcgatcttggcttataccatcgggaccacgcatttccagcgcgcgctcatcttcatcctgctgaccgccgtggcgcccagcatgaccatgcgctgcatcggcatctccaaccgggacttcgtcgagggagtgagcgggggctcctgggtggacatcgtcctcgagcacgggagctgcgtcactactatggccaagaacaagcccaccctggacttcgagttgatcaagaccgaggccaagcagcccgcaaccctccgcaagtactgcattgaggccaagctgacaaacaccactaccgagagccgttgcccgacgcagggtgagcccagcctgaatgaggagcaggacaagcgcttcatctgcaagcacagtatggtggaccgcggctgggggaatggctgcgggctgttcggcaagggcggaatcgtgacctgcgcgatgttcacctgcaagaagaatatggagggcaagatcgtccagcccgagaatttagagtacaccatcgtgataacgccccacagcggggaagagcacgccgtcggcaacgacaccggtaagcacggcaaggagataaagataaccccgcagtccagcaccaccgaggccgagctgacggggtacggcaccgtgaccatggagtgcagcccccggactggcctcgacttcaacgagatggtgctgctgcagatggaggacaaggcctggctcgtgcaccggcagtggttcctggacctgccgcttccatggttaccgggggccgacacgcaaggcagcaactggatccagaaggagaccctggtgacgttcaaaaacccccatgcgaagaagcaagacgtggtcgtgttggggtcccaggagggcgccatgcacaccgctctaacgggggccaccgagatccagatgagcagcggcaacttactgttcacaggccacctgaagtgccgtctgcggatggacaaactccagctgaaggggatgtcctacagcatgtgcaccggcaagttcaagatcgtcaaggagatcgccgagactcagcacggaaccatcgtgatccgcgtgcagtacgagggcgacggcagtccctgcaagatccccttcgagatcaccgacctggaaaagcggcacgtcctcgggcgcctgatcaccgtgaacccgatcgtgacggagaaggacagccccgtcaacatcgaggcggagcctcccttcggcgactcctacatcatcgtgggggtggagccgggccagctgaagctcaactggtttaaaaaggggagcagcatcggccagatgttcgagaccaccatgcgcggagccaagcggatggccatcctgggggacacagcctgggacttcggctcactcggcggggtcttcacgtccatcgggaaggccctccaccaggtattcggggcgatctacggcgctgccttcagcggggtgtcttggaccatgaagatcctgattggcgtaatcatcacctggatagggatgaacagccgctcgaccagcctgtccgtgagcctggtgcttgtcggcgttgtgacgctgtacttgggggccatggtgcaagcggattcaggctgcatcgttagctggaaaaacaaggagctcaagtgcggctccgggatcttcatcaccgacaacgtgcacacgtggaccgagcagtacaagttccagcccgagagccccagcaagctggcctccgccatccagaaggcccacgaggagggcatctgcggaatacggagcgtcacacgcctggagaacctcatgtggaaacagatcacccccgagctgaaccacatcctgtccgagaatgaggtgaagctcacgataatgaccggcgacatcaaggggatcatgcaagccggcaagagaagcctgcgcccgcagcccacggagctgaaatattcctggaagacctggggcaaggctaaaatgctcagcaccgagtcccacaaccagaccttcttaatcgacggtcccgagacggctgagtgcccgaacaccaaccgggcctggaacagcctggaagtggaggattacggtttcggggtcttcaccactaacatctggctcaagctgcgggagaagcaggacgtgttctgcgactccaagcttatgagcgccgccatcaaagacaaccgggcagtgcacgccgacatgggttactggatcgagtccgccctcaatgacacgtggaagatggagaaggccagcttcatcgaggtcaagtcctgccactggcccaagtcacacacgctgtggtctaacggtgtgttagagagcgagatgattatccctaagaacttcgccggacccgtctcacagcacaattaccgccctggctaccacacccagaccgcgggaccgtggcacctcggcaaactggagatggattttgacttctgtgaggggaccactgtcgtggtaaccgaggactgcggcaaccgtggccctagccttcgcaccaccactgccagcgggaagctcatcaccgagtggtgctgccggtcctgcacgctgccccctctgcgctaccgtggcgaggacgggtgctggtatggcatggagatacgcccgctcaaggagaaagaggaaaacctggtcaacagcctggtgaccgccgggcacggccagatcgataacttctccctcggcgtgctgggcatggccctgttcttagaggagatgctacggacgcgcgttgggactaagcatgcgatcctgctcgtcgccctgtctttcgtgactcttatcaccgggaatatgtccttccgggacctcggccgcgtcatggtgatggtgggagccacgatgacagacgacataggcatgggcgtcacctacctggccctgctcgccgcgttcaaagtgcgccccaccttcgccgcgggcctgttgctccgtaagctgacgagcaaagagctgatgatggccaccatcggcatcgcccttctgtcccagagcaccctgcccgaaaccatcctcgagctgacggacgctctggcactcggaatgatggccctgaagattgtgcgcaatatggagaagtaccagctggccgtcaccatcatggcaatctcatgcgtgccgaacgccgtgatcctccagaacgcgtggaaggtcagctgcaccatactggccgccgtgtccgtgagccccctgctcctcacctcgagccaacagaaggctgactggatacccctggccctcacgattaagggcctgaaccccactgccatcttcctgaccaccctctcccggacgtctaagaagcgctcctggccgctgaacgaggccatcatggccgtaggcatggtgagcatcctggcgtccagcttactgaaaaacgacatccccatgaccggacccctggtggccggcgggctcctgaccgtgtgctacgtgctcacgggccggtcagccgacctcgagctggagcgcgccgcggacgtaaagtgggaggaccaggcggagatatccgggagctcgcccatcctgtccatcacgatctccgaagacggcagcatgtccatcaaaaatgaggaggaggagcagactttaaccatcctgatccggaccggcctgttagtgatcagcggggtgttccccgtcagcatccccatcaccgccgcggcctggtatctgtgggaggttaagaagcaaagagccggcgtgctgtgggacgtcccctcgccgccgccagtgggaaaggcggaattggaggacggcgcctacaggatcaagcagcggggtatcctgggctactcccagatcggcgccggggtgtataaagagggcacgttccacaccatgtggcacgtcacccgcggggccgtgcttatgcaccgaggcaaacggatcgagcccagctgggccgacgtgaaaaaagacctcatttcctacggggggggctggaagctagagggggagtggaaggagggagaggaagtccaggtgcttgcgttggagcccggaaagaacccccgcgccgtgcagaccaagcccggcatcttcaagacaaataccgggaccatcggcgccgtctcactggacttctcccctggcaccagcggatcccccatcgtggaccggaaaggcaaggtggtcgggctgtacggcaatggcgtggtgacgcgcagcggagcctacgtctccgcgatcgcccagaccgagaagtctatcgaggacaaccccgagatcgaggacgacatattccggaagaagcgcctcaccatcatggatctgcacccgggcgccggcaagacgaagcggtacctgcccgcgatcgtgcgcgaggccatcaagcggggcctgcgcacgctcatcctggcgcccacccgcgtggtcgccgccgagatggaggaggctctgcggggcctcccgatccggtaccagacccccgccatccgggcggaacacaccggccgcgagatcgtggatctgatgtgccacgccacgttcaccatgcggctgctgagccccgtgcgcgtcccgaactataacctgattatcatggacgaggctcacttcaccgaccccgcctccatcgccgcgcggggctacatcagcacccgagtggagatgggggaggccgccggcatattcatgacggccactccgcccgggtcccgggatccgttcccacagagcaacgcgcccataatggacgaggagcgcgagatccccgagcgctcgtggaacagcggccacgagtgggtgaccgacttcaaggggaagaccgtctggtttgtgccaagcataaaagccggcaacgatattgccgcctgcctgcgcaagaacggcaaaaaggtgatccagctcagccggaagacgttcgactccgaatacgtgaagacccgcgccaacgactgggacttcgtggtgaccaccgacataagcgagatgggcgcgaacttcaaagccgagcgggtcatcgaccccagacggtgcatgaagcccgtgatcctgacggacggcgaggagcgcgtgatcctggccgggcccatgccggtcacacactccagcgcagcccagcgtcgcggtcgcatcgggcggaatccgaagaacgaaaacgaccagtacatctacatgggggagcccctggagaacgacgaggactgcgcgcactggaaggaggctaagatgctgctggacaacatcaacaccccagagggcatcatcccttccatgttcgagcccgagcgtgagaaggtggacgccatcgacggggagtaccggctccgcggcgaagctcggaagaccttcgtggacctgatgcgtcgcggggacctccccgtctggctcgcctataaggtggcggccgagggcatcaattacgccgaccgcaagtggtgcttcgatgggatcaagaataaccagatcctggaggagaacgtggaggtcgagatctggacgaaggagggcgagcggaagaaactgaagccccgctggctcgacgcccggatctactcggaccccctggcgttgaaggagttcaaggagttcgccgccggccgcaagtccctcacactgaacctgatcaccgagatgggtaggctcccaaccttcatgacgcagaaggccaggaacgccctggataacctggcggtgctccataccgccgaggttggcgggaaggcctatacccacgccctgagcgaactgcccgagacgctcgagacgctgctgctcctgaccctgctcgcggcggtcaccggcgggattttcctgttcttgatgtccgggaagggcatcgggaagatgaccctcggcatgtgctgcatcatcaccgccagcatcctgctgtggtacgcacaaatccagccacactggatcgccgcctccatcatcctggagtttttcctgattgtcctgctcatccccgagcccgagaaacagcggacaccccaggacaaccagctgacctacgtcgttatcgcgatcctgaccgtagtcgccgccaccatggccaacgagatgggattcctcgaaaagacgaagaaggacctgggcttcggcagcatcacaacccaggagtcggagtccaacatcctggacatcgacttgcgccccgcaagcgcgtggacactctacgccgttgccacgacgtttgttacccccatgcttcggcactccatcgagaacagctccgtaaacgtgagtctcaccgccatcgcgaaccaagccacggtgctgatgggactgggcaaggggtggcccctctccaagatggacatcggcgtcccgctgctggccatcgggtgctacagccaggtaaacccaatcaccctcacagccgccctgctgctcctggttgcgcactacgcgataatcggccccggcctgcaggccaaagccactcgcgaggcccagaagcgggcggcggccgggatcatgaagaaccccacggtcgacgggatcaccgtgatcgacctcgagcccatcccatacgaccccaagtttgagaagcagctggggcaggtcatgctgctcatcctgtgcgtaacccaggtgctgatgatgcgcaccacgtgggccctctgcgaggccctgaccctggcgaccggccccatctccaccttgtgggagggcaaccccggccggttctggaacacgaccatagcggtgtccatggccaacatcttccgcggctcctacctggccggggccggcttactgttcagcatcatgaaaaacacaaccaacacgcggagagggaccggcaatgtcggcgaaactttaggggagaagtggaagtcccgcctgaacgccctcggcaagtcggagttccagatctacaagaagtccggtatccaggaggtggaccggacgctggccaaagagggcatcaagaggggggagacggaccaccatgctgtgagtcgcggctctgccaagctgcgctggttcgtcgaacggaacatggtgaccccggagggcaaggtggtcgacctcgggtgtggccgcgggggctggagctactactgcgggggccttaagaacgtgcgggaggtgaagggcctgacgaagggcggtccgggccacgaggagcccatccccatgtccacctatggctggaatctcgtccgcctgcagagcggcgtggacgtgttcttcacaccgcccgagaagtgcgacaccctgctctgcgacatcggcgagagctcccccaaccccaccatcgaggcgggtcggaccttacgcgtcctgaacctcgtggagaactggctaaacaacaacacccagttctgcatcaaagtgttgaatccgtacatgcccagcgtcattgagaagatggagacactccagcggaagtatggcggcgccctggtgcgcaaccccctgtcccggaacagcacacacgagatgtactgggtgtccaacgccaccgggaacatcgtcagctccgtaaacatgatcagccgcatgctgatcaaccggttcactatgaaacacaagaaagccacgtacgagccggatgtggatctcggctccggaacccgcaacatcggaatcgagagcgagatccccaacttagacatcatcggcaagcggatcgagaagatcaagcaggagcacgagacctcctggcactacgaccaggaccacccatacaagacctgggcctaccatgggagctatgagacgaagcagaccggatccgctagctccatggtcaatggggtggtgcgcctgttaaccaagccctgggacgtcgtcccgatggtgacccagatggccatgacggacacaacccccttcggccagcagcgcgtttttaaggagaaggtggacacccggacgcaggaacccaaggagggcactaagaagttaatgaagatcaccgccgagtggctgtggaaagagctcgggaaggagaagacgccccgcatgtgcactagggaggagtttacaagaaaagttcggagcaacgccgccctgggagcggtcttcaccgacgagaacaagtggaagagtgcacgcgaggccgtggaggacgggcggttctgggagcttgtcgaccgcgagcggaacctccacctggaaggcaagtgcgagacctgcgtctacaacatgatgggaaagcgcgagaagaagctgggcgaattcggcaaggccaaggggagccgagcgatctggtacatgtggctcggcgcccgcttcctggagtttgaagctctggggttcttgaacgaggatcactggttttccagaggcaacagcctgtcaggggtggagggcgaaggattacaccgcctggggtacatcctgcgggaggtcggcaagaaggagggaggcgccatgtacgccgacgacacggccgggtgggacacccgcatcaccctggaggacctcaaaaacgaggagatggtaaccaaccatatgaaaggcgagcacaagaagttagccgaggccatctttaagctgacgtatcagaataaggtggtccgggtccagcgcccaactccccggggcactgtgatggacattatatcccgcaaggaccagcgggggagcggccaggtcgggacctacggcctcaacacgttcacgaacatggaggcccagctgatccgccagatggagggcgaggggatcttcaaatccatccagcacttgacagccaccgaggaaattgccgtacagaactggctcgcacgcgtgggccgggagcgcctgagccggatggccatctcgggggacgactgcgtcgtaaagcccattgacgaccgcttcgctagcgccctgacggcgctcaacgatatgggaaaggtccggaaggacatccagcaatgggaaccgtcgcgcgggtggaacgactggacccaggtcccgttctgcagccaccattttcacgagctggtgatgaaggacggccgggtgctggtcgtgccctgccgaaatcaggacgaactcatcggcagggcccgcatctcccaaggggccggctggagcctgaaggagaccgcctgcttagggaagtcatacgcccagatgtggacactcatgtacttccaccggcgcgacctccggctggcggccaacgccatatgcagcgccgtgccatcccactgggtccccacgagtcgtactacctggtccatccacgccaagcacgagtggatgaccaccgaagatatgctggcggtttggaaccgggtgtggatccaggagaatccttggatggaggacaagacgcccgtcgaaagctgggaggaggtgccctacctgggcaagcgcgaggaccagtggtgcgggtccctgatcggcctcacctcccgggccacctgggccaagaacatccagacagccatcaatcaggtacgcagcttgatgggcaacgagggatacacagactacatgccctccatgaagcggttcagacgcgaggaggaggaggcgggcgtcctgtggtga

SEQ ID NO: 24912 - RNA, 9876 nt, synthetic construct
  misc_feature 1..9876: note = derived and/or modified CDS sequence (opt11) from DENV-2__GQ868551__SS-prME
  source 1..9876: mol_type = other RNA
accgcgggcgtaatcgtcatgctgatccccacagctatggcattccacctcaccactcgcaacggggagccccacatgatcgtcggtcggcaggagaaggggaagtctcttctgtttaagaccgaggatggcgtgaacatgtgtaccttaatggctatagacctgggggagctctgcgaggacaccatcacgtataagtgccccttactgcgccaaaatgagcccgaggatatcgactgctggtgtaatagcacgagcacctgggtaacgtacggaacctgcaccaccacgggagagcatcggcgcgaaaagaggtcggttgccctagtgccccacgtcgggatgggcctcgaaaccagaacagagacctggatgagttccgagggggcctggaaacacgtgcagcggatcgagacatggatattgcgccacccgggtttcaccatcatggccgcgatcctggcctacaccataggtacaacgcatttccagcgcgccctcatattcatcctgcttaccgcagtggcgcccagcatgaccatgaggtgcatcggcatctccaaccgtgactttgtcgagggcgtaagcggcggctcctgggttgacatcgtactcgagcacggatcttgcgtgacgacgatggccaagaacaagccaaccttggactttgagttaatcaagaccgaggccaagcagcccgccacgctccgcaagtactgcatcgaggcaaagctgacgaacaccacaactgagagtcggtgtccgacgcagggagaacccagcctgaacgaggaacaagacaagcgcttcatatgtaagcactccatggtggaccggggctgggggaacgggtgtgggttgttcggcaagggcggtatagtgacctgcgccatgttcacgtgcaagaagaacatggaaggcaagatcgtgcaacccgagaaccttgaatacaccattgtgatcacgccccatagtggggaggaacacgccgtcggcaacgacaccgggaagcacgggaaggaaattaaaatcactccgcagtcgagcaccaccgaggccgagctgacgggttacggcacagtaacgatggagtgcagcccacgcaccggattagactttaatgagatggtacttctgcagatggaggacaaggcctggctcgtccatcggcagtggttcctggacctccccctcccgtggctgccaggggcagacacgcagggctccaactggatccaaaaggagacccttgttaccttcaagaatccccacgcgaagaagcaggacgtggtagtgctcgggtcccaggagggtgccatgcacaccgccttgacaggagccactgagatccagatgtcttccggcaacctcctcttcaccggacatctgaagtgccgcctgcggatggacaagctccagctgaaggggatgtcgtatagcatgtgcacgggcaagttcaagatcgtcaaggagatcgcagagacgcagcacgggacgatcgtgattagggtgcagtacgagggagacgggtccccgtgcaagatccccttcgagatcaccgacctggaaaagcgacacgtactcgggcggctgattaccgtgaatcccatcgtgacagaaaaggactctcccgtcaatatagaggcggagccgccctttggtgactcctacatcatcgtgggggtggagcctggccagctgaagctcaactggttcaagaaggggagctccatcggccagatgttcgagaccacaatgcgaggcgcaaagcggatggcgatcctcggggacaccgcctgggacttcgggagtctcggcggtgtcttcacctccatcgggaaggctttgcatcaggtgtttggggcgatatacggagccgccttcagcggcgtgagctggacgatgaagatcctgataggggtcataataacctggatcggtatgaacagccgttccacgtccctgagtgttagtctggtgctagttggagtggtcacgctgtacctgggggccatggtccaggcggactccggatgcatcgtcagctggaagaacaaggagctcaagtgcggctccggcatcttcattacggacaatgttcacacctggaccgagcagtacaagttccagcctgagagccccagcaagctggcctccgccatccagaaggcccacgaggagggcatctgcgggatccgcagcgtcacgcgcctggagaacctcatgtggaagcagatcacccccgagctgaaccacatcctgtcggagaatgaggtgaagctcacaatcatgacgggcgacattaaaggtatcatgcaggccggaaaaaggtcactgcgcccacagcctacggagctcaagtactcctggaagacctggggcaaggtaaagatgctctcgaccgagtcgcacaaccagacctttctcatagacgggcctgaaacggctgagtgcccaaacaccaatcgggcgtggaactcattagaagtggaggactatggcttcggtgttttcaccaccaatatctggctcaagctccgcgagaaacaggacgtgttctgcgactccaagcttatgtccgccgccatcaaggacaatcgtgccgtacacgccgacatgggctactggatcgagagcgctctgaacgacacgtggaagatggaaaaggccagcttcatcgaggtgaagtcctgccattggcccaagagccacacactgtggtctaatggcgttctggaaagcgaaatgattatccccaagaatttcgccggccccgtgtcccaacacaactacaggccgggctaccacacccagaccgcaggtccctggcatctcggcaagctggagatggactttgacttctgtgaggggactacggtagtggtcaccgaagactgcggcaaccggggcccctcgttgaggaccactacggcgtccgggaagttgatcacagagtggtgctgccggagctgcactctgcccccattacgataccggggcgaggacgggtgctggtacggcatggagatacgccccctgaaggagaaagaggagaacctggtgaacagcttagtgacggccggccacggccagatcgacaacttctctctcggcgttctggggatggcactcttcctcgaggaaatgctccgcacacgggtgggcaccaagcatgccatattgctcgtggcactgagcttcgtaaccctgattaccggaaacatgtccttccgggaccttggtcgcgttatggttatggtcggggccactatgaccgacgacatcggcatgggcgtgacctatctggcgctgctcgccgccttcaaagtgcgacctaccttcgcggcaggtctgctgcttcgcaaacttacgagcaaagagcttatgatggctaccataggcatcgccctgctgtcccaaagcacccttccggagaccattctggagctgacggatgccctagcactcggcatgatggccctgaaaatagttcgtaatatggagaaataccagctggcagtgaccatcatggctatctcttgcgtgccgaatgcagtgatcttgcagaatgcgtggaaggtatcctgcaccatcctggccgccgtgtctgtcagtcccctgctgctgaccagtagccagcagaaggccgactggatccccctggcgctcacgatcaagggcttgaatcccaccgcaatcttcctgactaccttaagccggacctccaagaaacgatcctggcctctgaacgaggccattatggccgtcggcatggtgagcatcctggcttccagccttttaaagaacgacattccgatgaccggccccctggtggccggcggcctcctgacggtgtgctatgtcctgaccggccggagcgccgacctagagcttgagcgggctgccgacgtaaaatgggaggatcaggccgaaatctccgggtcatcccccatccttagcatcactatctccgaggatggctcgatgtccatcaagaacgaggaggaggagcagaccctcaccattctgatccggactggcctcttagtgatctctggggtcttccctgtgtccatccccataaccgccgccgcctggtacttgtgggaggtgaaaaaacagcgagccggggtcctgtgggacgtgcccagcccgcccccggtagggaaagcggagcttgaagacggcgcgtaccgtattaagcagcgaggaatcctgggctactcccagatcggcgccggggtctacaaggagggaacgttccacaccatgtggcatgtgacccgaggtgccgtgcttatgcaccgcggcaagcgtatcgagcccagctgggcagacgtcaaaaaggacctcattagttacgggggcggatggaagctcgagggcgagtggaaggaaggcgaggaggtccaggtcctggccctcgaacccggcaagaacccacgcgcggtccagacgaagcccggcatcttcaagacgaacaccggaactataggagcagtgtctctggacttctctcccggcacctcgggctcccccatcgtagatcggaagggtaaggtcgtcgggctgtacggcaacggcgtggtcactcgcagcggggcctacgtgtccgctatcgcgcaaaccgaaaagtcaatcgaggacaaccccgagatagaagacgatatcttccggaaaaagcgcctcaccatcatggacttgcaccccggagccgggaagaccaagcggtacctgcccgccatcgttcgcgaagccatcaagcggggtttacgcacgctgatactggccccgacccgggtcgttgcggccgagatggaagaggccctgaggggtctccccattcgctaccagacccccgctatccgggccgagcataccggccgagaaatcgtggacctgatgtgccacgcaacgttcaccatgcggctgctcagccccgtccgagtcccaaactacaacctgatcatcatggacgaggcccactttaccgaccccgcctccatcgcagcgcgcggctacatcagcacccgcgtggagatgggggaagccgccggtatcttcatgacggccacgccgcccggatcccgggaccctttcccccagagcaatgccccaattatggacgaggaacgtgagatccccgagcggtcgtggaacagcggccacgagtgggtcaccgacttcaagggtaagacggtctggttcgtgccgtccatcaaggctggaaacgacatagctgcatgcctgcgcaagaacggcaagaaggtcatccagctcagcagaaagaccttcgactcggagtacgtaaagaccagagccaacgactgggactttgttgtgaccaccgacatctccgagatgggggcaaacttcaaagcggagcgcgtgatcgaccccagacggtgcatgaaacctgtgatcctgacggatggggaagagcgggttatactcgccgggccaatgccagttacccactccagtgccgcccagcggcgcggacgcatcggtaggaaccccaagaacgagaacgaccagtacatttacatgggcgagccactcgagaacgatgaggattgcgcccactggaaagaagcgaagatgctgctggacaacataaacactcccgagggcatcatcccgtccatgttcgagcctgagcgcgagaaggttgacgccatcgacggggagtaccgattacgcggcgaggcccggaagacctttgtggacttgatgcgccgcggggacctacccgtatggctcgcctacaaggtggccgctgagggtatcaactatgcggaccgcaagtggtgcttcgatgggatcaagaacaaccaaattctagaggagaacgtcgaggtcgagatctggactaaggagggcgaacggaagaagttaaaaccgcgctggcttgacgcccgaatatactctgacccactggccctgaaagaattcaaggagttcgcggcaggccgcaagtccctaacgctcaacttgataaccgagatgggtcgcctcccgaccttcatgacgcaaaaggcccggaatgccctggacaacttagcagttcttcacacagccgaggtcggcgggaaggcgtacacccacgccctctctgaactgccagaaaccttagaaacgctgctgctcctgaccctgcttgccgccgtcaccggcggcatctttctgtttcttatgagcgggaagggaatcgggaaaatgaccttgggaatgtgttgcattataacggcgagcatcctgctgtggtacgcacagatccaacctcactggatcgccgccagtattatcctcgagttctttttgatcgttctgctcatccccgaacccgagaagcaacggactccacaggacaaccagctgacctacgttgtgatcgcgatcttaaccgtggtcgctgccacgatggcaaatgagatgggtttccttgagaagacgaagaaggatctgggctttggcagcatcacgacacaggaaagtgagtccaacatcctagacatcgacctccgcccggcaagcgcatggactttgtatgctgtggctacgaccttcgtcacccctatgctgcggcactctattgaaaacagctcggtgaatgttagtctcaccgccatcgccaaccaggcaacggtcctgatggggctgggcaaagggtggcccttatccaagatggacatcggcgtgccccttttggctatagggtgctacagccaggtgaaccccatcaccctcaccgccgccctgctgttactagtagcccactacgccatcatcggccccggcctgcaggctaaggccacccgcgaggcacagaagcgggccgcagccgggatcatgaagaatcccaccgtggacggcatcacagtgattgacctcgagcccatcccgtacgaccccaaatttgagaaacagctagggcaggtcatgctgttgatcctctgcgtcacccaggttcttatgatgcgcaccacgtgggctctctgcgaggccctgaccctagccacaggccccatctccaccctctgggaggggaaccccggccggttctggaacacgaccatcgcagtcagcatggccaatatcttccgcggctcctacctggccggcgccggtcttctgttcagcatcatgaagaatactaccaacacgcgcagggggaccggcaacgtaggcgagacgctaggggagaagtggaaatcccgtctgaacgcgctcggcaagtcagagtttcagatatacaagaagtccggtatacaggaggtagaccggacgctggccaaggagggcatcaagcgcggggagactgaccaccacgcggtctctcggggtagtgccaagctgcggtggttcgtggagaggaacatggtgaccccggagggcaaggtcgtggacctcgggtgcggccgcggcggttggagctactactgcggaggcctgaaaaacgtacgggaggtgaagggcttgaccaagggcggaccaggtcacgaggagcccatacccatgtccacctacggatggaacctcgtacgcctgcagagcggcgtggatgtcttcttcacgccgcccgagaagtgcgataccttgttatgcgatatcggcgagagctcccccaacccgaccatcgaggccggccggaccctgcgcgtgctgaacctcgtggagaactggctaaacaataatacccagttctgtatcaaggtcctgaacccgtatatgcccagcgtaatcgagaaaatggagacgctccaacggaagtatgggggcgcgttggtccgcaatccactgtcccggaatagcacccacgagatgtactgggtgtccaatgctaccgggaacatagtttcaagcgtaaacatgatttcccgcatgctaattaaccggtttaccatgaaacacaaaaaggccacgtacgagccagacgtcgaccttggcagcgggacccgcaatatcggcattgaaagcgagatacccaacctggacataatcggaaagcggattgagaagatcaagcaggagcatgagaccagctggcactacgaccaggaccacccctacaagacctgggcctaccacgggtcatacgagacgaagcagaccggtagcgcctcgtccatggtgaatggggtggtacgcctgttaaccaagccatgggacgtggtgccaatggtgacacagatggccatgacggacaccaccccgttcgggcagcagcgcgtgttcaaagagaaggttgacacccggactcaggagcccaaggagggtaccaagaagctgatgaagatcaccgccgaatggctgtggaaggagctcgggaaggagaagacgccccggatgtgcacgagagaggagttcacccgcaaggtccggtccaacgccgccctgggcgcggtgttcaccgacgagaacaagtggaagagtgcgcgtgaggccgtggaagacgggagattctgggagctggttgaccgcgagcgcaacctccacctggagggcaagtgcgaaacttgcgtgtacaacatgatgggcaaacgagagaaaaagctgggtgagttcggcaaggccaaagggtcccgggcgatctggtacatgtggctcggcgcgcgcttcttggagttcgaagccctgggtttcctcaacgaggatcactggttcagccgagggaatagcctgagcggggtcgagggcgaaggcctgcaccgtctcgggtacattctgcgggaggtgggcaagaaggaagggggcgccatgtacgccgacgacacggccggttgggatacccgtatcacattagaggatctcaagaatgaggagatggttaccaaccatatgaagggcgagcacaagaagctagcggaggccatcttcaagctgacgtaccagaacaaagtcgtgcgagtgcagcgcccaacccccagggggaccgtaatggacataatctcccgcaaggaccaacgagggtcaggacaagtggggacctacggcctcaatacgttcacgaacatggaggcccagctgatccgccaaatggagggcgagggaatcttcaagtccatacagcacctcacggccacagaggagatcgccgtgcagaactggctcgcccgcgtcggacgggaacggttgagccgaatggccatctccggggacgactgcgtggtcaaaccgatcgacgatcgcttcgcaagcgcgctaacggccctcaacgacatgggcaaggtcagaaaggatatccagcagtgggagccttccagagggtggaacgactggacccaagtgccgttctgcagccaccactttcacgagctggttatgaaggacggccgggtactggtggtgccctgccgcaatcaggatgaactcatcggccgggcgcgcatctcccagggggccggctggagcctgaaagagaccgcttgcctgggaaaatcctacgcccagatgtggaccctcatgtactttcacaggcgcgacctgcgactggccgcgaacgccatctgctcagcagttccgtcccactgggtgcccacaagccgcactacctggtccatccacgccaagcatgagtggatgacgacggaggatatgctcgcggtttggaaccgggtatggatccaggagaacccgtggatggaggacaagacacccgttgagagctgggaggaggttccgtacctgggcaaacgagaggaccagtggtgcgggtccctcatcggcctcaccagtcgggcaacttgggccaagaacatccaaaccgctattaaccaggttcgcagcctgatgggaaacgaggggtacacggactacatgcccagtatgaaacggttccgccgagaggaagaggaggccggagtactgtggtag

SEQ ID NO: 24913 - RNA, 9876 nt, synthetic construct
  misc_feature 1..9876: note = derived and/or modified CDS sequence (opt11) from DENV-2__HM181971__SS-prME
  source 1..9876: mol_type = other RNA
acggctggagttatcgtaatgctaatcccgactgcaatggcattccacctaacgacgcggaacggagaaccacacatgatcgtgggacggcaagaaaaaggcaaaagcctcctatttaaaacagaagacggagtaaacatgtgcacgctcatggcaatcgacctgggcgaactctgcgaagacaccattacatacaagtgcccacttttacggcaaaacgaacccgaagacattgattgctggtgcaatagcacgagtacctgggtaacatacgggacatgtacgacaaccggagaacacagaagagagaaaagaagcgtcgcactggtcccccacgtaggcatgggcctcgaaacacgcacagaaacatggatgagctcggaaggtgcatggaagcatgttcagaggatcgagacgtggatactgagacaccccggctttaccataatggcagctatactcgcttacacgatcggaacaacgcatttccaacgggcactcatcttcatcctactaaccgcagttgcaccatcaatgaccatgcgctgtattggcataagcaaccgagacttcgtagagggtgtaagcgggggctcctgggtagacatcgtcctagagcacggctcttgcgtaacaaccatggccaaaaataaaccgacgctagatttcgagctgatcaaaaccgaagcaaaacaacccgcgacacttagaaaatactgcattgaggccaaattaaccaacaccacaaccgagagcagatgccccacccagggggaacccagcctcaacgaagaacaggataaacgcttcatatgcaaacacagtatggtggaccgcggctggggaaacggatgtggactattcggtaaaggcgggatagtcacgtgcgcgatgttcacatgcaagaagaacatggaagggaaaatagtacaacccgaaaacctcgaatacactatagtcattacaccccacagcggagaagaacacgccgtcggaaacgacaccggcaagcacggcaaagaaatcaaaatcacgccgcagagcagcaccacggaagcggaattaacggggtacggcacggtcaccatggaatgctctccacggacagggttggacttcaacgagatggtactcctacagatggaagataaagcatggctggtccatcggcaatggttcctcgacttgcctttaccatggctgccaggggccgacacgcagggcagcaactggatccaaaaagagacactcgttaccttcaaaaacccacacgccaagaaacaagacgtagtggtcctgggatcacaggagggagcaatgcacaccgcccttaccggagccactgaaatccaaatgtcaagtgggaacctcctctttaccggacacctcaaatgccgactacgaatggacaagctacagctcaaaggaatgtcgtactccatgtgtacgggcaaattcaaaatcgtcaaagagattgcggagacccaacatggcacgatcgtaatacgcgtccaatacgaaggcgacgggagtccgtgcaaaataccattcgaaatcacggatcttgagaaacgccacgtactgggacgtctcatcactgttaaccccattgtcaccgaaaaagactcaccagtaaatatcgaagcggagcccccattcggggacagttatataatagtaggtgtggaaccaggacagctgaaactgaactggttcaagaaaggaagttcaattggccagatgttcgaaacaacaatgaggggagcaaagagaatggccatattaggcgataccgcgtgggacttcggctcgctagggggagttttcacctcgatagggaaagcgctgcaccaagtcttcggagcgatctacggggccgcgttctcgggcgtaagttggacaatgaagatattgataggggtgatcatcacctggatcgggatgaactcaaggtcgacaagcctaagcgtcagcctagtcttagtcggcgtggtcacgctatacctgggagccatggtacaggcagactcgggttgcatagtatcctggaaaaataaagagctcaagtgcggaagcggaatcttcatcacggacaacgtccacacatggacagagcaatataagttccagccggaatctccatctaaactcgcctcagcaatccaaaaggcacatgaggagggcatatgcggaatccgcagtgtcacgaggctagagaacctcatgtggaagcagataacacccgaattaaaccacattctatccgagaacgaagtaaagttaacaattatgacaggggatataaaaggcattatgcaggcaggaaaacgctccctacgcccgcagcctaccgagctcaaatacagctggaagacgtggggcaaggccaaaatgctatccaccgaatcgcacaaccagacgttcctgatagacggaccggaaacagctgaatgcccgaacactaacagggcttggaatagcctagaggtggaggattacggcttcggagtctttacgaccaacatttggttaaaattgagagagaaacaagacgttttctgcgatagcaagctgatgagcgccgccatcaaggataatcgcgcggtgcacgcagacatgggctactggatagagagcgcactgaacgacacatggaagatggaaaaggccagcttcatagaggtcaaaagctgccattggccgaaaagccatacactatggagcaatggcgtactcgaaagtgaaatgatcatcccaaagaacttcgcaggcccagtaagccagcacaactacagacctgggtatcacacccaaaccgcgggcccctggcatctggggaaactcgagatcgatttcgacttctgcgaaggaacgaccgttgtcgttaccgaggactgcggaaaccgaggaccctcactccgcacaaccacagcaagtggaaaactaatcactgagtggtgctgcagatcatgcacgttacccccactacgatacaggggcgaagacggatgctggtacggcatggagatacgacccttgaaggaaaaggaggagaatctagtgaactccctagtaacagccggccacggccagattgataacttctcgctaggcgtcttggggatggccctattcctagaggagatgcttaggacccgcgttggcacaaaacacgcgatacttctcgtcgcactttcgttcgtgactctaataacaggaaatatgagttttcgagacttaggccgggtgatggtgatggtgggcgcaacaatgacagacgacatcggtatgggtgtaacatatctagcgcttttagccgccttcaaagtcagaccgacattcgcagccggcctgctactacgaaaactgacttccaaagaattgatgatggcaaccattggaattgctctgctcagccaatcaactctaccggagacaatcttagagctgaccgacgcactagccctgggaatgatggcactgaagatagtcagaaacatggaaaaataccaattggcagtgacgataatggcgatctcgtgcgtgccgaatgcggtgatactacaaaatgcatggaaagtgagctgcacgatcctggctgcagtatctgtgtcgcccttactccttacaagctctcaacagaaagcagactggatacccttggcattgacaatcaaaggcctaaatccaaccgcaatcttcctaaccactttgtcgcgaacgtccaaaaagagaagctggccgttaaacgaagcaatcatggccgtggggatggtctccatactagcttcaagccttctgaaaaacgacatacctatgacagggcctctagtggcaggagggctcctaacagtctgctatgttctcacaggccggagcgcggacctggagctcgagcgggccgccgatgtaaagtgggaggatcaagcagaaatatcggggtcatcacctatcctgagcataaccatcagcgaggacggcagcatgtccatcaaaaacgaagaagaggaacagacactgacgatactaatccgaacaggactcctagtaatatccggcgtgttccctgtcagcatcccaataacggccgctgcgtggtacctgtgggaggttaagaaacagcgcgcaggcgtattatgggacgtccctagcccgcctcccgtcggcaaagcagagctagaggacggggcatacaggataaaacagcgtggcatacttggctatagccagattggcgcaggagtgtataaggagggaaccttccacacaatgtggcacgtcaccagaggcgccgtcttaatgcacaggggcaagcggatcgaaccctcctgggcggacgttaagaaagacctcatcagctacggcggagggtggaagttagagggggaatggaaggaaggtgaagaagtccaagtcctcgcactagaacccggtaagaacccacgtgcagtgcaaacaaagcccggcatatttaagactaacactggaaccatcggggccgtatcgcttgacttctccccaggtacctccggctcgcccatcgtagacagaaaaggaaaagtcgtcggactctacgggaacggagttgtaaccaggtcgggggcctatgtatcagccatagcgcaaacggagaaatcaatcgaagacaacccagagatcgaagacgacatcttcaggaagaaacgattaactatcatggacctacacccaggggcgggcaaaaccaaacgctatctgccggctatcgtacgagaagccattaaacgtggactgcggacccttatactcgccccgacgcgagtagttgccgccgagatggaggaagctctcagaggactcccaataagataccaaacaccggctatccgagcagaacacaccggccgagaaatagtagacctaatgtgccatgcgacattcaccatgcgactcctgtcaccggtgcgggtccctaattacaacctcataattatggacgaggcgcacttcaccgacccagcgagcattgcagcacgcggatacatcagtacacgcgtcgagatgggggaggctgctgggatattcatgactgcaacgcccccaggatcacgagacccatttccgcaatccaacgccccgattatggacgaagaacgagaaatcccagaacgaagctggaactctggacatgaatgggtcacagacttcaaaggaaaaaccgtctggttcgtacccagcattaaggcagggaacgacatcgccgcctgcctaaggaaaaatggcaagaaagtaatccaactctctcgcaagacgttcgactccgaatacgtcaaaacacgagccaatgactgggacttcgtggtcacgacggacattagtgagatgggggccaacttcaaggccgaacgagtcatcgacccgagaaggtgtatgaaaccagtaatcctgactgacggggaagagagggtgatactagccggccctatgccagtaactcatagctccgccgcacaaagacgaggtcgcattggacgcaatcccaagaacgaaaacgaccaatatatctacatgggcgaaccacttgagaatgatgaggattgcgcacattggaaggaggcgaaaatgctacttgacaacataaatacccctgaagggatcattccaagcatgtttgaaccggagcgagagaaggtagatgcgatcgacggtgaatatcgattaaggggagaagcgcgtaaaacgttcgttgacttgatgcgtagaggcgacctgccagtatggctagcttacaaagtagctgcagagggcataaactacgccgaccgcaagtggtgcttcgacggaatcaaaaacaaccaaatattagaagagaacgtggaggtagaaatatggaccaaagaaggggaacgcaagaagctcaaaccgcgatggttggacgcgcgtatatatagcgaccctctcgctctaaaagagttcaaagagttcgctgcagggagaaagagcctgacgctgaacttgataacggaaatggggcgattgcccaccttcatgactcaaaaagccagaaacgccctggacaaccttgccgtactacacacagcggaagttgggggaaaggcgtacacccacgcacttagcgaactgcccgaaaccctggaaactttgctgctactaacgctcctagcagctgtcaccgggggcatattcctgttcctcatgagcgggaaaggaattggaaaaatgacactcgggatgtgctgcatcataaccgccagcattctcttatggtacgcacaaatacagccccattggatcgcagcgagtatcatcctcgagttctttctgatcgtgctcctcatacccgagccggaaaagcagcggactccacaggacaaccaactaacatacgtcgttattgcaattctgacggtggtcgcggcgaccatggcaaatgagatggggttcctcgagaaaacgaagaaagacctgggattcggcagcataaccacgcaggagtccgaaagcaacatcctcgacatcgacctcaggcctgcctccgcttggacactttatgcggttgctacgacgtttgtaacaccgatgctacgacacagtatcgaaaactcgtccgtcaatgtttcactcacagcaatagcgaaccaagcgaccgtactgatgggcttaggtaaaggctggccgctatccaaaatggacataggggttcctctcctcgctataggctgctacagccaagtaaaccctatcacactaacggccgcattgctcctactcgtagcacactatgcgataataggaccaggtcttcaggcaaaagcaacgagagaggcacagaagcgagcagcagccggcataatgaaaaatcctactgtcgacggaattacggtcattgacctcgaacccataccctacgaccccaagtttgagaaacaacttggccaagtcatgttactgatactatgcgtaacgcaagtgctgatgatgcgcacaacctgggcgctttgtgaagcgctcacgctggcaacgggccctatctcaaccctatgggagggaaatccgggacgcttctggaacacaacaatcgcggtgtcgatggcgaacatattcagggggagctatctagcaggggcggggctattgtttagcattatgaaaaatactacaaacaccagacgcgggaccgggaacgtcggtgagaccctaggagaaaaatggaaaagtcgtctgaacgcactcggtaaaagcgagttccaaatttacaagaaatcgggcattcaagaagtagaccgcactctcgcgaaagaagggataaagcgaggcgagacagaccaccatgcggtcagccgaggatctgccaaactcagatggttcgtcgagcgaaatatggtaacccccgagggaaaggtcgtagaccttgggtgtggacgaggcggctggtcctattattgcggcggactaaagaacgtgcgcgaagtgaaagggctgaccaaaggaggaccgggacacgaggaaccgatccccatgagcacatatggatggaaccttgttcgactccagtcaggggtggacgtgttcttcacaccgcccgagaagtgcgacacattactttgtgatataggggaaagcagcccgaaccctaccatagaagcaggcagaacactaagagtacttaatctggtagaaaactggctgaataacaatacgcaattttgcataaaagtgctcaacccttacatgccttccgttatcgagaaaatggaaacgctacagagaaagtacggaggtgccctagtgcggaacccactatcacggaactcaacgcacgagatgtactgggtaagcaacgcaacggggaacatcgtaagctccgtaaacatgatctcccggatgctcatcaaccgatttacaatgaaacacaaaaaggctacgtacgagcccgacgtggacctggggtctggaacaagaaatatagggatcgaaagcgagatccccaacctagacattataggaaaacgcatcgagaagattaagcaagaacacgagaccagctggcactacgaccaagaccacccttacaaaacctgggcataccacggctcatacgagacaaaacagacaggtagtgcctcgtcaatggtcaacggtgtggtgcgcctcctcaccaaaccctgggacgtcgtgcccatggtcactcaaatggcaatgacagacacaacaccattcggccaacagagagtttttaaagaaaaagttgacacgaggacacaggaacccaaagaaggcaccaagaaattaatgaaaataacagctgagtggctctggaaggaattagggaaggagaaaacaccgcgcatgtgcacacgggaggagttcactcgcaaagtgcgatcaaacgctgcgttgggagcagtcttcaccgacgaaaacaagtggaaaagtgcccgagaggcagtcgaagacggacgtttttgggaattagtagacagagagcggaacttgcacttggaggggaagtgcgaaacttgcgtctacaacatgatgggaaagagggagaagaaactgggcgagttcggcaaagctaaagggtcgagagctatctggtacatgtggctgggcgcacgattcctagagttcgaggcccttgggtttctcaacgaagaccattggttcagccgaggaaatagcctaagcggggtcgagggagagggactccacaggctaggctacatacttcgcgaggttgggaaaaaggaagggggcgccatgtacgccgatgatacagcagggtgggacacccggataactctagaggacttgaaaaacgaggaaatggtcaccaaccatatgaagggcgaacacaagaaattagcggaagctatatttaaactcacgtaccaaaacaaggtggtccgggtacagcgacctacaccacgaggaacagtaatggacattataagtcggaaggaccaacgagggagcggacaggtagggacctacggattaaacacattcacgaatatggaagcccagctcatacgccaaatggagggggaaggcatctttaagagcatccaacacctaacagcgacagaagaaatagcagtgcagaactggttggcgcgtgtagggagggaacggttgagccgaatggccatatcaggagatgactgcgttgtaaaacctatcgatgaccgttttgcttcggctctgacagcactaaacgacatggggaaggtacgaaaggacatccaacaatgggaacccagcagggggtggaatgactggacacaagtgcccttctgcagccaccactttcatgaattggtcatgaaagacgggcgcgtcctcgtggtaccatgcagaaaccaagacgaactcatcggccgcgccagaatctcccagggcgctggatggtcgctcaaagaaacggcctgcttaggaaaatcatacgcacagatgtggacgctcatgtacttccataggagagacctcagactagcagcaaacgcaatctgtagcgcagtccctagccactgggttccaacttcacgcacgacctggagcatccacgcaaagcacgagtggatgaccaccgaggacatgctagctgtctggaaccgcgtctggatccaggaaaacccttggatggaagataaaacacccgttgaatcgtgggaggaagtgccgtatcttgggaaacgcgaagaccaatggtgcggctccctcatcggcctcacgtcgagagcaacatgggcgaagaacatccaaaccgccataaaccaagtacgcagtctgatgggtaacgaaggatacacggactacatgcctagcatgaaaagattccgcagagaagaggaagaggccggagtactgtggtaa

SEQ ID NO: 24914 - RNA, 9876 nt, synthetic construct
  misc_feature 1..9876: note = derived and/or modified CDS sequence (opt11) from DENV-2__GU131881__SS-prME
  source 1..9876: mol_type = other RNA
acagccggggtgatcgtcatgttaatccccaccgcgatggccttccacctcaccacccgcaacggggagccccacatgatcgtgggccggcaggagaaggggaaatccctgctgttcaagaccgaggacggcgtgaacatgtgtaccctcatggccatcgacctgggggaattatgcgaggacaccatcacctacaagtgtcccctcctacgccagaacgagcccgaggacatcgactgctggtgtaacagcaccagcacctgggtcacctacgggacttgcacgaccacgggcgagcaccggagggagaagcggagtgtggccctagtgccccacgtcgggatgggcctcgagacccgcacagagacatggatgagttccgagggggcctggaagcacgtgcagcggatcgagacatggatcctgcgccacccgggattcaccatcatggccgcgatcctggcctatactatcggaaccacccacttccagcgggccctcatcttcatcctgctgacagcagtggcgcccagtatgacgatgcgttgcatcggcatttccaaccgggatttcgtagagggtgtgagcgggggctcctgggtggatatcgtcttagaacacgggagctgcgtgaccacgatggccaaaaacaagcccactctggacttcgagctgatcaagaccgaggccaagcaacccgccaccctccgcaagtactgcatcgaggccaagcttacaaacaccacaacggagtcacggtgtccgacgcagggcgagcccagccttaacgaggaacaggacaagcgcttcatctgcaagcactcaatggtagaccgcggctgggggaacggctgcggactgttcggcaagggcgggatcgtgacctgcgcgatgttcacgtgtaagaagaatatggagggcaaaatcgtgcagcccgagaacctggagtataccattgtgatcacgccccactcgggggaggaacacgcggtcggcaacgacaccgggaagcatggaaaggagatcaagataaccccgcagtccagcaccaccgaggccgagctgacgggttacggcaccgtgaccatggagtgcagcccccggaccggcctcgatttcaacgagatggtcctgctgcagatggaggataaagcctggctcgtccaccggcaatggtttttggacttgcccctcccctggctaccaggggccgacacgcagggcagcaactggattcagaaagagacgctggtgaccttcaagaacccccacgcgaagaagcaggacgtagtcgtgctcggctcccaagagggcgcaatgcacaccgcgctgacgggggcaaccgagatccagatgagcagcggcaacttactgttcaccggccatctgaagtgccgccttcggatggacaaactccagctgaaggggatgtcctactctatgtgcaccggcaaatttaagatcgtcaaagagattgccgagacgcagcacgggacgattgtgatccgcgtgcagtacgagggcgacggctcaccctgtaaaatccctttcgagatcaccgacctggagaaacggcacgtcctcgggcgcttgatcacggtgaacccgatcgtgacggaaaaggattcacccgtcaacatcgaggcagagccgcccttcggggactcctacatcatagtcggggtggagccgggccagctgaaactcaactggttcaagaaggggtcgtccattggacagatgttcgagaccactatgcgcggagccaagcggatggccatccttggagacaccgcctgggactttggcagtctcggcggcgtattcacttccatcgggaaagccctccaccaggtgttcggggcgatttacggagccgccttcagcggggtgtcatggaccatgaagatcctgatcggcgtcataatcacctggatcgggatgaatagccgctccaccagcctgtccgtgagcctggtgctcgtgggcgtggtgaccctgtacctgggggccatggttcaggcggacagtggctgcatcgtcagctggaagaacaaagagctcaagtgcggctccgggatcttcatcactgacaacgttcatacctggaccgagcagtacaagttccagcccgagagcccaagcaagctcgcctccgccatccaaaaggcccacgaggagggcatctgcggcatacggagcgtgacgagactggagaacctgatgtggaagcagataacccccgagctgaaccacatcctgtccgagaacgaggtgaagctcaccataatgacaggagatataaaagggatcatgcaggccggaaaacggagcctaagaccgcagcccacggagctgaagtatagctggaagacctggggcaaagcgaagatgctctcaaccgagtcccataaccagacttttctgatagacgggcctgagacggccgaatgcccgaacaccaaccgagcctggaacagcctggaagtggaggactacggcttcggcgtcttcaccaccaacatctggctgaagctccgcgagaaacaggacgtgttttgcgactccaagctgatgagcgccgctataaagaacaacagggcggtgcacgccgacatgggctactggatcgaatccgccctcaacgacacgtggaagatggaaaaggcaagcttcatcgaggtcaagtcctgccactggcccaaaagtcacacgctgtggtccaacggcgtgcttgagtcagagatgatcatccctaagaactttgccgggcccgtgtcccagcacaactaccgcccgggctaccacacccaaaccgcggggccctggcatctcggcaagctggagatggatttcgacttctgcgaagggaccaccgtcgtcgtgacggaagactgcgggaaccggggcccctcactgcgcacgaccacggccagtgggaagctcatcactgagtggtgttgccggtcctgtaccctgcccccgctacgctaccgcggcgaggatgggtgctggtacgggatggagatacgccccctcaaggagaaagaggagaacctggtcaactcactggtaaccgctgggcacggacagatcgacaacttcagtctcggcgtgctggggatggccctgtttctcgaggagatgctccggacgagagtcggcaccaagcacgcgatcttgttggtggccctgagtttcgtgaccctaatcaccgggaacatgtctttccgggacctcggacgcgttatggtgatggtgggggccacgatgactgacgacattggcatgggagtcacgtacctggccctgctcgccgcattcaaggtgcgccccacctttgctgcagggctgcttctccggaagctgacgagcaaggagctgatgatggccaccatcggcatcgccctcctttcccaaagcaccctccccgagaccatactcgagctgacggacgcgctggccttagggatgatggccctgaagatcgtgcgcaatatggaaaagtatcagcttgccgtcacgataatggccatctcttgcgtgccgaacgcggttattctccagaacgcctggaaggtcagctgcaccatcctggccgcggtgtccgtaagccccctgcttctgacctccagccaacagaaggcggattggatccccctggccctcactatcaagggcctgaaccccaccgccattttcctgaccacactctcccggacgagcaaaaagcgctcctggcccctgaatgaggccataatggcagtcggcatggtcagcatcctggcgtccagcctcctgaagaacgatatacccatgaccggccccctagtcgccggcgggctgctgaccgtgtgttacgtgctgactggacggtcggccgatctcgagctcgagcgcgcagcggatgtcaagtgggaggaccaggcggagatctccgggagctcacccatcctgagcattacgatctccgaggacggcagcatgtccatcaagaacgaggaagaggaacagaccctcactatcctgatacggacgggtctgctcgtgatcagcggagtgttcccggtctcgatccctatcaccgccgccgcctggtacctgtgggaagtgaagaagcaacgcgccggggtgctctgggatgtgcccagcccgccgcccgtcggaaaggcggagctcgaggacggagcctaccggatcaagcagaggggaatcctgggctactcccagattggagccggggtatacaaggagggcacgttccacaccatgtggcacgtcacccgcggagccgtgctgatgcaccgcggcaagcggatcgaacccagctgggccgacgtcaaaaaggacctcatctcctacgggggaggctggaagctggagggggagtggaaagagggcgaagaggtccaggtgctggcgctcgagcccggcaagaatccccgcgcagtgcagaccaaacccggtatcttcaaaacgaacaccgggaccatcggagccgttagcctggacttctcccctggcaccagcgggtcccccatcgtggaccggaagggaaaggtggtcgggctgtatggcaacggtgtggttacacgcagcggtgcctacgtctccgcgatcgcccagaccgagaagagtatcgaggataaccccgagatcgaggatgacatcttccggaagaagcgcctcaccattatggacctgcatcccggcgccgggaagaccaagcgctacctgcctgccattgtgcgcgaggccatcaagcggggcctgaggactctcatcctggcgccgaccagagtggtagccgcagagatggaggaggccctgcgtggtctccccatacgttaccagactcccgccatccgcgcggagcataccggtcgggaaatcgtggacctgatgtgccacgccacgttcaccatgcggctgctctctcccgtgcgcgtcccgaactacaacctgatcatcatggacgaggcccacttcaccgacccggcctccatcgccgcgcggggatatatcagcacccgcgtggagatgggggaagccgctggcatcttcatgacggcgactccacccgggtcccgggacccgttcccccagagcaacgcgccaatcatggacgaagagagggagatccccgagcggtcctggaacagcggccacgaatgggtaaccgacttcaaggggaagaccgtctggttcgtcccatcaatcaaggccggcaacgacatcgctgcgtgtctgcgcaagaatgggaagaaggtgatacagctcagccggaaaacgttcgattcagagtacgtcaagacccgcgccaatgattgggatttcgtggtgaccaccgacatcagcgaaatgggggctaacttcaaggccgagcgggtcattgacccccgcagatgcatgaaacccgtgatccttacggacggcgaggagcgtgtgatactggccgggcccatgccggtcacccactccagcgccgcacagcggcgcggcagaattgggcggaaccccaagaacgagaacgaccagtacatctacatgggcgagcctcttgagaacgatgaggactgtgctcactggaaggaggccaagatgctactggacaatatcaacacacccgagggcatcatcccgtccatgttcgagccggagcgcgagaaagtggacgccatcgacggcgagtatcggcttcggggagaggcccggaagactttcgtggacctgatgcgccgcggggacctacccgtctggctcgcctacaaggtggcggccgaaggtatcaattacgccgaccgcaagtggtgctttgacgggatcaagaacaatcaaatcctggaggagaacgtggaggtcgagatctggacgaaggagggcgagcggaagaagctgaagccgaggtggctcgacgcccggatctacagcgaccccctggcgctcaaggaatttaaagagttcgcagcaggacgcaagtccctgaccctgaacctgatcaccgaaatggggcggctcccgacattcatgacgcagaaagcccgcaacgccctggacaacctggcggtgctccacaccgccgaggtgggcgggaaggcctacacacatgccctgtcggagctgccagagaccctagagacgctgctcctcctgaccctgctcgccgcggtcaccggcggcatcttccttttcctgatgtccgggaagggtattgggaaaatgaccctaggcatgtgctgcatcatcaccgccagcattctcctgtggtacgcccaaatccaaccccactggatcgctgcctccatcattctcgagttcttcctgattgtgctgctcatccccgagcccgagaagcagcggacgccccaggacaaccaactgacctacgttgtgatcgcaatccttaccgtggtcgccgccacgatggccaacgagatggggttcctcgagaagacgaaaaaggacctgggcttcggcagcatcaccacccaggagtcagagtccaatatcctggacatcgacctccgcccggccagcgcgtggaccctgtacgccgtggccacgacctttgtgaccccaatgctgcggcactccattgagaacagctccgtcaacgttagcctgaccgccattgcgaatcaagcgacggtgctgatgggtctgggcaaggggtggcccctatccaagatggacatcggcgtccccctgctggccatcgggtgctacagccaagtaaacccgatcaccctcactgctgcactgctgctcctggtggcgcactacgccatcatcggccccggcctgcaggccaaggcaacccgcgaggcccagaagagggcggccgccgggatcatgaaaaatcccacggtcgacgggatcaccgtaatcgacctagagcccatcccgtatgaccccaagttcgaaaagcagctgggccaggtcatgttactcatcctgtgcgtcacccaggtgctgatgatgcgtacgacgtgggcactctgcgaggccctgaccctggcgaccggccccatctctacactctgggagggtaaccctggacggttctggaacacgaccatcgcggtcagcatggcgaacatctttcgcggctcctacttagccggggccgggctcctgttcagcataatgaagaacaccacaaatacgcgtcgggggaccggtaacgtcggcgagaccttgggggaaaagtggaaatcccgactgaacgccttgggcaagagcgagttccagatctacaagaagagcgggatccaggaggtggaccggaccctggccaaggagggcataaaacgcggtgagacggaccaccacgctgtctcgagaggatccgccaaactgcgctggtttgttgaacggaatatggtgacaccggagggcaaggtggtcgatctcgggtgcggccgcgggggctggagctactattgcggggggctgaagaacgtacgcgaggtgaagggtctcaccaagggcggccccgggcacgaggagcccatccccatgtccacctatggctggaacctggtccgcctacaaagcggtgtggacgtgttcttcacgccacccgagaagtgtgacaccctgctctgtgacatcggcgagagctcccccaaccccaccatcgaggcggggcggaccctacgcgtcctgaacctcgtggagaactggttaaacaacaacactcaattctgcatcaaagtgctgaatccttacatgccgagcgtcatcgagaaaatggagaccctccagcggaagtacggcggggccttggtgcgcaaccccctgtcccggaactcaacccacgagatgtactgggtttccaacgccaccgggaacatcgtcagctcggtgaatatgataagccgcatgctgatcaaccggttcaccatgaaacacaagaaggccacatacgagccggacgtggacctcggctccgggacccgcaacatcgggatcgagagcgagataccgaaccttgacatcatcggcaagcggattgagaagatcaaacaggaacacgagacctcctggcactacgaccaagaccacccctacaagacctgggcctaccacggaagctacgagacgaagcagacaggctccgcgagctccatggtcaacggtgtggtacggctgctgaccaagccctgggacgtcgtgccgatggtcacacaaatggccatgacggacaccacccccttcggccaacagcgcgtcttcaaggagaaggtggacactcggacgcaagagcccaaggagggcaccaagaagctgatgaagatcaccgccgagtggctgtggaaggagctcgggaaggaaaagacgcctagaatgtgcacgagggaggaattcacccgcaaggtccggagcaacgccgccctgggcgcggtcttcacagacgagaacaagtggaagagtgctagggaggccgtggaggacgggcggttctgggagctggtggaccgcgagcggaacctccacctggaaggtaagtgcgaaacctgcgtttacaacatgatgggaaagcgggagaagaagctgggcgagttcggcaaggccaaagggagccgggcgatatggtacatgtggctcggcgcccgcttcctggagtttgaagccctggggttcctcaacgaggatcactggttttcccgggggaactccctgtccggggtggagggcgaggggcttcaccgcctcgggtacatcctccgggaggttggcaagaaggagggaggcgccatgtacgcagacgacacggcggggtgggacacccgcataacgctggaagacctcaagaatgaagagatggtgaccaaccacatgaagggcgaacataagaagcttgccgaggccatcttcaagttaacgtaccagaacaaggtggtccgggtgcagcgcccgactccccggggcacggtgatggacatcatctcccgcaaggaccagagaggatcgggccaggtcggcacctacggcctaaatactttcaccaacatggaggctcagttgatccgccagatggagggagaggggatcttcaagtccatccaacacctgaccgctactgaggagatcgcggtgcagaactggctcgcccgcgtgggccgggagcgcctgagcagaatggccatctccggggacgactgcgtcgtgaaacccatcgatgaccggttcgcgagcgccctgacggcgctcaacgacatgggcaaggtgcggaaggatattcaacagtgggaaccatccagggggtggaacgactggacccaggtcccgttctgcagccaccacttccacgagctggtcatgaaagacggccgggtattagtcgtgccctgccgtaaccaggacgagctcatcggccgtgccaggatctcccaaggggccggctggagcctgaaagagacagcgtgcctggggaagtcctacgcccaaatgtggaccctcatgtacttccaccgccgcgatctgcggctggcggccaatgcgatttgcagcgccgtcccctcacactgggtccccaccagccgcacgacctggtccattcacgcgaaacatgagtggatgactacagaggatatgctcgccgtatggaaccgcgtatggatccaggagaacccgtggatggaggacaagacgcctgttgagagctgggaggaggtgccctacctgggtaagcgcgaggaccagtggtgcgggtccctgatcggcctcacttctcgggccacatgggccaagaacatccagaccgccattaaccaggtacgcagcctgatcggtaatgaggggtacacagactacatgccttcgatgaagcggttccgccgcgaggaggaggaggcgggtgtcctgtggtga

SEQ ID NO: 24915 - RNA, 9876 nt, synthetic construct
  misc_feature 1..9876: note = derived and/or modified CDS sequence (opt11) from DENV-2__FJ898461__SS-prME
  source 1..9876: mol_type = other RNA
acggccggcgtgatcgtcatgctcattcccaccgccatggcgttccatctcaccactcgcaatggggagccccacatgatcgtcggacggcaggagaagggtaagtccctgctgttcaagacagaggacggcgtgaacatgtgcaccctcatggccatcgacctcggggagctgtgcgaggacaccatcacgtacaaatgtcccctcctgagacaaaatgagcccgaggacatcgactgttggtgcaactcgacgtcgacctgggtcacctatgggacgtgcacaaccacgggcgagcaccgtcgcgaaaagaggtccgtcgcccttgttccccacgtcgggatgggcctcgagacccgcaccgagacctggatgtctagtgagggggcctggaagcacgttcagcgcatcgagacgtggatcctgcgccaccccggtttcacgatcatggccgcgattctggcctacacgatcgggaccacgcatttccagcgcgccctcatctttattctgctgacagccgtggcgccctcgatgaccatgcgctgtatcggcattagcaatcgggacttcgtcgagggcgtgagcggtgggagctgggtggacatagtcctcgagcacgggtcttgcgtaaccacgatggccaaaaacaaacccaccctggacttcgaactgatcaagacggaagccaagcagcctgccacgctcaggaaatactgcattgaagccaagctaacgaataccaccaccgagtcccggtgcccgacacagggagagccctcactgaatgaggagcaggacaagcggttcatctgcaagcactccatggtggaccgaggctgggggaacggctgcggcctgtttggcaagggtggcattgttacctgcgccatgttcacgtgcaagaagaacatggaggggaaggtggtgcagcccgagaacctggagtataccatcgtcataacgccacacagcggtgaggagcacgccgttggcaatgacaccgggaagcatggcaaagagatcaagatcacgccgcagagcagtataacggaggccgaactgacggggtacggaacagtcactatggagtgcagcccccggaccggactcgacttcaacgagatggtcctgctgcagatggaggacaaagcctggctggtccaccgccagtggttcctggacctgcccttgccatggctgccgggggccgacacccaaggaagcaactggatccagaaggaaacgctagtgaccttcaaaaacccccacgcgaagaagcaggacgtcgtggtcctcgggtcccaggagggcgccatgcacaccgccctgacaggcgctacggagatccaaatgagtagcggcaatttgctgttcaccggccacctgaagtgcagactgcggatggataagctccagctgaaggggatgtcatacagcatgtgcacgggcaagttcaagatcgtgaaggagatcgccgagacccagcacggtacaatcgtcatccgcgtccagtacgagggcgacggctccccctgcaaaatacccttcgagatcaccgacctggagaagaggcacgtgctcgggagattgatcaccgtgaacccgatcgtcaccgagaaggacagccccgtgaacatcgaggctgagccgccattcggcgattcctatatcatcatcggggtggaaccgggccagctcaagttaaactggttcaagaagggttcgtccatcgggcagatgttccagactaccgtcagaggtgcgaagaggatggccatcctgggggacaccgcttgggacttcgggagcctcgggggcgtgttcactagtatcgggaaggcgctccaccaggtgttcggggcgatttacggagccgccttcagcggtgtgtcctggacgatgaaaatcctgatcggtgtgataatcacctggataggcatgaactcacgctcgaccagcctctccgtgagcctggtgctcgttggcgtggtcaccttatacctgggggccatggtgcaagcggactccggctgcgtggtaagctggaagaataaggaactcaagtgcggcagcgggatctttatcacggataatgtacacacctggaccgagcagtataaattccagcccgaaagccccagcaagctggcctccgccatccagaaggcccatgaggagggcatttgcggcatccggagcgttacccgcctggagaatctcatgtggaagcagatcacgcccgaactaaaccacatcctctccgagaatgaggtcaagctcaccatcatgaccggcgacatcaaggggatcatgcaggcaggcaaacggtccctgcgcccgcagcccaccgagcttaagtacagttggaaaacgtggggaaaggcgaagatgctgagcacggaatcgcacaatcagactttcctgattgacgggcccgagaccgctgagtgcccgaatacaaatcgggcctggaacagcctggaggtggaggactacggcttcggggtgttcaccaccaacatctggctcaagctgcgcgagaagcaggatgtcttctgcgactccaagctcatgtctgccgcgatcaaggacaaccgggcggtgcacgccgacatggggtactggattgagtcagccctcaacgacacctggaagatggagaaagcctctttcatagaggtgaaatcctgccactggccgaagagtcataccctgtggtccaacggcgtcctggagtccgagatgatcatccccaagaattttgctgggcccgtgtctcagcacaactatcgcccggggtaccacacccagaccgcggggccctggcacctcggcaagctggagatggattttgacctgtgcgaagggacaacagtggtcgtgacggaggactgcggaaaccggggccccagccttcgcaccaccaccgccagcgggaagctgatcacggagtggtgctgtcggtcctgcacgcttcccccgctccgctaccgcggggaggacgggtgctggtacggcatggagatcaggcccctgaaggagaaagaggagaatctggtgaacagcctcgtgaccgccgggcacggccagatcgacaacttttccctgggcgtactgggaatggccctgttccttgaggagatgctgcggacgagaatcggtacgaagcacgcgatactcttggtagttgtgagctttgttaccctgatcacaggcaatatgtcctttcgggacctcggcagggtcatggtgatggtgggggctaccatgacggacgacatcggcatgggcgtcacctacctggccctgttagccgccttcaaggtgcgcccgaccttcgcggcggggctgcttctccggaagctgacaagcaaagagctgatgatggccaccatcggcatcgcactcctttcccagagcactatacccgagactatcctggagctgaccgacgccctagcgctggggatgatggtgctaaagatagttcgaaacatggagaagtaccagctggccgtaacgataatggcgatctcatgcgtgccgaacgccgtcatcctgcagaacgcctggaaggtcagctgtaccatactcgcggccgtgtccgtaagccccctgcttctcacctccagccagcagaaagccgactggatccctcttgcactcactatcaagggcctcaaccccacggcgatcttcttgactactctgtcccggacaagtaagaagcgctcctggccgctgaacgaggccattatggccgtcggcatggtcagcattctggcctcctctttactcaagaatgacatacccatgacggggcctttagtggcaggagggctgctcaccgtctgctacgtcctgaccggtcggagcgctgatctggagctcgagagagcggccgacgtgaagtgggaggaccaggccgagatctccgggtcgtctcccatcctctcgatcaccatctccgaggacggtagcatgtctatcaaaaacgaggaggaggagcagacgctgaccatcctcatccggactgggcttctggtaatctctggggtcttcccggtttccatccccatcaccgccgcggcctggtatctatgggaggtgaagaagcagcgcgccggtgtcctatgggacgtcccgagcccgccgcccgtggaaaaagccgagctggaagatggtgcctaccggatcaagcagaggggcatactcggctactcccagatcggcgccggcgtctacaaggaagggaccttccacaccatgtggcatgtgacgcggggcgccgtgctgatgcatcgcggcaaacggatcgagccaagctgggccgacgtcaagaaggacctgatttcatacggagggggatggaagttagagggcgaatggaaagaaggcgaagaggtccaggtgctcgcccttgagccgggcaagaacccccgcgccgtccaaacgaagcccgggatattcaagaccaacacaggcaccattggggcggtgagcctggacttttctcccggcaccagcgggtcccccattgtagatcgcaagggcaaggtggtgggcctgtacgggaatggcgtagtcactcgcagcggcgcctacgtgtctgccatcgcccagacggagaaatccatcgaggacaaccccgagatcgaggacgacatattccggaagaagcgcctgacaatcatggacctccaccccggcgcgggcaagacgaaacggtacctgccagccatcgttcgcgaggccatcaagcggggattaagaacactgatcctcgccccaacgagggtcgtggctgctgaaatggaggaggcgctgcgtggcctccccatacgctaccagacacccgccattaagaccgagcacacagggcgagaaatcgtggacctcatgtgccatgcgacgttcaccatgcgcctcctgagccccgtccgggtgccgaactataacctcatcatcatggacgaggctcacttcaccgacccggcgtccatcgccgcccgcggttacatcagcacccgggtggagatgggcgaggccgcagggatcttcatgactgcgaccccgccggggagccgcgacccgttcccccagtctaatgctcccattatggacgaggaacgggagatccccgaacgctcctggaactcggggcacgagtgggtcaccgacttcaaaggcaagaccgtgtggttcgttccaagtattaaggcggggaatgacatagctgcttgccttcgcaagaacggcaagaaggtgattcaactgagcaggaagacattcgactccgagtatgtgaagactcgggctaacgactgggatttcgtggttaccaccgacattagcgagatgggagccaacttcaaggcggagcgtgtgatagacccccggcgctgcatgaaacccgtgatcttaacggatggggaggaacgggttattttagccggccccatgcccgtgacacattccagcgccgcccagagacgggggcgcatcggcaggaaccccaaaaacgaaaacgaccagtacatctacatgggggagcccctggagaatgacgaggactgcgcccactggaaagaggccaagatgctcctggacaacatcaacacacccgagggcatcatcccgtccatgtttgaacccgaacgggagaaggtggatgccatcgacggtgagtacaggctccgcggggaggcgcgcaaaacattcgtcgacttaatgcgccgcggcgacctgccagtgtggctcgcctacaaagtcgccgcggaggggatcaactacgccgaccgtaaatggtgtttcgacggcatcaagaacaaccaaatccttgaggagaacatggaggtcgagatttggacgaaggagggggagcgcaagaagctgaagccgcggtggctggatgcgcgtatctacagcgacccactcgcgttaaaagagttcaaggaattcgcagccggccggaagtccctgacgctcaacctaataaccgagatgggccgcttgccgacctttatgacgcaaaaggctcggaatgccctcgacaacctggccgttctccacactgccgaggccgggggcagagcgtataaccacgctctgagcgagctgcccgagaccctggaaaccctcctgctgctgacccttctggccacggtaaccgggggcatcttcctgttcctgatgtccggcaagggtatcggcaagatgaccctggggatgtgttgtatcatcaccgccagcatattgctgtggtacgcccagatccagccacattggatcgcggcctccatcatactggagttcttccttatcgtgctcctaatccccgagcccgaaaagcagcggacaccacaggacaatcagttgacatacgtcgtcatcgccatcctgactgtggttgccgccaccatggcgaacgagatgggctttctggagaagacgaagaaggacctcgggctgggctctatcaccacccaagagcccgaaagcaacatcctggacattgacctgcgccccgccagtgcgtggaccctgtacgccgttgccacgaccttcgtgacccccatgctgcgccacagtatcgagaattctagcgtgaacgtctccctcaccgctatcgccaaccaggccactgtcctcatgggcctggggaagggctggcccctaagcaagatggacatcggcgtgccactgctggccatcggttgctacagccaagttaaccccatcaccctgaccgcggccctgctactcttagtagcccattacgccattatcgggcccggcctgcaggcaaaggcaacccgagaggcccagaagcgggctgcagccggcatcatgaagaaccccacggtggacgggatcaccgtcatcgatctcgagcctatcccctatgaccccaaattcgagaagcagctgggccaggtgatgctgttgatcctgtgcgtgactcaggtcctgatgatgcgcaccacgtgggcactctgtgaggccttaaccctggccaccggtcccatcagtaccctctgggagggcaaccctgggcggttctggaacacgaccatagccgtgagcatggctaatatcttccgcggcagctaccttgcgggcgccgggctcctgttctccatcatgaagaataccaccaacacccgccgagggaccgggaatatcggggagacgctgggcgagaagtggaagtcccgcttaaacgccctagggaagtccgaattccagatctacaagaagtccggcattcaggaggtggatagaaccctggctaaagagggtatcaagcgcggcgaaacggaccaccacgcggtcagtcgcgggagcgccaagctccgctggttcgtcgagagaaacatggtaaccccagagggcaaggtagtagacctgggctgcgggcgcggggggtggtcgtactactgcggcgggttgaagaacgttcgggaggttaagggtctgacgaagggtgggcccggtcatgaggaacccatcccgatgagcacctacgggtggaacctcgtgagactgcaatccggcgtggacgtattcttcacccccccagagaaatgcgacacactgctctgcgacatcggggagagcagccccaacccgaccatcgaagcaggccgaactttgcgcgtgctgaacctcgtggagaactggttgaacaacaacactcagttctgcatcaaggtcctgaacccgtacatgcccagcgtgatagagaagatggagaccctccagcggaagtacggcggggccctggtgcgcaacccgctgagcagaaactccacccacgagatgtactgggtttcgaatgccaccggcaatatcgtgtccagcgtaaacatgatctctaggatgttgatcaaccggttcaccatgaagcacaagaaggcgacttacgagcccgatgtcgacctcgggagtggcacccgcaatatcgggatcgagtccgagatccccaacctggacataatcgggaagcggatcgagaagattaagcaggagcacgagacgagttggcactatgaccaggatcacccttacaagacctgggcctaccacggttcctatgaaacgaagcagaccgggagcgccagcagtatggtgaacggcgtggtccgcctgctcaccaagccttgggacgtggtccccatggtcacccaaatggccatgacggacaccaccccctttggccaacaacgcgtgttcaaggagaaggtggacacccggactcaggagcctaaggagggaaccaagaagcttatgaagataaccgccgaatggttgtggaaggagctcgggaagaagaagacccccaggatgtgcacgcgggaggagttcacccgcaaggtccggtccaacgcggccctgggggctatcttcaccgatgaaaacaagtggaaatccgcccgcgaggccgtcgaggacggacggttctgggagctagtcgaccgcgagagaaacctccacctggaggggaaatgtgaaacatgtgtctacaacatgatgggtaagcgcgagaagaaactgggggagttcggtaaggcgaaaggctctcgggcaatctggtacatgtggctcggggcgcgattcctggagttcgaggcgctgggcttcctcaatgaggaccactggttcagcaggggaaactcactgagcggtgtggagggggagggcttacaccgcttgggctacatcctgcgggacgtagggaaaaaggagggcggcgcgatgtacgctgacgacacagcgggctgggacacccgcatcacgctggaggaccttaagaacgaggaaatggtgaccaaccacatgaaaggcgaacacaagaagctggccgaggccatcttcaagctgacgtaccagaacaaggtcgtccgagttcagcgtcccacaccccgaggcacggttatggacatcatcagtcgccgtgaccagaggggctccgggcaagtcggtacctacggactaaacacgttcaccaacatggaagcgcagttgatccgccagatggagggcgagggcatctttaagagcatccaacatctgaccgccaccgaggaaatagctgtgcagaactggctggcccggctgggccgcgagcgactgtcccgcatggccatcagcggcgacgattgcgtggtaaagcccatcgacgaccgattcgcgagcgccctcacggccttaaatgacatggggaaggttcggaaggacatacagcagtgggagcccagccgggggtggaacgactggacccaggtgccgttctgctcgcaccactttcatgaactggtaatgaaggacgggcgcgtgctcgtggtcccctgtcggaaccaagacgagctgatcggacgcgcccggatctcccagggcgcaggttggtccctgaaggagaccgcgtgtctcggcaagagctacgcccaaatgtggacgctaatgtactttcaccgccgggacttacgcctcgccgccaatgccatctgctccgcggtacctagccactgggtcccgacctcgcggacgacctggagcatccatgccaagcatgagtggatgaccacggaagatatgttagccgtctggaaccgcgtttggatacaggagaatccctggatggaggacaagacacctgtggaatcctgggaggaagtcccttacctggggaagcgggaggaccagtggtgtggcagcctcataggtctgacctcccgcgccacctgggcgaagaatatccagactgccataaaccaggtacggtccctcatcggcaatgaggagtacacggactacatgccgtccatgaagcggtttcgacgtgaggaagaagaggccggtgtgctctggtga

SEQ ID NO: 24916 - RNA, 9876 nt, synthetic construct
  misc_feature 1..9876: note = derived and/or modified CDS sequence (opt11) from DENV-2__FJ024473__SS-prME
  source 1..9876: mol_type = other RNA
accgcgggcgtaatcgtcatgctgatccctaccgctatggcatttcacctcacgacccgcaatggggagccgcatatgatcgttggccggcaggagaagggaaaaagtctgctattcaaaactgaggacggggtgaacatgtgcacccttatggccatcgacctgggggagctgtgcgaggacacaatcacgtataagtgccccctgctgagacagaacgaacccgaagacatcgactgttggtgcaactccaccagcacctgggtcacctacggaacctgtaccacgacgggcgagcaccggcgcgagaagcggtcggtggctctggtgccccacgtggggatgggcctggaaaccagaactgagacctggatgagctccgagggagcctggaagcacgtgcagcggatcgaaacgtggatcctacgccaccccggtttcaccatcatggccgcgatcctggcctacaccatagggaccacacacttccagcgcgccctcatcttcatcctactgactgcggtggcgcccagcatgaccatgcgatgcataggtacctccaatcgggacttcgtcgagggggtgagcgggggctcttgggttgacatagtactcgagcacggtagctgcgtcaccaccatggccaagaacaagccaaccttggacttcgagctgatcaagaccgaggctaagcagcccgctaccctcaggaagtactgcatcgaggccaagctgaccaacaccaccacggagtcccggtgccctacccagggcgagccgagccttaacgaagagcaggacaagcgtttcatttgcaaacactccatggtagaccggggctgggggaacggctgcggtctgtttggcaagggcgggatcgtgacctgcgctatgttcacgtgtaaaaagaacatggaaggtaaggtggtgcaacccgagaacctggagtacacgatcgttatcacgcctcactcgggggaggagcacgccgtgggcgacgacacaggcaaacacggcaaggagatcaagatcacccctcagtcgagcatcactgaggcagagcttacagggtacggcactgttaccatggagtgtagccccaggactgggctcgacttcaacgagatggttttgctgcaaatggaggacaaggcctggctcgtgcatcgtcaatggttcctggacctgcccctcccctggcttccgggggccgacacacagggctctaactggatacaaaaggagacccttgtgacctttaagaacccccacgcgaagaagcaggatgttgtggtcctcgggagtcaagagggagccatgcataccgcgctaaccggtgccactgagatacagatgagctccggcaacctcttattcaccggtcatttgaaatgccgcctgcgcatggacaagctccagctgaaaggcatgtcctacagcatgtgtaccggcaagtttaagatagtgaaggaaatcgccgagactcagcacggaaccatcgtgatacgcgtccagtacgagggcgacggctccccgtgcaagatacccttcgagatcacagacttggagaagcgccacgtcctcgggcgtctgattacggtgaatccaatcgtgattgaaaaagactcacccgtgaacatagaggccgagcctccgttcggcgactcttatatcatcattggggtggagccgggacagctgaagctgaactggttcaagaaggggagttccatcggccagatgttcgagacgactatgagaggcgctaagcgcatggccatcctgggggataccgcctgggactttggcagcctcggcggcgtattcacctccatagggaaggccctccaccaggtgtttggggcgatctacggtgccgcctttagcggcgtatcgtggacgatgaagatcctgattggcgtcgtgatcacatggatcggcatgaactcgcgcagcacaagcctgtccgtcagcctggtccttgtgggcgtggttaccctgtacctgggggcgatggttcaagcagacagcggctgcgtggtcagctggaaaaacaaggagctcaagtgcggctccggaatattcatcacggacaacgtgcacacctggaccgagcagtataagttccagcccgagtcacccagcaagctggcctccgccatccagaaggcccacgaggagggcatctgcgggatccggagcgtgacgcgactggagaatctcatgtggaagcagatcaccccggagctgaaccacatcttatccgaaaacgaggtcaagctcactatcatgaccggcgacaccaaggggataatgcaagccggtaagcggtacctgcgtccgcagcccacggagctaaagtactcgtggaagacctggggcaaagcgaaaatgttatccaccgagtcgcacaaccaaacttttctgatcgatgggcctgagacggccgaatgccccaacacaaaccgcgcctggaattccctggaggtggaagattacggcttcggagtcttcactaccaacatctggttgaagttaagagagaagcaggacgtcttctgcgacagcaagctgatgtccgccgccatcaaggacaaccgggcggtgcacgccgacatgggctattggatcgagagcgccctcaacgacacctggaagatggagaaagcctccttcattgaggtcaagtcatgccactggccaaagtcgcacactctctggagcaatggggtattagagtccgaaatgataatccccaaaaatttcgccgggcccgtgagccaacacaactacagacccggctaccacacccagaccgcagggccttggcacctcggcaagctggagatggactttgacttctgtgaggggaccacggtggtcgtcacggaggactgtggcaatcgggggccgtccctgcgaaccaccacggcgagcgggaaactcattaccgaatggtgctgccggagctgcaccctgcccccgctgagataccggggcgaggacgggtgctggtacggaatggagattagacctctcaaggagaaggaagagaacctcgtgaattcccttgtcaccgccgggcacggccagattgacaacttctctctcggagtattggggatggcgctgttccttgaggagatgctccggacgcgagtcggcacgaagcacgcgattctgttggtcgccgtgagtttcgtgaccctgatcaccgggaacatgagctttcgagaccttggccgggtcatggtgatggtcggcgcaacgatgaccgacgacatcggaatgggcgtcacctacctcgccctgctagccgcgttcaaagtgcgccccaccttcgcggccgggctcctcctgagaaagctcacgtcaaaagagctcatgatggctaccatcggaatcaccctgctcagccagtccaccatccccgagacgatcctggagttaaccgatgccctcgcgttagggatgatggttctgaagattgtgcgcaacatggaaaaataccagctcgctgttaccatcatggctatcagctgcgtgccgaacgccgtcatcctgaggaatgcctggaaggtgtcctgcaccatcttagcggccgtcagcgtaagccctctgctgctgacgagctcccagcagaaggccgactggataccgctcgcgctaaccatcaagggccttaatcccaccgctatcttcctcaccacgctgagccgcacctctaagaagcgaagctggccgctgaacgaggcgatcatggcagtcggtatggtctctatccttgcctcctctctgttgaagaacgacatccccatgacagggcccctcgttgcaggcgggttgttgaccgtctgctatgtcctcacgggtcgcagcgcagatctggaactggaaagagcggccgatgtgaagtgggaggatcaggccgagattagcgggtccagccccatcctgtccataacaattagcgaggacggttcgatgagcatcaagaatgaggaagaggagaccactctgaccatcctgatcagaactggcctcctggtgatatccggcgtcttccctgtgtctatcccaataacagcggcggcctggtacctttgggaggtgaagaaacagcgcgcgggcgtgctctgggatgtgccatcgccgccgctggtcgggaaggccgagttggaggacggcgcctacaggatcaagcaacgtggtatcttgggctacagccagatcggcgcgggggtctataaggaaggcaccttccacaccatgtggcatgtgacacgcggggcggtcctgatgcaccggggcaaacgaattgagcccagctgggcagacgtgaagaaagatctgatcagttacgggggcggctggaagctcgagggggagtggaaggagggcgaggaggtacaggtgctggcgttggagcccgggaagaacccccgggccgtccagaccaagcccggcatattcaagaccaacaccgggacgatcggtgcggtgtccctcgacttcagccccggcacctcagggagccccattgtggaccgtaaaggcaaggtcgtagggctgtacggcaacggtgtcgtcacccgctccggggcctacgtgagcgccatcgcccaaaccgagaagtccatcgaggacaacccggaaatagaagacgacatcttccgcaaaaagcggttaacgatcatggacctccaccccggcgctgggaagaccaaacggtacctgcccgctatcgtgcgggaggccatcaagcgtggcctgcgcaccctgatcctggccccgacccgagtagtggcggcggagatggaggaagccttacgcggtctacccatccggtatcagacgcccgccattaaggctgagcacaccggcagagaaatcgttgacctgatgtgtcacgccacattcaccatgcggcttttatcacccgtgcgagtgcccaattacaatctcatcatcatggacgaagcgcacttcacggacccggcctcgatagcagcacggggatacatcagcaccagagtggagatgggcgaggcagcggggatcttcatgaccgccacgcctcctgggagccgagaccccttcccgcaaagtaacgcccccatcatggatgaggagcgcgagatccccgagaggagctggaacagcgggcacgaatgggtgaccgacttcaaggggaagaccgtttggttcgtgccctctatcaaggccggcaacgacatagcggcctgtctacgtaagaacggcaagaaagtcatccagctgtccaggaagacgttcgactccgagtacgtgaaaacccgcgcaaacgactgggactttgtggtcacgaccgatatatccgagatgggtgccaattttaaggccgaacgggtgatcgatccccgcaggtgcatgaagcccgtgatcctaactgacggcgaggagcgcgtcatcctagcggggcccatgcccgtgacccatagctccgccgcgcaacgacggggccgcatcgggcggaacccgaagaacgagaacgaccaatatatatacatgggtgagcctctggagaacgacgaggactgtgcccactggaaggaagctaaaatgctcctggacaatatcaacacgcccgaaggaatcattccaagcatgttcgagccggaacgcgaaaaggtggatgcggtcgacggggagtaccggcttaggggtgaggccaggaaaaccttcgtagacctcatgagacgtggggacctgcccgtttggctggcctataaggttgccgccgagggcatcaactacgcggaccgcaagtggtgcttcgacgggattaaaaacaatcaaatcctcgaggagaatgtggaggtcgagatctggaccaaggagggggaacgcaagaagctgaagccgcgctggctggacgcgaggatttactccgaccccctcgccttgaaggagttcaaggaatttgctgcgggccggaagtctctcacacttaacctaatcacggagatgggacggttacccacattcatgacccaaaaggcccgcaacgcactcgacaacctggctgtgctgcacaccgctgaggcgggcggccgggcctacaatcacgccctcagtgaactgcccgagacgctagagaccctgctcctgctcactctcctggccaccgtaacaggtggcatcttcctcttcctgatgagcgggaagggcatcgggaagatgacgctgggcatgtgctgcattatcactgcctccgtcctcctgtggtatgcgcagatacagccccattggatcgcggcctcaatcattttagagttcttcctcattgtcctgttgatcccggagcccgagaagcagcgcacgccccaggacaatcagcttacctacgtggtcatcgccatcctgactgtcgtggcggccaccatggcaaatgagatgggttttttagagaagaccaagaaggacctcgggctgggctccatcaccacgcaggaaagcgagagcaatatcctggacatcgatctccggcccgcttctgcttggaccctgtacgccgtagcgaccacttttgtgacgccgatgctgcgccatagcatcgagaactccagcgtgaatgtcagcttgacagcaatcgcgaaccaagcgaccgtgctgatggggctgggtaagggttggcccctgagcaagatggacatcggcgtgcccctgctggcaatcggttgctactcccaggtcaaccccattaccctcaccgccgcgctgctgctcctcgtagcccactacgccatcatcgggccggggctgcaagcgaaggccaccagggaagcccaaaaacgcgccgcggcggggatcatgaagaaccccaccgtcgatggcatcaccgtcatcgatctcgaacctatcccctacgacccgaaatttgaaaagcagctggggcaggtgatgttgctcatattatgcgtgacacaagtactgatgatgcgcaccacctgggccctctgcgaggccctgaccctggcaaccggccctattagcaccctatgggagggaaaccccggccgcttctggaacaccaccattgcggtgtccatggcaaacatcttccgcggctcctacctggccggagccggcctcttattttccattatgaagaatactaccaacaccaggcgcggaacaggtaacataggcgagacgctgggggaaaagtggaaatccaggctgaatgccctcggtaagtccgagttccagatctataagaagtccgggatccaagaggtagaccggaccttagccaaggagggcattaagcgcggggaaactgaccaccatgccgtctctcgcggaagcgcgaagcttcggtggttcgttgagcgaaacatggtgacccccgagggtaaggtcgtcgacttgggatgcggccgaggcggatggtcctactactgcggcggtctgaagaacgttcgcgaggtcaaggggctgaccaagggcggaccggggcatgaggagcccattcccatgagcacatacggctggaatcttgtccggctgcagagcggggtggacgtcttctttactccacccgagaaatgcgacacccttctctgtgacataggggagtcaagccccaacccgaccattgaagccggccgaacgctacgggtgctcaatctcgtggagaactggctgaacaacaacacccagttttgcatcaaggttctgaacccctatatgcccagcgtgatcgagaagatggagaccctccagcgcaagtacgggggcgctctggtccggaatcccttaagccgcaactccacccacgagatgtattgggtcagcaacgcaacggggaacatcgtgtcctcggtgaacatgatctcgcggatgctgattaacagattcaccatgaagcacaagaaagccacctacgaggccgacgtagacctcggcagcggaacccggaacatcggtatagagtccgagatacccaacttagacatcatcggcaagcggatcgagaagatcaagcaggagcacgagacaagctggcactacgaccaagaccacccatataaaacctgggcctaccacggttcctatgagaccaagcagaccggttcagcctcctcaatggttaacggggtggtcagactgctcacgaaaccgtgggatgtggtgcccatggtgacgcaaatggcaatgaccgacacaacgcccttcggccaacagcgggtgtttaaggagaaggtggacacccgcacccaggagccgaaagagggcaccaaaaagttgatgcggatcacggcagagtggctgtggaaggagctcggaaaaaagaagacgcctcgaatgtgcacccgggaggagttcaccagaaaggtccgatccaatgccgctctgggcgctatattcactgacgagaacaagtggaaatcggcgcgcgaggccgttgaagacggtcgcttctgggagttagtcgaccgagagcggaacctccacctggaggggaagtgcgagacctgcgtgtacaatatgatgggcaagcgcgagaagaaactgggagagtttggcaaagccaaggggtcccgggcaatctggtacatgtggctcggcgcacgattcctggagtttgaggccctggggttcctcaacgaagaccactggttcagccgaggcaattccctgagcggggtggaaggtgagggcctgcaccgcttagggtacatcctgcgggacgtcgggaagaaggagggcggcgccatgtacgcagacgacaccgctgggtgggacacccgcatcaccttagaggatctcaagaacgaggagatggtgaccaatcacatgaagggtgaacataaaaaactggccgaagccatctttaaactgacctatcaaaataaggtggtccgggtgcagcgccctaccccgcgcggcacggtgatggacatcatcagccgccgcgaccaacgggggtccggccaggtcgggacctatggcctcaacacgttcacaaacatggaagcccaactgatccgccagatggagggtgaagggatcttcaagagcatccagcatctgacggccacagaggaaatcgcggcccagaactggctcgcccgggttggccgggagaggctgtccaggatggccatcagcggggacgattgcgtcgtcaaaccaattgacgaccgctttgcctccgccctgaccgcgctgaacgacatgggcaaggtgcgaaaggacatccaacagtgggagcccagccgggggtggaatgattggacccaagtacccttctgcagccaccacttccatgagttagtgatgaaggacggccgcgtactggtcgttccctgccggaatcaggacgagctcatcggccgcgcccgcatctcacagggcgccggctggagtctgaaggagactgcctgcctgggcaagagctacgcgcagatgtggactctcatgtactttcacagacgggacctccgcctggcggccaacgccatctgctccgccgtcccgtctcactgggtcccgacctctcggacaacctggtctatccacgcgaagcacgaatggatgacgaccgaggacatgctcgccgtctggaaccgcgtctggatacaggagaatccctggatggaggacaaaacgcccgtggaatcctgggaggaagtcccctacttaggaaagcgagaggatcagtggtgtggaagcctgatcggcctcacatcccgtgccacgtgggccaagaacatccagaccgccattaaccaggtgcgctcccttataggcaacgaggagtacacagactatatgcccagcatgaagcggttccgacgggaggaggaggaggccggggtcctgtggtga

SEQ ID NO: 24917 - RNA, 9876 nt, synthetic construct
  misc_feature 1..9876: note = derived and/or modified CDS sequence (opt11) from DENV-2__FJ024474__SS-prME
  source 1..9876: mol_type = other RNA
acggcgggcgtgatcgtaatgctgatccccaccgccatggcgttccatttaacgacgcgcaacggggagccacatatgatcgtgggtcggcaggagaaggggaaaagcctgctgtttaaaactgaggacggcgtgaatatgtgcaccctgatggccatagacctgggggagctgtgcgaagacacgatcacctacaagtgccccctcctaaagcaaaacgagcccgaagatatcgactgctggtgcaactcaaccagcacatgggtcacttacgggacctgcaccaccacgggcgagcaccgacgcgagaagcgctccgtggccttggtgccccacgttggaatgggcctcgagacgcggaccgagacgtggatgtctagcgagggggcttggaaacacgtgcagcgcatcgagacatggattctgcggcacccgggcttcaccataatggcagcaattctggcctacacaatcggcaccacgcacttccagcgcgccttgatattcatcctgctaaccgccgtagcgccctcaatgactatgagatgcatcggcatctccaatagggacttcgtcgagggcgttagcgggggatcctgggtggatatagttctcgaacacgggagctgtgtgactacgatggccaaaaacaaacccacgctggacttcgagctgataaagaccgaggccaagcagccagcgaccctccggaagtactgcatcgaggccaagctgaccaacacaacaaccgagtcacgatgcccgacgcaaggcgagccctctctgaacgaggagcaggacaagcgattcatctgcaagcactcgatggtcgaccgcggatgggggaacggctgcgggctgttcggcaagggcgggatcgtgacctgcgcgatgttcacctgcaagaagaacatggaagggaaggtggtgcagcccgagaacctggagtacaccatcgtgatcactccccatagcggggaggaacacgccgtgggcaatgacataggtaaacatggcaaggagattaagatcaccccgcaatccagcatcaccgaggccgagctgacaggttacgggactgtgacgatggagtgcagcccccggaccggtctcgacttcaacgaaatggtcctccttcagatggaggacaaggcctggctcgtacatcgtcagtggttcttggatctacccttaccctggttaccgggggccgacacccagggcagcaactggatccagaaggagaccctggtaacgttcaagaacccccacgcgaagaagcaggacgtcgtggtcctcgggtctcaggagggcgcgatgcataccgccttgaccggggcaaccgaaatccagatgagttccggcaacctcctgtttacgggccaccttaagtgccgactgcgaatggacaagctacaactgaaagggatgagctacagcatgtgtaccggcaaattcaagatcgtgaaggagatagccgagacccaacacgggaccatcgttatccgggtccaatacgagggcgatggctcaccatgcaagatccccttcgagatcacagacctggagaagcgccacgtgctcggccggctgatcaccgtgaatccgatcgtcatcgaaaaggacagccccgtgaacatcgaggccgaaccgcccttcggcgactcctatatcattataggggtggagccgggtcaattgaagctcaactggttcaagaaggggtcatccataggccagatgttcgagaccacaatgaggggagccaaacggatggccatcctgggggacacggcgtgggacttcggcagtctcggcggggtgttcacctccattgggaaggccctccatcaggtgttcggggcgatctacggcgctgcattcagcggagtgtcctggaccatgaagatcctgattggcgtcgtgatcacttggatcgggatgaacagccggtccacgtctttgtctgtgagcctcgtgctcgtgggcgtggtcaccctatatctgggggctatggtgcaggcagactccggctgcgtggtcagttggaagaacaaagaactgaaatgcggctccggtatcttcatcaccgataatgtgcacacctggacggagcagtacaagttccagcccgagtccccgagcaaattagcctctgcaatccaaaaggcccacgaggaaggcatctgcggcatccgcagcgtgacccgtcttgagaacctcatgtggaaacaaattaccccggaactgaaccacatcttatctgaaaacgaggtgaagcttaccatcatgaccggcgataccaaggggatcatgcaggcgggcaaacgctacttacggccgcagccaacggagcttaagtacagctggaagacctggggcaaggccaagatgttgagtacggagagccacaaccagacgttcctgattgacgggcccgagaccgccgagtgcccgaataccaaccgagcctggaactccctggaggtggaggactacggctttggggtgttcacgaccaacatctggctcaagctgcgggagaaacaggatgtcttctgcgatagcaagctgatgtccgccgctattaaggacaaccgcgcggtccacgcggatatggggtactggatcgaatcggccctcaatgacacctggaaaatggagaaggcttccttcatcgaggtcaagagctgtcactggcccaaaagccacaccctgtggagcaatggcgtgttagagagcgagatgattattcctaagaacttcgccgggccagtgagccagcacaattacaggccggggtaccacacccagacggccggtccctggcacttaggaaagctagagatggacttcgacttctgcgaagggaccaccgtggtcgtgaccgaggactgtggcaaccgcggcccctcactgcggacaaccaccgcctcagggaagctcataaccgagtggtgctgcagaagctgcacgctgccccccctcaggtaccgcggcgaggatgggtgttggtacggtatggagatcagacccctcaaggagaaagaagagaacctagtgaactcgctggtcacagccggtcacggccaaatcgacaacttttccctcggcgtactggggatggccttattcctcgaagagatgctgcggacccgggtggggactaaacacgcgatcctgctggtcgccgtgtccttcgtgacgctgatcaccgggaacatgagctttcgcgacctgggcagggtcatggtaatggttggtgctacgatgacggacgacatcggcatgggagtcacgtacctcgccctattagccgcgttcaaggttcgccccaccttcgccgccgggctactactgcgcaagttgacaagcaaggaactgatgatggccaccatcggaatcacgctactcagccaatccacgattcccgagaccatcctggagctaaccgacgcgttagcgctgggcatgatggtgttaaagatcgtccgcaacatggagaagtaccagctggccgttacgataatggccatcagctgcgtgcccaacgccgtcattctgcgcaatgcctggaaagtgtcctgcaccatactggcggcagccagcgtgagccccctcctgcttacctcgtcccagcagaaggccgactggatccccctcgcgctgacaattaagggcctgaatcccacggccatatttctcaccaccctgagccggacctccaaaaagcgcagctggccgctaaacgaagccatcatggccgtcggcatggtctccatcctcgctagctcgctgctgaagaacgatatccccatgacggggccgctcgttgcgggcgggcttctgaccgtgtgctatgtattaaccggacggagcgcagacctggagttagagcgcgccgcagacgtcaagtgggaggatcaagccgaaatcagcggctccagccccatactctccatcaccatcagcgaggatggcagtatgagcatcaagaatgaggaggaggagcagattctgacgatcctgatccggaccggcctcctggttatttccggggttttcccggtcagcatccctataaccgcagccgcctggtacctgtgggaggtgaaaaagcagcgggccggcgttctctgggacgtcccgagcccgcctcccgtggggaaggccgagttggaggacggtgcttaccggataaagcagcgcggtatcttgggctacagccaaatcggagccggggtgtacaaggagggcaccttccacaccatgtggcatgtcacgcgcggggcggttctcatgcacagaggcaagcggatcgagccgtcgtgggccgacgtgaagaaggacctgatctcctacggggggggatggaagctcgaaggggagtggaaggagggcgaggaggtccaagtcctagcactggagcccggtaagaaccctcgcgcggtgcagaccaaacccggcatcttcaagaccaacactgggacgattggcgccgtctccctagacttcagcccgggcaccagcgggagtcccatcgtggaccggaagggtaaagtggtcgggttatacggcaacggcgtggtgacacgctctggagcctatgtcagcgccatcgcgcaaacagaaaagtcgatcgaggacaacccggagatcgaggacgacatcttccggaagaaacgcctgacgataatggacctgcaccccggcgccggaaaaaccaagcggtacctccccgctattgtacgcgaggccatcaagagaggcttgcgcaccctgatccttgcgccaactagggtggtcgcggccgaaatggaggaagcactccgggggctgcccatacgttaccaaactcccgccatcaaggccgagcacaccggccgagagattgtggacctgatgtgccacgcgaccttcaccatgcgcctcctttcaccggtgcgggtacccaattacaacttaataatcatggacgaggcgcatttcacagaccccgccagcatcgctgcccgcggctacatctccacgcgggtggagatgggtgaagcggctggcatcttcatgaccgcaacgccgcccgggagccgggatccgtttccccagtccaatgcccccattatggacgaggagcgggaaatccccgagcgcagctggaactccggccatgaatgggtgactgacttcaaaggaaaaacagtttggttcgtcccgagcatcaaggcgggaaacgatatcgccgcgtgcctccggaagaacggaaagaaggtaatccagctgtccaggaagaccttcgacagtgagtacgtcaagacccgggccaacgactgggattttgtggtaacgaccgacatctccgagatgggggccaactttaaggcggagcgcgtcatagatccccgccgctgcatgaagcccgtgatccttactcacggcgaagagcgggtgatcctcgccgggcccatgccggtcacgcactcctccgccgcccagcgccggggccgcatcgggcgcaatcccaagaacgagaatgaccagtatatctacatgggcgaacccctggaaaacgacgaggactgcgcgcactggaaggaggccaagatgctgctcgacaacataaatacccccgagggcatcatcccgagtatgtttgaacccgagcgggagaaggtggacgccgtggacggagagtaccgccttaggggcgaagcccgcaagacatttgtcgacctgatgcggcgcggggacttacccgtgtggctggcctacaaggtggccgcggagggcatcaattacgccgaccggaagtggtgtttcgacggtatcaaaaacaaccagatcttggaagagaatgtcgaggttgagatttggacgaaggagggagagcgcaagaagctcaaaccgcggtggctggacgcccggatctactccgaccccctggcccttaaagagtttaaggagttcgcggccgggcggaaatccttgaccctgaacctcatcacggagatggggcgcttgcccaccttcatgacccagaaagcccggaacgccctcgacaacctcgccgtcttgcataccgccgaggccggcgggcgcgcctacaaccacgccctgtccgaactgcccgaaacgttagagacgctgctactcctgaccctactggccacagtgacgggcggaatcttcctgttcttaatgtctgggaaaggcatcgggaagatgaccctgggtatgtgctgcatcatcactgcgtccgtgcttctctggtacgcccagatccagccgcattggatcgccgccagcatcatcctggagttcttcctgatcgtcctcctgatccccgagcccgagaagcagcggacgccccaagataaccaactgacctacgtggttatcgccatcctcacggtcgtcgcggccaccatggccaacgagatgggtttcctggagaagaccaagaaggacctgggcttgggctccatcaccacgcaggaaagcgagagcaacatcctggacatcgacttgcgcccggcctccgcgtggaccctctacgcggtggctaccaccttcgtcacgcccatgctacggcacagcatcgagaactccagcgtgaacgtttcactgaccgccatcgcaaaccaggcgaccgtcttaatggggctcggcaaggggtggcccctgtcaaagatggatatcggcgttcccctcctggccatcgggtgttattcccaggtgaacccgatcaccctgacggccgccctactgctactcgtcgcccactacgccatcatcggccccggattacaggccaaggccacacgggaggctcagaagcgtgccgcggccgggatcatgaagaatcccaccgtggacggcatcacggtgatcgatttagagccgattccgtatgaccccaagttcgagaagcaattggggcaggtcatgcttctgatcctctgcgtgacccaagtcctaatgatgcgcaccacctgggccctctgcgaggccctcaccctggccacgggtcccatcagcacgctgtgggagggcaacccgggccggttctggaacaccaccatcgcggtctctatggccaacatctttcgcggctcgtatctcgccggcgccggcctcctgttttccataatgaagaatactaccaacacccgcaggggaaccggcaacattggagagaccctcggggagaagtggaaatcccgcctgaacgcgctgggcaagagtgagttccagatctacaagaagtcggggatccaggaggtggaccggacactcgcaaaggagggcatcaaacgcggggaaaccgaccaccacgccgtgtcccgggggtccgctaagcttcgctggttcgtcgagcggaacatggtgaccccggaaggcaaagtggtcgacctggggtgcggccgcgggggctggtcctactactgcgggggcctcaaaaacgtgcgggaggtgaagggccttacgaagggcggccccggacacgaagaacccatcccgatgagcacctacggttggaacctggtccgtctgcagtccggggtggacgttttcttcaccccgcccgagaaatgcgacaccctgctgtgcgatatcggggaatccagcccgaacccgacgattgaggccggtcgtacgctcagggtgctgaatctagtggagaactggctcaacaacaacacccagttctgcatcaaagtgttaaacccgtacatgccctcggtcattgagaaaatggagaccttacagcggaagtacgggggcgcgctcgtgcgcaacccccttagtcggaattcgacccacgaaatgtactgggtgtcgaacgccacggggaacattgtctcctccgtgaacatgatctcgcgcatgctgatcaaccgattcaccatgaagcacaaaaaggccacctacgagccggacgtagacctgggtagcgggacacgcaacatcggcatcgagtccgagatccccaacctcgatatcatcggaaagcggatcgagaagatcaagcaggagcacgagaccagctggcactacgaccaagaccacccctacaagacctgggcataccacgggtcctacgagacaaagcagaccggcagcgcctccagcatggtcaacggggtggtccgtctgcttacgaagccctgggatgttgtgcctatggtgacccagatggctatgaccgataccacacccttcggccagcagcgcgtcttcaaggagaaggtagacacccggacccaggaacccaaggaggggaccaagaagctcatgcgcataactgctgagtggctgtggaaggagttggggaagaagaagacgccccggatgtgcacccgagaggagttcacccgtaaggttcgctccaacgctgccttaggcgccattttcacggacgagaataagtggaagtccgcgcgggaggcggtcgaagacgggaggttctgggagctggtggaccgggagcgcaacttgcacctcgagggcaagtgcgaaacctgcgtctataacatgatggggaagcgggaaaagaagctgggcgagtttggcaaagccaagggctcccgcgcgatatggtacatgtggctgggcgcgcggttcctcgaatttgaggctctgggcttcctgaatgaggaccactggttcagccggggcaacagtctatccggggttgagggcgagggactgcaccggctggggtacatactccgcgacgtgggaaagaaggagggcggcgccatgtacgcggacgatacagccgggtgggatacccggatcacactggaagaccttaaaaatgaagagatggtcaccaaccacatgaagggcgagcacaaaaaactcgcggaggctatcttcaagctgacataccagaacaaggtggtccgcgtccagcggccgacgccccgcggcacggtgatggatattatcagccgtcgtgaccagcgcggttccggacaggtggggacctacggcctgaacaccttcactaatatggaggcccagctcatccggcagatggagggcgaggggattttcaaaagcatccagcacttgacggccaccgaggagatcgccgcgcagaactggctggcccgcgtcggccgtgaacgcttgtcccggatggccatctctggggacgactgtgtcgtgaagcccatcgacgaccgcttcgcttccgctctgactgcgttgaacgacatgggcaaggtccggaaggacatccagcagtgggagcccagccgcggttggaacgactggacgcaagtgccgttctgctcccaccatttccacgagctagtgatgaaggatggcagagtcctggtggttccctgccgcaaccaagacgagctgataggccgcgcacgcatcagccagggggccggctggtccctcaaggagacggcctgcctgggaaagagctacgcacagatgtggaccctgatgtacttccaccggcgcgacttgcggctggcggccaacgccatctgcagtgccgtcccctcccactgggtgccgaccagtcgcaccacgtggagcatccacgcgaagcacgagtggatgacgacagaggacatgctagccgtgtggaaccgggtctggatccaggaaaacccgtggatggaggataaaacccccgtggaatcctgggaagaggtgccctacctcggcaagcgcgaggaccagtggtgcgggagcctaatcggactcacgagtagggcgacgtgggcaaagaacatccagactgccattaatcaggtccgcagcttaattggcaacgaggagtacaccgattacatgccgagtatgaaacgattccggcgagaggaagaagaggcaggggtactgtggtga

SEQ ID NO: 24918 - RNA, 9876 nt, synthetic construct
  misc_feature 1..9876: note = derived and/or modified CDS sequence (opt11) from DENV-2__FJ024475__SS-prME
  source 1..9876: mol_type = other RNA
accgcgggcgtgattgtcatgctgatccccacggccatggctttccacctcaccacccggaacggggagccccatatgatcgtgggccggcaggagaaggggaagtcccttttattcaagaccgaagacggcgtgaacatgtgtactcttatggccattgatctaggggagctgtgcgaggataccatcacctataagtgcccactactgcgccagaatgagcccgaggacatcgactgctggtgcaacagtacctcgacgtgggtcacctacgggacctgcaccaccacgggcgagcaccggcgcgagaagcggtccgtggccctggtgccacacgtagggatgggcctcgagacccggaccgagacctggatgagctccgagggggcctggaagcacgtgcagcggatcgagacttggatcttgcgccacccgggcttcaccattatggcggcaatcctggcatacaccattggcaccacgcacttccagcgggccttaatttttatcctgctcacagccgtcgcgcctagcatgactatgcgctgtatcggcatctccaaccgggacttcgtcgagggcgtgagcgggggctcctgggtcgatatcgtcctcgaacacggaagctgtgtgaccacgatggcaaagaacaagcccaccctggacttcgagctgatcaagaccgaggccaagcagcccgcgaccttacgcaagtactgcatcgaggccaaactgacgaacaccacgacagagtccaggtgcccaacccaaggtgagcccagcttaaacgaggagcaggacaagcgtttcatctgtaagcactccatggtggacagaggctgggggaatggctgcgggctgttcggcaaaggagggattgtgacctgtgcgatgttcacgtgcaagaagaacatggagggcaaggtggtgcagcccgaaaacctggaatacacgatagtcatcacgccccacagcggagaggaacacgccgtgggcgacgacaccggaaagcacggcaaagagatcaagatcaccccgcaatccagcattaccgaggccgagctaaccggatacgggactgtgaccatggaatgctctccccggaccggacttgatttcaacgaaatggtgctgttgcagatggaggataaggcctggctcgttcatcgccaatggttcctggacttacccctcccctggctcccgggggcggacacccaaggctccaactggatccagaaggagacactggtgactttcaagaacccccatgcgaagaagcaggacgtcgtggtcctcgggtcgcaggagggagccatgcacaccgccctgaccggggccaccgagatccagatgagcagcggaaacctcctatttaccgggcacctgaagtgccgcctgcggatggacaagctccagctgaaggggatgtcctactctatgtgcaccggcaagtttaagatcgtgaaggagatcgccgagacccaacacgggacaatcgtcatccgcgtccagtatgagggcgacggcagtccctgcaagatccccttcgaaatcaccgacctggagaagcggcacgtgttgggccgcctgatcaccgtgaacccgatcgtcattgagaaggacagccccgtgaacattgaggcggagccgcccttcggcgactcctacatcatcatcggggtagagccaggccagctaaagcttaattggttcaagaaggggagctccatcggccagatgttcgaaaccacgatgagaggcgccaagcggatggctattctgggggacaccgcctgggacttcggcagcctaggcggcgtcttcacctccatcggcaaggccctccaccaggtgtttggggcaatctacggcgccgccttctctggggtttcctggaccatgaagatcctgattggcgtcgtcattacgtggatcggcatgaactcccgttccacctctttatccgtgagcctggtcttagtgggagtcgtcaccctgtacctaggggctatggtgcaggcggactccgggtgcgtcgtcagctggaagaacaaggagctcaaatgcggttcagggatcttcatcaccgacaacgttcacacgtggactgaacagtataaatttcagcccgagtcgcccagcaagctggcatccgctatccagaaagcccatgaggagggcatatgcgggatccggagcgtgacccgcttggagaacctcatgtggaaacagatcacgccggagttgaaccacatactgtccgaaaacgaggtcaagctcacgatcatgaccggcgacaccaaagggattatgcaggcgggcaagcggtacctacgcccgcagcccaccgagttaaagtactcctggaagacgtggggcaaggcgaagatgctctccaccgagagccacaaccagaccttcctgatcgacgggccggagaccgctgagtgccctaacacgaaccgggcctggaactccctggaagtggaggactatggcttcggggtgttcaccaccaacatatggctcaaactgcgcgagaagcaggacgtcttttgcgacagcaagctgatgtccgccgcgatcaaggacaaccgggcggttcacgccgacatgggctactggatcgagagcgccctcaacgacacctggaagatggaaaaagcttccttcatcgaagtcaaaagctgccactggcccaagtcccacactctgtggagcaatggggtgctggagagtgaaatgattatccccaaaaactttgccgggcccgtgtctcaacacaattaccgcccgggctaccacacgcagaccgcagggccatggcacctcggtaagttggagatggactttgacttttgcgaggggactaccgtggtggtgactgaggactgcggtaaccgaggcccgtccctccgcacgaccactgcctcgggtaagctcatcacggagtggtgctgccgtagctgtaccctgcccccgcttcgctaccggggggaggatgggtgctggtacggcatggagattcgcccactcaaggagaaagaggagaacctggtaaacagtctggtaaccgccggccacggccagatcgacaacttcagcttgggcgttctggggatggccctcttcctcgaggagatgctgcggacccgcgtgggcacgaagcatgcgatactgctagttgcggtgtcctttgtgaccctgattacggggaatatgagctttcgggacctgggcagagtcatggttatggttggggccactatgacggacgacatcggcatgggcgtcacttaccttgccttgctggctgcgtttaaggtgcggcccacctttgccgccgggctcctgctgcggaagctaacttccaaggagctgatgatggccacgatcggcatcaccctgctcagccagtccaccatcccagagaccattctggagctgactgacgccctcgcgctgggtatgatggtgcttaagatcgtcaggaacatggagaagtaccagctcgccgtgaccatcatggccatcagctgcgtgcccaacgccgtaatactgcgaaacgcctggaaggtgtcctgcaccatcttggcggccgtgagcgttagccccctgctgttgaccagctcccagcagaaggccgactggatcccccttgcgcttacgattaagggcctgaaccccaccgcgatcttcctcaccaccctgagccgcacgtccaagaagcggtcatggccgctgaacgaggcaattatggccgtgggcatggtctccatcctcgcaagcagtctgctgaagaatgacatccctatgactggccccctcgtggccggcggtctgctgaccgtgtgctacgtcctcaccggccgcagcgcggacctggagctcgagcgggccgccgacgtgaagtgggaggatcaggcggagatctcaggtagcagccccatcttgtccatcacgattagcgaggacggctcgatgagcatcaagaacgaggaggaggagaccaccctgaccatcctgatccgcaccggcctcctggtaatctctggggtcttcccggtgagcatccccatcacggccgcggcctggtacctgtgggaggtgaaaaagcagcgggccggggtcctatgggacgtgccgagcccgcctcccgtggggaaagccgagctggaggacggcgcctaccgcatcaaacagcgggggatccttggctatagccagatcggcgcgggcgtctacaaggagggcaccttccacacgatgtggcacgtcacccgcggggccgtgctcatgcaccgtggcaagcgcatcgagccctcctgggcggacgtcaagaaggacctgatcagttacggggggggctggaagctcgaaggagagtggaaggagggggaggaggtccaggtgctcgcgctggagccggggaagaacccccgggccgtccagaccaagcccgggatcttcaagacgaacacagggaccatcggcgcagtcagtcttgacttcagccccggcacgtccgggagcccaatagttgaccgcaagggaaaggtcgtggggttgtacgggaacggggtggtcacccggtccggggcctacgtgagcgccatcgctcaaaccgagaagtccatcgaagacaacccagaaatcgaggatgacatattccgcaagaaacggctgactatcatggacctgcacccaggagcagggaaaacgaagcgctacctccccgccatcgtgcgggaggccatcaagcgcggtctgcgcactctgatcctggccccgacccgggtcgtggcggcggagatggaggaggcactcagaggactgccaattcggtaccagacccccgccatcaaggccgaacacacgggccgcgagatcgtggatctgatgtgtcacgctaccttcacaatgcggctcctgagccccgtccgggtgccgaactacaacctaatcattatggatgaagcgcactttaccgaccccgccagcatagccgcccggggctacatctccactcgcgtggagatgggggaggccgccggcatcttcatgaccgcaacgccgcccgggagccgggatccattcccacagtccaacgcccccatcatggacgaggagcgcgagatccccgagcggagctggaactctggccacgagtgggtcaccgacttcaaggggaagacggtgtggttcgtgccgagcataaaggcaggcaatgacattgcggcgtgcctcagaaaaaacgggaagaaagttatccagctgtcccggaagaccttcgactcagaatacgtgaagacccgcgccaacgattgggacttcgtggttaccacggacatctccgaaatgggggccaacttcaaggccgaacgggtgatcgacccgcgccggtgcatgaagcccgtgatcctgaccgacggcgaggagcgtgtcatcctcgcgggacccatgcccgtgacccacagctccgccgcccagcggcgaggacgcatcgggcggaaccccaagaacgagaacgaccaatacatctacatgggggagcccctggaaaatgatgaggactgtgcccactggaaggaggccaagatgctgttagacaatatcaacacccccgagggcatcatccctagcatgttcgagccggaacgcgagaaggtggacgctgtcgacggggagtaccggctgaggggcgaggctcggaaaacgttcgttgacctgatgcgccgaggggatctccctgtttggctggcctacaaggtcgccgccgaaggcatcaattacgcggaccgcaagtggtgcttcgacgggattaagaacaaccagatcctggaggagaacgtggaggtcgaaatttggaccaaggagggcgagcggaagaagctcaagccccgctggctggatgccagaatctactcggacccgctggccctcaaagagttcaaggaattcgccgcggggcgcaagagcttgaccctgaacctcatcaccgagatggggcggctgcccacgttcatgacccagaaggcccgcaatgccctggacaatctcgccgtgctgcacaccgccgaggcgggcgggcgggcatacaaccacgccctgtccgagctccccgagaccctggagacgctgctcttactgaccttactcgccaccgtgaccggcggcatcttcctgtttttaatgagcgggaagggaataggtaagatgaccctgggaatgtgctgtatcatcacggccagtgttcttctctggtacgcgcagatccagccacactggatagccgccagcatcattctggagttctttctcatcgtgctcctgatccccgagcccgagaaacagagaacgccccaggacaatcagctgacctacgtggtcatcgccatcctcactgtggtagccgcgacgatggccaacgagatggggttcctggagaagacgaagaaggatctgggcctcggctcgatcaccacgcaggagagcgagagtaacatcttggacatcgacttacggccggcctccgcttggacgctctatgccgttgcgaccactttcgtgacccccatgctgcgccacagcatcgagaactccagcgtaaacgtctccctgacggccatagccaaccaagccactgtcctcatggggctgggtaaggggtggccactgtcgaagatggacatcggcgtgcccttactggctatcgggtgctacagtcaggtcaacccgatgaccctgaccgccgcgctcctactgctcgtcgcgcattacgccatcatcggccccggcctgcaggcgaaggcaacgcgggaagcccagaaacgcgccgccgcggggatcatgaagaaccccaccgtggacggcatcaccgtcatagacttggagcccatcccgtacgacccaaagtttgagaaacagctcggccaggtgatgctgctgatcctgtgcgtgacccaggtcctgatgatgcggacaacgtgggccctgtgcgaggccctcaccctggccaccgggcccattagcaccctgtgggaagggaaccccgggcgcttctggaacaccaccatagccgtgtccatggcgaatatcttccgaggcagctacctcgccggggcgggcctgctgttctcaataatgaagaacacaacgaacacccggcgcgggaccggcaacatcggcgagaccttaggggagaaatggaagtcccggctgaatgccctgggcaagtccgagttccagatctataagaagtccgggatacaggaggtggaccgcacgctcgcgaaagaaggcatcaagaggggagagaccgaccaccacgccgtctcccggggcagcgctaagctgcggtggttcgtggagcgaaacatggtcaccccggagggcaaggtcgtcgacctggggtgcggccgcggcgggtggtcatactactgcggagggctcaaaaatgtacgagaggtcaaggggctgaccaagggaggccccgggcacgaggagcctatcccgatgagcacgtacggctggaacctggtgcggttacagtccggggtggatgtattcttcaccccgcctgagaaatgcgacaccttactgtgtgacattggcgagagcagccccaacccgaccatcgaggccgggcgcaccttacgggtactgaacctcgtggagaactggctcaacaacaacacgcagttctgtatcaaggtcctcaacccgtacatgccctccgtgatcgagaagatggagaccctgcagcgcaagtacgggggagccctggtgcgaaaccccctaagccgcaactccactcatgagatgtactgggtcagtaatgccactgggaatatcgtgtccagcgtgaacatgatctcccggatgctgatcaaccgcttcaccatgaagcacaagaaggccacctacgagccggacgtcgacttgggcagcgggacccggaatataggcatagagtctgagatccctaacctcgacattatcggcaagcgcatcgagaagatcaagcaggaacacgagacaagttggcactacgaccaagaccacccgtacaaaacctgggcctaccacgggtcctacgagaccaagcagaccggcagcgcctcctcaatggtcaacggggtggtccgcctgctgacaaagccctgggacgtggtaccgatggtcacgcagatggccatgactgacaccaccccgttcggccaacagcgggtgttcaaggagaaggtggacacgagaacccaagagccgaaggagggcaccaaaaaactcatgcggatcaccgcggagtggctgtggaaggagctggggaagaagaagacgccccgcatgtgcaccagagaagagttcacccgaaaggtccggtccaacgccgccctcggcgccatattcaccgacgagaacaagtggaagagcgctcgggaggcggtggaggacgggcggttctgggagctggtcgaccgcgagcggaacctgcacctcgaaggcaaatgcgaaacgtgcgtgtataacatgatgggtaaacgcgagaagaagctgggcgagtttggcaaagccaaaggatcccgagccatctggtacatgtggctgggcgcccgcttcttggagttcgaggcgctggggttcttgaacgaggaccactggttctcgcggggcaactccttatccggggtggaaggcgagggccttcatcgtctggggtacatactccgggatgtcggcaaaaaggagggaggcgccatgtacgccgacgacacagccgggtgggacacccgcatcaccctggaggacctgaaaaacgaggagatggtgacgaaccacatgaaaggcgaacacaagaagctcgccgaggcgatcttcaagctgacctaccaaaacaaggttgtccgcgtgcaacgccccacgccccggggcacggtgatggacattatcagccgcagagaccagcgtgggtccggccaggtcggaacgtacggcctcaacacgttcaccaatatggaggcccagctcatccggcagatggaaggcgagggcatcttcaagagcatccagcacctgactgcaacggaggagatcgccgcccagaactggctggcgcgggtgggcagagaacggctcagtcgcatggccatcagcggggacgactgcgtggtcaagcccattgacgaccggttcgcgtccgccctaaccgcactgaacgacatgggcaaggtgcgcaaggatatccagcagtgggagccctctcgggggtggaacgactggacccaggtgccgttctgttcccaccacttccacgagttagtcatgaaggacggccgcgtgctagtcgtcccctgccggaaccaggacgagctgatcggcagagctcggatctcacagggggccggttggtccctcaaggagaccgcctgcttaggcaagagctatgcccagatgtggacgctgatgtactttcaccgccgggaccttcgcctagcggcgaacgcaatctgctcggccgtgcccagccactgggttcccacgtcccggaccacgtggtcgatccacgccaagcacgagtggatgaccacagaggacatgctggccgtctggaaccgtgtgtggatccaggagaacccgtggatggaggacaagactcccgtcgagtcatgggaagaggtcccctacttaggtaaacgggaagaccagtggtgcggaagcctgataggcctgacgtcccgcgccacctgggctaagaacatccagacggccataaatcaggtgcgcagcttaatcggcaacgaggagtataccgattacatgcccagcatgaagcggttccgccgggaggaggaggaggccggcgtgctgtggtga

SEQ ID NO: 24919 - RNA, 9867 nt, synthetic construct
  misc_feature 1..9867: note = derived and/or modified CDS sequence (opt11) from DENV-2__FJ182012__SS-prME
  source 1..9867: mol_type = other RNA
accgctggcgtgatcgtcatgctgatcccaaccgccatggcgttccacttaaccacgcgcaatggggaacctcatatgatcgtgggccggcaggagaaggggaagtccctgctgttcaagaccgaggatggcgtgaacatgtgcacgctcatggccatcgacctcggcgaattatgcgaggacacgatcacctacaagtgcccacttcttcgccaaaacgagcccgaggacattgactgctggtgcaacagcacctccacgtgggtcacctacgggacctgcaccaccaccggcgagcatcgtcgtgagaagcggtccgtggctttggtgccccacgtcgggatgggtttggagacccgcactgagacgtggatgagcagtgagggggcgtggaagcacgttcaacggatcgagacgtggatcttacgccacccaggcttcactatcatggccgctatcttagcctacaccatcggtaccacgcacttccagcgggccctcatattcatcctgctgaccgccgtcgcgcccagcatgaccatgcgttgtatcggcatctccaaccgggatttcgtcgagggcgtgtcggggggctcctgggtggatatcgtcctcgaacacggaagctgcgtgaccactatggccaagaacaagcccaccctggacttcgagctgatcaaaaccgaggccaaacagcccgccacgctccgcaagtactgcatagaggccaagcttacgaataccaccacagagtccaggtgtccgacgcagggtgagccctccctcaacgaggagcaagacaagagattcatatgcaagcactctatggttgaccggggctgggggaacggctgcgggctgttcggcaagggcgggatcgtgacctgcgcgatgttcacgtgcaaaaagaacatggagggcaaggtggtccagcccgagaacctggaatacaccatcgtcattacaccgcatagcggggaggagcacgccgtgggcaacgacaatgggaaagagatcaaaatcacgcctcaatccagcatcacggaggccgagctgacgggctacggcacggtgacgatggaatgcagcccccggaccggccttgatttcaatgaaatggtcctgctgcagatggaagataaagcctggttggtccacagacagtggttcctggacctgcctctaccctggctgccgggggctgatacccaaggaagcaactggatccagaaggagactctggtgacgttcaagaacccacacgcgaaaaagcaggacgtcgtggtcctcggttctcaggagggggcgatgcacaccgccctgacaggcgccaccgaaatccagatgagcagcgggaatctactatttacgggccacctgaagtgcagactgcggatggacaagctccaacttaagggcatgtcctatagcatgtgcaccggtaaattcaagatcgttaaggagatcgccgagacacagcacggtaccatagtgattcgagtccagtacgagggggacggctccccctgcaaaatcccatttgagatcacggacctggagaaaaggcacgtgttaggccgcctgattactgttaacccgatcgtcatcgagaaggacagccctgtgaacatcgaggcggagccgccattcggtgactcttacattatcattggcgtggagcctgggcagctgaaacttaactggttcaaaaagggctcttccatcgggcagatgttcgagaccacgatgcgcggcgccaagcggatggccatcttaggcgacacggcgtgggatttcggttcgctgggcggggtcttcacctccatcggaaaagccctccaccaggtgttcggggcgatctacggcgccgccttcagcggcgtgtcctggactatgaaaatcctgatcggggtcgtcatcacctggattggcatgaactcccgctccacgagcctttccgtgagcctggtcctagtgggggtggtcaccctgtacctgggcgcgatggtacaagcagactccgggtgcgtggtcagttggaagaataaggagctcaagtgtgggtctggtatcttcatcacagacaacgtgcatacatggacggagcagtacaagttccagcccgagtcgcccagcaagcttgcctcggcaatccagaaggcacacgaggagggcatctgcggcataagaagcgtgacgcgcctggaaaacctcatgtggaaacagatcaccccagaactgaatcacatcctgtccgagaacgaggtgaagctaaccattatgaccggagacaccaagggtatcatgcaggccgggaagcggtacctgcgcccacagcccaccgagctaaagtacagctggaagacctggggcaaggcgaagatgttatccacggagtcacacaaccagacctttcttatcgacggtccggaaaccgctgagtgcccaaacacgaaccgggcctggaattcgctggaggtggaggactacgggttcggggtgttcacgactaacatttggctcaagttgcgcgagaagcaggacgtcttctgcgacagcaaactgatgtccgcggccatcaaggacaaccgggcggtgcacgccgacatggggtactggatcgaaagcgccctcaacgacacctggaagatggagaaggcatccttcatcgaggtaaagagctgccactggcccaagtcccacaccctgtggagcaacggtgtcctggagtccgaaatgatcatccccaagaacttcgccggacccgtgagccagcataactaccggccggggtaccacacccaaacggcgggcccctggcacctcgggaagctggagatggacttcgacttctgcgagggtaccacggtggtagtgaccgaggactgcgggaaccggggcccttctttacgaaccaccactgcaagcggcaagctcattaccgagtggtgctgccggtcgtgcacactgcccccgctgcgctaccgcggggaggacggctgctggtacgggatggagatccgccccctcaaggaaaaggaagagaacctggtgaactccctagtcacggccggccacgggcagatcgacaacttcagcctcggagtgctggggatggcactgttcctagaagagatgctgcggactcgcgtggggaccaagcacgcgatcctgctcgttgccgtatccttcgtgaccctgatcacaggcaacatgagcttccgggatctggggcgcgtcatggtaatggttggcgccaccatgacagacgacattgggatgggagtaacgtacctcgcactgctggcggcgttcaaagtcagacccacctttgcggccggcctcctgctgcggaagctcacctctaaggagctgatgatggccaccatcgggataacgctgctcagccagtccaccatccccgagaccatcctggagctgaccgacgctctcgcgttgggcatgatggtgctgaagatcgtacggaacatggagaagtaccagctcgcggtgacgatcatggcaatcagttgcgtacctaacgccgtcatcctgcgtaacgcctggaaagtgtcttgcaccatactggcggccgtctcggtgagccccctcctactgaccagctcgcaacagaaggcggattggatccccttagctctgaccatcaaggggttgaaccccacggctatcttcctcaccaccctgagcaggacatccaagaagaggagctggccgttaaacgaggccatcatggccgtgggaatggtctccatcctagccagctcgctgctgaagaacgacatccccatgactggcccccttgtggccgggggactgctaaccgtttgctacgtcctcaccgggcggtcagcggacctggagcttgagcgggcggcggacgtgaagtgggaggaccaggcggagatctccggatccagccccattctatccattaccatcagcgaggatggaagcatgtccatcaagaacgaagaggaggagcagattctgacgatcctgatccgcacgggcctccttgtgataagcggcgtcttcccggtaagcatacccatcaccgccgcggcctggtacctttgggaggtgaaaaagcagcgagccggggtattgtgggacgtgcccagtccgccgcccgtgggcaaggccgagctggaggacggggcctaccgcataaagcagcggggcattctcgggtatagccagatcggcgccggggtctataaggagggcaccttccacaccatgtggcacgtcactcgcggagccgtgttgatgcaccggggcaagcgaatcgagccctcctgggccgacgtcaaaaaggacctgatcagctatgggggaggttggaaactggagggcgagtggaaggaaggggaggaggtccaggttctcgccctggaaccgggtaagaacccgcgggcagtgcagaccaagcctgggatcttcaagaccaacaccggaaccatcggagcggtatccctggacttcagccccggcaccagcggcagccccatcgttgaccgcaaagggaaggtcgtggggttatacgggaacggcgtggtcactcggtcgggagcctatgtcagcgctatcgcccagaccgagaagtcaatcgaggacaaccccgagatcgaggacgacatattccgcaagaagcggctgactatcatggatctgcaccccggggctggcaagaccaaacgctatcttcccgcgatcgtgcgggaagccatcaagcgcgggctgcgcactctgatccttgccccgacccgggttgtggccgctgagatggaggaggccctccgcggcctgccaatccggtatcaaacgcctgctattaaggcggagcacaccgggcgcgaaatcgtggacctgatgtgtcacgcgactttcactatgcggctactgtcacctgtccgcgtgccgaactacaacctgatcatcatggatgaagcgcacttcactgaccccgctagcatcgccgccagaggatatatctccactcgcgtggagatgggagaagccgcggggatcttcatgaccgccacgccacccggctcacgggacccgttccctcagtcgaatgcgccaatcatggacgaggagcgcgagatccccgagcggtcctggaactccgggcatgagtgggtaacggacttcaaaggcaaaaccgtctggttcgtgcccagcatcaaggccgggaacgacatcgccgcatgcctccgtaagaacggcaagaaggtcatccaactgtcgcggaagaccttcgactcagagtacgtgaagacccgcgctaacgattgggactttgtggtcacgaccgacatctccgagatgggcgcgaacttcaaagcagagcgggtgatcgacccccgccggtgtatgaagcccgtgatactgacccacggggaagaaagggtcatcctagcggggcccatgccggtgacccactcgtccgctgcccagagacgcggccgcatcggccggaatcccaagaacgagaatgaccagtacatctacatgggagagcccctggagaacgacgaggactgcgcacactggaaggaggccaagatgctgctggacaatatcaacacgcccgagggcatcattccgagcatgttcgagcccgaacgcgagaaagtggacgcggttgacggcgagtaccggctgcgcggggaggcccggaaaaccttcgtggatctgatgaggcggggcgacctccccgtctggctggcctataaggtcgctgcagaggggatcaactacgcggaccgcaagtggtgtttcgacggcatcaaaaacaaccagatcctggaagagaacgtcgaggtcgagatttggacaaaggagggtgagcggaagaagctcaagccacgctggctggacgcaaggatttattccgaccccctggctctcaaagagttcaaggagtttgccgcgggcaggaagtccttgaccctgaacttgataacggagatgggccggctgcccaccttcatgactcagaaggcccgcaacgcgctcgacaacctggcggtgctgcacacagccgaagccggtgggcgggcctacaaccatgccctgtccgaactccctgagacgttggagactcttctcctgctgacccttctggccaccgtgactggtggcatctttctcttcctcatgagcggaaaggggatcggcaagatgactttagggatgtgctgcatcatcaccgcctccgttctcctctggtacgcccagatccaaccgcactggatcgccgcgagcatcatcctggaatttttcttaatcgttctcctgatcccagagccggagaaacagcgcacgccccaggacaaccagctgacctatgttgtcatagccatcctcacggtcgtggccgccaccatggccaacgaaatgggcttccttgaaaagacaaaaaaggacctaggactcggctccattaccacgcaggagtctgagagcaacatactggacatcgatctgcggccagcgtccgcttggactctctacgccgttgcgacaaccttcgtgacgcctatgctgcgacacagcatcgagaatagtagcgtgaacgtctctctgactgccatcgccaaccaggccactgtgctcatgggccttggaaaagggtggccgctttccaaaatggacatcggggtgcccctcctcgcgatcggatgctactcccaggtgaacccgataaccctcacagcagcgctcctgagcctggtggcacactacgccatcatcggtcccggtctccaggcaaaagcaacccgtgaggcccagaagcgcgccgccgcgggcatcatgaagaacccgaccgtggacggaatcaccgtcatcgatttagaacccataccgtacgaccctaagttcgagaagcagctgggacaagtgatgctattaatcctgtgcgtgacgcaggtgctcatgatgcggaccacctgggccctgtgcgaggcattaaccctcgccactgggcccatatccaccctttgggagggcaacccgggccgcttctggaataccaccattgcggtgagtatggctaacatcttccgcggctcttacctagccggcgcggggctgctcttcagcatcatgaagaacacgactaatacccgacgcggcacggggaacattggcgagacgcttggcgagaagtggaagtcccgcctcaacgccctggggaagtccgagtttcagatatacaagaagtccggcatccaagaggtggaccgcaccctggcgaaggaggggatcaagcggggtgagaccgaccaccacgcggtcagcagggggagtgccaagctccggtggttcgtggagaggaacatggtgacaccagaggggaaggtcgtcgacctgggatgtggccggggaggctggtcctactactgtggaggcctgaagaacgtgagggaggtaaaggggctcacgaagggagggccgggccacgaggagccgatccccatgtctacctacgggtggaacctggtgagactgcagagcggagtcgacgtcttctttaccccacccgagaagtgcgacaccctcctatgcgacattggtgagagctcccccaacccaacgatcgaggcgggccgtaccctacgggtgctcaatctggttgaaaactggctaaataataacactcagttttgcattaaggttctcaatccgtacatgcccagcgtgatagaaaagatggagaccctgcagcgaaagtacggcggggcccttgtacgaaaccccctgtcccgcaatagcacccatgaaatgtactgggtctccaacgcgacgggcaacattgtaagctccgtgaacatgatcagccggatgctgataaaccgcttcacgatgaagcacaagaaggccacctatgagccggacgtcgatctggggtccggcactcggaacatcgggatcgagagcgagatccccaacctggacattataggcaagcgcatcgagaaaattaaacaggaacacgagacgtcctggcactatgaccaggaccacccctacaagacctgggcctaccacggcagctacgagacaaagcagaccgggtccgcctcttccatggtgaacggcgtggtccgactcctgacgaagccctgggacgttgtaccgatggtcacacagatggccatgaccgacaccacacccttcgggcagcagcgtgtgttcaaagagaaggtggacacccggacccaggagcctaaggagggcacaaagaaacttatgcggatcacggcggagtggctctggaaggaactgggcaagaagaagacgcccaggatgtgcacccgggaggagtttacccgcaaggtccggtctaacgccgccctgggggccatcttcacggacgagaacaagtggaagtccgcgcgcgaggcggtggaggacggccggttctgggagctcgtcgaccgcgagcgtaatctgcacctggagggcaagtgcgagacctgcgtgtacaatatgatgggaaagcgcgagaaaaagctcggcgaatttggtaaggccaagggaagccgggccatctggtacatgtggctcggagcccgtttcttagagttcgaggcgctaggcttcctgaacgaggaccactggttctcgcgggggaatagcctgtcaggcgtggaaggagagggcctccatcgcctgggttacatcctgcgggacgtcgggaagaaggagggcggtgccatgtacgccgatgacacggccggctgggacacccgcatcacgctcgaggacctgaagaacgaggagatggtgactaaccatatgaagggggaacacaagaagctggccgaggccatatttaaactcacttaccagaacaaggttgtccgggtgcagcgtccaacgccccggggcacggtgatggacatcatctcccgccgcgaccaacgtggcagtgggcaagtcggcacctacgggctgaacacgttcaccaacatggaggcccagctgatccgccagatggagggcgagggcatatttaaatctatccagcacttgacggccaccgaggagatcgctgcccagaactggctggcgagagtggggcgcgagcggctgagccgcatggccatttctggcgacgactgtgtggtaaagcccatcgacgaccggttcgccagcgccttgaccgcccttaacgacatgggaaaagtccggaaggatatccaacagtgggagccctcccggggctggaacgattggacccaggtaccgttctgctctcaccacttccacgaactggtcatgaaggacggccgcgtcctagtggtcccctgccggaaccaagacgagctgataggcagggcccggatctcccaaggcgccgggtggtcgctcaaggagacggcctgcctcggcaagtcctacgcccaaatgtggaccctgatgtatttccaccgccgagacctgcgcttggccgcgaatgcaatctgcagcgcggtcccgtcgcactgggtgcccacgtctcggaccacctggagtatacacgccaaacatgaatggatgactaccgaggacatgctggccgtctggaaccgcgtctggatccaggaaaacccgtggatggaggataaaacacccgtggagagctgggaggaggtcccctacctagggaagcgggaggatcaatggtgtggcagtctcatcgggctaaccagccgcgctacgtgggccaagaacatccagaccgccatcaaccaggtgcgctcactgatcggtaacgaggaatacaccgactacatgccctccatgaagcggttcagacgagaggaggaagaggccggcgtgctctggtaa

SEQ ID NO: 24920 - RNA, 9876 nt, synthetic construct
  misc_feature 1..9876: note = derived and/or modified CDS sequence (opt11) from DENV-2__EU854293__SS-prME
  source 1..9876: mol_type = other RNA
accgcgggcatgatcatcatgctgatacccaccgtgatggcttttcacctcaccacgcggaacggggaacctcacatgatcgtaagccgccaggaaaagggcaagagcttgctgttcaaaaccggtgacggcgtgaacatgtgcaccctaatggctatggatctgggtgaattgtgcgaggatacgataacctacaagtgcccgctcctgaggcaaaacgagcccgaggacatcgattgctggtgcaactctaccagcacctgggtcacctacggaacctgcaccaccacgggcgagcaccggagagagaagcggagcgtcgcactggtgccccatgtcgggatggggttggagacccgcaccgagacctggatgtctagcgagggggcatggaagcacgcccagcggatcgagacgtggatactgcgccaccccgggtttaccatcatggcagcgatcctggcctacaccatcggtaccactcatttccagcgagccctcatctttatcctgctgaccgcggttgcgccctccatgaccatgcgctgcattggtatcagcaacagagactttgtggaaggcgtgtccgggggctcctgggtagacatagtcctcgagcacggctcttgtgtgactacgatggccaagaacaagcccaccctggactttgagcttataaagaccgaggccaagcagagcgctactctccgaaagtactgcatcgaggcgaaacttacgaacaccaccaccgagtctcgttgccccacgcagggcgagccaagcctgaacgaggagcaggataagcggttcgtctgtaaacactccatggttgaccggggttgggggaatggctgtgggctgtttggcaagggcggtatcgtgacctgtgcgatgttcacgtgcaagaagaacatgaagggcaaggttgtgcagccagagaatttagaatataccatagtaattaccccacacagtggggaggagcacgccgtcggtaacgacaccgggaagcacggtaaggagattaagatcacaccccagtcctctataaccgaagcagagctgaccgggtacggcacggttaccatggagtgctccccgcgcaccggcctcgatttcaacgagatggtgctgctacagatggagaacaaagcctggctcgttcacagacagtggttcctggacctacccttaccctggttaccaggggctgatacccagggcagcaactggatccagaaggaaacgctggtgacctttaagaaccctcacgccaagaagcaggacgtggtcgttctcgggtcacaggagggcgccatgcacaccgccctgaccggtgcaacggagattcaaatgtccagcggcaacctactgttcaccggccacctgaaatgccgcctgcggatggataagctccagctaaaggggatgtcctacagtatgtgcaccggcaagttcaaagtcgtgaaggagatcgccgaaacccagcacgggacgatcgtgatccgggtgcagtacgagggcgacggctccccctgcaagatcccattcgagatcatggacctagagaagcgacacgtgctcgggcgcctgattaccgtaaaccccatcgtcaccgagaaggacagcccggtgaacatcgaggcggagccgcccttcggcgactcctacatcattatcggggtggagcctggccaactgaagctcaactggttcaagaaaggatcttccataggccagatgtttgagaccacgatgcgcggcgccaagcggatggctatcctgggggacaccgcctgggatttcggatcccttggcggggtcttcacctccatcgggaaggccctccaccaggtgttcggggctatttacggcgctgccttcagcggggtgtcctggacgatgaaaatcctgattggcgtcatcatcacgtggatcggaatgaacagccgctccaccagcctaagcgtgagcttagtgctcgtcggtgtggttaccctgtatctcggagtcatggtccaggccgattctggctgcgtggtcagctggaagaacaaggagttaaagtgtggcagcggcatcttcatcaccgacaatgttcatacgtggacagagcagtacaagttccagccggagtcacccagcaagctcgcctccgccattcagaaggcccacgaagagggcatctgcgggatccggagcgtgacccgcctggagaacctcatgtggaagcaaatcactcccgagctgaaccacatcttgtccgagaacgaagtcaagctcacgattatgaccggtgacatcaagggcatcatgcaggccggcaagcggagtctgcgcccccagccgaccgagctgaagtacagttggaagacttggggtaaggccaagatgctctcgaccgagtcccataaccaaacctttctaatcgatggacccgagacagcggagtgccccaacaccaaccgggcatggaacagcctggaggtggaggactacggtttcggtgtattcacgaccaacatctggctgaagctgcgcgagaagcaggatgtcttctgcgacagcaagctgatgtccgccgctatcaaggacaaccgagccgtgcatgcggacatgggttactggattgagtccgcccttaacgacacctggaagatcgagaaagcctccttcatagaggtgaagtcctgccactggcccaagagccacaccctgtggtccaacgaggtactggagagcgaaatgataattcccaagaactttgccggccccgttagccaacacaactaccgccccgggtatcacacccaaacggccggtccttggcacttagggaagttggaaatggatttcgatttctgcgagggcaccaccgtggtcgtgaccgaggactgcgggaaccgcggcccctcattgcgcacaaccaccgcaagcggcaagctcatcactgagtggtgctgtcggtcctgcacgctcccgcctctgcgataccgtggggaggatggctgctggtacgggatggaaatacgaccactcaaggaaaaggaggagaacctggtaaacagcctggtgaccgccggacacgggcagatcgacaacttttccctcggcgttctgggcatggccctgttcctcgaggagatgctccggactagggttggaaccaaacacgccatcctgctcgtggctgtgagtttcgtcactttgataaccggtaatatgtcctttcgggacctcggtcgcgtcatggtgatggtaggggccactatgaccgacgatatcgggatgggagtaacgtacctcgccctgctcgccgccttcaaggtgagacccaccttcgctgccggcctcctcctaagaaagttgaccagcaaggagctgatgatgaccacgatcgggatagtgctgctcagtcagtcaaccatccccgagacaatcctggagcttaccgacgccttagcgctggggatgatggtcctgaaaatggtgcggaagatggagaagtaccagttggcggtgacgatcatggcgatcctttgtgtccccaacgccgttatcctgcagaacgcctggaaggtctcttgtaccattctcgccgttgtaagcgtctccccgctgttcctcaccagctcccagcagaaggccgactggatccccctcgcgctaaccattaagggactgaacccgacggccattttcctcacaaccttgagccggaccaataagaaacgctcctggccccttaacgaggccatcatggccgtaggcatggtgagcatcctcgcgtcctccctgctgaagaacgacatcccgatgacgggacccctcgtagccggcgggcttctgaccgtgtgctacgtgctcaccgggcggagcgccgatctggaactggaacgcgccgccgacgtcaagtgggaggaccaggcggagatctccgggagctccccgatcctcagcatcacaatttccgaggatggatcgatgtccataaagaacgaggaggaggagcagatcctgacgatcctgatcagaaccggcctcctggtgatcagcggcttattccccgtgtccatgcccatcactgccgccgcctggtacctctgggaggtcaaaaagcagcgggccggggtactgtgggacgtgccctcccctccacccgtagggaaggccgaattagaggacggtgcctaccggatcaaacagaagggcatcctgggctactcccagatcggcgccggcgtctacaaggaggggaccttccacaccatgtggcacgtgacgcgaggtgcggtactgatgcataaggggaagcggatcgagcccagctgggcagacgtgaagaaagacctgatctcctacggagggggctggaagctcgagggggagtggaaggagggggaggaggtgcaggtcctcgcgctagaacccggtaagaacccacgcgccgttcagacgaagcccggcctgttcaagaccaacgccggcacgatcggtgcggtgtccctggacttctcacccggaacgagcggctcacccatcattgacaagaaggggaaggtcgtaggcctctacgggaacggcgttgtcacccggagcggggcctacgtgtccgcgatcgctcagaccgaaaagtccatcgaagataacccggaaatagaggacgacatcttccgcaagcggaagctcaccatcatggatctgcaccccggggccggcaagacgaagcgctacctccccgccatcgtgcgggaggctatcaagcgcgggctgaggaccttaatactcgcccccacgcgcgtcgtcgccgccgaaatggaggaggccctgcgaggcctaccgatccgctatcagacgccagcgatccgcgccgagcacacggggcgggagattgtggacctgatgtgccacgcaacattcaccatgcgcctgctctcccccgtccgtgtgccaaactacaacctgatcattatggacgaggctcattttaccgaccctgcctccatagctgcccgcggctatatcagcacgcgggttgagatgggggaggctgccggaatctttatgaccgccacgcctccaggctcccgcgaccctttcccgcagagcaacgcgccgatcatggacgaggaacgggagatccccgagcgctcctggagcagcgggcacgaatgggtcaccgacttcaagggcaaaacggtgtggttcgtgcccagcatcaaggctggcaacgacatcgcggcctgtctgcggaagaacggaaagaaggttatccagctctcccgcaagacgttcgacagcgaatacgtgaagacccggacaaatgactgggactttgtggtcacaaccgacatcagcgagatgggcgcgaacttcaaggctgagcgcgtgatagacccgagacgctgtatgaagcccgtgatcctgaccgatggggaggagcgggtgattctggccggccccatgcctgtgacccacagcagcgctgcgcagcgacggggacgcattggccggaaccccaagaacgagaacgaccagtacatttacatgggcgaacccctcgagaacgacgaggactgcgcgcactggaaggaggctaagatgttgctggacaacatcaacacgcccgaaggcatcatacccagcatgttcgaacctgagcgcgagaaggtggacgcaatcgacggcgagtaccgcctcagaggggaggcccgcaaaaccttcgtcgatctcatgcggcgcggggatttgcccgtttggctcgcctaccgggtggcggccgagggcatcaactacgccgaccgccggtggtgcttcgacgggataaagaacaaccagatactagaggagaatgtcgaagtcgagatctggacaaaggagggggagaggaagaagctgaagcctcggtggctcgacgcgagaatctactccgacccgttagccttaaaagagttcaaggagttcgcagctggccgcaagagcctcaccctgaacttgatcacggagatgggcaggctccccaccttcatgacccaaaaggcccgggacgcattagataacctggcggtccttcacacagccgaggctgggggccgcgcctacaaccacgccctgtccgagctgccagaaacgctcgagaccctgctgctcttgaccctgctcgcgaccgtcaccgggggtatcttcctgttcctgatgagcggccgggggatcggaaagatgaccctcggcatgtgctgcatcatcaccgcctccatcctgctgtggtacgcccagattcagccccactggatcgcggcaagcatcattctcgagttcttcctgatcgtgctgctcatcccggagcccgagaaacagagaacacctcaggacaatcagctgacctacgtcgtgatcgcgatactgacggtggtcgccgccaccatggctaacgaaatgggcttcctcgagaagaccaagaaggatctggggctgggcagcataaccacgcagcagccagagagtaacatactcgacatcgacctgaggccggccagcgcgtggacgctatacgccgtggcgaccacctttgtgacgcccatgctacgccatagcatcgagaacagctccgtcaacgtgtcgctaacagctatcgccaatcaggccaccgtgctgatgggcctggggaagggctggcccctgtccaagatggatatcggggtccctttgctggccatcggctgttacagccaggtgaacccgatcaccctgacggcggccctgttcctcctggtggcgcactatgccatcatcgggccaggccttcaggcaaaagccacccgagaggcccagaagcgcgcggccgccgggatcatgaagaaccccaccgtggacgggataaccgtcatcgacctcgaccccataccgtacgaccccaagtttgaaaaacagctgggccaggttatgctgctcgtcttgtgcgtcacacaggtgctcatgatgcgaaccacatgggccctgtgcgaggctttgaccctggcgacggggcccatcagcaccctctgggagggcaaccccgggcgcttctggaacacaacgatagccgtcagcatggctaacatcttcagaggttcgtatctggccggggccgggttactgttctcaatcatgaagaacaccaccaacaccaggcgcggcacagggaacatcggcgaaacgctgggcgaaaaatggaagtctcgtttaaacgcactcggcaagagcgagttccagatatataagaaatccggcatccaggaggtggaccgcaccctggccaaggaggggatcaagcgcggcgagaccgaccaccatgccgttagccgcgggagtgccaagctacggtggttcgtcgagcgcaacatggtgacgccggagggcaaggtggtcgacctcggctgcggccggggcgggtggtcgtactactgtggtgggcttaaaaacgtgcgcgaagtgaaaggccttacgaagggcgggcccggacatgaggagcccatacccatgtccacctacgggtggaatctagtccggctgcagagcggcgtagatgtcttcttcaccccgcccgagaagtgcgacaccctgctatgtgacataggggagagctcccccaatcccacggtcgaggcgggccgcacgctgcgggtgctgaacctagtggagaactggctgaacaacaacacacagttctgcataaaggtcctgaacccgtacatgcccagcgtgatagagaagatggaggccctccagagaaaatacgggggcgccttggtgcggaaccctttgtcccgcaacagcacccacgagatgtattgggtctcaaacgccagcggaaacatcgtgtccagcgtgaacatgatctcccgaatgttaatcaaccgcttcaccatgcggcacaaaaaggcgacgtacgagccggacgttgaccttggtagcggcacccggaacatcgggatagagtcggagatccccaacctagacataataggcaagcgcatcgagaagatcaaacaggagcatgagaccagctggcattacgaccaggaccatccctacaagacctgggcttaccatggctcctacgaaactaagcagaccggcagcgcgtccagcatggtgaatggcgtggtacggctgctcacaaaaccctgggacgtagtgccgatggtcacccagatggcaatgacggataccacgccatttgggcagcaacgcgtgttcaaggaaaaggttgacaccagaacgcaggaacccaaggagggcaccaagaagctcatgaagatcaccgccgaatggctgtggaaggagctcggcaagaagaagacaccccggatgtgcacgcgggaagagttcacccgtaaggtcagatctaacgctgccctgggggccatcttcaccgacgagaacaagtggaagagtgcccgcgaggccgtggaggattcccggttttgggagctggtcgataaggagcgcaacctccacctggagggcaagtgcgaaacatgcgtgtataacatgatggggaagcgggagaagaagctgggggagttcgggaaggctaagggcagccgcgctatctggtacatgtggctcggcgccagattcctggagtttgaggccctggggttcctcaatgaggatcattggttcagtcgtgaaaactcgctgtcgggcgttgaaggcgagggactgcacaagctcgggtacatactgcgggacgtctccaagaaggaaggcggcgccatgtacgcggacgacacggcgggatgggatacgcgtatcaccctggaggacctcaaaaacgaggagatggtgacaaatcatatggagggggagcataagaaacttgccgaagccatcttcaagctgacgtaccagaacaaagtagttcgggtacagcgaccgacgccgcgggggacggtgatggacatcatcagccgccgggatcaacgcggctccgggcaggtcggcacctatggcttgaataccttcaccaatatggaggcgcagttaatccgtcagatggagggggagggcgtgttcaaatcgatacaacacctgaccgtgaccgaagagatcgcggtccaaaactggctagcccgggtgggccgggagaggctgtccagaatggcgatcagcggcgacgactgcgtggtcaagccactggacgaccggttcgcctccgcgctcacggcgctaaacgatatgggcaaggtgcgcaaggacatccagcagtgggagccgtcacgggggtggaacgactggacacaggtgccgttctgctcccaccacttccatgagcttatcatgaaggacggccgcgtccttgtggtgccttgccggaatcaggacgagctcatcggccgcgcccgcattagccagggcgcgggatggagtctgagagagaccgcctgcctgggcaagtcttacgcccagatgtggtccctcatgtacttccaccgccgcgacctgcggctcgcggccaacgccatctgcagcgccgtgccctcccattgggtgcccaccagcagaacgacctggagcattcacgccaagcatgagtggatgaccaccgaagacatgctaaccgtatggaaccgggtctggattcaggagaatccgtggatggaagacaaaacgccggtagaatcctgggaggagatcccctacctgggtaagcgcgaggaccagtggtgcgggtctctcatcggcctcacctcccgggcgacctgggccaagaacatccagaccgccatcaaccaggtgcgatctctcatcgggaacgaggagtacacggactacatgccctctatgaagcgcttccggcgcgaggaggaggaggcaggcgtcttgtggtaa

SEQ ID NO: 24921 - RNA, 9876 nt, synthetic construct
  misc_feature 1..9876: note = derived and/or modified CDS sequence (opt11) from DENV-2__EU854294__SS-prME
  source 1..9876: mol_type = other RNA
accgccggcgtgatcgtcatgctaatacctaccgccatggcgttccacctaaccacccgcaacggggagccccatatgatcgtaggccggcaggagaaagggaagtccctgctgtttaagacggaggacggcgtgaacatgtgcaccctcatggccatcgaccttggggagctctgcgaggataccattacctacaagtgccccctgctgcgacagaacgagcccgaggacatcgactgctggtgtaacagcacctcaacctgggtcacctacgggacctgcactacgacgggtgagcaccgccgtgagaagagaagcgtagccctggtgccccacgtagggatgggcctcgagacccgcaccgagacctggatgagctctgaaggggcctggaagcacgtgcagcggatcgagacctggatcctccgccatccgggctttaccatcatggccgcgatcctggcctacaccatcggaaccacgcacttccagcgcgccctcatctttattttgttgacggcggtggcccccagcatgaccatgcgatgcataggcatctccaatcgggacttcgtcgagggtgtgagcgggggctcctgggtggacatcgtactagagcacgggagctgcgtgaccacgatggcaaagaataagcccactctggacttcgagctgatcaagactgaggccaagcagcccgccacactccggaaatactgcatcgaggcaaagctgacgaacaccaccaccgaatcccggtgtccgactcagggcgagccctccctgaacgaggagcaggacaagcggttcatttgcaaacactccatggtggaccggggctgggggaacgggtgcgggctgttcggcaagggagggatcgtaacctgcgcgatgttcacgtgcaagaagaacatggaaggcaaagtggtgcagcccgagaacctggaatacaccatcgtcatcacgccccacagcggagaggagcacgcagtcgggaacgataccgggaagcacggcaaagagataaagatcacgccgcagtcgtccatcaccgaggccgagctgaccgggtatggcacggtaaccatggagtgcagcccccgaaccggcctcgacttcaacgagatggtcttgctgcagatggaggacaaggcttggctcgtgcaccggcaatggttcctggatctgccgctaccctggctgccgggggccgacacccagggcagcaactggatccagaaggagacgctcgtgaccttcaaaaatcctcacgcgaagaagcaggacgtcgtggtcctggggtcccaggagggtgccatgcataccgccctgactggtgccacggagatccagatgagcagcggcaacctcctgttcaccggccacctgaaatgccgcctgcggatggacaagctccagctgaagggtatgtcctacagtatgtgcaccggcaagttcaaaatcgtgaaggaaatcgcagagacccagcacgggacgatcgttatccgcgtccagtatgagggcgacggctccccctgcaagatccccttcgaaatcactgaccttgagaaacggcacgtgctcgggcggctgattaccgtgaacccgatcgtcatcgagaaggacagccccgtgaacatcgaagcagaaccgcccttcggcgattcctacatcatcatcggggtcgaaccgggccagctgaagcttaattggtttaagaaggggagcagcattggtcagatgttcgagaccacgatgcggggcgctaagcggatggccatcctgggagacaccgcctgggactttggttcattgggtggggtcttcacctcgatcgggaaggcgctccaccaagtgttcggggcgatctacggtgccgccttcagcggggtgtcctggaccatgaagatccttatcggcgttgtgatcacgtggattggtatgaacagccgttccacaagcctgtccgtgagcctggtccttgtgggagtagtcaccctgtacctgggcgccatggtgcaggcggacagtgggtgtgtggtcagttggaagaacaaggagcttaagtgcggctctgggatcttcatcacagacaacgtgcatacgtggaccgagcagtacaagtttcagcccgagagccccagcaagctggccagcgccatccagaaggcccacgaggagggcatctgcgggatccggagcgtgacacgcctggagaaccttatgtggaagcagatcactcctgagttaaaccacatcctttccgagaacgaggtcaagttaacaatcatgaccggcgacaccaaagggattatgcaggcaggcaagcggtacctgcgcccgcaacccaccgagctgaagtacagctggaagacatggggcaaggcgaagatgctctccaccgagagccacaaccagacgttcctgattgacgggcccgagaccgccgaatgcccgaacacgaatcgggcctggaacagcctggaggtggaggactacggcttcggggtgttcactaccaacatctggttaaagctgcgcgagaaacaagacgtcttctgtgacagcaaactgatgtccgccgccatcaaggacaacagggcggtgcatgccgatatgggctactggatagagtccgccctcaacgacacgtggaaaatggagaaggcctccttcatagaagtaaagtcttgccactggcccaagtcccacaccctgtggagcaacggcgttctggaatccgagatgatcatccccaagaattttgccgggcctgtgtcgcagcataactaccggccggggtatcacacacagaccgcgggcccatggcatctcggcaagctggagatggactttgacttttgtgaggggacaaccgtggtcgtgacggaggactgcggcaaccggggaccctccctgcgcaccaccaccgccagcgggaagctcatcactgagtggtgctgtcggagctgcaccctgcccccgctgcgctaccggggcgaagacggttgttggtacgggatggagatccgcccactcaaggagaaagaagagaatttagtgaacagtctggttaccgccgggcacggccaaatagataactttagtttaggagtccttgggatggcactgttcctggaggagatgctgcgcacgcgcgtcggcacgaaacacgctatcctgttagtagccgtgtccttcgtgaccctgataaccgggaacatgagcttccgggacctgggccgggtcatggtcatggtgggtgccaccatgacggacgatatcggcatgggcgtaacctatctcgccttactggccgcgttcaaggtgcgccccaccttcgccgccggcctcctgctgagaaagttaacctccaaggagctgatgatggccactatcggaatcaccctgctcagccagtccaccattcccgagacaatcctggaactgactgacgccctcgcgctggggatgatggtgctgaagatcgttcgcaatatggagaagtaccagctcgccgttacaataatggccatcagctgcgtgccaaacgctgtcatccttagaaacgcctggaaggtgtcctgcacaatcctggcggcagtaagcgtgagccccctcctgcttaccagctcccagcaaaaggcggactggatccccttagccctcacgatcaagggactgaaccccaccgcgatcttcctcaccaccctgagccgcacgtcaaagaagcggtcgtggccgctgaacgaggcaatcatggccgtaggcatggtctccatcctcgccagcagtctgctgaagaacgacatccccatgaccggccccctcgtggccggtggactgctgaccgtgtgttacgtattgaccggccgatccgcggacttagagctggagcgggccgccgacgtcaagtgggaggaccaggccgagatcagcgggtccagccctattctctccataacgatctccgaggacggctccatgagcatcaaaaacgaggaggaggagcagactctgactatcctgattcgaacgggcctcctggtgatctccggggtcttcccggttagcatacccatcaccgccgcggcctggtacctgtgggaggtgaagaagcagcgggccggcgtcctctgggacgtgcccagccccccgccggtggggaaagccgagctggaggacggcgcctaccgcatcaagcagcgggggatcttggggtatagccagatcggcgcaggggtctacaaagagggcacgttccacaccatgtggcacgtgaccagaggtgcagtcctcatgcaccggggcaagcgcatcgagccctcctgggccgacgtcaagaaggatctgatcagttacgggggcggctggaaactggagggggagtggaaggagggtgaggaggtccaagtgcttgcgctggagcccggaaagaatccccgagccgtccagaccaagcccggcatcttcaagacgaacaccgggacgattggcgccgtctccttggatttcagccccggtacctccgggagccccatcgtggaccgcaagggcaaggtcgtgggactctacggaaacggagttgtcacgcggtccggggcatacgtgagcgcgatcgcacagaccgagaagtccatcgaggataaccccgaaatcgaagacgacatttttcgcaagaaacggctgaccatcatggacctgcaccccggcgcgggaaagacgaaacgctacctccccgcaatcgtgcgggaggccatcaagcgcggactgcgaactctgatcctagctccgacccgggtcgtcgccgcagagatggaggaagccctccgcgggctgcctattaggtaccagacccccgccattaaggccgagcacaccggccgcgagatcgtggacctgatgtgtcacgccacatttaccatgcggctccttagccccgtccgcgtgccaaactacaacctgatcatcatggacgaggcgcacttcaccgaccccgcaagcatcgccgcccgggggtacatctccaccagggtggagatgggggaggccgcgggcatattcatgacggccacgccgcccgggagccgggacccgttcccccagtccaacgcccccatcatggatgaggagcgcgagattcccgagcggagttggaactccggccacgagtgggtcaccgatttcaaagggaagaccgtatggttcgtaccgagcatcaaggccgggaacgacatcgcggcctgtctccgcaagaatggcaagaaggtcatccagctttcccggaagaccttcgactccgaatacgtcaagacacgagccaacgattgggatttcgtggtcaccaccgatatttcggagatgggagccaactttaaggcggagcgggtgatcgacccccgccggtgcatgaagcccgttatcctgaccgacggcgaggagcgcgtcatcctcgcggggccgatgccggtgacccacagctccgccgctcaacggcggggccgcatcgggcggaatcccaagaacgagaacgatcaatacatctacatgggtgagcccctagaaaacgacgaggactgcgcccactggaaggaagccaagatgctgctcgacaacatcaacacccccgagggcataatcccgagcatgttcgagcccgagcgcgagaaggtggacgcggtcgacggtgagtaccggctgaggggcgaggcccggaagaccttcgtggacctgatgcgccgcggtgacctgcccgtgtggctggcctacaaggtcgcagccgagggcatcaactacgcggacaggaagtggtgcttcgacggtatcaagaacaaccagatcctggaggagaacgtggaggtcgagatatggaccaaggaaggcgagaggaagaagctcaagccgaggtggctggacgccagaatctactccgaccccctggccctgaaggagttcaaggagttcgccgcgggtagaaaaagcctgaccttgaacctcatcaccgagatggggcgtttacccacctttatgacgcagaaggcccgcaacgctctcgacaacctcgccgtgctccacaccgccgaggcgggcgggcgggcctacaaccacgccctgtccgagctgcccgagaccctggagaccctcctcctgctgacgctcttagccaccgtgacgggcggcatattcctgtttctcatgagcgggaaaggcatcgggaagatgaccctgggcatgtgctgcatcatcacagcctctgtactgctctggtacgcgcaaatacagccgcactggatcgccgccagcatcatcctggagttcttcctgatcgttttgctgatccccgagcctgaaaagcagcgcacgccacaggacaatcagcttacctacgtggtcatagccatcctcaccgtggtggccgcgaccatggccaatgaaatgggcttcttagaaaagactaagaaggacctgggcctcggttccatcaccacccaagaaagcgagagcaatatcctggatatcgacctgagaccggcctcggcctggaccctgtacgccgttgcgaccaccttcgtgacccctatgctgcgtcatagcattgagaactccagcgtgaacgtgtccctgaccgcaatcgccaaccaagccacagtgctcatgggcttgggcaaagggtggcccctgagcaagatggacatcggcgtgcccctcctggcgatcggctgttactcccaggtcaaccccatcactctgacagcggccctcctgctgctcgtggcgcactacgcaatcatcggacccggcctgcaggctaaggccaccagggaggctcagaagcgcgccgccgcggggatcatgaaaaaccccacggtggacggcatcaccgtcatcgacctggagcccatcccgtatgaccccaagttcgagaagcagttgggccaggtgatgctgctgatcttatgcgtgacccaggtcctgatgatgcggaccacgtgggccctgtgcgaggccctcaccctggccaccggccccatcagcaccctgtgggaggggaacccgggccgcttctggaataccaccatcgccgtttccatggctaacatcttccgcggctcatacttagccggcgccggcctgctgttttccattatgaagaacaccacaaacacgcggcgcgggaccggcaacatcggcgagaccctcggtgagaagtggaagagccgactgaacgccctaggcaaatccgagtttcagatctacaagaagtcagggatccaagaggtggaccgcaccctcgctaaagaggggatcaagcgcggggagaccgaccaccacgccgtcagccgcggctcagccaaactgcgttggttcgtggagcgcaacatggtcaccccggagggcaaggtcgtcgacctgggctgcggccgcggcgggtggtcctactattgcggcgggctcaagaacgtgcgcgaggtcaaagggctcacaaagggaggccctgggcacgaggagcccattcccatgagcacctacggctggaacctggtccggctccagtccggggttgacgtcttctttacgccgcccgagaagtgcgacaccctgctgtgcgacataggcgaaagtagtcccaatcccacgatcgaggccggccgcaccctaagagtgctgaacctggtggagaactggctcaacaacaatacccagttctgcatcaaagtcctgaacccgtacatgccctccgttatcgagaagatggaaacgctacagagaaagtacgggggcgcactcgtgcggaaccccctgagccgcaactccacccacgaaatgtactgggtcagtaacgcgaccggaaacatcgtgagtagcgtgaacatgatctcccggatgctgatcaaccggttcaccatgaagcataagaaggcgacgtacgaaccggatgtcgacttaggcagcgggacccggaacattggcatcgagtccgaaatccccaatctcgacatcatcgggaaaagaatagagaagatcaaacaggagcatgagacctcatggcactacgatcaggaccatccctacaagacctgggcctaccatgggtcctacgaaactaagcagaccggcagcgcctccagcatggtgaacggggtggtccgcttgctgaccaagccgtgggacgtagtcccgatggttacacagatggctatgaccgacaccacccccttcggccagcagcgggtgttcaaggagaaagtggacactcgaacgcaggagccgaaggaggggaccaagaagctcatgcggatcacggccgagtggctgtggaaagaactggggaagaagaaaacgccccggatgtgcacccgggaggagttcacccgcaaggtccggagcaacgctgcactcggtgccatcttcacagacgagaacaaatggaagtccgcgcgcgaagcggtagaggacgggcggttctgggagctggtcgaccgcgagaggaacctgcacctcgagggcaagtgcgagacctgtgtatacaacatgatggggaagcgggagaaaaagttgggcgaatttggcaaggcgaaagggtcccgggccatttggtacatgtggctgggcgcccggttcctcgagttcgaagccctggggttcctgaacgaggaccactggttcagccgaggcaactcactcagcggggtggagggtgaaggcctgcaccggttagggtacattttgcgggacgtcggcaagaaggagggcggcgccatgtacgccgacgacacggccgggtgggacaccaggatcaccctggaggacctgaaaaatgaggagatggtgaccaaccacatgaagggagagcacaagaagctagccgaggccatttttaaactgacgtaccagaacaaagtggtccgagtgcagcgccccacgccccggggcaccgtgatggacatcatctcccgccgcgaccagcggggttccggccaagttgggacgtacggcctgaacacgttcacaaacatggaggcgcagcttatcaggcagatggagggcgagggaatcttcaagagcatccaacacctgaccgccaccgaagagatcgccgcgcagaactggctcgcacgggtgggccgcgagcggctctcccgcatggcaatctccggggacgattgtgtggtcaaaccgatcgacgaccggttcgcctcggccctgacggctctgaacgacatgggcaaggttcgaaaggacattcagcagtgggagcccagccgggggtggaacgattggacccaggtgcccttctgctcccaccacttccacgaactcgtcatgaaggacggccgcgtgctggtggtcccctgtcgtaaccaggacgagcttatcggccgcgcgaggatcagccagggggccggctggtccttgaaggagaccgcctgcctgggcaagtcatacgcccagatgtggaccctgatgtacttccaccgccgggacttgcgcctggcagcgaacgcaatctgctccgcggtaccctcccactgggtgcctacctcccggacgacctggagcatccacgcaaagcacgagtggatgaccaccgaggacatgctggcggtctggaaccgcgtatggatccaagagaacccgtggatggaggacaagacgcccgtcgagtcctgggaggaggtcccctacctggggaagcgggaggaccagtggtgcgggagcctgatcggcctgacctcccgcgccacctgggccaagaacatccagaccgccatcaatcaggtccgcagcctcatcggcaacgaggagtacacggactacatgcctagcatgaagcggttccgccgggaggaggaggaggcaggggtgctctggtag

SEQ ID NO: 24922 - RNA, 9876 nt, synthetic construct
  misc_feature 1..9876: note = derived and/or modified CDS sequence (opt11) from DENV-2__FJ024477__SS-prME
  source 1..9876: mol_type = other RNA
accgccggcgtgatcgtcatgctgatccccaccgccatggcgttccacctcacgacccggaacggggagccccacatgatagtgggccggcaggagaaggggaagtccctgctcttcaagaccgaagacggcgtgaacatgtgtacactcatggccatcgacctgggggagttatgcgaggacactattacctacaagtgccccctcctgcgccagaatgagcccgaggacatcgactgctggtgtaacagcacctccacctgggtcacctatgggacctgcaccaccacgggcgagcaccgccgggagaagcggtcagtggccttagtgccccacgtcgggatgggcctcgagacccgcaccgagacttggatgagctcagaaggggcctggaagcacgtgcagcggatagaaacgtggatactgcgccacccgggcttcaccatcatggccgcgatcctagcatacactatcggaaccacgcacttccaaagggctctcatcttcatcctgttaacggccgtggcgcccagcatgaccatgcgttgcattggaatctctaatcgggacttcgtcgagggcgtgagtgggggatcctgggtggacatcgtcttagaacacgggagctgtgtgaccacgatggccaaaaataagcccaccctggacttcgaactcataaagaccgaggccaagcagcccgcgacgttacgcaagtactgcattgaagcaaagttgacgaatactaccaccgaaagtcggtgcccgacgcagggcgagcccagcctgaacgaagagcaggacaagcgttttatctgcaagcactccatggtggaccgaggttgggggaacggctgtgggctgtttggcaagggcgggatcgtgacatgcgcgatgttcacgtgtaagaagaacatggagggcaaggttgtgcagcccgagaatctggaatacaccatcgtcatcacgccccacagcggggaggagcacgccgtaggcaacgacactgggaaacacggcaaggagatcaagatcacgccgcagtccagcattacagaggccgagctgaccggttacggtacagtgaccatggaatgctcaccccggaccggcctggacttcaatgagatggtactgcttcagatggaggacaaggcctggctcgtgcaccggcagtggttccttgacctacccctcccgtggttacctggggccgacacccagggcagcaactggatccagaaggagacgctggtgactttcaaaaacccccatgcgaagaaacaggacgtggtggtccttggttcccaggagggcgccatgcacaccgccctgactggggcgacggagatccagatgagcagcggaaacttgctgttcaccggccacctcaagtgcagactgcggatggacaagcttcagctgaaagggatgtcctacagcatgtgcacaggcaagttcaagatcgtgaaggagatcgccgaaacccagcacgggactattgttattcgcgtacagtacgagggcgatggcagcccctgcaaaatccccttcgagataactgacttagaaaagcggcatgtgctcgggcgcctgatcaccgtaaacccgatcgtcaccgaaaaggatagcccagtgaatatcgaagcagaaccgcccttcggcgactcctatatcatcatcggggttgagccgggccagctgaagctcaactggttcaagaaggggtcttccattggccagatgtttgagacgactatgcgcggcgccaagcggatggccatcctcggagacaccgcatgggacttcggcagcctcgggggcgtcttcacctctatcggaaaggccctccaccaggtgttcggcgcgatctacggcgccgccttcagcggtgtaagctggacaatgaaaatcctgatcggcgtcatcatcacatggatcggtatgaactcgcgctccaccagcctttcggtgagcctggtactcgtcggcgtggtgaccttatatttaggggccatggtccaggcggattccggatgtgtggtgagctggaagaacaaggagttgaagtgcggttcgggcatctttatcacggacaacgtccacacatggaccgagcagtataaattccagcccgagtcgccctcgaaacttgctagcgcaattcagaaggcccacgaagagggcatctgcgggatccgttcggcaacccgcctggagaatctcatgtggaagcagatcacgcccgagctaaaccacatcttgtcggagaacgaggtgaagctcaccatcatgaccggcgacatcaaggggatcatgcaggcgggcaagcggagtctacgtccgcagcccacagagctgaagtactcgtggaagacgtggggcaaagctaagatgctctccaccgagtcgcacaaccagacttttctgatcgacggtcccgagaccgcagagtgcccgaacaccaaccgggcctggaacagcttggaagtggaggactacggcttcggggtcttcactaccaatatctggctgaagctgagagagaagcaggacgtgttctgcgactccaaactgatgtcagcagcgatcaaggacaaccgggccgtgcatgccgatatgggctattggatcgagtctgcccttaatgacacttggaagatggagaaggcctcattcatagaggtcaagtcttgccactggcccaaatcacacaccctgtggtctaacggggtcctggagtctgagatgatcatccccaagaacttcgcgggaccagttagtcagcacaactaccgcccgggttaccacacccaaaccgccgggccctggcacctcggcaagctggagatggatttcgacttctgcgaggggaccaccgtagtggttacggaggactgcggcaacaggggccccagtcttcgcacaactactgctagcgggaagctaatcacagagtggtgttgccggtcctgcaccctaccgccgctgcgctatagaggcgaggacgggtgctggtatggcatggagatcagacccctcaaagagaaggaagagaacctggtcaacagcctggtgaccgccggccacggccaaatcgacaacttcagcctcggcgtgctgggtatggcgctgtttctcgaagagatgctgcggacccgcgtgggaacgaagcacgccatcctactcgccgccgtgagcttcgtgactctgatcaccggtaacatgtccttccgggacttgggccgcgtcatggtgatggtgggggccaccatgacggacgacatcggcatgggcgttacctacctcgcgttattagcggccttcaaggttcgccccacctttgctgctggtctcctgctgcgcaagctcactagcaaagagctgatgatggccacgataggcatagccctgctctcccagagcaccatacccgagaccattctcgaactgaccgatgccctcgccctaggaatgatggtgctgaagatcgtccgcaacatggaaaaatatcagctcgccgttactataatggcgatatcctgcgtcccgaacgccgtcatcctgcagaacgcctggaaagttagctgcaccatcctggccgtagtctctgtaagccccctacttttaaccagcagtcagcaaaaggcggattggatccccttagctctgaccatcaagggcctgaatcccacggccatttttctaaccactctgtcccggaccagcaaaaaacgcagctggccgctgaacgaggccatcatggccgtcggcatggttagcatcctcgccagcagccttttgaagaacgacatccccatgacgggaccactcgtggccggcgggctgctgaccgtctgctacgttttgaccggccggtctgccgacctggaactggagcgcgccgctgacgtgaagtgggaggaccaagcggagatcagcggcagctccccgattctatctattacaatctccgaagacggctctatgtccatcaagaacgaggaggaggagcagacgctcaccatcctgatacggacaggcctattagtgattagcggagtgttcccggttagcatccccatcactgccgcggcctggtacctgtgggaggtcaagaaacagagggccggcgtgctatgggacgtaccgagcccgccccccgtcgggaaggcggagttggaggatggtgcctaccggattaagcagcgggggattctgggctacagtcagatcggcgcaggggtctataaagaaggcacctttcacacgatgtggcacgtgacccgcggggctgtcctcatgcaccgcggcaagcggatcgagccctcctgggccgacgtaaagaaagacctgatctcctacgggggcggctggaagctggagggggagtggaaggagggcgaagaagtccaggtcttggcgctggagcccggtaagaatccacgcgccgttcagacaaagcccggcatcttcaagaccaacacggggaccatcggcgccgtgtcactggatttctcccccggcaccagcgggtcccccatcgtcgaccggaaaggcaaagtggtggggctctacggcaacggagtcgtgacccgcagcggggcctacgtgtccgcgatagcgcagacggagaagtccatagaggataaccccgagatagaggacgacatcttccggaagaaacgcctcacgatcatggacctgcatcccggagcaggcaaaactaagcggtatctcccggccatagtcagggaggccatcaaacggggactgcgcaccctgatactggctccgacgcgggtggtggcggccgagatggaggaagccctccggggcctgcccatcaggtaccaaacccccgccatcaaggcggagcatacgggccgtgagatcgtcgacctgatgtgccacgccaccttcacgatgaggctcttgagccccgtgcgggtgcctaactacaacctgatcatcatggacgaagcccatttcaccgatcccgcctcgatcgccgctcgcggctacatctcaactagagtcgagatgggggaggccgcaggtatcttcatgacggccacgccgcccggatcccgtgacccgttcccccagagcaatgcgcccatcatggacgaggagcgggagatccccgaacgctcctggaatagcggccacgaatgggtgaccgatttcaagggaaagacggtgtggttcgtaccgtcgattaaggccggaaatgacatcgccgcctgcctacggaagaacggcaagaaagttatccagctgtcacgcaagaccttcgactccgaatatgtgaaaactcgggctaatgactgggatttcgtcgtgacgaccgacatctcagagatgggggccaatttcaaggccgagcgcgtgatcgacccccgacgatgcatgaagcccgtcatcttgaccgatggggaagagcgggttatactcgccggccccatgcctgtgacgcattccagcgccgctcagcgacggggccgcattgggcgcaaccccaagaacgagaacgaccagtacatctacatgggcgagcccctggaaaacgacgaagactgtgcgcactggaaggaagccaagatgttactcgacaatatcaacacccccgaggggatcattccgtccatgttcgagcccgagcgggagaaagtggacgcgatcgacggggagtaccgcttgcggggcgaggcacgcaagaccttcgtggacctgatgcggcgcggggacctacctgtgtggctggcctacaaagtcgctgccgaagggatcaactacgcagatcggaagtggtgcttcgacggcatcaagaacaaccagatcctggaagaaaacgtggaggtcgaaatctggaccaaggagggcgagcgtaaaaaactcaagccgcgatggttggacgcccgcatatacagcgaccccctggcgttaaaggagttcaaggagttcgccgccggccgaaagtcactgacactgaacctcataaccgagatggggcgcctgcccacctttatgacacaaaaggcccggaatgccctagataacctcgccgtcctgcacactgccgaagccggcggccgcgcctacaaccatgcgctgagcgagcttccagagaccctggagactctgttgctattaacgctcctggcaacggtgactggcggcatattccttttcctcatgtccggaaagggcatcgggaagatgaccctgggaatgtgttgcatcatcaccgcctcagtcctgctctggtatgcccagatacagcctcactggatagctgcctctattatcctggagttctttctcatcgtgctcctgatacccgagcccgagaaacaacggacgcctcaggacaaccagctgacatacgtggtcatagccatcctcaccgtggtggccgccaccatggccaacgagatggggttcctggaaaagactaagaaggatctgggcttgggcagcattacgacacaggagagcgaatccaacatccttgacatcgatctgcgcccagctagcgcgtggaccctgtatgccgtagccacgacgtttgtgacccccatgttacggcacagtatcgagaacagctccgtgaacgtcagcctaaccgccatcgcgaaccaggccactgtgctcatgggtctggggaaggggtggccattgtccaagatggacataggcgtgcccctcctggcgatcgggtgctacagccaggtgaacccaatcacgctgaccgccgccctcctgctgctcgttgcgcattacgccatcatcggccctgggctccaggccaaggccacgcgcgaagcccaaaagcgtgcggccgccggtatcatgaagaacccgaccgtggacggaatcacggtgatcgacctggagcccatcccgtacgatcccaagtttgagaagcagctcggccaggtcatgctgctgatcctttgcgtcacccaggtcctgatgatgcgcaccacctgggccctttgcgaggccctcactctggcaacaggccctatctccaccctgtgggaggggaacccaggccgcttctggaacaccacgatagccgtcagcatggccaacatcttccgcggcagttacctggccggggcgggacttctgttctctataatgaagaataccaccaacactaggcgaggtacgggtaacatcggagaaaccctaggggagaagtggaagagtcgcctgaacgccttgggcaagagcgagtttcagatctacaagaagtcggggattcaggaggtggacaggaccctcgccaaggagggtatcaagcgcggggagaccgaccaccacgccgtcagcagaggctccgccaaactgcgctggttcgtagagcggaacatggtgacgcccgagggcaaggtcgtggacctggggtgtggccgagggggatggtcgtactactgcgggggcttaaagaacgtacgggaggtcaagggactgacgaagggaggccccggtcacgaggaacccatacccatgtccacatacggctggaacttagtgcgcctccaaagcggggtggacgtcttttttaccccgcccgagaagtgcgacacgctgctgtgcgacataggcgaatcctcccccaaccccaccattgaggcgggccgcaccttacgcgtactcaacctggtggagaactggctcaacaacaacacccaattctgcatcaaggtcctgaacccctacatgcccagcgtgatagagaagatggagacgctgcaaagaaaatacgggggagcgctcgtgcgaaaccctctgtcccggaactcaacgcacgagatgtactgggtttccaacgccaccggtaacatcgtgagctccgtcaacatgatcagccgcatgctgatcaaccggttcaccatgaagcacaagaaggccacctacgagccggatgtcgatctggggtccgggacgcgcaacatcggtatcgagagcgagattcccaacctcgacatcataggcaagcggatcgagaagattaagcaggagcacgagacctcttggcactacgaccaagaccacccctacaagacctgggcgtaccacggtagctacgagaccaagcaaacgggctccgctagcagtatggtcaacggggtggtccgcctgctgaccaagccatgggacgtagtgccgatggtcacccaaatggccatgaccgacactacccccttcggtcaacagcgcgttttcaaggagaaggtggacacgcgtacccaggaacccaaggagggcacgaagaaactcatgaagatcaccgccgagtggctatggaaagagctaggtaagaagaagaccccccgcatgtgtacccgggaggagttcacgcgtaaggtccggagcaatgcagccttgggagcgatcttcaccgacgaaaacaagtggaagtccgcaagagaggccgtggaggatgggagattctgggagctggtcgaccgggagcggaacctgcacttggagggcaagtgcgagacctgcgtctacaacatgatggggaagcgagagaagaaattgggtgagttcggaaaggcaaaggggagccgggcgatctggtacatgtggctaggagcccgtttcctcgagttcgaggccctgggtttcctgaacgaagaccattggttctccaggggcaactctctcagtggggtggagggcgagggcctacaccgcctgggttacatcctccgggacgtcagtaagaaggaaggcggggccatgtacgcggacgacacagccggctgggacacgcgcataaccttggaagacctgaagaacgaggagatggtgacaaaccacatgaagggggagcacaagaaactcgccgaagccatcttcaagctgacctatcaaaacaaggtggttcgggtgcagcgcccgacgccccggggaaccgtcatggacatcatcagccgccgggaccagcgcggctccgggcaggtcggcacttacggcctgaacacctttacgaacatggaggcccagctcatccgccaaatggagggcgagggcatcttcaagtcgatccagcacctgaccgccaccgaagagatagcggtgcagaactggctggcccgcgtagggagggaacggttgtcccgcatggcaatatcgggtgacgactgcgtcgtgaagcccattgacgaccgcttcgcctccgcactgaccgctctgaacgacatggggaaggtgcgcaaggacatccagcaatgggagcccagccggggctggaacgactggactcaggttcccttctgctcccatcatttccacgaactcgtgatgaaggacgggcgcgtgctggttgtgccctgccgcaaccaagatgagctaatcggccgtgccagaatatcgcaaggcgccgggtggtccctgaaggagaccgcctgcctgggcaagagctacgcacagatgtggacgctgatgtacttccaccgccgtgacctccgcctggcagccaacgcaatttgttccgccgtgcccagccactgggtacccacctcgcggacgacctggtctatccacgcgaagcacgagtggatgacgaccgaggacatgcttgccgtctggaaccgagtctggatccaggagaatccgtggatggaggacaaaacccctgtcgagtcttgggaggaggtgccctacctcgggaagcgggaggatcaatggtgcggctcattgatagggctgacgagccgtgcaacctgggccaagaacatccagaccgccatcaaccaggtgcggtcactcatcggcaacgaggagtacaccgactacatgcccagtatgaagagattccgccgggaagaggaggaggcgggagtcctgtggtga

SEQ ID NO: 24923 - RNA, 9876 nt, synthetic construct
  misc_feature 1..9876: note = derived and/or modified CDS sequence (opt11) from DENV-2__GQ868552__SS-prME
  source 1..9876: mol_type = other RNA
acggccggggtgatcataatgctaatccctaccgccatggcgtttcacctcactaccaggaacggcgagccccacatgattgtaggtcgccaggagaaggggaagtctcttctcttcaagaccgaggacggggtgaacatgtgcaccctcatggccatcgacctgggcgagctgtgcgaggataccatcacctacaagtgccctttactgcgacagaacgagccagaagatatagactgctggtgcaatagcactagcacctgggtgacctacgggacctgcaccaccacgggcgaacaccggcgggagaagcggtccgtcgccctcgtgccccacgttggcatgggcttagagacacgcaccgagacctggatgagctccgaaggcgcatggaagcacgtccagcggatcgagacttggatcctgaggcatcctggctttgccatcatggctgctatcctggcatacacgatcgggacgacacacttccagagagcactcatcttcatattgctaacagcggtcgcgcccagcatgaccatgcgctgcatcggcatctccaaccgagacttcgtggagggagtctccggaggctcctgggttgacatcgtgctcgagcacgggagctgtgtcaccactatggccaaaaacaagcccaccctggacttcgagctgatcaagaccgaggccaagcagcccgccacgctcagaaagtactgtatagaggcgaagttaaccaacacgaccactgagtcccggtgccctacccagggcgagcccagcctgaacgaggaacaggacaagcgattcatctgcaagcacagtatggtggaccgggggtgggggaatggctgcgggctctttggcaagggcgggatcgtgacgtgcgccatgttcacgtgtaagaagaacatggaaggtaaggtcgtgctgcccgaaaatctggagtataccatcgtgatcacgccccacagcggggaggagcacgccgtcggaaacgacactgggaagcatggtaaggagatcaaaatcaccccgcagtcaagcatcactgaggccgagctaaccgggtacggcaccgttacgatggagtgcagccctcgcaccggcctggacttcaacgaaatggtgctgctccagatggaagaaaaagcctggttagttcaccggcagtggttcctagacttgcccctgccctggctgccgggggcggacacccaaggaagcaactggatccagaaggagacgttggttacgtttaaaaacccacacgccaagaagcaggacgtggtcgtgttagggtcccaggaaggcgcaatgcacaccgcgctgaccggtgccaccgaaatacaaatgagcagcggcaacctcctatttactggccacctgaagtgccgcctccgcatggacaagctacagctgaaggggatgagctacagcatgtgcaccggaaagttcaagatcgtcaaggaaatagcagagacccagcacgggaccatcgtcatccgcgtgcagtatgagggagatgggtccccctgcaaaatcccctttgagattatggatctcgagaagcggcacgtgctggggcgactgatcacagtgaaccccatcgttaccgagaaggactcgcccgtgaacatagaagcagagccgcccttcggagattcgtacattatcatcggggttgagccgggccagctcaagctgaactggttcaagaaggggagctccatcggccaaatgtttgaaaccacgatgcgcggcgcgaagcggatggcgatactgggtgacacagcctgggactttggctcattagggggcgtattcacctctatcgggaaggcgcttcatcaggtcttcggcgcgatttacggtgcagccttcagcggggtgtcctggaccatgaagatcttgataggggtgataatcacttggatcggaatgaacagccgcagtacgagcctgtccgtctcgctggttctggtgggtgtggtaaccttgtacttgggggcgatggtccaggcggattccggctgtgtagtatcctggaagaacaaggagctgaaatgtggctcagggatcttcatcaccgacaacgtgcacacctggaccgagcaatataagttccaacccgagagcccgtcgaagctagcatccgccatccaaaaggcccacgaggagggcatctgcggaatacggagcgtcacccgccttgagaacctgatgtggaagcaaatcacccccgagctaaaccacatcctcagtgaaaacgaggttaagctgaccatcatgacgggggacatcaagggaatcatgcaggcgggcaaacggagcctccgcccccaacccacggagctcaagtactcctggaaaacctggggcaaggctaaaatgctgagcactgaatcccacaatcagacgttcctaatcgatgggccggagacagccgagtgtccgaacaccaatcgcgcttggaactccctcgaggtggaggactatggcttcggcgtcttcaccactaacatctggctgaaactgcgcgagaagcaggacgtattctgcgactccaagctcatgagcgccgcaatcaaggacaaccgggcagtgcacgccgatatgggctactggatagaatcggccctcaacgacacctggaaaatggagaaggccagcttcatcgaggtcaagtcctgccattggcccaagagccacaccctgtggtccaacggcgtcctcgaaagcgagatgattatccctaagaactttgcggggccggtgtcgcagcacaactaccgcccgggctatcatactcaaaccgccggcccctggcacctgggcaaactggagatggacttcgacttctgcgagggcacgaccgtggtagtcaccgaggattgcggcaaccggggcccaagcctccggaccactacagccagcgggaagctgatcaccgagtggtgttgccggtcttgcaccttaccgcccctccgctatcgtggggaggatggttgctggtacggaatggagatccggccactgaaggagaaggaagaaaacttggtgaacagcctcgtgaccgcagggcacggccagatcgacaatttcagtcttggcgttctggggatcgccctcttcttagaagagatgctgaggacccgagttgggaccaagcatgcaattctccttgtggccatctctttcgttactctgatcacggggaacatgtcgtttcgggacctcggcagggtcatggtgatggtgggggcgaccatgaccgacgacattgggatgggagtcacttacttggcgttgctcgcggcctttaaagtgagacccacgtttgccgctggtctgctgctccggagacttaccagcaaggagctaatgatggctaccatcgggatcgcactcctttcacagagcaccatccctgagacgatcctggaattaaccgacgcgcttgcactggggatgatggtgctcaaaatagtccgaaacatggagaagtaccagctggccgtgaccatcatggccatctcctgtgtgccgaacgcggtaattcttctcaacgcctggaaagttagctgcactatactcgcggcagtgtccgtatcgccactgctcttgacgtcgtcccaacagaaggcagactggatccccctggccttaaccatcaaaggcttaaatcccactgccatattcctgacgacgttatcccgcacctctaagaagcggtcctggcctctgaacgaggccgtgatggccgtaggcatggtgagcatcctggcatcctctctcctgaagaatgacatacccatgaccgggcccctggtggccggagggctgctgacggtctgctacgtcttgacgggacgctccgccgacctcgagttggagcgggccgccgacgttaaatgggaagaccacgcagagatctctgggagctctcccatcttaagcatcactatatctgaggacggcagcatgtccataaagaacgaggaggaggaacagacactcaccatcctgattcgcaccggcctgctagtcatcagcggggtgttcccggtgtctatcccaatcaccgcggccgcctggtatctgtgggaggtgaagaagcagcgggccggggtgttgtgggacgtgccctcgcctccccctgttgaaaaggcggagctcgaagacggggcgtatcgaatcaaacagaggggtatactggggtactcccagatcggcgcgggtgtgtataaagaggggaccttccacaccatgtggcacgtgacaagaggcgctgttctgatgcaccgcggtaagaggatcgagcccagctgggcagacgtgaagaaggacctcatctcatacggcggtggctggaaactcgagggcgaatggaaggagggcgaggaggttcaagtcttggcgctcgagcccggcaagaatcccagggccgtgcagacgaagccggggctattcaagaccaacaccggcaccatcggggctgtgagtctggacttttccccaggcacgtcggggagccccatcgtcgaccgcaaggggaaagtggtggggctctacgggaacggcgtcgtgacccggagcggcgcttacgtgtccgcgatagctcagaccgagaaatccattgagaacaaccccgagattgaggacgacatattccgcaagaagcgactgacgattatggatctacatcccggtgccggtaagacgaagcgctacctgcccgccatcgtccgggaggccatcaagcgcgggttgcgtaccctaatcctggcgcctacacgggtggtcgccgccgagatggaagaggccctcagaggactccctatccggtaccagaccccggccatccgcgcggagcacacaggtcgagagatcgtcgaccttatgtgccacgccaccttcaccatgaggctcctgagccccgtgcgggtgccgaattataatttgatcataatggacgaggcccatttcaccgaccccgcctccatcgcagcgcgcggctacatcagcacgcgggtggaaatgggcgaggctgccggtatcttcatgacggccacgcctcccggctccagagacccgtttccccagagcaacgcgcccatcatggatgaagaacgggaaatcccagagcgttcctggaacagcggacacgagtgggttaccgactttaaaggtaagaccgtttggttcgtcccgtctatcaaggcggggaacgacatcgctgcttgcctccggaagaacggtaagaaagtgatccagctgagccgcaagaccttcgactcagaatacgttaagacccgcgccaacgactgggactttgtcgtgaccacggacatcagcgagatgggcgccaacttccgcgccgagcgggtgatcgacccccgccggtgcatgaagcccgtcattctgaccgacggggaggagcgcgtgatcctcgctggccccatgccggtaacccactcaagcgccgcccaacgccgagggcgaatcggtcggaaccccaagaacgagaacgaccagtacatctacatgggggagccgctcgaaaacgacgaggactgcgcgcactggaaggaggctaagatgctgctcgataatatcaacacccccgagggcatcatcccttccatgttcgaaccagagcgcgaaaaggtcgatgccatcgatggcgagtaccgcctgcgcggggaggcccggaagacattcgtggacttaatgcgccgcggcgacctacccgtgtggctggcataccgcgtcgcggccgaggggatcaactacgccgatcggagatggtgcttcgacggcatcaagaataaccagattctggaagagaatgtagaggttgagatttggaccaaggagggggagcggaagaaattgaagccgcgctggctggacgcacgaatctacagcgatcccctggctctgaaggagtttaaggagttcgccgccggaagaaagagtctgacgctgaacctcatcaccgagatgggccgactgcccacgtttatgacccaaaaggcccgcgacgccctggataacctctccgtcctgcatacggcggaggcaggaggccgggcctacaatcacgcactgagcgagctcccagagacgcttgaaacgctgctcctgctgaccttactggccaccgtcaccgggggcatctttctgttcctcatgagcggcaaggggatcggaaagatgacactcgggatgtgttgcattatcacagcatccatcctgctctggtatgcccagatacagccacactggatagcggccagcatcatcttggagttcttcctgatagtcctcctcattccagagccagaaaagcagcgcacgccccaggacaaccagctgacctacgtcgtgattgcgatcctcaccgtcgttgcggccacaatggccaatgaaatggggtttctggagaaaacaaagaaggacctagggctgggcagcatcaccactcaggagcctgagtctaacattttggacatcgacctgcggcccgcgtccgcttggacgctctacgcggtggccaccaccttcgtaacgcccatgctgcgccattccatcgagaacagctccgtgaacgtgagcttaacggcgatagccaatcaggccaccgtccttatggggctcgggaaaggctggccactgtcaaaaatggacatcggggtgccactcctggccataggttgttacagccaggtgaatcccatcacgctgaccgcggcgcttcttcttttagtagcccactatgcgatcatcggccctggcctgcaggcgaaggccacgcgggaggcccagaagcgggcagctgccggcataatgaagaaccccaccgtcgacgggatcaccgtgattgacctggagcctattccctatgatcccaagtttgaaaagcagctcgggcaggtaatgctactgatactctgcgtgacccaagttctgatgatgaggacgacctgggccctgtgtgaagccttaacccttgcaaccgggcccatctccacactgtgggaaggcaacccggggcgattctggaataccaccatcgcggtcagcatggccaacatattccgcggttcctatctagccggcgcagggctattattctctatcatgaaaaacaccaccaatacccggcgcggcaccggcaacatcggcgagaccctcggggagaagtggaaatcccgtctgaacgcgctgggcaaaagcgagtttcagatctacaagaagagtggaatacaagaagtagaccggaccctcgcaaaggaggggataaagaggggcgaaaccgatcatcacgcggtcagccgcgggtccgccaagctgcggtggttcgtcgagcgcaacatggtaacacccgagggtaaagtggtcgacctgggatgcgggcggggcgggtggagctactattgcggcgggttgaagaacgtccgcgaagttaagggcctcaccaagggcgggcccggccacgaggagcccatcccgatgtccacgtatggttggaacttagtacggttacaaagcggtgtcgatgttttcttcaccccgcccgagaagtgcgacaccctcctgtgcgacatcggggagagctcccccaacccgaccatcgaggccggacgcacgttaagagtcctgaacctggtggagaactggttaaacaataatacgcaattctgcatcaaagtgctgaacccatatatgcccagcgtcatagagaagatggaaaccctgcaacgcaaatacggcggggcgttagtgagaaaccccttatcccgtaattccacccacgagatgtattgggtgtccaacgcaaccggtaacatcgtcagctcggtaaatatgatcagccggatgctgatcaatcggttcacgatgaagcataagaaagctacttatgagcccgacgtggacctggggtcagggacccgcaacatcggtatcgagagcgaaatcccgaacctcgacatcatcggaaagcggattgaaaagatcaagcaggagcacgagacgtcctggcattatgaccaggaccacccctacaagacatgggcataccacggcagctacgagacaaagcagacggggtccgccagctccatggtcaacggcgttgtgcgcctgctgaccaagccgtgggacgtcgtgccaatggtaactcagatggcgatgactgatactacgccattcggccagcagcgggttttcaaggagaaggtggacacgcgaacccaggagcccaaagaaggtaccaagaagttgatgaaaattacagccgagtggttatggaaggagttaggaaagaagaagacaccgcggatgtgcacccgcgaggaatttacccggaaagtccgctcgaacgcggccctcggtgccatattcactgatgaaaacaagtggaaatccgctcgggaggccgtcgaggacagccgcttctgggagctggtggaccgggagcgcaacctgcacttagaagggaagtgcgaaacgtgcgtctacaacatgatgggtaagcgggagaagaagctgggcgaatttgggaaagcgaagggctcccgcgccatttggtacatgtggctgggggcgcggtttttagagttcgaggccctgggttttctgaacgaggaccactggtttagccgcggcaacagcctttcaggcgtagaaggcgaagggctgcacagactaggctacattctacgcgacgttagcaagaaggagggtggtgccatgtacgcggacgataccgcaggctgggatactcgtatcacgttggaggacttgaagaatgaggagatggtgactaaccacatgaaaggtgaacacaagaagctcgcagaagctatcttcaagctgacctaccagaataaagtcgtgcgcgtccagcgccccacgcctcgaggcaccgtgatggacatcatatcccgaagagaccagagggggagcggccaggtgggtacgtacgggctaaacacctttacaaacatggaggcccagctcatccggcagatggagggcgaagggatcttcaagagtatccagcacttgaccgtcactgaagagatcgccgttcaaaattggctggcccgcgtaggacgagagcgccttagccggatggcgatatccggcgacgactgcgtagtgaagcccctggacgaccgcttcgcgtccgccctgactgccttgaacgacatgggcaaggtgcgtaaggacatccagcagtgggagccgtcccgcggctggaatgactggacgcaagtgcccttctgcagccatcacttccacgagctagtgatgaaggacggtcgcgtcttagtggtgccttgccgcaaccaggacgagctcatcggaagggcccgcatcagtcagggggctggatggagcctaaaggagaccgcttgcctgggcaaatcctacgcccagatgtggacgctcatgtacttccatcggcgcgatttgagactagcggccaacgcgatttgctccgccgtcccctctcactgggtcccgaccagcaggaccacgtggtccatccacgcgaagcacgagtggatgacaacggaggacatgctcgccgtctggaaccgcgtgtggatccaggagaatccctggatggaggacaaaaccccagtagagagctgggaggaagtgccctatcttggaaagcgggaggatcagtggtgtggatctctgatcgggctcacaagtagggcgacctgggcgaagaacattcagacggcaatcaaccaggtacggagcttaatcggcaacgaggagtacacggactacatgccgtccatgaagagatttagacgcgaagaggaagaggccggggtcctgtggtga

SEQ ID NO: 24924 - RNA, 9876 nt, synthetic construct
  misc_feature 1..9876: note = derived and/or modified CDS sequence (opt11) from DENV-2__GQ868553__SS-prME
  source 1..9876: mol_type = other RNA
accgcgggcgtgatcgtcatgctaatacccaccgcaatggcgttccaccttaccacgcggaacggggaaccccacatgatcgtgggccgacaagaaaaggggaaatccctccttttcaagactgaggacggcgtcaatatgtgcacgctcatggccatagatttgggggagctgtgtgaggataccattacgtacaagtgccccctactacgccaaaacgagcccgaagacatcgactgttggtgcaactcaaccagcacgtgggttacctacgggacctgtacaacaacgggagagcatcgtcgcgagaagcggtctgtagccctggtgcctcacgtgggcatgggcctcgagacacggaccgaaacatggatgagctccgaaggtgcttggaagcacgttcagcggatagagacatggatacttcgccacccgggcttcactatcatggcggcgatccttgcctacaccatcgggaccacgcatttccagagggcgttgatcttcatactcttgaccgcagtggcgccctccatgaccatgcgctgtatcgggatatcaaaccgggattttgtcgagggcgtttctgggggctcctgggtggacatagtcctcgaacatggaagctgcgtgaccacgatggcgaagaacaaacctaccctggattttgagttaatcaagaccgaagctaagcagccagcaacactccggaagtactgcattgaagccaagctgacgaacaccacgaccgagagtagatgcccgacgcaaggcgagcccagtctgaacgaggagcaagacaagcgctttatctgtaagcattccatggtggaccggggctgggggaatggctgcggcttgttcggcaagggcggtatcgttacttgcgcgatgtttacctgcaagaagaatatggaaggcaaggtggtgcagcccgagaacctcgaatacacgatagtcatcacgccccacagcggggaagaacacgccgtgggtaatgacaccgggaaacacgggaaggagatcaagattactcctcagtccagcatcacggaggctgaactgaccggatacggaacagtgaccatggaatgctctccacgaacaggcctggacttcaacgagatggtcctgcttcagatggaagacaaagcctggttagtccaccggcagtggttcctagacctaccactcccgtggctgccgggcgccgacacccagggcagcaattggatccagaaggagacgctagtgacatttaaaaacccccacgctaagaaacaggacgtcgttgtcctcgggtcccaggaaggagccatgcacaccgcccttacgggggcaacagagattcaaatgagcagtggaaacctcctgttcaccggacacctgaaatgccgccttcggatggacaagctccagctcaaaggtatgtcctacagcatgtgtaccggaaagttcaaaatagtcaaagagatcgctgagacccagcacggtacgattgtcatccgagtccagtacgagggtgacggttccccctgcaagattcccttcgaaatcactgacctagagaagcggcatgtcctcgggcgcctgatcaccgtgaatccgatcgtgacagagaaagactcgcccgtcaacatagaggcggagccacccttcggcgacagttatatcattatcggggtggagccggggcagctgaaattaaactggttcaagaagggttcctccatcgggcagatgtttgaaactaccatgcgcggcgcaaagcggatggccatcttaggggataccgcttgggatttcgggtcgctcggaggagtcttcacctctatcgggaaagcgctccaccaagtgttcggcgctatatacggggccgccttcagcggggtaagttggacgatgaagattctgatcggtgtaatcataacctggatcgggatgaactcaaggagcacgagcctgtccgtaagcctggtgctcgtcggagtggtcacactctacctgggggcaatggtccaggcagattctggctgcgtggtcagctggaagaacaaggaactcaaatgcggcagtgggatctttattactgacaatgtgcacacctggacggagcagtataagttccagcccgaatcgccttcaaagctagcatccgcaatacagaaggcccacgaggaaggcatctgtgggatccggtcagtgacccgcttggagaatctcatgtggaagcaagtaacgcccgagctaaatcacatattatccgagaacgaggtcaaactaaccatcatgactggcgacataaagggtataatgcaggccgggaaacggagcctgcgtccacaacccaccgagctgaagtacagttggaagacgtggggcaaggccaaaatgctgagcaccgagtcacacaaccagacattccttattgacggacccgagaccgccgagtgcccgaacacaaaccgggcctggaactcacttgaggtggaggactacggttttggggtgtttaccaccaacatttggttaaagctgcgcgaaaaacaggacgtattctgtgattctaaattgatgagcgccgccatcaaagataacagggccgtacacgccgacatgggctactggatagagtccgccctcaacgatacctggaagatggaaaaggccagctttatcgaggttaagagttgtcactggcccaagagtcataccctatggagcaacggcgtgctggagagcgagatgatcataccgaaaaacttcgcgggccccgtgtcccaacataactaccgaccgggctatcacactcagacagtcgggccctggcaccttggcaagttagagatggacttcgacttctgcgagggaacgacagtagtcgtgaccgaagactgcggcaaccggggcccctcactgcgcacgaccaccgcgtctgggaaactcatcaccgagtggtgttgccggagttgcacgctgccgccgctgaggtatcgaggcgaggatgggtgctggtatggtatggaaatccgcccattgaaggagaaggaggaaaatctcgttaacagcctggttactgccgggcacggacagatcgacaacttctccttaggggtgctaggaatggcgctgttcttagaagagatgcttcggacccgggtagggacgaagcacgccatcctgctcgtggccgtgagctttgtcacactgatcactgggaacatgtcctttcgggatctgggccgcgtgatggtgatggtcggagctaccatgacggacgatattggcatgggggtgacctatctcgccctacttgccgcctttaaggtacgccccacattcgcggccgggctcttactcaggaagctcacatctaaggaactgatgatggcgacaatcgggatcgccctgctttcacaatctaccatccccgagaccatcttcgagttaaccgatgcgctggccctcggtatgatggtcctgaaaatcgtcaggaacatggaaaaatatcagttagctgtcacgatcatggccatctcatgcgttcctaacgcagtgatcctccagaatgcgtggaaggttagctgcactatcttggcggccgtatccgttagtccgctgctccttaccagtagccaacagaaagctgattggattcccctggccctcactatcaaaggacttaaccccacagcgatcttcctgacgacgctctctcgtacctcgaagaagaggtcctggccgttaaacgaagccattatggctgtcggaatggtgtctatcctggcatccagtctcctgaagaacgatatccccatgacggggccactcgtagccggcggtctcttaaccgtctgctatgtgttaaccggcagaagcgcggatctcgaactggaacgcgcagctgacgttaagtgggaggaccaggccgagataagtgggagctccccaattcttagcatcacgatcagtgaggacggaagcatgtccatcaagaatgaagaggaggaacaaatcctgaccatactgatccggacgggattactcgtcatcagcggagtgtttcctgtatccataccgattaccgcagctgcctggtacctgtgggaggtcaaaaagcagcgtgccggagtgctttgggatgttcccagcccgccacccgtcgaaaaagcagaactcgaggatggggcctaccggattaagcaacgcggtatactgggctactcccaaataggtgcgggcgtgtacaaggaaggcacctttcacactatgtggcacgtgacgcgaggcgccgtcctgatgcatcgggggaagcgaatagagcccagctgggccgacgttaagaaggacctcatttcctacggcgggggatggaaattagagggagagtggaaagagggggaagaggtgcaggtcctggcactcgagcccggcaagaacccccgcgccgtgcagacgaaacccgggatcttccgcactaacaccggcacgataggagccgtcagcctagacttctcccccggcaccagtggctctccgatagtcgacaggaaagggaaggtggtgggcctgtatgggaacggggtcgtgacccggagcggcgcctacgtgtccgcaattgcacaaacggagaagtccatcgaggacaatcccgagatcgaggatgacatattcagaaagaaacgactcacgatcatggatctgcaccccggggccggcaagactaagcgctatctgccggcaatcgtacgggaggccataaaacgcgggcttcgcaccttgatactggcaccgacccgggtggtggccgcggagatggaggaggcccttcgcggattgcccatccggtaccagacgcccgccattaaggctgagcatacggggagagagattgtcgaccttatgtgtcacgcgacatttacgatgcggctgctctcaccagtgagggtcccgaactataacctaatcatcatggacgaagcacatttcacggaccccgccagtatcgcggcccgcggctatatttcgacacgcgtcgagatgggagaggcagcagggattttcatgaccgctaccccgcccggttctcgggacccgttcccacagagcaatgccccgattatggacgaagaacgtgaaattcccgagcggtcgtggaacagcggtcatgagtgggtaacggacttcaaaggaaagaccgtgtggttcgtcccgtctataaaggcgggtaatgacatcgcggcgtgtcttcgcaaaaacggcaaaaaggtaatacagctaagccgcaagaccttcgacagcgaatacgtcaagacacgtgcaaatgattgggacttcgtagtcacgacagacataagcgagatgggtgccaactttaaggctgaacgggtgatcgacccccgacgttgcatgaagcccgtcatcctgaccgacggggaggagagggtaattctggcgggccccatgccagttacccactcctctgccgcccaacgccgaggtcgtataggcagaaaccccaagaacgaaaatgaccagtacatctacatgggggaaccgcttgagaacgatgaggactgcgcccactggaaggaagccaagatgcttctggataacatcaatacgcccgaaggcatcatcccgtccatgttcgagccagaacgtgagaaggtagatgcgatcgatggggagtacagactccgcggggaggcccggaagacgttcgttgatctgatgcgaagaggggacttacccgtgtggctcgcctataaagtcgcggcagagggtattaactatgcggatcgtaaatggtgcttcgacggcatcaagaataaccagatccttgaagagaacgtggaagtcgaaatctggaccaaggagggggagcgaaagaaactgaagcctagatggctcgacgcgcggatttatagcgaccccctggcccttaaggagtttaaagagttcgccgcgggccgcaagtccctcacgctaaatctgatcaccgaaatgggccggctcccaacgttcatgacccaaaaggctcgcaacgccttagacaacctggcggtattacacaccgccgaagctgggggaagggcctataaccacgctctttctgagctgccagagacgctcgaaactctactcctcctgaccctgttggcaacggttacagggggcatctttctgttcctaatgtctgggaaggggatcggcaagatgactctcggtatgtgctgtatcataactgcctcgattctgctgtggtacgcgcagattcagcctcactggatcgccgcctccatcattctcgagttctttctgattgtgctgttaatccccgagccggagaaacaacgaacgccgcaagacaaccagctgacctacgtggtgatagccatcttaacagtcgtggctgcgaccatggcgaacgaaatgggctttcttgagaaaacgaagaaggaccttgggctgggatctatcaccactcaggaatcggaatctaatatcctagatatagatctgcggcccgccagcgcatggaccctgtacgccgtggctaccaccttcgtcacacccatgctcaggcattccattgagaactcttcggttaatgtgagccttaccgccatcgccaatcaggccacagtcctgatgggactcgggaagggatggcccctctccaagatggatatcggggtcccgctgctcgccatcggctgttatagtcaggtgaacccgataaccctaacggccgcgctgctcctgctggttgcacactacgcgataattggccctggtttacaggcaaaggccacccgcgaagcacaaaaacgcgccgcagcgggaatcatgaagaaccctaccgttgatgggattaccgtaatcgacctggagccgattccgtacgaccccaaatttgagaagcagttagggcaggttatgttgttgatcttgtgcgtcacccaggtactcatgatgcgaaccacatgggccctgtgcgaagcgctgaccctcgccacggggcccatttccacgctgtgggagggaaaccctgggcgcttctggaacacaaccatcgccgtgtccatggcgaacatattccggggcagttacctcgcgggcgcggggttgctattcagtatcatgaagaacacgacaaacacccggcgcggcacaggtaacatcggagaaacgctgggagagaagtggaagagtcggctcaacgcattaggtaagagcgagttccaaatttacaaaaagtccggcatccaagaagtagaccgaaccctagccaaggaggggataaagagaggggagactgatcaccacgccgtttcacgcgggtccgcaaaattacgttggttcgtcgagcgcaacatggtgaccccggagggaaaggtggtcgacctgggctgcgggcgcggcggctggagctattactgtggcgggttgaagaatgtccgggaggtgaagggcttaacaaagggcgggccaggccatgaggagccgatccccatgtccacctacgggtggaatttggtgagattacagagcggagtggacgtcttcttcactccgccagaaaagtgtgacacactactctgcgatattggcgagagcagcccgaatccaacgatcgaggcgggcagaactctccgggtcctcaatttagtcgaaaattggctgaacaacaacactcagttttgcatcaaagtactaaacccgtacatgccgagcgtgatcgaaaagatggagacactgcaacgcaagtacggcggcgccctggttcgtaaccccctctccagaaacagcactcacgagatgtattgggtgtccaacgcgacaggcaacatcgtcagctctgtgaacatgatcagccgaatgctaatcaatcgttttaccatgaagcacaagaaggccacctacgagcctgatgtggacctgggctccggcacccggaacattggcatcgaaagcgagatccccaacttagacatcataggtaaaaggatcgaaaagatcaagcaggagcatgagacgtcgtggcattacgaccaggaccacccctacaagacctgggcctaccacggtagttacgaaaccaagcaaaccggctccgccagctccatggttaatggtgtggtgagactcctgacgaaaccctgggacgtcgtgccgatggtgacccagatggctatgactgacacgacgcctttcgggcagcagcgagtattcaaagagaaggtggacacccgcacacaggagcccaaggaggggacgaagaagctgatgaagataacggctgaatggctctggaaggagcttggaaagaagaaaacgccccgtatgtgtacgcgtgaggagttcacgcggaaagtgcggagcaacgccgccctgggggccatctttacggacgagaacaagtggaaatccgcacgggaggctgtcgaagacggcaggttctgggagctcgttgaccgggagaggaacttacacctagaggggaaatgcgaaacctgtgtctacaacatgatgggcaagcgggagaagaaactcggcgagttcggtaaggcaaaggggtcacgagcaatctggtacatgtggctgggcgcccgcttcctagagttcgaggcgctgggtttcctcaatgaggaccactggtttagccgtgggaactctttgagcggcgtcgagggcgaaggactccaccgactgggttacatactgcgcgacgttggcaagaaggagggaggcgcaatgtacgcagacgatacagccgggtgggacactagaatcacgctggaggatctcaaaaatgaggaaatggtgacaaaccacatgaagggtgagcacaagaagctggcggaagcgatctttaagctcacataccagaacaaagtggtgcgcgtccaacggccgactccccgcggcacggtgatggacatcatctcccggcgcgatcaacgcggaagcggccaggttggtacatacgggctgaatacattcacgaacatggaagcacagctcattcggcagatggagggtgagggcatcttcaagtccatccaacatctcactgcgaccgaggagatagccgcccaaaactggttggcgagagtcgggcgggagcgcttgtctagaatggctatatctggtgatgactgcgtggtgaagcccatcgatgaccgcttcgcttcggccctcacagccctgaatgacatgggcaaggtgcggaaagacatccagcagtgggagcccagcaggggctggaatgactggacacaagtgccgttttgttcgcaccacttccatgagttagtaatgaaggatgggcgggtcctcgttgtcccctgccggaaccaggacgaactaataggccgcgcgcgcatctcacagggggccggctggagcctgaaggaaactgcatgccttggcaagtcctacgcccagatgtggacccttatgtattttcaccgacgcgacctgcgtctagctgccaacgctatatgtagtgcagtcccctctcactgggtgccgacgagccgcaccacgtggtccatacatgccaaacacgagtggatgacaacggaagacatgctggcggtgtggaatcgtgtgtggattcaggagaacccttggatggaagataagacgcctgttgagtcgtgggaagaggtgccatacctgggaaaacgcgaagaccagtggtgcggctccttaatcgggctgaccagccgggcaacgtgggccaagaacatacagacggctatcaaccaggtccgcagcctgatcggcaacgaggagtacaccgactacatgccctccatgaagagattccgaagggaagaggaggaggcaggcgtgctctggtaa

SEQ ID NO: 24925 - RNA, 9876 nt, synthetic construct
  misc_feature 1..9876: note = derived and/or modified CDS sequence (opt11) from DENV-2__GQ868554__SS-prME
  source 1..9876: mol_type = other RNA
accgccggcgtgattgtcatgctgatccccaccgccatggcgtttcacctcaccacccgcaacggggagccccacatgatcgttggccggcaggagaaggggaaatccctgctgttcaagactgaagacggtgtgaacatgtgcaccctcatggccatcgacctgggagagctgtgcgaggacaccatcacctataaatgtcccctcctgcggcaaaacgagcccgaagacatcgactgctggtgcaacagcaccagcacctgggtcacctacgggacctgtaccaccacgggagaacacagacgcgagaagcggtccgtggccctggttccccacgtagggatgggcttagagacccggaccgaaacctggatgagctccgagggggcatggaagcacgtgcaacggattgagacatggatccttcgacacccaggcttcaccatcatggccgcgatcctggcctacaccatcgggaccacgcacttccagcgggccctcatcttcatcctgctgacggcagtggcgcccagcatgacaatgcgctgcatcggcatcagtaaccgagactttgtcgagggcgtgtccgggggctcttgggtggacattgtcttagagcacgggagctgcgtgaccacgatggccaagaacaagcccaccttagatttcgagttgataaaaactgaggccaagcagcctgccaccttgcgcaagtactgcatcgaggccaagttaacgaacaccaccacggagtcccgttgcccgactcagggggagcccagcctgaacgaggagcaggacaaacgcttcatttgcaaacactccatggtggaccggggctgggggaacggctgcgggctgtttgggaagggcgggatcgtgacgtgcgcgatgttcacgtgcaagaagaacatggagggtaaggtcgtgcagcccgagaacctggagtacaccatcgtcatcacgccccacagcggggaagagcatgccgtgggaaacgacaccgggaagcacggaaaggagatcaagatcacaccgcagtccagcatcacagaggccgagctgacagggtacggcacggtgaccatggagtgctcaccccggaccggcctcgacttcaacgaaatggtcctgctgcagatggaggacaaggcctggctggtccaccggcagtggttcctggacctgcccctaccctggttgcctggggccgacacccagggcagcaattggatccagaaggaaacattggtgactttcaagaacccccacgcgaagaagcaggatgtagtggtcttagggtctcaagagggcgccatgcacaccgccctgaccggggccaccgagatccagatgagcagcggcaacctcttatttaccggccacctgaagtgccgcctgcggatggacaaactccagctgaaggggatgagttatagcatgtgcaccggcaaattcaagatcgtgaaggaaatagccgagacccagcacgggacaattgtgatccgtgtccagtacgagggcgatggctccccctgcaagatccccttcgagatcaccgatctagagaagcgtcacgtgctcgggcgcctcatcaccgtgaacccgatcgttatcgagaaggactcacccgtgaacatcgaagcggagccacccttcggcgattcgtacattatcatcggtgtggagccgggccagctgaagctcaactggttcaagaagggaagttccataggccagatgttcgagaccaccatgcgcggcgccaagagaatggccatcctgggggacaccgcctgggacttcggcagtctcggcggggtcttcacctccattgggaaggccctccaccaggtattcggggcgatctacggcgcggccttcagcggggtgtcatggaccatgaagatccttatcggggtcgtgatcacctggattgggatgaactccagatccaccagcctgtccgtgagcctggtccttgtgggcgtggtcaccctctacctgggcgccatggttcaggccgacagtggctgcgtggtttcatggaagaacaaagagctcaagtgcggtagtggaatatttatcaccgacaacgttcacacgtggaccgagcagtacaagttccagcccgagagcccctccaagctggcctccgccatccagaaggcgcacgaggaaggcatatgcgggatcaggagcgttacccgcctggagaacctgatgtggaaacagatcaccccggagctgaaccacatcctctctgagaacgaggtcaagctcacgatcatgaccggcgatactaaggggatcatgcaggccgggaagcgtagcttgcgcccgcagcccacagaactgaagtactcctggaagacgtggggcaaggcgaagatgttgagcaccgagtcccacaaccagaccttcctcatcgacgggcccgagactgtggagtgcccaaacacgaaccgggcctggaactccctggaggtggaggactacggcttcggtgtcttcaccaccaacatctggctcaaactgcgcgagaagcaggacgtgttctgcgactccaaattgatgagcgccgccattaaggacaaccgggccgtgcacgcggacatgggctactggatcgagtccgccctcaacgacacatggaaaatggagaaggctagcttcatcgaggtaaagtcctgtcactggcccaaaagccataccctgtggtccaacggtgtgcttgagagcgagatgatcatccccaagaactttgccgggccagtgtcccagcacaactatcgcccgggctaccacacccagaccgccgggccctggcacctcgggaagctcgagatggatttcgacttctgcgaggggaccaccgtcgtggtgacggaggattgcggcaaccggggccccagcctgcgcaccaccaccgcgagcgggaagctcatcacggagtggtgctgccgttcctgtaccctgcccccgctgcgctaccgtggggaagatgggtgctggtacggcatggaaatccgccccctcaaagagaaggaggagaacctggtaaacagtctggtgactgccgggcacggccagatcgacaacttctccctcggcgtgctggggatggccttattcctcgaggagatgcttcggacccgcgtcggcacgaagcacgccatcctgctcgtcgcggtgagcttcgtcacgctgatcaccgggaacatgtccttccgggacctgggccgcgtgatggtgatggtcggggccacgatgacggacgacatcggcatgggcgtgacctacctcgctctgttggccgccttcaaagtgcgccctacatttgcggccgggctccttctgcggaagctcaccagcaaggagctgatgatggccacgatcggcatcacgctgttgtcccaaagcaccatccctgagaccatcctcgagctgacggacgctctcgccctggggatgatggtcctgaagatcgtgcgcaacatggagaagtaccagttagcggtgacaattatggccatctcctgtgtcccgaacgccgtgattctgcggaacgcttggaaggtcagctgtacaatcctggccgcggtttccgtgagccccctcctgctgacctcgagccagcagaaggccgactggatccccttggcgctgacgatcaagggcctgaaccccaccgccattttcctcactaccctatcccgcacgtcaaagaagcgatcctggccgctgaacgaggcgatcatggccgtcggcatggtaagcatcctcgcctccagcttactgaagaacgacatccctatgaccggtcccctcgtggccggggggctgctgaccgtctgctacgtgctcaccggccgcagcgctgacctggagctggagcgggcggcggacgtgaagtgggaggaccaggccgagatcagcgggagctcccccatcctcagcatcacgatctccgaagacggaagcatgtccatcaagaacgaagaagaggagcagaccctgaccattctgatccgtaccggcctcctggtcatctcaggggtgttcccggtgtccatcccaatcaccgccgccgcctggtacctgtgggaagtcaagaagcagcgggccggcgtgttgtgggacgtgcccagcccgccgcccgtcgggaaggccgagctggaggacggcgcctatcgcatcaagcagcgggggatcctgggctactcccagatcggcgcgggggtatacaaggagggaacgtttcataccatgtggcacgtgacgcgcggggcggtcctcatgcaccggggcaagcgcatcgagcctagctgggccgacgtcaagaaagatttgatctcctacggaggcggctggaaactggaaggagagtggaaggagggcgaggaggtgcaggtcctcgccctggagccagggaaaaatccccgggccgtgcagaccaagcccggaatattcaagacgaacaccgggaccatcggtgccgtgagcctggacttctcccccggaacctcagggtcccctatcgtcgaccgcaagggcaaggtggtggggctctacggcaacggcgtcgtgacgcgaagcggggcctacgtgtccgccatcgcccagaccgagaagtccatcgaggacaatccggagatcgaggacgacatcttccgcaagaagcggctgactatcatggacctgcaccccggcgccgggaagaccaagcgctacctccccgctatcgtccgggaggcaatcaagcggggcctgcgcacgctaatcctggccccgacccgggtggtggccgcagagatggaggaggcgctacgcgggctgcccatccggtatcagacccccgccattaaggccgagcacaccggccgcgaaatcgtcgacctgatgtgccacgccacgttcaccatgcggctcctgagccccgtgcgcgtgccgaactacaacctgatcatcatggacgaagcccacttcaccgaccccgcgtccatcgcagcccggggctacatcagcacccgcgtcgagatgggggaggccgccgggatattcatgacggcgactccaccagggtcccgggacccgttcccccagagcaacgcccccatcatggacgaggagcgggagatacccgagcggtcgtggaacagcggccacgagtgggtgaccgacttcaaggggaagactgtgtggttcgtcccgtccatcaaggccggcaacgatatcgccgcgtgcctccgcaaaaatggcaagaaggtgatccagctcagccggaagacgttcgactccgagtacgtgaagacccgcgccaacgactgggacttcgtggtgaccaccgacatctcggaaatgggcgccaacttcaaggccgagcgtgtgatcgacccccgccggtgcatgaagcccgtcatcctgacggacggcgaggagcgcgtgatcctcgccgggccaatgccggtgacccactcctcagcggcccagcggcgcggacgcatcgggcggaaccccaagaacgaaaacgatcagtacatctacatgggcgagccccttgagaacgacgaggactgcgcccactggaaggaggctaagatgctactcgacaacatcaacacccccgagggcatcatcccgtccatgttcgagcccgaacgagaaaaggtcgacgccatcgacggggaatatcgactgcgcggcgaggcgcggaagacttttgtggacctgatgcggcgcggtgacctccccgtttggctggcgtacaaggtcgccgccgagggtatcaactatgcagaccgcaagtggtgttttgatgggatcaagaacaaccagatcctggaggagaacgtggaagtcgagatctggacgaaggaaggtgagcggaaaaagctcaagccgcggtggctcgacgcgcggatctacagcgaccccctggccctcaaggagtttaaggagttcgccgccggcaggaagtccctgaccctgaacctcatcaccgagatggggcggcttcccaccttcatgacgcagaaggcgcgcaatgccctggacaacctcgccgtgctgcacaccgccgaggccggcgggcgggcgtacaatcacgccctgagcgagctcccagagaccctggagaccctgctcctgctgacgctcctggccaccgtgaccggcggcatcttcctcttcctcatgtccgggaagggcatcgggaagatgaccctgggcatgtgctgcatcatcaccgctagcgtcctgctctggtacgcccaaatccagccgcattggatagcggccagtatcatcctggagttcttcctcatcgtgctcttaatccccgagcccgagaaacagcgcacgccccaggacaaccagctaacctatgtggtcatcgctatccttaccgtggtggccgccaccatggcgaacgagatggggttcctggagaagacgaagaaggacctgggcctcggcagtatcaccactcaggagagtgagtccaacatcctggacatcgacctgcggccggcctcagcctggaccctttacgccgtcgcgacgaccttcgtgacccccatgctgagacactccatcgagaacagcagtgtgaatgtcagcttaacggcgatcgccaatcaagccacggtgctcatgggactgggcaagggctggcccctgtccaagatggatatcggcgtgcccctcctggccatcgggtgctactcccaggtcaacccgatcaccctgaccgccgccctcctgctgctcgtggcacactacgccataatagggcccggcctgcaggccaaggcaacacgggaggcccagaagcgcgccgccgcagggattatgaagaaccccactgtggacggcataaccgtcatcgatctggagcccatcccgtacgaccccaagttcgagaagcagttagggcaagtcatgctgctgatcctctgcgtgacccaggtgctgatgatgcggacaacgtgggcgctgtgcgaggctttaaccctggccaccgggcccatctccaccttatgggagggcaaccccggccgcttctggaacacgaccatcgccgtgagcatggccaacatattccgcggcagttacctcgcgggggccggcctgctgttcagcattatgaagaacaccaccaatacgcggcgcgggaccggcaacatcggcgagacccttggtgaaaagtggaagtcccggttgaacgcgctgggaaaaagcgagttccagatctataagaagtccgggatccaggaggtggatcgcaccctcgcgaaggagggcatcaagcgcggggagacggaccatcacgcggtcagccgcggctccgcgaagctgcgatggttcgttgagcgcaacatggtgaccccagagggcaaggtcgtggacctggggtgcggccgcgggggctggagctactactgcgggggcctcaagaacgtgcgcgaggtgaagggcttgaccaaaggcggccccgggcacgaggagcccatacccatgtccacctacggctggaacttagtacggctccagagcggggtagacgtcttcttcacgccgcccgagaaatgcgacaccctgctgtgcgacatcggcgagagctcccccaacccgaccatcgaggccggacgcaccctccgagtgttgaacctggtggagaattggctcaacaacaacacccagttctgcatcaaggtcctgaacccatacatgcccagcgtgatcgagaagatggagacgctgcagcgcaagtacggtggcgctctcgtgcggaaccccctgtcccgaaatagcacccacgagatgtactgggtctccaatgccaccgggaacatcgtgagctccgtgaatatgatcagccgtatgctgatcaaccgcttcaccatgaaacacaagaaggctacgtacgagccggacgtcgacctgggctccggaacccggaatatcggcatcgagagcgagattcccaacctcgatatcatcggcaagcgtatcgagaagatcaaacaggagcacgagaccagttggcattacgaccaggaccatccctacaagacctgggcgtaccacgggagctacgagacgaaacagaccggctcagcgagctccatggtgaacggggtcgtccgcctgctgaccaaaccctgggacgtggttccgatggtgacccagatggccatgactgacacaacgcccttcggtcagcagcgggtcttcaaggagaaggtagacacccgcacgcaagagcccaaggagggcaccaagaagctcatgagaatcaccgccgagtggctgtggaaggagctggggaagaagaagactccccggatgtgcacgagggaggagttcacccgcaaggtccggagcaacgcggcgctcggcgcaatctttaccgacgagaacaagtggaagtccgcccgcgaggccgtggaggatgggcggttctgggagttggtcgaccgcgaacgcaatctgcacctcgagggcaagtgcgaaacctgcgtgtacaacatgatggggaagcgcgagaagaagttaggcgaattcggcaaggcgaaggggagccgggccatctggtacatgtggctgggcgcccgcttcctcgagttcgaggcgctgggcttcctgaacgaggaccactggtttagccggggcaacagcctcagcggggttgagggagagggactgcaccgcctggggtacatcctccgagacgtcggaaaaaaggagggcggagcgatgtacgccgacgacacggccggttgggacacccgtatcaccttggaggatctgaagaacgaggagatggtcaccaaccacatgaagggggagcataagaagctcgccgaagccatcttcaagctgacgtaccagaacaaggtggtccgggtccagcgaccaacgccccggggcaccgtgatggacatcatctcccgccgcgaccagcgggggagcggccaggtagggacgtacggcctgaacacattcaccaatatggaggcgcaactcatcaggcagatggagggcgagggtatcttcaaatccatccagcacctgaccgcaaccgaggagatcgccgttcagaactggctggccagagtgggcagagagcggctatcccgcatggccatttccggggatgactgcgtcgtgaagcccatcgacgacagattcgcgagcgccctgacggccctgaacgacatgggaaaggtgcgaaaggacatccagcagtgggagccctcccgggggtggaacgactggacccaggtcccgttctgtagccaccacttccacgagctcgtgatgaaggacggccgcgtgttagtcgtgccatgccggaaccaagacgagctcatcggccgcgccagaatcagccagggggccggctggagcctcaaggaaaccgcgtgcctggggaagtcctacgcccagatgtggacgctgatgtacttccaccgccgggacctccgcctggccgccaacgccatatgcagcgcggttccctctcactgggtccccaccagccggacgacctggtccatccacgcgaagcacgagtggatgaccaccgaggatatgttggccgtgtggaaccgtgtatggatccaggagaacccatggatggaggacaagacgcccgtcgaaagctgggaggaggtgccctacctcggcaagcgggaggaccagtggtgcgggagtcttataggcctgacaagtcgcgccacctgggcgaagaacatccagacggcaatcaatcaggtgcgctccctcatcggcaacgaggagtacacggactacatgccctccatgaagcggttccgccgagaggaggaggaggccggggtcctgtggtga

SEQ ID NO: 24926 - RNA, 9876 nt, synthetic construct
  misc_feature 1..9876: note = derived and/or modified CDS sequence (opt11) from DENV-2__GQ868555__SS-prME
  source 1..9876: mol_type = other RNA
accgccggtgttatcgtcatgctgatccccaccgccatcgcgttccacttgaccactcgcaacggggagccccacatgattgtggggcgccaggagaagggtaagtccctgctgttcaagacggaggacggcgttaacatgtgtaccctcatggcgatcgacctgggggagctgtgcgaggacaccattacatataagtgccccctactgcgccagaacgagccagaagacatcgactgctggtgcaacagcaccagtacctgggtcacctatgggacgtgtaccaccacaggcgagcaccgtcgcgagaagcggtccgtggccctggtgccccacgttggaatgggcttagagacgcgaaccgagacctggatgagctccgaaggggcctggaagcacgtacagcggatcgagacctggatcctgcgccaccctggattcaccattatggcagcaatactggcttacaccatcggtaccacccacttccagcgggcgcttatcttcattctgttaacagccgtggcgcccagcatgaccatgcgctgtatcggaatttcaaacagagacttcgtggaaggggtgtcggggggctcgtgggtggacattgtccttgagcatgggagctgcgtgaccaccatggccaaaaataagcccacactggacttcgagcttattaaaacggaagccaagcagcccgcaaccctcaggaagtactgtatcgaggccaagctgaccaacaccaccaccgagagtcggtgcccgacccaaggcgagcccagccttaatgaggagcaggacaagaggttcatctgcaaacactccatggtggacagaggctgggggaatggctgcggcctattcggcaagggcgggatcgtgacatgcgcgatgttcacgtgcaagaagaatatggagggcaaagtggttcaacctgaaaatctggaatacacaatcgtcatcacgccccacagcggggaggagcacgccgtggggaatgacaccgggaaacatggcaaggagataaagatcacccctcagtccagtatcaccgaggccgaactcaccgggtacggcacggttaccatggaatgcagccccaggacaggtctcgacttcaacgagatggtgctgttacagatggaggacaaggcctggctcgtgcatcggcagtggttcctggacctgcccctcccctggctaccgggtgctgacacacaagggagcaattggattcagaaagaaacgttagtgacgttcaagaacccccacgccaagaagcaagacgtcgtggtgttggggtcccaggagggagccatgcacaccgccctgaccggggcgacggagatccaaatgagcagcggcaacctcctgttcaccgggcacctgaagtgccgcctgcggatggacaaactacagttaaaaggcatgtcctacagcatgtgcaccggaaagttcaagatcgtgaaggagatcgccgagacacagcacggaacgatcgtgatccgggtgcagtacgagggcgacggctccccgtgcaagatccccttcgaaatcactgacctggagaaacggcacgtactcggtcgcctgatcaccgtgaacccaatcgtcacagagaaggacagccctgtgaatatcgaggcagagccgcccttcggcgattcctatatcatcatcggtgtagagccaggccagctgaagctaaactggttcaagaaggggagcagcatcgggcagatgttcgagacaaccatgcgcggtgccaagcggatggccattctgggcgacaccgcatgggatttcggctcattgggcggggtatttacctccatcggaaaggcgctccaccaagtgttcggggcaatctatggcgccgccttcagcggtgtgtcatggacgatgaagatcctgatcggcgtcgtgataacctggattgggatgaattcgcgctccaccagcctgagtgtcagcctagtcctcgtgggcgtggttaccctgtacctgggtgccatggttcaggcggacagcggctgcgtagtcagctggaagaacaaggaactcaaatgcggatctgggatattcatcacagacaacgtgcatacttggaccgaacaatacaagtttcagcccgagagccccagcaagctggccagtgccatccagaaggcccacgaggagggcatctgtgggatccgtagcgtgacccgcctggaaaatctcatgtggaagcaaatcacgccggagttaaatcatattctgtccgagaacgaggtcaagctcaccatcatgacaggcgatactaagggaatcatgcaggcgggaaagcggagcttgcggccgcagcccacggagctgaagtattcttggaagacgtggggcaaagctaagatgctctccacagaaagtcacaaccagaccttcctcatcgacggacccgaaacggcagagtgtccaaacacgaacagggcctggaatagcttagaggtggaggactatggcttcggggtgttcaccaccaatatctggctaaagctgcgcgagaagcaggacgtcttctgcgattccaagctgatgagcgccgccatcaaggacaaccgggcagtgcacgccgacatgggatactggatcgagtccgccctgaacgatacctggaagatggaaaaagcctcgtttatcgaggtgaagagctgtcactggcccaaatcgcacacgctctggagtaacggcgtccttgagtcagagatgatcatcccaaaaaacttcgcggggcccgtgtcccaacacaactatcgcccgggctaccacacccagaccgcgggaccttggcacctcgggaaactggagatggatttcgacctgtgcgagggaaccacggtggtcgtgacagaagactgcggaaacagagggccctcgctccgtactaccacggccagcggcaaactgatcaccgagtggtgttgccggtcctgcaccctgcccccgcttcgctaccggggcgaggacgggtgttggtatggcatggagatacgccccctgaaggagaaggaggaaaatctggtgaactcgctcgtcacagccggacacggccagatagacaacttctccctgggtgtactggggatggccctcttcctggaggagatgctgcggacacgcgtaggcaccaagcatgcgatcctcttagtcgcggtgagcttcgtgacactgatcaccgggaacatgtcctttagagacctcggcagagtcatggtaatggtgggggcaacgatgaccgacgacatcggcatgggcgtcacgtacctggccctgttggccgcattcaaggtgcgccctaccttcgccgccggtctgctgctccgcaaactgacgagtaaggagctgatgatggcgacaatcggcatcgccctcctctcccagagtaccatccccgagaccatcctggagctgaccgacgccctggcactgggcatgatggtgctcaagatcgtccgcaacatggaaaaataccagttggccgttaccattatggcaatctcctgtgtgccgaacgccgtcatccttcggaacgcgtggaaggtgtcgtgcaccatcttggccgcagtctccgtgagcccactattgctgacctcaagccagcagaaggccgattggataccactggcccttacgatcaaaggtctcaaccccaccgccatcttcctgaccacgctttcccgcacgtcaaaaaaacggagttggccgctcaacgaggccatcatggctgtgggcatggttagcatcttagcgtccagcctgctcaagaatgatatcccgatgaccgggcccctggttgcgggagggcttctcacagtatgttacgtcctaaccggccgcagcgctgacctggaattagagcgtgcagccgaagtgaagtgggaggaccaggccgagatctccgggtcctcaccgatcctgagcattacgatctccgaggatggcagcatgtccatcaaaaacgaggaggaggagcagacactgactatcctcatccgcaccggcctactcgtgatcagcggtgtttttccggtaagtatacccatcactgcagctgcatggtatctctgggaggtaaagaagcagagggccggggttctgtgggacgttcccagccctccaccggtcgggaaggcggagcttgaggagggcgcgtaccgcatcaagcagcggggaatcctcggctattcgcagattggcgctggagtctataaggaagggacgttccacaccatgtggcatgtcacccgtggggccgtgctgatgcatcgcgggaagcgcatcgagcccagctgggccgacgtcaagaaggaccttatcagttacgggggcggctggaagcttgaaggggaatggaaggagggcgaggaggtccaggtgctggcccttgagcccgggaagaacccccgcgcggtccagaccaagcccgggatattcaagacgaacaccgggaccatcggtgccgtatccctcgacttctcccccggcaccagcgggtcccccattgtggacagaaaaggcaaggtcgtgggtctgtacggaaacggagttgtcacgcgcagcggggcatatgtgtccgccatcgcgcagaccgaaaagagcattgaggacaaccccgagattgaggacgacatctttcgaaagaagcggctgaccattatggatctccaccccggggccggtaaaaccaagcgctacctgccggccattgtgcgggaggctatcaagcggggtctgcgaactctgatcttggccccgacccgggtggtagcggccgaaatggaggaggccctgcgcggattaccgatcaggtaccagacccccgccataaaggccgagcacactgggcgcgagatcgtggaccttatgtgccatgcgacttttaccatgcggctgctgagccccgtccgtgtgcccaactacaacctcataataatggacgaggcccatttcactgacccagcatccatcgccgcccggggctacattagcaccagagtggagatgggggaggcggccggcatcttcatgacggctactccgcccggttctcgggacccgttccctcagtctaacgcacccattatggatgaggaaagagagatccccgagcggtcatggaacagcggtcatgagtgggtcaccgacttcaagggcaagaccgtgtggttcgtgccgtcaataaaggccgggaatgatatcgccgcctgtctgcggaagaacggcaagaaggtcatccaactgagtcggaagacttttgactcggagtacgtgaaaacccgcgccaacgactgggactttgtggtgaccaccgacatcagcgagatgggggccaactttaaagcggaacgagttatcgaccccagacgttgcatgaagcccgtaattctaacggacggtgaggagcgcgtcatactggccgggcccatgccggtgacccactccagcgcagcccagcggcgcggcaggataggtcggaaccccaaaaacgaaaacgaccagtacatttacatgggtgagccgctggaaaacgatgaggactgcgcacactggaaagaggcaaagatgctattagataacatcaacacccccgaagggatcatcccttccatgtttgagccagaacgtgagaaggtggacgcgatcgacggcgaatacagactgcgcggcgaggcccggaagaccttcgtcgacctcatgcgccgaggtgacctgcccgtgtggcttgcctacaaggtggccgcggagggcattaactacgcagacagaaaatggtgcttcgatggtataaagaacaaccagatcctggaggagaacgtcgaggtggagatctggacgaaggagggcgaaagaaagaagttaaaaccgcgctggctcgatgcccggatctacagtgaccccctcgccctgaaggagttcaaagaattcgcagccggccgcaagtccctgacattaaacctaattactgagatgggtcgtctgcccacttttatgacgcaaaaagcccgcaacgctctggacaacctggcagttctacacacggcggaggccggagggcgggcctacaaccacgcacttagcgagctgcccgagacccttgagactctcctgctgctcacgctattggcgaccgtcaccggcggcatcttcctcttccttatgtccgggaagggcatagggaagatgaccctgggcatgtgctgcatcatcacagcgagcgtgctcctgtggtacgcccagatccaaccgcactggatcgccgcgtctatcatactggaatttttccttatcgttttactaatccccgaaccagaaaagcagcgcacgccccaggacaaccagctcacctacgtagtgatagccatccttaccgtcgtggcggccaccatggcgaatgaaatggggtttctggagaaaacgaaaaaagacctcgggttgggtagcattaccacccaggagagcgaatccaacatcctagacatcgatttgaggccggccagcgcctggaccctgtacgccgtggccactactttcgtgacccccatgctgaggcactccatagagaacagctcggtaaacgtgagtctaaccgccatcgctaaccaagcgactgtccttatggggctgggcaaggggtggcccttgtccaagatggacattggcgtgccgctgctggctatcgggtgctactcgcaggtgaaccccatcacgctcaccgccgcactgctgctcctggtagcccactacgcgataatcgggcccggcctgcaggccaaagccacgcgggaggcccagaaacgcgccgccgccgggatcatgaagaacccaacggtggacggcatcaccgtgatcgatttggagcccatcccgtacgaccccaagttcgagaagcagcttgggcaggtcatgctgctcatcctctgcgttacccaggtgttgatgatgcggactacctgggccctctgcgaagccctcactctagccaccggcccgatctccacgctatgggaggggaaccccggccgcttttggaacactaccattgcggtcagcatggccaacatattccgagggagttatcttgcgggagccggcctactgttcagcatcatgaaaaacaccacgaacacgcggcgcggaaccggcaatatcggggaaaccctgggggagaagtggaagtcccggctaaatgccttaggaaagagcgagttccagatctacaagaagagtgggatacaggaggtcgaccgcactctggccaaagaaggcatcaagcgcggggagactgatcaccacgccgtgtcacgcggctctgccaagctgcggtggttcgtcgagcgcaatatggttaccccggagggaaaggtggtcgacttaggttgcggtcgcgggggctggtcgtattactgcggtggactgaagaacgtgcgcgaggttaagggcctgaccaagggcggccccggtcacgaggaacccatacccatgtccacctacggttggaacctcgttcgactccaaagcggggtcgacgtgttcttcacgccgcccgagaagtgtgataccctgctgtgcgacataggggagagctcccctaatcccacgatcgaggcaggccgcacacttcgggtcctgaaccttgttgagaactggctgaacaataacacccagttctgcatcaaggtgttaaacccgtacatgcccagcgtcattgagaagatggagacgctccaaaggaagtacggtggcgccttggtgaggaaccctctgagtcgtaattcgacacacgagatgtactgggtgtccaacgcgaccgggaacatcgtcagcagcgtgaacatgatcagccgaatgttaatcaatcgcttcacaatgaaacacaagaaagccacgtacgagccggacgttgacctaggctccgggacccggaacatcggcatcgagtcggaaatcccgaatttggacatcataggaaagcgcatcgagaaaatcaagcaagagcacgagacatcctggcactatgaccaggaccacccctacaagacctgggcctaccacgggagctacgagactaagcagaccggctccgcctcctccatggtcaacggggtggtgcgtttattgaccaagccttgggacgttgtgccgatggtgacacaaatggcgatgacggacaccaccccgttcggtcagcagagagtctttaaggagaaggttgatacccgtacgcaggagcccaaggagggtaccaagaagctaatgaagataaccgccgagtggttgtggaaggagctaggcaagaagaagacaccccggatgtgcacgcgggaagagttcacccggaaggtcaggagcaacgccgctctaggggctattttcaccgacgagaacaagtggaaatctgcgcgggaagctgttgaagacgggcgcttctgggagctggttgaccgggagcgcaacctccatctggagggaaagtgcgagacgtgcgtttataacatgatggggaagcgtgaaaagaagctgggcgagttcggcaaagccaaagggagccgcgcgatctggtacatgtggcttggagcgcgctttctggagttcgaagccctggggttcctaaacgaggaccattggttttcccgcggcaatagcctgtcaggggttgagggcgagggcctgcaccggttagggtacatcctgcgcgacgtgtccaagaaagagggcggggccatgtacgctgacgacacagccgggtgggataccagaatcaccctggaggaccttaagaacgaagaaatggtcactaaccacatgaaaggtgagcacaaaaagctggcggaggccatcttcaagttgacataccagaataaagtggtcagagttcagcgacctacgccccgggggaccgtgatggacatcatcagccggcgcgaccaacggggctccggccaagtgggcacctatggcctaaacactttcaccaacatcgaggcccagctgatccggcagatggaaggcgagggcatcttcaaaagcattcagcacctgaccgccaccgaagagatcgcggttcagaactggctcgcccgcgtgggtcgggagcgcctttcccggatggccatcagcggcgatgactgtgtcgtcaagcccatcgacgaccgcttcgcctccgccctgactgctctcaacgacatggggaaggttcggaaggacatccagcaatgggagccctcccgggggtggaacgactggacacaggttcccttctgttctcaccactttcacgaacttgtcatgaaagacgggcgcgtgctggtggtcccctgccgtaatcaggatgaattgatcgggcgggcccgaataagccagggagcgggatggtccctgaaggaaaccgcttgcctgggtaagagctatgcccagatgtggactctcatgtacttccaccggcgcgaccttcggttggccgcgaacgctatatgttccgcagttcccagccattgggtacccacatccagaactacctggagcattcacgccaagcacgagtggatgaccaccgaggacatgctcgcggtttggaaccgggtgtggatccaagagaatccatggatggaggataaaacacccgtggaatcctgggaagaggtaccctacctggggaagcgcgaggatcagtggtgcggctccctgatcgggttgaccagccgggctacctgggccaagaacatacagaccgccataaaccaggtgcgttccttaatcggtaacgaggagtacacggattacatgcccagcatgaagcgcttcaggcgcgaggaggaggaggccggcgtgctttggtga

SEQ ID NO: 24927 - RNA, 9876 nt, synthetic construct
  misc_feature 1..9876: note = derived and/or modified CDS sequence (opt11) from DENV-2__GQ868556__SS-prME
  source 1..9876: mol_type = other RNA
accgccggagtgatcgtcatgctgatccccaccgctatggctttccacctcacaacccgcaacggggaaccccacatgatcgtgggccggcaggaaaaggggaagtcactgctgtttaagaccgaggacggcgtgaacatgtgcaccctcatggctatcgatctgggggagctgtgcgaggacaccatcacctataagtgtcccctccttcggcagaacgagcccgaggacatcgactgctggtgcaacagcacctcgacgtgggtcacatacgggacctgtaccaccactggcgagcaccgacgggagaagcggtccgtggccctggtgccccatgtggggatgggcctcgaaacccgcaccgagacctggatgagctccgagggggcctggaagcacgtccagcggatcgagacctggatccttcgccacccgggcttcaccattatggccgcgatcttggcctacaccatcgggaccacccacttccaacgtgccctcattttcatcctgctgacggccgtggctcccagcatgaccatgaggtgcatcggcatctccaaccgggacttcgtcgagggagttagcggtgggtcctgggtggacatagtccttgagcacgggagctgcgtcaccacaatggccaagaacaagcccacactggatttcgagctgattaagaccgaggccaagcaacccgccaccctccgcaagtattgcattgaggccaagctgactaacacaaccaccgagagtcggtgcccgacgcagggcgagccctccctgaacgaggaacaagacaagcgcttcatctgcaagcactcgatggtggaccgaggttggggcaacggctgcgggctgttcggcaagggcgggatagtaacctgcgcgatgttcacgtgcaagaagaacatggagggcaaggtggtgcagcctgagaacctggagtacaccatagtcataacgccccacagcggagaggagcacgcggttggcaacgatacggggaaacacggcaaggagatcaagatcactcctcagtccagcatcaccgaagccgagctgaccgggtacggcacggtgaccatggagtgtagcccgcggactggcctcgacttcaacgagatggttcttctgcagatggaagacaaggcgtggcttgtgcaccggcagtggttcctggatctgcccttgccctggttacccggggccgacacccagggctcaaactggatccaaaaggagaccctggtgaccttcaagaacccccatgcgaagaaacaggacgtcgtggtcctcgggtcccaagagggcgccatgcatacggcactcaccggggccacggagatccagatgagcagcggcaacctcctgttcacaggccacctgaagtgccgcctccggatggacaagctccagctaaaggggatgtcctactcaatgtgcaccggcaagttcaagatcgtgaaggagatcgccgagacacaacacgggacgatcgtgatccgcgtccagtacgagggcgacggctccccctgcaaaatccccttcgagatcaccgacctggagaagcggcacgtgctcgggcgcctaatcaccgttaacccgatcgtcatcgagaaggacagccccgtgaacatcgaggctgagcctcccttcggagactcctacataatcataggggtggagccgggacagctgaagctcaattggttcaagaaagggagctccatcggccagatgttcgagaccacgatgcgcggcgccaaaagaatggcgatcctgggcgacactgcctgggattttggctcgttgggcggggtcttcacctcaatcgggaaggccctccaccaagtgttcggagcaatctacggcgccgctttctcgggcgtttcctggactatgaagattctcattggcgtcgtgatcacttggatcggaatgaactcccgctccaccagcctttccgtgagccttgtccttgtgggcgtggtcaccctgtacctgggtgccatggtgcaagcagactctggctgtgtggtcagctggaagaacaaggagctcaaatgcggctccgggatcttcatcaccgacaacgttcacacgtggaccgagcagtacaagttccagccagagagcccctccaagctggcctccgccatccagaaggcccacgaggagggcatctgcggtatccgtagcgtcacccgcctcgagaatctcatgtggaagcagatcacccccgagctgaaccacatactgtccgagaacgaggtcaagctcacgatcatgacgggcgacaccaaggggattatgcaggcgggcaagcggagcctgcgacctcaacccaccgagctgaagtacagctggaagacgtggggcaaggcgaagatgctcagcactgagagtcacaaccagaccttcctcatagatgggcccgagaccgccgagtgccccaacacgaatcgggcgtggaacagtctggaagtggaggactacggcttcggggtgttcactactaacatctggttaaagctgagagaaaagcaggacgttttctgcgactccaaattgatgagcgctgccatcaaggacaatcgggcggtgcatgccgacatgggctactggatcgagtccgccttaaacgatacctggaagatggagaaagcgagcttcatcgaggtgaagtcctgccactggcccaagtcccacaccctgtggtccaacggagtccttgagtcagaaatgataattcccaagaacttcgccgggcccgtatcccaacacaactaccgcccgggctaccacacgcagacagcgggtccatggcacctcggcaaattggaaatggacttcgacttctgcgaaggtaccacggtggtcgtgacggaggactgtgggaatcggggcccctccctgaggacgactaccgcctcagggaagctcatcacggagtggtgctgccggtcctgcaccctgcccccgcttcgctaccggggcgaggacgggtgctggtacggcatggagatccgccccctcaaagagaaggaggagaacctggtaaattcactggtaaccgccgggcacggccagatcgacaacttctccctcggcgtgctggggatggccctgttcctcgaagagatgctgcggacccgcgtcggcacgaaacacgcgattctgctcgttgcggtgagcttcgtgaccttgatcaccgggaacatgtcctttcgggacctgggccgagtcatggtgatggtgggagccaccatgactgatgacatcggcatgggcgtcacctacttggccttactggcagctttcaaggtgcgtccgaccttcgccgccgggctcctgctgcggaagctcacctcgaaggagctgatgatggccacgataggcatcacattactctctcaaagcacaatccccgagaccatcctggagctgacggacgccctcgccctggggatgatggtcctgaagatcgtacgtaacatggaaaagtaccagctcgccgtgactatcatggccatctcctgcgtccccaacgccgtcatcctgcggaacgcttggaaggtgagttgtacaatcctggccgccgtctctgtgagccccctcctgctaacctctagccagcagaaagccgactggattcccctcgccctgacaatcaaggggctgaatcccaccgcgatctttctcaccaccctgagtaggacaagcaagaagcggtcctggccgctgaacgaagcgataatggccgtgggtatggtctcaatcttggcctccagcttattgaagaacgacatccccatgactgggcccctcgtggcagggggcctgctgaccgtgtgttacgtcctcaccggccgaagcgcggacctggagctcgaacgggcggccgacgtgaagtgggaagaccaggccgagataagcgggagctcccctatcctcagcatcacaatctccgaggacggtagcatgtccattaagaacgaggaggaagaacagaccctgactatcctgattcgcaccggcctcttagtcatcagcggggtctttccggtgtccattcccataaccgcagcggcatggtacctgtgggaggtgaagaaacagcgggccggcgttctttgggacgtcccctcgccgccaccggttggaaaagccgagctggaggacggtgcctaccgcatcaagcagcggggcatcctgggttacagtcagataggcgcgggggtatacaaggaagggacgtttcacaccatgtggcatgtgaccagaggggccgtgctcatgcaccgaggcaaacgcatcgagcccagctgggcggacgtaaagaaggacctgatctcctacgggggcggctggaagctggagggcgagtggaaggagggcgaggaggtccaagtcctcgcgctggagcccgggaagaaccctcgggctgtacagactaagccaggtatcttcaagacgaataccgggactataggtgcggtgagcctggacttcagcccaggcaccagcgggtcccctatagtggaccgcaagggcaaggtcgtgggactctacggcaacggcgtggtaacacggagcggagcctacgtgagtgcaatcgcccagaccgagaagtccatcgaggacaaccccgagatcgaagacgacattttccgcaagaagcggctaactattatggacctgcacccaggcgcggggaagactaagcgctatctccccgccatcgtccgggaggccataaagcgcggcctgcgcacgctaatcctggccccgaccagagtcgtggccgcggaaatggaggaggccctccgcgggctgcccattcggtaccagacccccgccatcaaggctgagcacacaggccgcgagatagtggacctgatgtgccacgccacgttcaccatgcgcctcctgagccccgtgcgcgtgccgaactacaacctaatcatcatggacgaggcgcacttcacggaccccgcctccatcgccgcccgaggctacatcagcacccgtgtggaaatgggggaagctgcgggcatcttcatgacagccacgccacccggatcccgggatccgtttccccaaagcaacgcccccataatggacgaggagcgcgagatccccgagcggtcctggaatagcgggcatgagtgggtcaccgatttcaagggtaagaccgtgtggttcgtgccatctatcaaggccggcaacgacatcgcggcttgcctccggaagaacggtaagaaggttatccagctgagccggaagacgtttgacagtgagtacgttaagacccgcgccaacgactgggacttcgtagtcactaccgacatctcagagatgggggccaatttcaaagccgagcgggtgattgacccccgccgctgcatgaagcccgtgatcctgacggacggcgaggagcgcgtaatcctcgcggggcccatgccggtgacccactcctcggccgcccaacggcgtggccgcatcgggcggaaccccaagaacgagaacgaccaatacatctacatgggcgagcccctggaaaacgacgaggactgcgcccattggaaggaggccaagatgctgctcgacaatatcaacacccctgagggcatcataccatccatgttcgagcccgagcgtgagaaggtggacgcgatcgacggcgagtaccggctccgcggcgaggctcggaaaaccttcgtcgacctgatgcgccgcggggacctccccgtgtggctggcctacaaggtggccgcggagggaattaattatgcggaccgcaagtggtgcttcgatggcatcaagaacaaccagatcctggaagagaacgtcgaggtggagatctggacaaaagagggcgagcgaaagaagctcaaaccgcgctggctggacgcccggatctacagcgacccccttgccctcaaggagttcaaggagttcgccgcgggccgcaagtctctgaccctgaatctcatcaccgagatggggcgtctgcccacgttcatgacgcaaaaggcccgcaatgctctggataacctcgccgtcctgcacaccgccgaggcgggtgggcgtgcctacaatcacgcgctgtccgagctccccgagaccctggagaccctgttattactgacgctcctggccaccgtgaccgggggcatctttcttttcctcatgtccgggaaaggcatcggtaagatgaccctgggcatgtgctgcattatcaccgcctcagttctgctatggtacgcgcagatccagccgcactggatcgccgcctccatcatcctggagttcttcctgatcgtcctcctgatacccgagcctgagaagcagcgcacgccacaggacaaccagctgacatatgtggtgattgccatactcaccgtcgtggccgcgaccatggccaacgagatgggtttcctggagaagacgaagaaggacctgggcctcggcagcatcactacccaggagagtgagtccaatatccttgacatcgacctgcgcccggccagcgcctggaccctctacgccgtagcgacgacctttgttactcccatgctgcgccactccatcgaaaactcatccgtcaatgtcagcctgaccgcaatcgccaaccaggccaccgtcttaatgggtctgggaaaggggtggcccttgtccaagatggatatcggcgtgcccctcttagcgatcgggtgctactcacaggtcaacccgataaccctcaccgctgccctccttctgctcgtggcccactacgccatcatcggccccggcctgcaggccaaggccacccgggaggcccagaagcgggccgctgcggggatcatgaagaatcctaccgtggacggcattaccgtaatcgacctggaacccatcccgtacgatcccaagttcgagaagcaattagggcaggtcatgctgctgattctctgcgttacccaggtgttaatgatgcggaccacgtgggctctgtgcgaggcgctcaccctggcgaccgggcccatctcgacgctgtgggaggggaatcccgggcgcttctggaatactacaattgcagtcagcatggcgaatatctttcgcggctcctacctcgccggcgccggcctgctgttcagcatcatgaagaacaccaccaacacgcggcgcgggactggaaacatcggcgaaacacttggggagaagtggaagtcccgactgaacgcccttggaaagagcgagttccagatctataagaagtccgggatccaagaggtggaccgcaccctcgcgaaggaaggcatcaaacgaggggagacggaccaccacgccgtgagccgcggctccgccaagctgcggtggttcgtcgagcgcaacatggtgaccccggagggcaaggttgtagacctggggtgcggtcgtggaggctggagctactactgtgggggcctcaaaaatgtacgcgaggtgaaggggctgaccaagggtggcccagggcatgaggagccgatccccatgtccacctacggctggaacctggttcggcttcagagcggagtggacgtgttcttcacgccgcccgagaagtgtgacaccctgctgtgtgacatcggcgaaagctccccaaacccgaccatcgaggcaggccgcaccctgcgggtcctgaacctggtggaaaattggctcaacaacaatacacagttctgcatcaaggtgctgaatccgtacatgccctccgtcatcgagaaaatggagacactgcagcgcaagtacgggggcgccctcgttcgcaaccccctgtcccgcaacagcacccacgagatgtactgggtgtccaacgcgaccgggaacatcgtcagctccgtgaacatgatcagccggatgctcatcaaccgcttcaccatgaagcacaaaaaggccacgtacgagccggacgtggacttaggctccgggacgagaaacatcggaatcgagagcgagatcccaaatctcgacatcattggcaaacgcatcgagaagatcaagcaggagcacgagacctcctggcactacgaccaggaccacccctacaagacctgggcctaccacgggagctacgagactaagcaaaccggctccgccagctccatggtgaacggggtggtgcgcctactgaccaaaccctgggacgtcgtgcctatggtgacccagatggctatgacggacacaacccccttcgggcaacagcgggtgttcaaggaaaaagtggacaccaggacgcaggagcccaaagagggcaccaagaagctcatgcggatcaccgcggaatggctatggaaggagctggggaagaagaaaacgccccggatgtgcacgagggaggagttcactcgaaaggtgagaagcaatgccgccctgggcgccattttcaccgacgaaaataagtggaagtccgcccgcgaagcggtcgaggacggacggttctgggagctggtcgaccgcgagcggaatctgcacctcgagggcaagtgcgagacctgcgtctacaatatgatggggaagagagagaaaaagctgggcgagttcggcaaagccaaggggagccgtgcgatatggtacatgtggctgggcgcccgcttcctcgagttcgaggcgctggggttcctgaacgaggaccactggttctcccggggcaactcattaagcggagtggaaggcgagggcctgcaccgcctggggtacatcctccgggacgtgggcaaaaaggagggcggcgctatgtacgccgacgacactgccgggtgggacacccgaatcaccctggaagacctcaaaaacgaagagatggtgaccaaccacatgaagggcgaacacaagaagctcgccgaggcgatctttaagctgacgtaccagaacaaggtggtacgggtccaaaggcccacgccccgtggcaccgtgatggacatcatatcccggcgcgaccaacgcgggagcggccaggtgggaacctacggcctgaacacgttcaccaacatggaggcccagctcataaggcagatggagggtgaggggatcttcaagtccatccagcacttaaccgcaaccgaggagatcgccgtccagaactggctggcccgggtgggccgtgagcggcttagccgcatggcgatctccggagacgattgcgtcgtcaaacccatcgacgaccggtttgcctccgccttaacggcccttaacgacatgggaaaggtgcgcaaggacatccagcaatgggaaccctccagggggtggaacgactggacccaggtgccgttttgcagccaccatttccacgagctcgttatgaaggatggccgcgtgttagtggtcccctgccgtaaccaggatgagctgatcggccgcgcccggatatcccagggggctggctggagcctcaaggagactgcctgcctaggcaagtcctacgcacagatgtggaccctgatgtacttccacagaagagacctccgattagccgccaatgcgatctgcagcgccgtgccctcccactgggtgcccaccagccgcacgacctggtccatccacgccaagcacgagtggatgaccaccgaggacatgctggccgtctggaaccgcgtgtggatccaagagaacccgtggatggaggacaagacgcctgtggagagctgggaagaggtcccttacctgggcaagagggaggaccagtggtgcgggtccttgatcggcctcacatcacgcgcgacctgggccaagaatattcagaccgcgatcaaccaggtgcggagcctcatcggcaacgaggagtacacggactacatgccgtcgatgaagcggttccgcagagaggaagaagaggccggggtgctgtggtga

SEQ ID NO: 24928 - RNA, 9876 nt, synthetic construct
  misc_feature 1..9876: note = derived and/or modified CDS sequence (opt11) from DENV-2__GQ868557__SS-prME
  source 1..9876: mol_type = other RNA
accgccggtgtgatcgtaatgctcatccctaccgccatcgcgtttcacctcaccacccgcaacggggagccccacatgatcgtcggccggcaggaaaaggggaagagtctactgttcaagaccgaggacggggtgaacatgtgtacactcatggccatcgacctgggggagctgtgcgaggacaccattacctacaagtgccccttactgcggcagaacgaacctgaagacatagactgttggtgcaacagcaccagcacttgggtcacctacgggacttgcacaaccacgggcgagcaccgccgcgagaagcggtccgtcgccctggtaccccacgtcggcatgggcctcgagaccagaaccgagacgtggatgagctccgagggtgcctggaaacacgtgcagcggatcgagacctggatcctgcgccacccgggcttcaccattatggccgcgatcctggcctacaccatcggtaccacgcattttcagcgggccctcattttcatactgctgaccgccgtggcccccagtatgaccatgcgctgcatcgggatatccaaccgcgacttcgtggagggcgtgagcggcggctcgtgggtggacatagttctcgaacacggatcttgcgtgacgactatggccaaaaacaagcctaccctggacttcgagctgatcaagaccgaggccaaacagcccgccaccctccgcaagtactgcatcgaagccaagctgacgaacaccaccaccgagtcccggtgcccgacgcagggcgagcccagccttaatgaggagcaagacaagagattcatttgcaaacatagtatggtggaccggggctgggggaacgggtgtgggctgtttggcaagggagggatcgtgacctgcgctatgttcacgtgcaagaagaatatggaaggcaaggtggtgcagcccgaaaacctggagtacaccattgtcattaccccccactccggcgaagaacacgccgtgggtaacgacacagggaagcacggcaaggagatcaagatcaccccgcaatccagcataaccgaggcagaattaaccgggtacggcacggtgaccatggaatgctcgccgcggaccggcctcgactttaacgaaatggtactgctccagatggaggataaggcatggctcgtgcaccgccagtggtttcttgacttaccactcccgtggctgcccggggccgacacacagggcagtaactggatccagaaggagacgctggtgaccttcaagaacccccatgcaaagaagcaggacgtcgtggtcctcggatcccaggagggcgccatgcatacagcccttaccggggccacggaaattcagatgagctccggcaacctcctgtttaccgggcacctgaagtgcagactgcggatggacaagctccagctgaaagggatgtcctactcgatgtgcaccggtaagtttaaaatcgtgaaggaaatagcggagacccagcacgggaccattgtgatccgcgtacagtatgagggcgacggctcaccctgtaagatccccttcgagatcaccgacctggagaagcgacatgtgctcgggcgcctgatcactgttaacccgatcgtaaccgagaaggacagcccagtgaacatagaggcggagccgcccttcggcgactcctacatcatcatcggcgttgagccgggccaactgaagctgaactggttcaagaaggggagctccattggccagatgttcgagacaactatgcgcggcgcaaagagaatggccatcttgggggacaccgcctgggacttcggctccctcggaggggtcttcaccagtatcgggaaagccttgcaccaggtgttcggtgcgatttacggcgcagcattcagcggagtctcctggactatgaagatcctgatcggcgttgtgatcacatggatcggcatgaacagccgcagtacctcactgagcgtgagcctggtgctcgtgggagtggttacgctctacctgggggcaatggtgcaggctgactccggctgtgttgtctcctggaaaaataaggagttaaaatgcggctccgggattttcatcacggacaacgtgcatacctggacagaacagtataaattccagcccgagagccccagcaagcttgcctccgctatccagaaggcccacgaggagggcatctgcgggatacggagcgtgacccgactggaaaacctcatgtggaagcagatcacgcccgaattaaaccacattcttagtgaaaacgaggtcaagcttaccataatgaccggcgacaccaagggcatcatgcaggccggcaagcgaagcctgcgtccgcagcccacggagctgaaatactcctggaaaacctggggaaaggcgaagatgctaagcaccgaatcacataaccaaaccttcttaatcgacgggccagagacggccgagtgcccgaacaccaaccgggcttggaatagcctggaggtggaggactacggcttcggggtatttaccacgaacatctggctcaagctgcgagaaaagcaagacgtgttctgcgactctaagctgatgagcgccgccattaaggataatcgggcggtgcatgcagacatgggctattggatagaatccgccctcaacgacacctggaaaatggaaaaggccagcttcatcgaggtgaagagttgccactggcccaagagccacacgctgtggtcaaacggcgtcttggagtcagagatgataatccccaaaaactttgcaggccccgtttcccagcacaactaccgcccgggctaccacactcaaaccgcggggccctggcacttgggcaaactcgagatggacttcgacctctgcgaggggacgacggtggtcgtgaccgaggattgcggcaaccggggcccgagcctccgcacgaccacggccagcggtaagctgatcaccgagtggtgttgccggtcctgcaccctcccgccgctccgctatcggggtgaagatgggtgctggtacggcatggagattagaccactgaaggagaaggaggaaaatctggtgaacagcctcgtcactgcggggcacggtcagatcgacaacttttccctgggcgtgctggggatggccttattcctggaagaaatgctgcggacgcgcgtggggaccaagcacgcgatcctcctggtagccgtgagcttcgtgacattgataacgggaaatatgtccttccgggacttaggccgggtcatggttatggtgggagccacgatgaccgatgacatcggcatgggcgtcacgtacctggccctgctcgcagcgtttaaggtgcggcccaccttcgcagcagggcttctgctccggaagctgacttcaaaggagctgatgatggctaccatcggcatcgccctcctgtctcagtcaaccatccccgagaccatcctggaactcactgacgcgctggcgttggggatgatggtactcaagatcgtacggaatatggagaagtatcagttagccgtgaccataatggcaatctcctgcgtgccgaacgccgtgatcctgcggaacgcctggaaggtcagttgcactatcctcgccgccgtctccgtgagccccctgctgctcacaagtagtcaacagaaggctgactggatccccctcgcgctgacaattaagggcctcaaccccaccgctatcttcctgaccaccttatcccgcacgagcaagaagcggtcctggcctctcaacgaagccatcatggccgtaggaatggtcagcatcctggcctcctcactgctcaagaacgacatccctatgaccgggcccctggtggcgggcgggctgctcaccgtgtgttacgttctgaccggccgcagcgccgacctggagctcgagcgggcagcagaggtgaagtgggaagatcaggccgagatctccgggagctctcccattttaagcataactatttccgaggacggaagcatgtccatcaagaatgaggaggaggagcagaccctgacaatcctcattcgcaccgggctgctggtgatctcaggcgttttcccggtgtccatccccatcaccgccgccgcctggtatctctgggaggtgaagaaacaacgggctggtgtcctgtgggatgtgcccagcccgccccccgtggggaaggccgaacttgaggacggcgcttaccgaatcaagcagagggggattctcggctactcccagatcggcgccggggtctacaaggagggcacgttccacaccatgtggcacgtgacccgcggagctgtgctgatgcaccggggaaagcgaatcgagccctcgtgggccgacgtcaagaaggacctgatctcttacgggggcggctggaagttagaaggagagtggaaagagggcgaggaggtgcaggttctagccctggaacccgggaagaacccaagagcggtccaaaccaagcccggcattttcaagacgaacaccggcacgatcggggccgtgagcctcgatttctcccccggcactagcgggtccccaatcgtagatcgcaaaggcaaggtcgtggggctgtacggcaacggagtggtcacgcggagcggggcgtacgtgagcgccatagcgcagaccgagaagtccatcgaggacaaccctgagatcgaggacgatatcttccggaagaagcgtctcaccatcatggatctgcaccccggtgcggggaagaccaagcgctacctgccagctatcgtgcgggaggccatcaaacgcggcctgcgcacgctgatcctcgccccgacccgggtcgtggcggcagaaatggaggaggccctgagagggctgcccatccggtaccagacccccgcgatcaaggccgagcacacaggccgagaaatcgtagacctcatgtgtcatgcgacgttcaccatgcgcctgcttagcccggtgcgggtcccgaactacaatctcatcatcatggacgaggcccacttcaccgaccccgcctctattgccgcccgggggtacatctcaactcgcgtagagatgggtgaggcggccggtatcttcatgacggccacgccgccaggatcccgggacccgtttccccagtccaacgcccccatcatggacgaggagcgggagatccccgagcggtcctggaacagcggacacgagtgggtcaccgacttcaagggtaagaccgtgtggtttgtgccatcaattaaggccggcaacgacatagcggcctgcctgcgaaagaacggcaagaaggtcatccagctgagccggaagacgttcgactccgagtacgtgaaaaccagagccaatgactgggacttcgtcgtgaccacggacataagcgagatgggggccaacttcaaggcggaacgcgtgatcgatccccgccggtgcatgaagcccgtgatcctcacagacggcgaggagcgtgtaatcttagccggacccatgccggtgacacacagcagcgcagcccagcggcgcggccgcatcgggcggaaccccaagaatgagaatgaccaatacatctacatgggcgaaccgctggaaaatgacgaagattgcgcccactggaaggaggccaagatgctcctggacaacatcaatactccggagggcattatcccgtccatgttcgagcccgagcgcgaaaaagtcgacgcaatcgacggtgagtaccggctgcgcggcgaggcccggaagaccttcgtcgaccttatgcgccgaggggacctgcccgtttggcttgcttacaaggtggccgcagagggcatcaactacgccgaccgcaagtggtgcttcgacgggatcaagaacaaccagattctggaggagaacgtcgaggtggagatctggacgaaggagggcgaacggaagaagctgaagccgcgttggctggatgctcggatatacagcgaccccctcgccctgaaggagttcaaggaatttgccgccggccgcaaatccttgaccttaaacctgatcaccgagatggggcgcctgccaacattcatgacgcagaaggcccgcaatgccctcgataacctggctgtcctgcacaccgcggaggccggcggaagggcatacaaccacgccctcagcgagctccccgagactctggagaccctcctgctgctcacgctgctggccaccgtaactggcggcattttcctattcctgatgtccggcaaggggatcgggaaaatgaccctgggtatgtgctgcattataactgcgtcagtgctcctgtggtacgcccaaatccaaccacactggattgccgcctccatcatcctggagttcttcctcatagttctgctgatccccgagcccgagaagcaacgcacgccccaggacaaccagctcacatacgttgtgatcgctatcctgaccgtcgttgcggccactatggccaacgagatggggttcctagagaagacgaagaaggacttaggactggggagcatcacaacccaggagagcgagagcaacattttggatatcgacctccgcccggcctccgcctggacgctctacgccgtggccacgacgttcgtcacccccatgctgcgccactccatcgagaactcttctgtgaacgtgagcctcaccgccatcgccaaccaggcgacggtactgatgggactgggcaagggctggcccttgtcaaaaatggacatcggggtgccactgctggccatcggctgctacagtcaggtgaacccgatcaccctcaccgccgccctgttacttctcgttgcccactatgccattatcggccccggactgcaggccaaggccaccagggaggcacaaaagcgagccgcggccggtatcatgaagaaccccacagtagacggaatcactgtcatcgacctcgagcctataccgtacgaccccaagttcgagaaacagctggggcaagtgatgctgctcatcctgtgcgtgacacaggtcctgatgatgagaaccacctgggccctgtgcgaggccctgacgctggccaccggcccgatctcgaccctctgggagggaaaccccggccgcttctggaacacgactatcgccgtttcaatggccaacatcttcagaggctcctacctggccggagccggacttctgttcagcatcatgaaaaatactaccaacacgcggcgcgggactggcaacatcggcgagactctgggggagaagtggaagtcccgcctgaacgctttgggcaagagtgagttccagatctacaaaaagtccggtatccaggaggtggaccgcaccctggccaaggagggcattaagcgcggggagacagaccaccacgccgtgagccgaggatcggccaaattgcggtggtttgtcgagcgcaacatggtgactcccgagggcaaggtggtcgacctcggctgcgggcgaggggggtggagctactattgcgggggcctgaaaaacgtgcgagaggtgaagggactgaccaagggcggccccgggcacgaagagccgatcccgatgtccacctacggctggaacctcgtgcgcctgcagagcggcgtggacgtgttcttcacgccgccggagaaatgcgacaccctgttatgcgacataggcgagtctagccccaatcccaccattgaggccgggcgtaccctgcgggtgctcaacctggtggagaattggctgaacaacaatactcaattttgtatcaaggtcctgaatccgtacatgcccagcgtgatcgagaagatggagacactccagcgcaagtacgggggtgccctggttcggaaccccctgtcgcgcaacagcacccacgaaatgtactgggtgtcaaatgccacggggaacattgttagctccgtaaacatgatcagccgaatgctaattaaccgcttcaccatgaaacacaagaaggccacgtacgagccggacgttgacctcggctccgggacccggaacataggcattgagtccgagatccccaacctggacatcatcggtaaacgcattgagaaaatcaagcaggagcacgagacctcatggcactacgaccaggaccacccctataagacatgggcctatcacgggtcttacgagacgaagcagaccggcagcgcaagcagcatggttaacggggtggtccgcctgctcacaaagccctgggacgtcgtgccgatggtcacccagatggcgatgaccgacacaaccccgttcgggcagcagcgagtcttcaaagagaaagtggacaccaggacgcaggagcctaaggagggaaccaaaaaactgatgaagatcactgcggagtggctgtggaaggagttgggtaagaagaagacgccccgcatgtgcacgcgcgaagagttcacacggaaggtaagaagcaacgccgccctcggcgccattttcaccgacgagaacaagtggaagtccgcgcgggaggccgtcgaagacgggaggttttgggagttagtggatcgggaacgcaacctccacctggagggcaagtgcgagacttgcgtctacaatatgatgggaaagcgtgagaaaaagctgggcgagttcggcaaggcgaaggggagccgcgccatctggtacatgtggcttggcgcccggtttcttgagttcgaggccctggggttcctcaacgaggaccactggttttcccgcgggaactccctgagtggggtggagggagagggcttacacagattagggtatattctgcgtgacgtctccaagaaggagggcggggccatgtatgccgacgacacggccggctgggacacccggatcaccctcgaggacctcaagaacgaggagatggtaactaaccacatgaaaggagaacacaaaaagctcgcggaggcgatcttcaagctgacttaccagaacaaagtggtacgggtccagcggcctacgccccggggtaccgtgatggacatcataagccggcgcgatcagcgcgggagcggacaggtgggcacttacgggctcaatacgttcacgaatatggaggcccagttaatacggcagatggagggcgagggcatattcaagagcatccagcatctgaccgccaccgaggagaacgccgtccagaactggctcgcgcgcgtgggacgggagcgcctgtcccggatggccatctccggtgacgactgcgtggtcaagcccatagacgaccggtttgcctccgccctgacggccctcaatgatatggggaaagtacggaaggacatccagcagtgggaaccgagccgcggctggaacgactggacgcaggttccgttctgctcccaccacttccatgagttagtcatgaaggatgggcgggtgttggtggtgccctgccgcaaccaagacgagctcataggccgggcccgaatcagccaaggcgccgggtggtcactgaaggagaccgcttgcctgggcaagagctacgctcagatgtggacgctcatgtatttccatcggcgtgacttacggcttgccgcgaacgcaatatgcagtgccgtgcccagccactgggtgcccacctcccgcacgacctggagcattcacgccaagcacgagtggatgactaccgaggacatgttagcggtgtggaaccgggtgtggatccaggagaacccgtggatggaggacaagacgcccgtggagtcctgggaggaggtcccctacctcgggaaacgagaggaccagtggtgcggtagcctgatagggctcacaagccgggccacctgggccaagaacatacagacggccatcaaccaggtgcgctctcttatcggtaacgaggagtacacggactacatgccctcaatgaagcgcttccggcgcgaggaggaggaggccggcgtgctgtggtga

SEQ ID NO: 24929 - RNA, 9876 nt, synthetic construct
  misc_feature 1..9876: note = derived and/or modified CDS sequence (opt11) from DENV-2__GU131947__SS-prME
  source 1..9876: mol_type = other RNA
acggccggtgtgatcgttatgctgattcccaccgccatcgcatttcacctcaccacccgcaacggggagccacacatgatcgtgggccggcaggagaaggggaagtccctgctcttcaagaccgaggacggtgtgaacatgtgcactctcatggccatcgacttgggggagctgtgcgaggacacaatcacctacaagtgccctctcctccgccagaacgagcccgaggacatcgactgctggtgcaacagcaccagcacttgggttacatacgggacctgcaccaccacgggcgaacatcgacgtgagaaaagaagtgtggctctagtgcctcacgtagggatgggcctcgagacccgcaccgagacctggatgagctccgagggggcctggaagcacgtccaacggattgagacgtggattctacgccacccgggcttcacaatcatggccgcaatcctggcctataccatcgggacaacgcatttccaacgtgccctcatctttatcctgctgactgccgtggcccccagcatgaccatgcgctgcatcggcatctccaaccgggacttcgtcgagggcgttagcgggggcagttgggtggacatcgttctcgagcacgggagctgcgttactacgatggcgaagaacaagcccaccctggacttcgagctgatcaagactgaggccaagcagcccgccacgctccgcaagtactgcatcgaagccaagttgacgaacaccaccacagaatcccggtgccctacgcagggcgagccctctctgaacgaagagcaggacaagcgtttcatctgcaagcactccatggtcgaccggggctgggggaacggctgcgggctgttcgggaaaggcgggatcgtgacatgcgctatgttcacatgcaagaagaacatggagggcaaggtagttcagcccgaaaatctggaatacaccatcgtgattacgccccacagcggggaggagcacgccgtgggcaacgataccggaaaacatggcaaggaaatcaagatcactccgcagtcgagcatcaccgaggccgagctgaccggatacggcacggtgaccatggagtgcagcccccggacgggcctcgacttcaacgagatggtcctgctgcaaatggaggacaaagcttggctcgtgcatcggcagtggttcctggacttgcctcttccttggctgccgggggcggacacccagggaagcaactggatccagaaagagacgttagtgaccttcaagaacccccacgcgaagaagcaggacgtcgtggtccttggatcccaggaaggcgccatgcacaccgccctgacaggggcaacggagatccagatgagcagcggcaacctcctgttcaccggacacctgaagtgccgcctgaggatggacaaacttcagctgaagggcatgtcgtattcaatgtgcaccggcaaattcaagatagtgaaagagatcgccgagacacagcacggtacgatcgtgatccgcgtccagtacgagggcgacggctccccctgcaagatcccgttcgagatcacggatctggagaagcgccacgtgctcgggcgcctaatcaccgttaacccgatcgtgactgagaaggatagccccgtgaacatagaggctgagccgcccttcggagactcctacatcatcatcggggtggaaccgggccagctgaagctcaattggttcaagaaggggagctccatcggccagatgttcgagacgaccatgcgcggcgccaaacggatggccatcttaggggataccgcctgggacttcggcagcctcgggggggtcttcacgtcgatagggaaggccctccaccaggtgttcggggcgatctacggcgccgccttcagcggggtgtcctggactatgaagatcctgatcggcgtcgtgataacgtggatcggtatgaacagccgctccacgagcctgtccgtgagcctggtcctcgtgggcgtggtcaccctgtacctgggggctatggtgcaggcagactccggctgtgtggtcagctggaagaacaaggagctcaagtgcggctccgggatcttcataacggataacgtgcacacctggaccgagcaatacaaatttcagcccgagagccccagcaagctggcctccgccattcaaaaggcccacgaggagggcatttgcgggatccggagcgtgacccgcctggagaaccttatgtggaaacagatcacgcccgagctgaatcacatcctatccgaaaatgaggtcaagctcaccatcatgactggcgacacgaaggggatcatgcaggccggcaagcggagcttgagaccgcaacccacagagctgaagtattcctggaagacctggggcaaggcgaagatgctcagcaccgagtcccacaaccagaccttcctgatagacggacccgagacggccgagtgcccgaacaccaaccgggcctggaacagcctggaggtggaggactacggctttggtgtgttcacaactaacatctggctcaaactgcgcgaaaagcaggacgtcttctgcgattccaaactgatgagcgccgccatcaaggataaccgggcggtgcacgccgacatgggttactggatagaatcagccctcaacgacacctggaaaatggagaaagcctcattcatcgaggtgaagtcctgtcattggcccaagagccacaccctgtggtccaacggcgtcctggagagtgagatgatcatcccgaagaattttgccggccccgtatcccagcacaactaccggcctggctaccacacccaaactgcggggccctggcacctcggcaagctggagatggatttcgacctgtgcgagggcactacggtggtagttaccgaggactgcggcaaccgggggcccagcctccgcaccaccacggcctcgggtaagctgatcaccgagtggtgctgccggtcctgcaccttacccccgctccgctaccgcggcgaggacgggtgctggtacggcatggaaatccgccccctgaaagagaaggaggagaacttggtcaacagcctcgtgactgccggacacggccagatcgacaacttctctttaggcgtgctggggatggccctcttcctggaggagatgctgcggaccagggtgggaaccaagcacgcgatccttctggtcgccgtaagcttcgtgaccctcatcaccgggaacatgtcttttcgggacctcggacgagtaatggtaatggtcggggccacaatgaccgacgatatcgggatgggcgtcacctacctggccctgctcgctgcatttaaggtgcgccccaccttcgccgcagggctgctcctccggaagctgacgagcaaggagctgatgatggcaacaatcggcatcgccctcctttcccagagcaccattcccgagaccatcctagagttgacggacgcgctggccctggggatgatggtactaaaaatcgtccgcaacatggagaagtaccagctggccgtgaccattatggccatcagctgcgtgccgaatgcaatgatcctgcggaacgcgtggaaggtctcgtgcaccattctcgcagccgtgtccgtcagccccctgctgctaacctcatctcagcagaaggccgattggatccccctggcactgacgatcaaaggcctcaaccccaccgccatcttcctgaccaccctgtcccgcacgtccaagaagcggagctggcctctcaacgaggctatcatggccgtcggcatggtcagcatcctggcttccagcctcctcaagaacgacattcccatgaccgggcccctggttgccggggggctgctcaccgtctgctacgtattgaccggccgcagcgccgatctagagttagagcgggccgcagaggtcaagtgggaggaccaggccgagatctccgggagcagtcccatacttagcatcacgatctccgaggacggcagcatgtctatcaagaatgaggaggaagagcagacgctgaccatcctcatccgcaccgggctgctggtgatctccggggtattcccggtcagtatacccatcaccgcggccgcttggtatctctgggaggtaaagaagcagcgggccggtgttctctgggacgtcccctccccgccgcccgtgggccgtgccgagctggaagacggcgcctaccggatcaagcagcgcgggattctgggctactcacagataggcgctggggtgtacaaggagggcacgttccacaccatgtggcatgtcacccgcggggccgtgctgatgcaccgaggcaagcggatcgagcccagctgggccgacgtgaagaaagacctgatttcctatgggggcggctggaagttagagggggagtggaaggagggcgaagaggtccaggtgctggccctggagcccgggaagaacccccgcgcggtccagacaaaacccggcattttcaagactaacacggggaccatcggcgccgtcagtctcgacttcagccccggcaccagcgggtcccccatcgtggaccgcaagggaaaggtggtcggtctgtacggcaacggcgtggtcacgcgcagcggggcctacgtctccgccatcgcgcagaccgagaagtccattgaggacaaccccgagatagaggacgatatcttccggaagaaacgcctgaccataatggacctacaccctggcgctgggaagaccaagcgttacctgcccgccatcgtgcgtgaggccatcaagaggggactgcggacgttaatactcgctccgacccgcgtcgtcgcggccgaaatggaggaggccctgcgggggcttccgatccgctaccagaccccggccatcaaagccgaacacaccggccgggaaatcgtggacctcatgtgtcacgcgacgttcacgatgcgacttttaagcccggtgagagtccctaactacaacctcatcatcatggacgaggcccacttcaccgaccccgcctccatcgcggcccgcggctacatttctacccgggtggagatgggggaagcggctggcatctttatgacggccacccctcccgggtcgcgcgatccgttcccccagagcaacgcccctatcatggacgaggagcgggagatccctgagcgtagttggaactccggccacgaatgggtaaccgatttcaaggggaagaccgtctggttcgtgccgtccatcaaggcgggcaacgacatcgccgcctgcctgcggaagaacggcaagaaggtgatccaacttagccgcaaaacgttcgactccgagtacgtcaagacccgggcaaacgactgggattttgtggtgaccacggacatcagcgaaatgggggccaacttcaaggcagagcgcgttattgacccccggcgctgcatgaagcccgtgatcttgacggacggcgaggagcgggtaatcctggccgggcccatgcctgttacacactccagcgccgctcagcgccgaggccggatcgggcgcaaccccaagaacgagaacgaccagtacatctacatgggcgagcccctggagaacgacgaggactgcgcccattggaaagaggcgaagatgctcctagacaacattaacacgcccgagggcatcattccgtccatgttcgaacccgagcgggagaaagtggacgctatcgacggggagtataggttacggggtgaggcccgcaagaccttcgtagacctcatgcggcgcggggacttacccgtctggctggcttataaggtggccgctgagggcattaactacgcagaccggaagtggtgtttcgacgggatcaagaacaaccaaatcttagaggagaacgtggaggtcgagatctggacaaaggagggcgagcgcaagaagctgaagccacggtggctggatgcccgaatctactcagaccccttagccctgaaagagtttaaagagttcgcggccggccgtaagtccctgaccctcaatttgatcaccgaaatggggcgcctgcccacattcatgacgcagaaagctcggaacgccctggacaacttagctgtgctacacaccgcggaggccggcgggcgcgcttacaaccacgcgctcagcgagcttcccgagacccttgaaaccctccttctgctcacgctgctggccaccgtcaccggaggcatcttcctcttcctgatgtccgggaagggcatcgggaagatgaccctgggcatgtgctgtataatcactgcgagcgtgctcctgtggtacgcccagattcagccgcactggattgccgcctccatcatcctggagtttttcctcatcgtgttgttgatacccgagcccgagaaacagcggacgccccaggacaaccagttaacctacgtcgtgatcgccatcctgaccgtggtagcggccacgatggccaacgagatggggttcctggaaaagacgaagaaggacttaggcctgggcagcatcaccacgcaggagagcgagtccaacatcctggacatcgacctccgcccggctagcgcgtggaccctgtacgcggtggccacgacattcgtgacacccatgctgcgtcactccattgagaacagctccgtcaacgttagcttaaccgcaatcgccaaccaggcgacggtgctgatggggttggggaaggggtggcccctctctaaaatggacattggggtcccactcctggcaatcgggtgctatagccaggtcaacccgataaccctcaccgctgccctcctgctcctggtggcccactacgcgatcataggccccggcctgcaagcgaaggccacccgagaggcccagaagcgggccgcggccgggatcatgaagaaccctacggttgatggcattaccgtaatcgacctcgagcccatcccgtacgatcccaagttcgagaaacagctgggtcaggtgatgctgcttatcctgtgcgtcacccaggttttgatgatgcgaactacctgggccctttgcgaggctctgaccctggccactggacccatttcgacgctctgggagggtaaccccggccgcttttggaacacgaccatcgcggtgtctatggcaaacatcttccggggcagctacctggccggggccggcctcctgttcagcatcatgaagaacaccaccaacacgcgccggggtaccggcaacatcggggagaccctgggggagaagtggaagtcccgactgaacgcactcggcaaatcggagttccaaatctacaagaagagtggaatccaggaggtcgaccgcaccctagctaaggagggcatcaagaggggggagacggaccaccacgccgtatcgcgaggttccgccaaactgcgctggttcgtggagcggaacatggtaaccccagagggcaaggtggtagacctcgggtgcggccgcgggggctggagctactactgcgggggcctgaagaacgtcagagaggtgaagggcctgaccaagggcggccccgggcacgaggagccaatcccgatgagcacctacggctggaacctagtacgcttacagagcggcgtggacgtgttcttcacgcctcccgagaagtgcgacaccctgctctgcgacatcggtgagtcctcccccaaccccaccatcgaggcggggcgaaccctgcgcgtgctaaacctcgtcgaaaactggctgaacaataatacccagttctgtatcaaggtgctgaacccatacatgcccagcgtgatcgagaagatggaaacgctccagcggaagtacggaggagccctggtccgtaaccctttgagtcggaacagcacccacgagatgtactgggtctccaacgccaccgggaacatcgtaagttccgtcaatatgatcagccgcatgctgatcaatcggttcaccatgaagcacaagaaggctacgtacgagccggatgtcgacctcggctcggggacccgcaacatcggcattgaaagtgagatcccgaacctggacatcatcgggaaacgcattgagaagatcaagcaggagcacgagacctcctggcactacgaccaggaccatccctacaagacctgggcctatcacgggagctacgagacgaagcagaccggctccgccagctcgatggtgaacggagtcgtgcggctgctcaccaaaccctgggacgtggtcccgatggtcacccagatggcgatgacggacaccacccccttcggccagcagcgcgtgttcaaggaaaaggtcgacacccggactcaggagcccaaagagggcaccaagaagctgatgaagatcaccgccgagtggctgtggaaggagctcgggaagaagaagacgcctcgcatgtgcactcgggaagaattcacaaggaaggtgcggagcaacgccgcactcggcgcaatctttacggacgagaacaagtggaagtccgcgcgagaggccgtcgaggatgggcggttctgggagctggtcgatagagaacggaacctccatctggagggcaagtgcgagacctgcgtgtataacatgatgggaaagcgcgagaagaagctgggcgagttcggcaaggcaaagggatcacgggccatctggtacatgtggctcggcgcgcgcttccttgagttcgaggccctggggttcttaaacgaggaccactggttctcccggggtaacagcctaagtggagtagagggggagggcctgcaccgcctcgggtacatactgcgggacgtgtccaagaaagagggcggggccatgtacgccgacgacacggccggatgggatacacgcatcaccctggaggacctcaaaaacgaggagatggtcaccaaccacatgaagggggagcacaagaaactggcggaggcaatcttcaagctgacgtaccagaacaaggtcgtgcgggtgcaacgcccgacgccccggggcaccgtcatggacatcatctcgcgacgcgatcagcggggctcaggccaggtcgggacctacgggctcaacacgttcaccaacatggaggcccagttaatcagacaaatggagggcgagggcatcttcaagagcatccagcatctgaccgccatcgaggagattgccgtgcagaactggctcgcgagggtcgggcgtgagcgactgtcgcgcatggctatcagtggcgacgactgcgtggtgaagcccattgacgaccgattcgcctccgccctcaccgccctcaacgacatggggaaggtccgcaaggacatacagcagtgggagcccagccggggctggaacgactggacccaggtgccgttctgctcccatcacttccacgagctggtgatgaaggacgggcgagtcctggtggtgccctgccgtaaccaggacgaactcatcggccgcgcgcggatcagccagggtgccggttggtcgctgaaggaaaccgcctgcctgggcaagagctatgcccagatgtggaccctcatgtacttccatcgccgtgatctgcgcttggccgctaacgccatctgctccgccgtcccgtcgcactgggtgcccacctctcggaccacgtggagcatccacgcaaagcacgaatggatgaccaccgaggacatgctcgcggtgtggaacagggtctggatccaggagaacccatggatggaggacaagacacccgtagagtcctgggaggaagtcccgtacctggggaagcgggaagatcaatggtgcggcagcctgatagggcttactagccgcgcaacctgggccaaaaatatccagaccgccatcaaccaagtccgctccctgatcggcaacgaggaatacaccgactacatgcccagcatgaagcggttccgccgggaggaggaggaggccggcgtgctgtggtga

SEQ ID NO: 24930 - RNA, 9876 nt, synthetic construct
  misc_feature 1..9876: note = derived and/or modified CDS sequence (opt11) from DENV-2__GQ868558__SS-prME
  source 1..9876: mol_type = other RNA
accgccggcgtgatcgtcatgttaatccccactgccatcgcgttccacctcaccacccgcaacggggaaccgcacatgatcgtgggccggcaggagaaggggaaatccctgctgttcaagaccgaggacggcgttaacatgtgcacgctcatggccatcgacctgggggagctgtgcgaagacactatcacgtacaagtgccccctcctgaaacagaacgagcccgaggacatcgactgttggtgtaacagcaccagcacctgggtcacctacggtacttgcaccaccacgggcgagcaccgccgcgagaagcgctcagttgcccttgtgccccacgtcgggatgggcctcgagacccggaccgagacctggatgagctccgagggtgcatggaaacacgtgcagaggatcgagacgtggatcctgcggcacccgggcttcaccatcatggccgcgatcctggcctacaccatcggaaccacgcacttccagcgcgcgctcatattcatcctgctgacagcagtagcgccgtccatgaccatgcggtgcattggcatctccaaccgcgacttcgtcgagggcgtcagcggcggctcctgggtggacatcgtcctcgagcacgggagctgcgtgaccacgatggccaagaacaaacccaccctggacttcgagctgatcaagaccgaggccaagcagcccgccacgctccggaagtactgcatcgaggccaagctgacaaataccaccaccgagtcccgctgcccgacacaaggagagcccagcctgaacgaagagcaagataagcggttcatctgcaagcactccatggtggaccgcggctgggggaacggctgtgggctgttcggcaagggggggatcgtgacctgcgcgatgttcacgtgtaagaagaacatggagggcaaggtggtgcagcccgagaacctggagtacaccatcgttatcacgccccacagcggggaggagcacgccgtgggcaatgacaccggaaagcacggcaaggagatcaagatcaccccgcagtccagcattaccgaggccgagctgaccggatacggcacggtgaccatggagtgcagcccccgaacaggcctcgatttcaacgagatggtcctgctgcagatggaggacaaggcctggctcgtgcaccgccagtggttcctggacctccccctcccttggctgccgggggccgacacccagggcagcaactggatccagaaggagacgctcgtgacattcaagaacccccacgcgaagaagcaggacgtcgtggtcttggggagccaggagggcgccatgcacaccgccctcaccggggctacggagatccagatgagctccggcaacctcttgttcacaggccacctgaagtgccggctgcgcatggataaactccaactgaaggggatgtcctatagcatgtgcaccggcaagttcaagatcgtgaaagagatcgccgagacccagcacggcacgatcgtgatccgggtccagtacgagggcgacggctccccctgcaagatccccttcgagatcacggatttagagaagcgccacgtgctcgggcggctcatcaccgtcaacccgattgtcaccgagaaggacagccccgttaacattgaggcggaaccgcccttcggggactcctacataatcatcggtgtggagccaggccaactgaagctgaactggttcaagaaggggtcttccatcggccagatgttcgagacgaccatgcgcggcgccaagcgcatggcgatcctgggtgacaccgcctgggacttcggcagcctcgggggcgtcttcaccagtattggaaaggccctccaccaggtgtttggcgcgatctatggggcggccttcagcggggtgtcctggacgatgaaaatcctgatcggtgtcgtcatcacatggatagggatgaacagccggtccaccagcctctccgtgagcctggtcctcgtgggcgtggtcaccctgtatttaggggccatggtgcaggcggattccggctgcgtggtaagctggaagaacaaggagctcaagtgtggctccggaatcttcatcacggacaatgtccacacctggaccgagcagtacaagttccagcccgagagcccctcgaagctggcctccgccattcagaaggcccatgaggaaggcatctgcgggatccgaagcgtgactcggctggagaacctcatgtggaagcaaatcacgcccgagctgaaccacatcctgtccgagaacgaggtcaagctcacaatcatgaccggtgacaccaagggcatcatgcaggccggcaagcgcagcctgcggccgcagcccacggagctgaagtactcctggaagacttggggcaaggcgaagatgcattccaccgagtcccacaaccagaccttcctcatcgacgggcccgagacggccgagtgcccaaacacgaaccgcgcctggaacagccttgaggtggaggactacggcttcggggttttcaccaccaacatctggctgaagctccgagagaagcaggacgtcttctgcgactctaagcttatgagcgccgccatcaaggacaaccgcgcggtgcacgccgacatgggctactggatcgagtccgccttgaacgacacctggaagatggagaaagccagcttcatcgaggtgaagtcttgccactggcccaagagtcacacgctctggtccaacggcgtcctggagagcgagatgatcatccccaagaacttcgccgggcccgtgtcccagcataactaccggccgggctaccacacccagaccgcggggccctggcatctgggaaagctcgaaatggatttcgatctgtgcgagggaaccacggtggtagtgaccgaggactgcggcaaccgtggcccttcgctgcggaccaccacggccagcggtaagctcatcactgagtggtgttgccgctcctgcaccctgcccccgctgcggtaccggggcgaggacggatgctggtacggcatggagatccggcccctcaaggaaaaggaggagaacctggtgaacagcctggtcaccgctggacatggccagatcgacaacttctccctcggagtgttggggatggccctgttcctggaggagatgctgcgcacccgggtgggcaccaagcacgcgatcttgctcgtcgcggtcagcttcgttaccctgatcaccgggaacatgtccttccgcgacctgggccgggtcatggttatggtgggcgccacgatgaccgacgatatcggcatgggcgtcacataccttgcgttgctggccgcgttcaaggtacggccaaccttcgccgccgggctcttactgcggaagctcactagcaaggagctgatgatggccacgattggcatcgccctgctctcccagagcacgatacccgagacaatcctggaactgacggacgcactggccctggggatgatggtgctgaagatcgtccgcaacatggaaaaataccagctagccgtgactattatggccatttcctgcgtcccaaacgccgtcatcctgcgcaacgcatggaaggtgagctgcactattctggccgccgtctccgtctctcccctcctgctgacctccagccagcagaaagctgactggatacccctcgtgctgacgatcaagggcctgaaccccaccgcgatcttcttaaccaccctatcacggacgagtaagaagcgctcgtggccgctgaacgaggccatcatggccgtcggcatggtgagcatcctcgcctcgtccttgctgaaaaacgacatccccatgaccgggcccctagttgccggcgggctgctgaccgtctgctacgtgctcaccggtcggagcgcggacctggagctggagcgcgccgccgaggtgaagtgggaggaccaggccgagatctcgggtagctcccccatcctctcaatcacgatctctgaggacggctcaatgtccatcaagaacgaggaggaggagcagaccctgaccatcctgatccgcaccggattactggtcatctcaggggtcttcccggtgtccatccccatcaccgccgcggcctggtacctgtgggaggtcaagaagcagcgcgccggcgtcctctgggacgtgcccagcccgccgcccgtagggaaggccgagctggaggacggcgcctaccggataaagcagcgcgggattctgggctactcccagatcggtgcgggggtctacaaggaaggcacgttccacaccatgtggcatgtaacccgcggggccgtcctcatgcaccgcggcaaacgcatcgagcccagctgggccgacgtcaagaaggaccttatctcctacggtggcggctggaagctggagggtgagtggaaggagggcgaagaagtgcaggtattggcccttgagccggggaagaacccccgcgccgtgcagaccaagcccggcatcttcaagacaaacgccggcactattggcgctgtgagtctggacttctcccccgggaccagcgggtcccccatcgtcgatcgcaagggcaaggtggtggggctctacgggaacggcgtcgtgaccaggagcggggcatacgtgtccgctatcgcccagacggagaagtccatcgaggacaaccccgagatcgaggacgacatctttcggaagaagcgcctgaccatcatggacctgcaccccggcgccgggaagaccaagcggtacctccccgccatcgtccgtgaggccatcaagcggggcctgcgcaccttaatcctggcccctacgcgcgtagtggcggccgagatggaggaggccctccgggggttgcccatcagataccagacccccgccatcaaggccgagcacaccggccgggagatcgtcgacctgatgtgccatgcgaccttcacgatgcgcctactgagccccgtgcgggtgccgaattacaacctgatcatcatggacgaggcccacttcaccgaccccgccagtatcgccgcccgcggctacatcagcacccgagtcgagatgggggaggcggccggaatcttcatgaccgccacgcctcccggctcccgcgatccgttcccccagtcgaacgccccgattatggatgaggagcgggagattcccgagcgctcctggaacagcggacatgagtgggtgactgactttaaagggaagaccgtgtggttcgtcccgtcgatcaaggcgggcaacgacatcgcagcctgcctccggaagaacggcaagaaagtgatccagctgagccgcaagaccttcgactccgagtacgttaagacgcgggccaacgactgggactttgtcgtgaccaccgacatcagcgagatgggggccaacttcaaggcggagcgcgttatcgacccccggcgctgcatgaagcccgtcatcctgaccgacggcgaggagcgagtgatcctcgcggggcccatgccggtgacgcactccagcgccgcccagcgcagaggccgcatcggacgcaaccccaagaatgagaacgaccagtacatctacatgggcgagcccctggagaacgacgaggattgcgcccactggaaggaggcaaagatgcttcttgacaacatcaatacccccgaaggcatcatcccgtccatgttcgagcccgagcgggagaaggtcgacgccatcgacggggagtaccgcttacggggcgaggcccgcaagacctttgtggacctgatgcggcgcggggacctccctgtatggctggcctacaaggtcgcagcggaaggcatcaactacgccgaccggaaatggtgcttcgacgggatcaagaataaccagatcctggaagagaacgtggaggtcgagatctggactaaggaaggtgagcggaagaagctcaagccgcggtggttagacgcccgcatctatagcgaccccctggccctcaaggagttcaaggagtttgctgcgggtcggaaatccctgacgctgaacctcatcaccgaaatggggcgcctgcccaccttcatgacccagaaggcccgaaatgccctggacaatctcgccgtcctgcacacggcggaggccggcgggcgtgcctacaaccacgccctgagcgagctgcccgagactctggagaccctgctcctcctgaccctcctggccacggtgacaggcggcatcttcctgttcctcatgtccgggaaggggatcgggaagatgacactaggcatgtgctgcatcatcacggcgagcgtcttactctggtacgcgcaaattcagccgcactggatcgctgcctctatcatcctggagtttttcttgatagtgctcctgattcccgagccagagaagcagcggacgccccaggacaaccagctgacgtacgtggtcatcgccatcctcacggtggtggcggccaccatggccaacgagatgggcttcctggagaaaaccaagaaggacctgggcttaggcagcataaccacccaggagagcgagtccaacatactggacattgatcttcgcccagccagcgcctggaccttgtacgcggtcgctaccacgttcgtgacccccatgctacggcactccatcgagaacagctccgtgaacgtcagcctgaccgcgatcgccaaccaggcgaccgtactcatggggctgggcaaggggtggccgttatccaagatggacatcggtgtgcccttactggccatcgggtgctacagccaggtcaacccgatcacgctgacggccgccctcctgctgttggtggcccactacgcgatcatcggccccggcctgcaggccaaggccacccgcgaggcccaaaagcgggccgcggccgggatcatgaaaaaccccacggtggacggcattacggtcatcgacctggagcccatcccctacgatcccaagttcgagaagcagctcgggcaggtgatgctgctgatcctatgcgtgacgcaggtcctgatgatgcgcaccacctgggccctgtgcgaagccctcactctggccaccggcccgatctccaccctgtgggaggggaatcccggccgcttctggaatacgaccatcgcggtgagcatggccaacatcttccgcgggtcgtacctcgccggggccggcctgctgttctccatcatgaaaaacaccaccaacacccgccgagggacgggcaacatcggcgagactctcggcgaaaagtggaagtcccgcctgaacgcgctgggcaagagcgagtttcagatctacaagaagtccgggatacaggaggtggaccggaccctcgccaaagagggcatcaagcgcggggagaccgaccaccacgccgtcagccggggctccgctaagctgcggtggttcgtggagcggaacatggtgacgccggaaggcaaggtcgtggacctggggtgcggccgcgggggttggagctattactgcgggggcctcaagaatgtgagagaggtcaagggcctgaccaagggtggtccggggcacgaggagccaatccccatgtccacctacggttggaacctagtgcgtctccaaagcggggtggacgtcttcttcaccccgcccgagaagtgcgacacactgctgtgcgacatcggcgagagctcccccaatccgaccattgaggccggccggaccctcagagtgctgaacctggtggagaactggctcaacaacaatactcagttctgcatcaaggtcctcaacccatatatgccgagcgtgatagaaaagatggagaccctgcagcggaagtacgggggcgcgctcgtgcgcaaccccctgtcccggaacagcacgcacgagatgtactgggtctccaacgccaccggaaacatcgtgtcgtccgtgaacatgataagccgcatgctgatcaatcggttcaccatgaagcataagaaggccacctacgagccggacgttgacctgggctccgggactcgcaacatcggcatcgagagtgagatccccaacctcgacatcatcggcaagcggatcgagaagatcaagcaggagcacgagacctcctggcattacgaccaggaccacccctacaagacctgggcctatcacgggagctacgagaccaaacagacgggctccgccagctctatggtgaacggggtggtccgcctgctgaccaagccctgggacgtggtgccaatggttacccagatggcgatgaccgacactacccccttcggccagcaacgcgtcttcaaggagaaggtggacacccggactcaggagcccaaggaaggcacgaagaagcttatgaagatcaccgccgagtggctgtggaaggaactggggaagaagaagacgccccgcatgtgcacccgggaggagttcacgcgcaaggttcgcagcaatgccgccctcggcgccatcttcaccgatgagaacaaatggaaatccgcgcgcgaggccgtggaggacgggcggttctgggagctggtcgaccgcgagcggaacctgcacttggagggcaaatgtgagacctgcgtgtacaacatgatggggaagagggagaagaagctgggcgagttcggcaaggccaagggcagcagggccatctggtacatgtggcttggcgcgcgcttcctcgagttcgaggccttggggttcctgaacgaggaccactggttctcccgcggtaacagcctcagcggtgtggagggcgagggcctgcaccgcctcggatacattctccgggacgtctcaaagaaggagggcggcgccatgtatgccgacgacaccgccggttgggacacgcgtatcaccttggaggacctgaagaacgaggaaatggtgaccaaccacatgaagggggagcacaagaagctcgcggaggccatcttcaagctgacctaccagaacaaggtggtccgtgtgcaacgccccaccccacggggcaccgtgatggacatcatctcgcgccgggaccagcgaggctccgggcaggtcggcacctacgggctaaacaccttcactaacatggaggctcagttaatccgccagatggaaggcgagggcatctttaaaagcatacagcacctgaccgctatcgaggagatcgcggtgcagaactggctggcgaaggtgggtcgggagcgcctctcccggatggccatcagcggcgacgactgtgtcgtgaagcccatcgatgaccgcttcgcctccgccctgaccgccctgaacgacatggggaaggtgcgcaaggacatccagcagtgggaaccgagccgcggctggaacgactggacccaggtaccgttttgctcccaccacttccacgagctggtgatgaaggacgggagggtgctggtcgtgccttgccgcaaccaggacgagttgatcggccgggcgcgcatcagccagggggccgggtggtccctgaaggaaacagcctgcctgggcaagagctatgcccaaatgtggaccctgatgtacttccaccggcgcgacctccggctggccgcgaacgccatctgctccgccgtgcccagccattgggtccccacctcccgcaccacctggagcatccacgccaagcacgaatggatgactaccgaggacatgctggcggtatggaaccgggtgtggattcaggagaacccttggatggaggacaagaccccagtcgagtcctgggaggaggtgccctacctcgggaagcgcgaggaccagtggtgcggcagcctcatcgggctgaccagcagagcgacgtgggccaagaacatccagaccgccatcaaccaggtccgctccctcatcggcaacgaggagtacaccgactacatgccctcaatgaagcggttccgccgcgaagaagaggaggccggcgtcctgtggtga

SEQ ID NO: 24931 - RNA, 9876 nt, synthetic construct
  misc_feature 1..9876: note = derived and/or modified CDS sequence (opt11) from DENV-2__KJ189305__SS-prME
  source 1..9876: mol_type = other RNA
accgccggtgtaatcgtcatgctgatccccactgccatggctttccacctcaccacccgcaatggggagccccacatgatcgtcggccggcaggagaaggggaagtccctgctgttcaagaccgaggacggtgtgaacatgtgcacacttatggcaatagatctgggagaactgtgcgaggacaccattacctacaaatgcccgctgctgcgtcaaaacgaacccgaggatatcgactgttggtgcaactctacgtcaacgtgggtcacctacgggacctgcactaccacaggagagcaccgcagggagaagcggtcggtggccctggtgccacacgtagggatgggtctcgagacccgcaccgaaacctggatgagctccgagggggcctggaagcacgtgcagcggatagagacgtggattttgcgccacccgggctttaccatcatggccgcgatcctggcctacaccatcggtacgacgcacttccagcgggccctcatcttcatcctgctcaccgccgtcgcgcccagtatgaccatgcgctgcatcggcatctccaatcgcgactttgtggaaggagtgagcgggggctcgtgggtggacatcgtactcgagcatgggagctgtgtgaccactatggcaaagaacaagcccaccctggactttgagctgataaaaacagaggccaaacaacccgcaaccctccgcaagtactgcatcgaggccaaactgacgaataccaccactgagtcccgatgtccgacccagggagagcccagcctgaacgaggagcaggacaagcgattcatctgcaagcactccatggtagaccggggctggggaaatggctgcgggttgtttggtaaaggagggatcgtgacttgcgcgatgttcacgtgcaagaagaacatggaagggaaagtggtccagcccgagaaccttgagtacaccatcgttatcacgccccatagcggggaggaacatgcggtggggaacgacaccggaaagcacggcaaagagataaaaattacaccgcagtccagcatcaccgaggccgaactgactgggtacggcacggtgaccatggaatgttcgccgcgcaccggcctcgacttcaatgagatggtcttactgcagatggaagacaaggcctggctcgttcaccgtcagtggttcctggacttaccgctgccctggcttccgggggccgacacccaggggtccaactggatccagaaggaaacgttagtgacctttaagaacccgcacgcgaagaagcaagacgtcgtggtcctggggtcccaggagggcgccatgcacacagcgctcaccggggctactgagatccagatgagcagcggaaacctcctgttcaccggccacctgaagtgccgactacggatggacaaacttcagctcaaagggatgtcctacagcatgtgcaccggcaaattcaagatcgtgaaggagattgccgagactcagcacgggacgattgtaatccgcgttcagtacgaaggagatggatccccttgcaaaatcccattcgagataacagacctggagaagcgtcacgtgctggggcgcctgataacggtgaaccctatcgtcaccgaaaaagacagccctgttaacatcgaggcggagccgcctttcggcgattcgtatatcattattggcgtcgagccgggccagctaaagctcaactggttcaagaagggtagctcgatcggccaaatgttcgagacaaccatgcgcggcgcgaagcggatggccatactgggggacaccgcctgggacttcggcagcctcggcggggtcttcacctccattgggaaggccctccatcaggtgtttggggcgatctacggcgccgccttcagtggcgtctcatggacaatgaaaatcttaatcggagtgatcatcacctggatagggatgaacagccgttcgaccagcctctcagtcagcctagtgctcgtaggcgtggtgaccctttatctgggggccatggtccaagcggacagtggttgtgtcgtgagttggaaaaacaaggagctcaaatgcggcagcggcatcttcataacagacaatgttcacacctggaccgaacagtataagtttcagcccgagagccccagcaaactggcgtcggcgatccagaaggcccacgaggaagggatctgcgggattcgttctgtgacccgattagagaacctcatgtggaaacagatcacgcccgagctgaaccacatcctctccgagaacgaggtgaagctcaccatcatgaccggcgatatcaaggggatcatgcaggccggcaagcggtcgctccgcccacagcccaccgaattaaagtactcttggaaaacgtggggcaaggcgaagatgctcagcaccgaatcccacaaccagacctttctgatagatggacccgagaccgccgagtgcccgaacacgaaccgggcgtggaactcacttgaggtggaggactacggcttcggtgtgtttactaccaacatatggctaaagctgaaagagaagcaggacgtgttctgcgactcgaaacttatgagcgccgccatcaaggacaaccgcgcagtccacgcagatatgggctactggattgagtccgccctcaacgacacctggaagatggaaaaggccagcttcatagaggtgaagtcctgccactggcctaaatctcacaccctgtggtccaacggagtgctggagagcgagatgatcatccccaagaacttcgcaggtcccgcgtcccagcacaactaccggccgggctactacacgcagaccgcagggccgtggcatctcggcaagctagaaatggacttcgatttctgcgagggcaccacggttgtggtgacggaggactgcggcaaccgaggcccgagcctgcgcaccaccactgccagcggcaaactcatcacggagtggtgctgccgatcctgtacgctgcctccacttcggtaccggggcgaggatgggtgttggtatggtatggaaattcggcccctcaaggagaaggaagagaatcttgtcaatagcctagtaaccgccggtcacggccagatcgacaatttctcactaggcgtactgggaatggcactgtttctagaggagatgctgcgaacccgggtcggcacgaagcacgccatcctgctcgtagccgttagctttgtcaccctgatcactggtaatatgtccttccgcgatttaggtcgggtgatggtgatggtaggagccaccatgacagacgacatcggcatgggcgtgacctacctcgccctcctagcggcctttaaggtgcgcccaaccttcgccgccgggctgctgctgcgcaagctcacgagcaaggaactgatgatggccactataggcatcgcgctgctctcccagtcaaccatccccgagactatcctggagcttaccgacgccctcgccctagggatgatggtgctaaagattgtgcggaacatggagaagtaccaacttgccgtgacgataatggccatctcatgcgtaccgaacgcggtgatactgcagaacgcatggaaggtgagctgcaccatcctggccgccgtctccgtcagccccctcctgcttacaagcagccagcagaaggcggactggatacccctcgccttgacgattaagggcctaaatcccactgcgattttcttaaccaccctctcccgtacgagcaagaaacgctcctggccgctgaacgaggcaataatggcggtcggtatggtgagcatcctcgcgagtagcctgctcaagaatgacatacccatgaccgggcccctcgtagccggaggcctgcttaccgtctgctacgtgctcacaggccggagcgccgacctggagctggagcgggccgccgacgtaaagtgggaggaccaggcggagatctccgggtctagtccgatcctcagcatcaccatctcagaagacggcagcatgtccatcaaaaatgaagaagaggaacagacgctgaccatcctcatacgcacgggcctcctggtcatcagcggcgtattcccggtatccatacccatcacagcagctgcctggtacttatgggaggttaagaagcagcgtgccggcgtgttgtgggacgtccccagcccgccgcctgtcgggaaggcggagcttgaggacggcgcgtaccgcatcaagcagcgggggatcctgggttactcccagatcggagccggagtgtacaaagaggggacgttccacaccatgtggcatgttacacgaggggcagtactcatgcaccggggcaagcgcatagagccgagctgggccgacgtgaagaaggacctaatctcctacggtggcggctggaagctggaaggagaatggaaggagggggaagaagtgcaagtcctcgcgctggaacccgggaagaacccccgggcagtgcagactaagccaggcatattcaagaccaacaccgggacaataggcgccgtgagcctggacttcagccccggtacatcggggtcccccatagtggacaagaaggggaaggtggtggggctctacggcaacggggttgtgacccgctccggggcctacgtctcagcgatcgcccagacggagaagtccatcgaggacaaccccgagatcgaggacgacattttccggaagaagcgcctgaccatcatggatttgcaccccggcgctggaaagaccaagcggtacctccccgccatcgtgcgcgaggccatcaaacggggcttacggacactgatcctagcgccgacgcgggttgtggccgccgagatggaggaggccctgcgagggttgcctatcaggtatcagacccctgcgatcaaggcggagcacacgggccgggagatagtcgatctgatgtgccacgctacctttacgatgcgcctcctgtcccccgtgcgagtaccgaactacaatttgattatcatggacgaggcccacttcacagacccggcctccatagctgcacgcggctacataagcactcgggtcgagatgggggaggccgccggtatcttcatgaccgccacgccgcccggatcgcgcgatccgtttccccaatccaacgctcccatcatggatgaggagcgggagattccagagaggtcatggaacagcggccacgagtgggtcaccgacttcaagggcaagaccgtgtggttcgtaccgagtataaaagcgggtaacgacatcgccgcctgccttaggaagaacggaaagaaggtcatacagctgagccgtaaaaccttcgactccgagtacgtgaagacgcgggccaacgactgggacttcgtcgtgacaacagacatcagcgaaatgggggcgaacttcaaggccgagagggtgatcgacccgaggagatgcatgaaaccggtgatcctgacggacggcgaggaacgggtgattctcgccgggccaatgccggtcacgcactcttccgctgcgcagcgacgggggcgtatcgggcggaacccgaagaacgagaacgaccagtacatttacatgggtgagcccctggagaatgacgaggactgtgcccactggaaggaagcgaaaatgctgctcgacaacatcaacacccccgagggtatcatcccctctatgttcgagccggagcgtgagaaggtcgacgccatcgacggcgagtacagacttagaggggaagcccgcaagaccttcgtagatctcatgcggcgtggcgatctccccgtgtggctggcctacaaggttgcggccgagggcatcaattacgccgaccgtaagtggtgtttcgacgggatcaagaataaccagattttagaagagaacgtggaagtggagatctggaccaaggagggcgagagaaagaagctcaagcctcgttggttggacgcccgaatctactccgaccccctcgctctcaaagagttcaaggagttcgccgccggccggaagtccctgacactgaacctcatcaccgagatgggccgcctcccgaccttcatgacccaaaaggcaaggaacgcccttgataacctcgctgtacttcacacggcagaggccggcgggcgtgcctataaccacgccctgtcagagctaccggaaaccctggaaacactactcctgctgactctcttggcgacagtcacgggcgggatcttcctgttcctcatgtccggcaaaggaatcgggaaaatgaccctgggcatgtgctgcataattactgcctccattctgctctggtatgcccagatccagccacactggatcgcagcttccatcatcctagagttctttctgatcgtcctcctgatccccgaacccgaaaagcagcggacgccccaagacaaccagttgacatacgtggtgatagcgatcctcacagtggtcgccgccaccatggcgaacgagatgggcttccttgagaagaccaaaaaggacctgggcctcggaagcatcaccacccaggagagcgaatccaacatactggacatcgacctgcgccctgcttccgcctggaccctctacgcagtggccaccacgttcgtgacaccaatgctccggcattcgatagagaacagctccgtgaacgtgagtttgaccgccatcgcgaaccaggccaccgtgctcatggggctgggcaagggatggcccctgtccaaaatggatatcggtgttcccctcctggccatcggctgctattcgcaggtcaaccccatcacgctgaccgccgccctcctgctgttagtcgcgcactacgccatcataggtccgggactgcaggccaaggcgacccgcgaggcccagaagcgggcggcagccggcatcatgaaaaatcctactgtggacggcatcacggtgatcgacttggagcccatcccgtacgaccccaagttcgagaagcaactcgggcaggtcatgttgctgatcctctgcgtgacccaggtgctgatgatgcgtaccacctgggccctctgcgaagccctcacgttggccaccggccccatctccaccctttgggagggcaaccccggccgtttctggaacaccaccattgctgtcagcatggccaacatcttccgaggctcttacctagccggtgcgggccttctgttcagcatcatgaagaacaccaccaacacccggcgcgggacgggcaatatcggcgagaccctcggggaaaagtggaagtctcgcctgaacacactgggcaagagcgagtttcagatatacaagaagtccgggatccaagaggtggaccggaccctcgcgaaggagggtatcaagagaggggaaacggaccaccacgccgtgtctcggggctcagccaagctgcgttggttcgtcgagaggaacatggtaaccccggagggcaaggtcgtagacctgggatgtggccgagggggctggagctactactgtggagggctcaagaacgtgcgggaggtgaagggcctcacgaaagggggaccaggccatgaggaacccatacccatgtccacgtacggctggaatctcgtcagattgcagagcggggtggacgttttcttcacgcctcccgagaagtgtgacactctgctgtgcgacataggcgagagctcgcccaatcccaccatcgaggccggccgaaccctccgggtcctgaacctggtagaaaactggctcaacaacaacacccaattttgcatcaaggttcttaacccctacatgcccagcgtcattgagaagatggagacgctgcaacggaaatacgggggcgcactcgtacgcaaccccctgagccggaactccacccacgaaatgtactgggtaagcaacgccacagggaatatcgtcagctccgtgaacatgatcagccgcatgctaatcaaccggttcactatgaagcacaagaaggcaacgtacgagccggatgtggacctgggctccgggacacgcaatataggcattgagagcgagatcccaaacctggacatcatcggcaagcggattgaaaagatcaagcaggagcacgagacctcgtggcattacgaccaggaccacccctacaagacctgggcataccacggctcttacgagacgaagcagaccggctccgctagctcgatggtcaacggggtggtgcgcctcctgaccaagccctgggacgtcgtgccaatggtgacccaaatggcaatgacagacaccacgcccttcggccaacagcgggtcttcaaggagaaggtggacacccgcacccaggagcccaaggagggcaccaagaagctcatgaagatcaccgcggagtggttatggaaagagctggggaagaagaaaacaccccgaatgtgcacgcgtgaggagtttacccgcaaggtgcggagtaatgcagccctgggggccatcttcaccgacgagaacaagtggaagtccgcgcgggaggccgtcgaggacgggcggttctgggagctggtggaccgcgaacggaacctgcacctggagggcaagtgcgagacctgcgtgtacaacatgatggggaagcgagagaagaaactgggcgagtttggcaaagcgaaaggcagccgggccatatggtatatgtggctgggcgcgcgcttcctggagttcgaggcgctggggttcctgaacgaggatcactggtttagccgaggcaacagcctgagcggggtcgagggcgaaggactgcaccgactggggtacatcctccgggacgtgggtaagaaggagggcggagccatgtacgccgacgacacggccgggtgggacacccgcatcaccctagaggacttaaagaacgaggagatggtcaccaaccacatgaagggcgagcacaagaagttggcggaagccatcttcaaactgacctaccagaataaagtagtgcgcgtccagcggccgacgccccggggcacagtgatggatatcatatcccgccgggaccaacgcgggagcggccaggtgggtacttatgggctgaataccttcaccaatatggaggcccagttaattcggcagatggaaggcgaggggatcttcaagagtattcaacacttgaccgccactgaagagatcgcagtccagaattggctggcacgcgtgggccgcgagcggctcagccgcatggccatctcaggggacgactgtgtggtcaagcccatcgatgaccggttcgccagcgccctgactgcccttaacgatatgggtaaagtgcgtaaggacatccaacaatgggagccctcccgggggtggaacgactggacccaggtaccattctgcagccaccacttccacgagctcgtcatgaaggatggccgcgtgctggtagtcccctgcaggaaccaggatgagctgatcggccgtgcacgtatctctcagggggcgggctggagcctgaaggagaccgcctgcctcgggaaatcctacgcacagatgtggacgctgatgtacttccataggcgggacctgcgcctggccgcgaatgccatctgtagcgccgtgccctcccactgggttcccacaagccggacgacgtggtccatacacgccaagcacgaatggatgaccaccgaggatatgctggcggtctggaaccgcgtgtggatccaggagaatccgtggatggaggataaaacgcctgtggagagctgggaggaagtcccttacctcggcaagagagaggaccagtggtgcgggtccctgatcggcttgaccagtcgtgccacttgggccaagaacattcagaccgccatcaaccaggtgcgcagtctaataggcaacgaggagtacacggactacatgccgtccatgaagcgcttccgcagagaggaggaagaggcaggggtcctgtggtga

SEQ ID NO: 24932 - RNA, 9876 nt, synthetic construct
  misc_feature 1..9876: note = derived and/or modified CDS sequence (opt11) from DENV-2__FJ898451__SS-prME
  source 1..9876: mol_type = other RNA
accgccggcgtaatagtgatgctgatccccaccgccatggcgttccaccttaccacccggaacggtgagccccacatgattgtcggccggcaagagaaggggaagtccctcctgttcaagacagaggacggcgtgaacatgtgcaccttgatggccatcgacctaggggagctgtgcgaggacaccatcacttacaagtgcccactcctgcggcaaaacgagcccgaagatatcgactgctggtgcaacagtacgagcacctgggtcacgtacgggacctgcaccaccactggcgagcaccggcgcgagaagcggtccgtagccctggtgccccacgtcgggatggggctcgagacacgcaccgagacctggatgagctcggagggtgcctggaagcacgttcaacgcatcgagacttggatccttcggcaccctggcttcaccatcatggccgcgatcctggcctataccatcgggaccacgcacttccaacgggccctcattttcatcttgctgacggccgtggcgcccagcatgacaatgcgctgcatcggcatctccaaccgggattttgtcgagggcgtgagcgggggcagctgggtggacatcgtcctcgagcacgggtcatgcgttactacaatggccaagaacaagcccacgctggacttcgagctcataaagaccgaggctaagcagcccgcaaccctacgcaagtactgcatagaggccaaactgacgaataccaccaccgagtcccgttgccccacgcagggggagccctcactgaacgaggagcaggataagcgcttcatctgcaaacactccatggtggaccggggctgggggaacggctgcgggctgttcggtaagggtggcattgtgacgtgtgcgatgtttacgtgcaagaaaaacatggagggcaaaatcgtgcagcccgaaaatctggagtacaccattgtgatcactccccacagcggcgaggagcacgccgtcggcaatgacaccgggaaacacggtaaggagatcaagatcacgccacagagcagtaccaccgaagccgagttaacagggtacggcaccgtgaccatggagtgttcaccccgaaccggcctcgactttaacgaaatggtgctgcttcagatggaggacaaggcctggctcgtccatcggcagtggttcctggatctaccccttccttggttgcccggggccgatactcagggcagtaactggatccagaaggagacgctggtcaccttcaagaacccccacgcaaagaagcaagacgtggtcgtgctcggttcccaggagggcgccatgcacacagcgctgacgggggccaccgagatccagatgagctctggcaaccttctgttcacgggccacttaaagtgccgcctccggatggacaagctccagctgaaggggatgtcctacagcatgtgtaccggcaagttcaaaatagtaaaggaaatcgccgagacgcagcacgggaccatcgtgattagagtgcagtacgagggcgacggctccccctgcaagataccgtttgagatcaccgacttagagaagcgacacgtgttagggcgcctgatcaccgtgaaccccattgtgaccgagaaggacagcccggttaacatcgaggcggagccgccattcggagactcgtacattatcgtaggggtggagccgggccagctgaagctgaattggttcaagaaggggagctctataggccaaatgttcgagaccaccatgcgcggcgctaagcgcatggccatcttaggggacaccgcctgggacttcggcagcctcggaggggtgtttacgtccatcgggaaggcgctccaccaggtgtttggggcgatctatggcgccgcctttagcggggtgtcctggacgatgaagatcctgatcggtgtcatcatcacctggatcgggatgaatagccgctccacaagcctctccgtgagcctggtgctcgtcggcgtggtgacgttgtacctcggggtgatggtgcaggccgactccggctgcatcgtgtcgtggaaaaacaaggaactcaagtgcggctccgggatcttcatcaccgataatgtccacacctggaccgagcagtacaagttccagcccgagagccctagcaagctggccagcgccatccagaaggcccacgaagagggcatctgtgggatccggagcgtgacgcgcttggagaacctcatgtggaaacagatcacccccgagttaaaccacatcttgtccgagaatgaggttaagctcaccatcatgaccggcgacatcaaggggataatgcaggccggcaagaggagcctgaggccgcagcccacggagctgaagtactcctggaagacgtggggaaaggccaagatgctcagtaccgagtcccacaaccagaccttcttaattgacgggccagagacggcggaatgcccgaacaccaaccgggcttggaactcgctggaggtagaggactacggcttcggggttttctccaccaatatctggctgaagctgcgcgagaagcaagatgtgttttgcgacagcaagctgatgtccgcggccattaaagacaatcgagcggtacacgcagacatgggctactggatcgaaagcgtgctcaacgacacgtggaagatggagaaggcttcgtttattgaagtgaaaagctgccactggcccaagtcccatactctgtggagcaacggcgtgctggagtcagagatgattatacccaaaaacttcgccgggcccgttagccagcacaactaccgacctggctatcacactcagacagccggcccttggcacctcggcaagctggagatggatttcgacttctgcgaggggaccaccgtggtcgtgacagaggactgcggcaaccggggcccctcattgcgcaccaccacagccagcgggaagctcatcacagagtggtgctgccggagctgcaccctgccacccctccgctacagaggggaggacgggtgctggtacggtatggagatacgcccccttaaggagaaagaggagaacctggtgaactcattggtcaccgcggggcacggccagatcgacaatttcagcttgggcgtgctagggatggccctgttcctcgaggaaatgctgcggacccgcgtgggcaccaagcacgccatactgctcgtcgccctgtccttcgttaccctgatcaccgggaatatgagcttcagggacctcggtcgagtgatggtcatggtgggggcgaccatgacggacgacatcggcatgggcgtcacctacctggccctgctcgccgcattcaaggtcaggccaaccttcgctgcggggctgctgctccggaagctcacctccaaagaactgatgatggccacgatcggcatcgccctcctgagccagagcaccctacccgagacaatcctcgaactgaccgacgccctggcactcggtatgatggtgctgaagattgtgcgcaacatggaaaagtaccaactggcggttacgatcatggctatatcctgcgtgccgaacgccgtgatcctccagaacgcctggaaagtttcctgcaccatcctcgccgcggtgagcgttagccctctgctcttgaccagctcccaacagaaggcagactggatcccactggccctgaccatcaagggcttgaaccccacggcaatctttctgaccaccctcagccgtactagcaagaagcgaagctggccgctgaacgaggcaatcatggctgtggggatggtgtccatcctggccagctcactcctgaagaacgatattcccatgacggggcccctggtagccggcggactcctgaccgtttgttacgtgttgaccggccggtcggctgacctcgagctagagcgcgcggccgatgtcaagtgggaagaccaggccgagataagcgggtcctcacccatcttatccatcaccataagcgaggacggctccatgagcatcaagaacgaggaggaggagcagacattaacaatcctgatcagaactggccttctcgtgatctccggagtgttccctgtcagcatccctattaccgccgccgcatggtacttatgggaggtgaagaagcagagggccggcgtgctgtgggacgtcccgagcccgccgccagttgggaaagccgaactcgaagacggtgcatacagaatcaagcaacgcgggatattaggttactctcagatcggcgccggggtgtacaaggagggcacgtttcacaccatgtggcacgtcacccgcggcgcggtgttgatgcatcgcggcaaacggattgagccctcctgggccgacgtgaagaaggacctgattagctatgggggcggctggaagctagagggggagtggaaggagggggaggaagtccaggtgcttgccctcgagcccggcaagaaccccagagccgtgcagaccaaaccgggcatctttaagactaacactgggaccatcggcgcggtctccctggatttctcgcccggtacctccgggagccccatcgtggaccggaaaggcaaggtggtcggactctacggcaacggcgtggtgacccgcagtggggcgtacgtgagcgcaatcgcccagacggagaagtctatcgaagacaatcccgaaatcgaagacgacatattccggaaaaagcgcctcactatcatggacctgcacccaggtgctgggaaaaccaagcggtacctgcccgcgatcgtacgcgaagccattaagcggggcctgcgcaccctcattttggccccgacgcgcgtggtcgccgccgagatggaggaggcgctgagaggcctccccatccgctaccaaacccccgccatccgggccgagcacaccggacgcgagatcgtggatctgatgtgccacgccacttttacaatgcggttactctcgcctgtgcgcgtcccgaattacaatctgattatcatggacgaggcccacttcacagacccagcgagcattgccgcccggggctacatctccacccgcgtcgagatgggagaggccgccggcatctttatgaccgctacgccgcccggtagcagagacccgttccctcaatccaacgcccccatcatggacgaggagcgcgagatccccgagcggagctggaactccggccacgagtgggtgactgatttcaaaggtaagaccgtttggtttgttccgtccatcaaagctggaaacgacatcgccgcgtgcttgcgcaaaaacggcaagaaggtgatccagctctcccggaagaccttcgacagtgagtatgtcaagacgagggcgaacgactgggatttcgtggtgaccaccgacatctccgagatgggcgccaacttcaaggccgagcgggtcatcgacccccggcgatgcatgaaacccgtgatcctgaccgacggcgaggaacgcgtgatacttgccgggcccatgccggtcacgcacagctccgcggcccagcggcgcggccgcatcgggcgaaatccgaaaaacgagaatgaccagtacatttacatgggcgagcccctcgagaacgacgaggactgtgcgcactggaaggaggccaagatgctgttggacaacatcaacacgcctgagggtatcatcccgtcgatgttcgagcctgagcgcgagaaggtggacgctatcgacggggagtaccggctccgcggcgaagcgcggaagacgtttgtggacctgatgcgacgaggggacctgcccgtctggctcgcctataaagtcgcagcggagggcatcaactacgcggaccgcaagtggtgcttcgacggaatcaagaacaaccaaattctggaagagaacgtggaggtcgagatctggaccaaggaaggcgaacggaagaaacttaaaccgaggtggctggacgcgcggatctactctgaccccttggcgctgaaagagttcaaagagtttgccgcgggccgaaaaagccttacgctgaacttgataacggagatggggcgcctacccaccttcatgacgcagaaggctcgcaacgccttggataacctggcggtactccatacggcggaggtgggcgggcgggcctacaaccacgctctttccgagctgcccgagaccctcgagaccctgctgctccttaccttactcgccacggtcactggcgggatctttctgttcctcatgagcgggaaggggatcgggaagatgaccctcggcatgtgctgcatcatcaccgcctccatcctgctgtggtatgcacagattcagcctcactggattgccgcaagcatcatcctagagttctttctgatagtactgctgatcccagagcccgagaagcagcggacgccccaagacaaccagctgacgtacgtcgtgatcgctatcctgactgtggtcgccgcaacgatggccaacgagatggggttcctggagaagaccaagaaggacctgggctttggaagcatcaccacccaggagtccgagagcaacatattagacatcgacctccggcctgcgtccgcctggaccctgtacgctgtggcaaccacgttcgtcacccccatgctgcgccactcgattgagaactccagcgtaaacgtgtccctcactgccatcgcgaaccaggccaccgtcctgatggggctgggcaagggctggccactcagcaagatggacatcggcgttcctctgctggccatcgggtgctactcccaggtgaacccgataacgctcaccgccgcactgctgctactggtcgcccattatgccataatcggccccggcctgcaggcgaaggccacccgggaggcccagaagagagccgccgccgggatcatgaagaaccctacagttgacggcatcacggtgatcgatctcgaacccattccgtatgaccccaagttcgagaagcagctgggtcaggtcatgctactcatcctgtgtgtcacccaagtactgatgatgcgtactacctgggctctctgcgaggcgctgacgctcgccaccgggcctatcagcacgctgtgggaggggaaccccggccgcttctggaacacaacgatcgccgtgtcgatggccaatatcttccgcggcagctacctggctggggcgggcctcctgtttagcatcatgaagaacaccaccaacactagacgagggacgggcaacgtcggcgagaccctgggggagaagtggaagtcccggttaaacgccttaggcaagtccgaatttcagatctacaagaagtctgggattcaggaggtcgaccgcaccctggctaaagagggtattaaacggggtgagacggaccaccatgcggtgtcccgcggctctgcgaagctgcggtggttcgtcgagcgcaacatggtgactcccgagggcaaggtggtcgacttgggttgcggccgcggcgggtggtcctactactgcggcggactgaaaaacgtcagggaggtgaaagggctgacaaagggcggccctgggcatgaggaacccatcccgatgagcacttatggctggaacctcgtccggctccagagcggggtggacgtgttcttcaccccgcccgagaagtgtgacacactactctgtgacatcggggagtccagccccaaccccaccattgaggctggccgcaccctgcgggtcctgaatctcgtcgaaaactggttaaacaacaacacgcagttttgcatcaaggtgctgaacccgtacatgccctccgtgatcgagaagatggagaccctgcagcgcaagtacgggggcgccttagttcggaaccccctgtcccgcaactcgacgcacgaaatgtactgggtgagcaatgcaaccggcaacatcgtctctagcgtgaatatgatctcccggatgctgatcaaccgcttcaccatgaagcacaagaaagcaacttatgagccggacgtggatctcggcagcgggacgcgcaatatcggcattgaatccgagatccccaatctggacataatcggcaaacgcatcgagaagattaagcaagagcacgagacctcctggcactatgaccaggaccacccgtacaagacctgggcgtaccatgggtcctacgagactaagcagacgggcagcgcctccagcatggtcaacggggtagtgcgcctgctcaccaagccctgggacgtcgtgccgatggttacccagatggccatgaccgacacgacccctttcgggcagcagcgggtcttcaaagagaaagtcgatacccgcacacaggagcccaaggagggaacgaagaaacttatgaaaataaccgcagagtggctgtggaaagagctcgggaaaaagaagacgccccgcatgtgcaccagggaggagttcacgcggaaggtccgctccaatgccgcgttgggcgccatcttcaccgacgagaataagtggaagtccgcgcgggaggccgtcgaggacgggcgcttctgggagctggtcgaccgcgaacgcaatctgcaccttgagggcaagtgcgagacctgtgtctacaacatgatggggaagcgggagaagaagctgggcgaatttggcaaggccaaggggtcccgcgcgatttggtacatgtggctgggagcccggtttctggagttcgaggctctggggtttctcaacgaggaccactggttcagtcgtgggaacagcctgagcggggtggagggcgagggcttgcatcggctcgggtacatcctacgcgaggtgggcaagaaggaaggcggcgccatgtacgctgacgacaccgccgggtgggacacgcggatcacattggaggacctcaagaacgaggagatggtcaccaaccacatgaagggcgaacataagaagctggccgaggcgatcttcaagctgacataccagaacaaggtggttcgcgttcaacggcctacgccccgcggcacagtgatggacataatcagccggaaggaccaacgtgggtccggccaggttgggacgtacggcctcaacaccttcacgaacatggaagcccagctgatccgccagatggagggtgagggcatatttaagtcaatccagcacctgaccgccaccgaggagatcgccgttcaaaactggctagcccgggtgggccgcgagcggttgtcccgcatggccataagcggggacgattgcgttgtcaagcccatcgacgaccggtttgcctcggcgctgaccgccctcaacgatatgggtaaggtgcgcaaggacatccaacagtgggagcccagccgcgggtggaacgactggacccaggtgccgttctgctcccaccatttccacgagctagtcatgaaggacggcagggtgttggtggtaccctgccgaaaccaggacgagctcatagggcgcgcccggatcagccagggggccggatggtccctgaaggagaccgcctgcctgggcaagagttacgctcagatgtggaccttgatgtacttccaccgccgtgacctgagactggccgccaatgccatctgctcagccgtgccctcccactgggtgcccacctcacggaccacgtggagcatccacgcgaagcacgagtggatgaccaccgaagacatgcttgcggtctggaaccgcgtgtggatccaggagaacccgtggatggaggacaagacccccgttgagtcctgggaggaggtcccatacctgggcaaacgcgaggaccagtggtgcgggtccctgatcggcctcacgtcccgcgccacctgggccaagaacatccagaccgcgatcaaccaggtgcgatctctgattggcaacgaagagtacaccgactacatgccgagcatgaagcgcttccgccgcgaggaggaggaggccggggtgttatggtga

SEQ ID NO: 24933 - RNA, 9876 nt, synthetic construct
  misc_feature 1..9876: note = derived and/or modified CDS sequence (opt11) from DENV-2__HM488257__SS-prME
  source 1..9876: mol_type = other RNA
acagccgggatcatcatcatgatgatccccaccgtgatggctttccacctgaccacacgaaacggggaaccccacatgatcgtctctcggcaggagaagggcaagagcctgctgttcaagaccgagaacggggtgaatatgtgcaccttgatggcgatggatcttggcgagctgtgcgaggataccatcacctacaactgccccttgctacgacagaacgagccagaggacatcgactgctggtgtaatagcacaagcacctgggtgacctacggaacctgtaccgtcactggagaacacaggagggagaaacggagcgtggcgcttgtcccccacgtcgggatggggctcgagacgcgcactgagacctggatgagttccgagggtgcatggaagcacgcccagaggatcgagacctgggtcctccggcacccaggcttcacgattatggcagcgatcctggcgtacaccatcggcaccacgtactttcagcgggtgctgatattcatccttcttacggccgtcgccccgtccatgaccatgcgatgcatagggatctcaaaccgggacttcgtggagggcgtgtcaggagggagctgggtcgatatcgtgctggagcacggcagctgcgtgaccaccatggctaagaataagcctacgctcgattttgaattgatcaagactgaggccaagcaccccgccacactgcgcaagtattgcatcgaggccaaacttactaacacgaccaccgcaagccggtgcccgacccagggcgaaccctccctcaacgaagagcaggacaagcgcttcgtctgtaagcacagcatggtggaccggggctggggcaacgggtgcggcctgtttgggaagggagggatcgtgacgtgtgccatgttcacatgcaagaagaacatggagggcaagatcgtccagcctgagaacctcgagtacaccatagtcattacgccccactcaggcgaagagaacgccgtgggaaacgacacggggaaacacgggaaggagatcaaagtaactccgcagagctctatcaccgaggcagaactgactggctatggaacggtgacgatggagtgcagtccgcgcacaggcctggatttcaatgagatggtgctcctgcagatggagaacaaggcctggctggttcatcggcagtggttcctcgacttgcccctgccctggctcccgggcgccgacacacaggggtccaattggatccaaaaggagaccctagtgacattcaagaaccctcatgcgaagaagcaggacgtcgtggtgctgggtagccaggagggggccatgcacaccgccctcaccggcgccacggagatccagatgagctccgggaacctgctattcacaggccacctcaagtgtcgcctgcggatggacaaactgcagctcaaggggatgagctattccatgtgcaccgggaagttcaaggtcgtgaaagaaatagccgagacccagcacggcaccatcgttatccgcgtccagtacgaaggggacggctctccctgcaagatcccgttcgaaatcatggacttggaaaaaaggcatgtacttggccgcctcattacggtaaaccctattgtaacggagaaggactcccccgtgaacatagaggcggagcccccattcggggattcttacatcatcgtgggcgtcgaaccagggcagctgaagctgtcctggttcaagaaaggctcgtccatcggtcagatgttcgagaccaccatgagaggtgccaaacggatggcaatcctcggcgacacggcctgggactttgggagcctaggtggggtcttcacctccatcggcaaagcccttcaccaggtgttcggagctatatatggggccgccttctcaggagtctcctggacgatgaagatcctcattggtgtagtgataacctggatcggaatgaacagccgctccacgtcgctgtccgtcagcctggtgttggtgggggtcgtgaccctgtatctgggcgtcatggtccaggcagactccgggtgcgtggtgagctggaagaacaaagagctgaaatgtggtagtggcatatttattaccgacaatgtccacacctggacggagcagtacaagttccagcccgaatcaccatctaaactcgcgtcagccatccagaaggcccacgaggaaggcatctgcggtatacggagcgtgaccagactagagaacctgatgtggaagcaaataacacccgaactcaaccatatcctgtccgagaatgaggtgaagttaacaatcatgacgggggacatcaaggggatcatgcaggcgggaaaacgttccctacgcccgcagcccaccgagctcaaatactcctggaaggcctggggcaaggccaagatgctgagcacggaactccacaaccacaccttcctgatcgacggccccgagacggccgagtgcccaaacaccaaccgcgcctggaatagtctagaggtcgaggattacgggttcggggtgttcaccaccaacatctggctcaagctgaaggaacgccaggacgtgttctgcgatagcaagctgatgtccgctgccatcaaggacaacagggcggtccacgcggacatgggttattggatagagagcgccctcaacgatacgtggaagattgagaaggcctccttcatcgaggtcaagtcctgccactggcccaaatcccacaccctgtggagcaacggtgttctggagtccgagatgatcatccccaagaacttcgccggccccgtgagccaacacaactaccgcccggggtaccacacccaaaccgcgggaccctggcacctcgggagactggagatggacttcgacttctgtgagggcactaccgttgtggtcaccgaggactgcgggaaccgcggcccaagcctcaggaccacgactgcttccggtaagctaattaccgagtggtgttgtcgcagttgcaccttacccccgctgcgttaccgcggggaagacggctgttggtacgggatggaaatccgacccctgaaggagaaggaggagaacctcgtgaattccctggttaccgccggccacggccagatcgacaacttctcactcggagtccttggcatggcactatttctcgaggagatgctgcgcactcgtgtaggcaccaagcacgcgatcctgctcgttgccgtatccttcgtgaccctgattactgggaacatgtcattccgcgacctgggacgcgtgatggtcatggttggcgccacgatgactgacgacatcgggatgggcgtgacgtacctcgccctgctggccgcgtttaaagtgcggcccacctacgccgccggcctcctgcttcgtaagctcacctccaaggagctgatgatgaccaccatcgggatcgtgctactgagccagtccaccatcccggagacgatcctggagctgaccgacgccttagccttaggcatgatggtgctgaaaatcgtgcggaacatggagaagtaccagctcgcggtaaccatcatggccattctgtgcgtccctaacgctgtgatcttgcagaacgcctggaaggtgagctgcaccacgctcgcaatggtctccgtgagccctttgctgttgacatcaagccagcaaaaggcggactggatccccctggcgttaaccatcaaggggctcaatccgactgctatctttctgacgaccctgagccgcactagcaagaagcggtcctggccgctcaacgaggccatcatggcggtgggcatggttagcatcctcgcctccagtctgctcaagaacgacatacccatgactggccccctggtagccgggggcctgctcacggtgtgctacgtcctgaccgggcgcagtgccgacctggagcttgagcgagccgcggacgtgcggtgggaggaacaggccgagatctccggcagctcgcccatcctgtcgatcaccatttccgaggacgggtcaatgagtatcaagaacgaagaagaagagcagacactgacaatcctcatacggaccggcctcctggtcatatctggcctcttcccggtctccatccccatcaccgccgccgcctggtacctgtgggaggtgaagaagcagagagcgggtgtgctgtgggacgtacccagtccgccgcccgtgggcaaggccgagctcgaggacggggcgtaccggatcaagcagaagggcattctggggtatagccagatcggcgccggcgtgtacaaggaggggaccttccacactatgtggcacgtaacgcgcggggccgtgctaatgcacaaggggaagcgaatcgagcccagctgggccgacgtaaagaaagacctcatatcctacggcgggggctggaagctggagggtgagtggaaggagggtgaagaggtccaggtgttagccctcgagccaggcaagaatccccgcgccgtccaaaccaagcccggactcttcaagacgaataccggcacgatcggtgccgtcagcctggacttctcccctggcacctctggctcgcccatagtagataagaaggggaaagtggttggtctatacgggaatggagtggtgacccggagcggcacctacgtctcagccatagcacaaacggagaagtccatcgaagacaaccctgaaatcgaggatgacatcttccgcaagaagcggctcaccataatggacctgcaccccggggctgggaagaccaagcgctacctacccgccatcgtgcgggaggccatcaagcgcgggctccggaccctgatcttggccccgactcgcgtagtcgccgcggaaatggaggaggctctccgtggcctaccaatccgctaccagacccccgcaattcgcgcggagcacacggggagggagatcgtggaccttatgtgccacgccaccttcacgatgcgcctattgagccccatccgtgtgccgaactacaacctgattatcatggatgaggctcacttcaccgacccggcctccatcgccgcccgcggctacatcagcacccgggttgaaatgggagaggcagccgggatcttcatgaccgctacgccgcccggctcccgcgacccgtttccccagtcgaacgcccccatcatggacgaggagcgggagatccccgagcgctcctggaacagcgggcacgagtgggtgacggacttcaagggcaagactgtgtggttcgtgccatcgatcaaggcggggaacgatatcgcagcgtgcctccgtaagaacggtaagaaggtgatccagctcagccgcaagaccttcgactcggagtacattaaaacgcggaccaatgactgggacttcgtggtcacgaccgacataagcgaaatgggcgccaactttaaggccgaacgcgtgatcgaccccaggcgctgcatgaagcccgtgatcctgacggatggcgaagagcgagttatcctggccggacccatgccggtgacgcattccagcgccgcacaaaggcggggtcgcgtgggacggaaccccaaaaacgaaaacgaccagtacatctacatgggggagcccctagagaacgatgaggactgcgcccattggaaggaggcgaaaatgttgctcgacaacatcaacacgcccgagggcatcattccgtccatgttcgagcccgagagggagaaggtcgacgccatcgacggcgagtaccgcctccgcggggaggcccgcaagaccttcgtggacctgatgagacgcggcgatctcccggtctggctagcctaccgggtggccgctgaggggatcaactacgccgaccgccggtggtgtttcgacggcgtgaagaacaaccaaatcttagaggagaacgttgaagttgagatctggacgaaggagggggagcggaaaaaactcaaaccgcggtggctggacgcccgcatctactcagatcccttggcccttaaggagtttaaggagttcgccgccggacggaagtccctgaccctgaacctcatcaccgagatgggccgcctgcccaccttcatgacacagaaggcccggaatgcactcgacaacctcgccgtgctccacaccgccgaggcagggggccgcgcgtacaaccacgccctgagcgagctccccgagacgctggagaccctgttactgctgacgttactggccaccgtcaccggggggatcttcctgttcctcatgtccggcaaggggatcggcaagatgaccctcgggatgtgctgcatcatcaccgcgagcatcctgctctggtacgcccagatacagccgcactggatcgccgcctccatcatcttggagttctttctgatcgttctcctgatccccgaacccgagaagcagcgcacgccccaggataaccagctgacgtatgtggttatcgccatcctcaccgtggtggcagccaccatggccaatgagatgggcttcctggagaagacgaagaaggacttcgggcttggtagcatcaccacccagcagccggaaagcaacatcctcgacatcgacctacgcccagcctccgcgtggaccttgtacgcggtcgccacgacctttatcacccccatgctccggcatagcatcgagaactccagcgtgaatgtatccctgactgcaatcgcgaatcaggccacggttctaatgggcctcgggaagggatggcccctttcaaagatggatatcggggtgccgctgctcgctatcggctgctactcgcaagtgaatcccatcaccctcaccgccgccctcctcctgctggtcgctcactacgcgattatagggccgggcctacaggccaaggccacccgtgaggcccagaaacgcgccgccgctgggatcatgaagaatcccactgtggacgggatcacagttatcgacctggacccgataccctacgaccccaagttcgagaagcagcttggccaggttatgctcctagttctatgcgtgacccaggtgctcatgatgcgcaccacctgggccctgtgcgaggccctgaccctcgcgactgggccaatcagcaccctgtgggagggcaacccggggcgcttctggaacacgaccatcgcggtgtccatggccaacatatttcggggctcctacctggccggcgcagggctactgttcagcatcatgaagaacaccgctaacacccgcaggggcacggggaacaccggagagaccctgggagagaagtggaagcaccggctcaatgcgctgggcaagagcgagttccagatctacaagaaatccggcatccaggaagtggaccggacgctggcaaaggaggggatcaagcgcggggaaacggaccaccacgccgtcagcaggggatccgctaagctccgctggttcgtggaacggaacctcgtgacacccgagggcaaggtcgtggatctaggctgcgggaggggagggtggagctactactgcggcggtttgaagaatgtgaaggaggtcaagggcctgactaagggcgggcccggtcatgaggagcccatcccgatgtccacctatgggtggaacttagtacggctccagagcggcgtggacgtcttctttaccccgcccgagaaatgcgacaccctactgtgcgacatcggggagtcgagccccaacccgaccgtggaggcgggacgcacactccgggtactgaacctggtagagaattggctaaacaacaatacccagttctgtatcaaggtgctgaacccctatatgcccagcgtgatcgagaaaatggaggccctgcagcgcaagtacggcggggcgctagtcaggaatccgctctcccgcaacagcacgcatgagatgtactgggtgtccaacgcctcgggcaacatcgtgtcctctgtaaacatgataagcagaatgttaatcaaccgtttcaccatgagacataaaaaggccacctacgagcccgacgtggacctggggagcggaacccgcaatattggaatcgagtccgagactcccaaccttgacatcatcggcaagagaattgagaagatcaagcaggagcacgagacctcgtggcattacgaccaagaccacccctacaagacgtgggcgtaccatggatcctacgagaccaagcagacagggtccgcctccagtatggtcaatggagtcgtccggctgctgaccaagccgtgggacgtgatccccatggtcacccagatggcgatgacggataccacccccttcgggcagcagcgcgtgttcaaggagaaggtcgacacccggacccaggagccgaaggagggtacaaagaagctcatgaaaataaccgccgagtggttatggaaggagctgggcaagaagaaaaccccgcgcatgtgcaccagagaggagttcacacgaaaggtgcgctccaacgccgcgctaggggccatctttaccgacgaaaacaaatggaagtccgcccgcgaggccgttgaagattcagggttctgggaactggtcgataaggaaagaaatctgcacctcgaggggaagtgcgaaacttgcgtatacaacatgatgggcaagcgtgaaaagaagctgggggagttcggcaaagccaagggcagcagggcgatttggtacatgtggctgggagcacgcttccttgaatttgaggccctgggctttctgaacgaagaccactggttttcccggaaaaacagcctcagcggggtagagggcgagggtcttcacaaactgggatacatcctccgcgatgtgtccaagaaggaaggtggtgccatgtacgcggacgacaccgccggctgggacacgcggatcaccctagaggatctgaagaacgaggagatggtgaccaatcacatggagggtgagcacaagaagctcgccgaggccatcttccgcctgacataccaaaacaaagtggtccgggtgcaacgtcccacgccccgaggtaccgtgatggacatcatcagcaggcgggaccagcgtgggtccggccaggtcgtgacctacggcctgaacaccttcacgaacatggaggcgcagctcatccgacagatggagggggagggcgtgttcaagtcaatccagcacctaaccgctaccgaagagatcgccgtcaagacctggctggtgcgtgtggggcgggagcgtctctcccgcatggccataagcggcgacgactgcgtggttaagccgctggacgaccgcttcgcctcggccctaacggcgttaaacgacatgggcaaggtgcgcaaggacatccagcagtgggaaccaagccggggatggaacgactggacccaggttcccttctgctcccaccactttcatgagctgattatgaaggacggccgcgtgcttgtggtcccctgccggaatcaggacgagctcatcgggcgcgcccgaatctcgcagggcgcggggtggagtctgagagaaaccgcatgcctgggaaagagctacgcccagatgtggagtcttatgtacttccatcggcgtgacctgcgcctggcggcgaacgcgatctgcagcgctgtgccctcgcattgggtgccgaccagccgcactacgtggagcatccacgccactcacgaatggatgaccaccgaggacatgctcactgtatggaaccgggtgtggatccaggagaacccctggatggaagacaagacccccgtggagagctgggaggaaatcccatacctgggaaagagagaggatcagtggtgcggctcactgatcggcctcacctccagagcgacctgggctaagaacattcagacggccatcaaccaggtccgcagcctgattggtaacgaggagtacaccgactatatgccgtccatgaagcgctttcggcgcgaggaagaggaagcaggagtgctgtggtga

SEQ ID NO: 24934 - RNA, 9876 nt, synthetic construct
  misc_feature 1..9876: note = derived and/or modified CDS sequence (opt11) from DENV-2__HQ999999__SS-prME
  source 1..9876: mol_type = other RNA
acagcgggcgtgatcgtgatgctgatccccaccgccatggcgttccacctcaccacccgcaacggagagcctcacatgatcgtgggccggcaggagaaggggaagtccctgttgttcaagaccgaggacggcgtgaatatgtgcaccctcatggccatagacttaggggagctgtgcgaggacaccatcacctacaagtgccccctcctaaggcagaacgagcccgaagacatcgactgttggtgcaatagcacgagcacctgggtcacctacgggacctgcaccaccacgggcgagcaccggcgcgaaaaacggagcgtggccctggtgcctcatgtagggatgggtctcgagacccgaaccgagacctggatgagcagcgagggggcttggaagcacatccagcggattgagacctggattctgcgccacccgggcttcaccattatggctgcgatactagcctacaccatcgggaccacccacttccagcgggccctcatcttcatactgctgaccgcggtcgcgcccagcatgaccatgcgctgcataggcataagcaaccgggacttcgtagagggcgtgagcggtggcagctgggttgatatcgtgctcgagcacggcagctgcgtcaccacgatggccaagaataaacccaccctggacttcgagctgatcaagacggaggccaagcagcccgccaccctccgtaaatattgcatcgaggcaaagctgacgaacaccaccaccgagtcccggtgcccgactcagggtgagcccagcctgaatgaggagcaagacaagcgttttatctgcaagcactccatggtggacaggggctgggggaacggttgcggactgttcggcaagggcgggatcgtgacgtgtgctatgttcacgtgcaagaagaacatggaggggaaagtcgtgcagcccgagaacctggagtataccatcgtgatcacgccccactcgggggaggagcacgccgtcggcaacgacaccggtaaacacggcaaggagatcaagatcaccccgcagtccagcatcaccgaggccgagctgaccgggtacggcactgtgacaatggagtgcagcccccgcaccggtctcgactttaacgagatggtgctgctgcagatggaggacaaggcttggctcgtccatcggcagtggttcctggacctgcccctcccctggctgcctggggccgacacacagggcagcaactggatccaaaaagagaccctggtaaccttcaagaacccccacgcgaagaagcaggacgtggtggtactcgggtcccaagagggagccatgcacacggccctgaccggggccacggagatccagatgagcagtggcaacctcttattcaccggccacctgaagtgtcgcctgcggatggacaagctccaactgaaggggatgtcctacagcatgtgcaccggcaagttcaagatcgtcaaggagatcgccgagacgcagcacggcacgattgtgatccgcgtgcagtacgagggcgacggctccccctgcaagatccccttcgagatcaccgacttagagaagcggcatgtactcgggcgcctgatcaccgttaaccccatcgtcaccgagaaggacagccccatcaacatcgaggcggagcctcccttcggcgactcctacatcatcatcggggtcgagcctggccaactgaagctcaactggttcaagaagggtagctccatcggccagatgttcgagacgacgatgcgaggcgccaagcggatggctatcctgggggacaccgcctgggacttcggcagcctcgggggcgtgttcacctcaatcgggaaggcccttcaccaggtgttcggcgcgatctacggagccgccttcagcggcgtctcttggacgatgaagatcctgatcggcgtgatcatcacctggatcgggatgaacagccgcagtacgagcctgtccgtgagcctggtcttagttggcgtcgtgaccctgtacctgggggccatggtgcaggcggactccggctgcgtggtcagctggaagaacaaggagctcaagtgcggctctgggatcttcatcacggacaacgtgcacacgtggaccgaacagtacaagtttcagcccgagagccccagcaagctggcatccgccattcagaaggcgcacgaggagggcatctgcgggattcggagcgtcacccggctggaaaacctcatgtggaagcagattacgcccgaactgaatcacatcctgtccgagaacgaggtcaaactcaccatcatgacaggggacatcaaggggatcatgcaggcaggcaagcggagcctgcgcccacagcccaccgagctgaagtactcttggaagacgtgggggaaagcgaagatgctcagcacggaatcccacaatcagactttcctaatcgacgggcccgagaccgccgagtgcccgaacacgaaccgagcctggaacagcctcgaggtcgaggactacggcttcggggtgttcaccaccaacatctggctcaagctgaaggagaagcaggacgtattttgcgactccaagttgatgagcgccgccatcaaggacaaccgcgcggtacacgccgacatgggctactggatcgagtccgccctcaacgatacctggaagatggagaaggccagctttatcgaggtgaagtcatgccattggcctaagagtcacaccctgtggtccaacggcgtgctggaaagcgagatgatcatccccaagaacttcgccgggccagtgtcccagcacaactaccggccgggctaccacacgcagaccgcagggccctggcacttaggaaagttggagatggacttcgacctgtgcgaggggactaccgttgtcgtgacggaggactgcggcaaccgcggacctagtctccggaccactaccgcgtctgggaagctgattacggagtggtgctgccgctcctgtaccttacccccgctccggtaccgaggcgaggacggctgctggtacggcatggagatccgacccctgaaggagaaggaggagaatctggtgaacagcctcgttaccgccgggcacggccagatcgacaacttctccctgggcgtgttggggatggcactcttcctggaggagatgctgcggacccggatcggcacgaagcacgccatcctcctggtggccgtcagcttcgtgacccttatcaccgggaacatgtccttccgcgacctcgggcgggtgatggtcatggtgggggccacgatgactgacgacatcggcatgggcgtgacctacctagccctgcttgccgcattcaaggtccgccccaccttcgccgccgggctgctgctcagaaagctgacctctaaggagctgatgatggccaccatcggcattgccctcctgtcccagagcaccatcccggagaccatccttgagctcaccgacgcactggctctggggatgatggtgctcaaggtggtccggaatatggaaaagtaccagcttgctgtgacgatcatggccatctcctgcgtcccgaacgccgtcatcctgcagaatgcgtggaaggtgagctgcaccatcctcgccgccgtgtccgtcagcccactgctgctcacctccagtcagcagaaagcggactggatccccctggcgctgaccatcaagggcctcaaccccacggccatctttttaaccacgctgtcccgcaccagcacgaagcggtcctggccgctcaacgaggccatcatggccgtgggcatggttagcatcctggcctccagcctgctcaagaacgacatcccgatgactgggcccctggttgcgggcgggctgctcacggtgtgctacgtcctgaccggccgcagcgcagacctggagctcgagagggccgcagacgtgaagtgggaggaccaggccgaaatctccgggtcctcccctatcctgtcgatcacgatctccgaggatggcagcatgtccatcaagaacgaagaagaggagcagaccctgactattctcatacgcaccggcttgctggtgattagcggggtcttcccggtgtccatccccatcaccgcggccgcctggtacctctgggaggtaaagaagcagcgggccggcgtcctgtgggacgtgccaagcccgccgcccgtggagaaagccgagctggaggacggggcgtaccgcatcaagcagcgaggcatcctcgggtactcccagatcggcgccggcgtctacaaggagggcacgttccacaccatgtggcacgtgacacgcggcgcggtgctgatgcaccgggggaagagaatcgagccaagctgggcggacgtcaagaaggacctgatatcctacggcgggggctggaagctcgagggcgagtggaaggagggggaggaggtccaagtgctggccctggagcccggcaagaaccctcgtgctgtccagaccaagcccgggatcttcaagacgaacaccggcacaataggggcagtgagcctcgatttctcacccggcaccagcggctcgccaattgtggaccgcaaggggaaggtcgtgggcctgtacgggaacggcgtggtcactcggagcggcgcctacgtatccgccattgcgcagaccgagaagtccattgaggacaaccccgagatcgaggatgacatattccgcaagaagcggctgaccatcatggacctccaccccggggccggcaagaccaagcgctacctgcccgccatcgtgcgggaggccatcaagagagggctgcggacgctgatcctcgccccgacaagggtggtggcggccgagatggaggaggccctgcgcggcctgcccattcggtaccagacccccgccatcaaaaccgagcatacgggtcgcgagatcgtggacttgatgtgccacgccaccttcaccatgcggctgcttagccccgtccgcgttccgaactacaacctcatcatcatggatgaggcgcacttcaccgaccccgcctccattgccgcgcggggctacatcagcacgcgcgtggagatgggcgaggccgcgggcatatttatgaccgctacgccgcccggctcccgggacccgttcccccagagcaacgcccccatcatggacgaggagcgcgaaatccctgagcggtcctggaacagcgggcacgagtgggttaccgactttaagggcaagacggtgtggttcgttccgtccatcaaggccgggaacgacatcgctgcctgcctgaggaagaatggcaagaaggtcatccagctgagccggaaaactttcgactccgagtacgtgaagactcgcgcaaacgactgggactttgtggtcaccacggacataagcgagatgggcgccaactttaaggccgagagagtgatcgacccgcgccggtgcatgaagcctgtcatcctcaccgacggggaggagcgcgtcatcctggcgggccccatgccggtgacccactccagcgccgcgcagagacgcgggaggatcggccgcaaccccaagaacgagaacgaccagtacatctacatgggcgagcccctggagaacgacgaggattgcgcccactggaaggaggccaaaatgctcctggacaacataaacacccccgagggcatcatcccatccatgttcgaacccgagcgcgagaaggtggacgcgatcgacggagagtaccggctgcgcggggaggcccggaagacgtttgtagacctcatgcgccggggcgacctgcccgtgtggctggcatacaaggtggcagcggaggggatcaactacgcagaccgaaggtggtgcttcgacggcatcaagaacaaccaaatcctcgaagagaacatggaggtcgagatctggaccaaggagggggagcgcaagaaactgaagccgcgttggctggacgcccgcatctactctgaccccctcgccctaaaggagttcaaggagtttgccgcgggccggaagtccctgaccctcaacttgatcacagagatgggccgccttcctaccttcatgacgcagaaggcccggaatgcactcgacaacctggccgtgctgcacaccgcggaggcagggggccgcgcctacaaccacgcgctcagcgagctgcccgagaccctggagacactcctgctgctcactctgctggccaccgtgaccgggggcatcttcctcttcctgatgtccggcaaggggatcggcaagatgaccctggggatgtgctgcataattacggccagcatcctcttatggtacgcgcagattcaaccgcactggattgccgcctccatcatcctggagttcttcctcatagtcctgctgatccccgagcctgagaagcagcggacgccccaggataatcagcttacgtatgtggtcattgccatcctaaccgtggtggccgcgacaatggcaaacgagatgggcttcctggagaaaaccaagaaggacttagggctgggcagcataactacccaggagagcgagtcaaacatcctggacatcgaccttaggcccgccagcgcttggacgctttacgccgtcgcaaccacctttctgacgcccatgctccggcactccatcgagaacagttccgtgaacgtgtctctgacggccatcgccaatcaagccaccgtactcatggggctggggaagggctggccgctgtcaaagatggacatcggtgctccgctgctggccatcggctgctactctcaggtgaaccctattaccctgaccgccgccctgctcctgctggtcgcccactacgcgattatagggcccggtctccaggccaaggccacgcgcgaggcccagaagcgggccgccgccggcatcatgaagaatccaaccgtcgacgggatcaccgtgatcgacctggaccccatcccctatgaccccaagttcgagaagcagttgggccaggtgatgctcctgatactgtgcgtcacacaggtgctcatgatgcgcacgacctgggccctgtgcgaggccctgaccctcgccaccggccccatctcaacgctgtgggaaggcaaccccgggcggttctggaataccacaatcgcggtgagcatggccaacatcttccgtggctcctatttggccggcgccgggctcctgttcagcatcatgaagaacaccacgtccacccgccgggggacagggaacatcggcgagaccctgggcgagaagtggaagtcccgcctcaacgcgctggggaagtccgagttccagatctacaagaagagtggcatccaggaggtcgaccggacgcttgccaaggaagggatcaagcgcggcgagaccgatcaccacgctgtctcccgggggagcgccaagctccgctggttcgtggagcggaacatggtcaccccggagggcaaggtggtcgacctgggctgcggtcgcggcgggtggtcctactactgcggcgggctgaaaaatgtgcgagaggtgaagggcctcaccaagggcgggcccggccatgaggagcctatccccatgagcacgtatgggtggaacctggtgcgcctgcaaagcggcgtcgacgtgttcttcaccccgcccgaaaagtgtgacacattactgtgcgatatcggggagtccagccccaaccccaccatcgaggctggccggaccctgcgcgtgctcaacttagtcgagaactggctgaataacaacacgcagttctgcatcaaggtgctcaacccgtacatgccctccgttatcgagaagatggaggcgctgcagcggaagtacggcggggccctggtacggaaccccctgagccgcaattccacccacgagatgtactgggtgagcaacgccacaggcaacatagtgtccagcgtcaacatgatctcccgcatgctcatcaatcggttcaccatgaagcacaagaaggccacgtacgagccggacgtagacctagggagcggcacccgcaacattgggatcgagtcagaggtgcccaacctggacattatcggtaagcggatcgagaagatcaagcaggagcacgagaccagctggcactacgaccaggatcacccctacaagacctgggcctaccacggctcctacgagacgaaacagaccgggagcgcgtccagcatggtgaatggcgttgtgcgcctcctgactaagccctgggacgtcgtgccgatggtgacccaaatggccatgacggacacgacccccttcggacagcagagggtctttaaggagaaggtggacaccaggacgcaggaacccaaggagggcaccaaaaagctgatgaagattaccgccgaatggctctggaaggagctgggaaagaaaaagacccccaggatgtgcactcgggaagagttcacccgcaaggtccggtccaacgccgccctgggggcaatcttcaccgatgagaataagtggaagagtgcccgcgaggccgtcgaggacggcaggttctgggagctcgtggatcgcgagcggaacctgcatctggaggggaagtgcgagacctgcgtttacaacatgatgggcaagcgcgagaagaagctcggcgagttcgggaaggctaagggctcccgggcgatctggtatatgtggctgggggcccgcttcctagagttcgaggccctgggcttcctgaatgaggaccactggttcagccgggggaacagcctgtccggggtcgagggggagggcctccaccgcctaggatacatcctgcgggaggttagcaaaaaggagggcggagccatgtacgccgacgacacggcagggtgggacacccgcatcaccctggaagacctgaaaaacgaagagatggtgaccaaccacatgaagggcgagcacaagaagctagccgaggccatctttaaactcacttaccaaaacaaggtcgtgcgggttcagcgaccgacaccccgggggactgtaatggacatcatctcccgtcgggaccagcggggcagcggccaggtggggacctacggcctgaacacatttaccaacatggaagcccagctaatccgccagatggagggggagggcatcttcaaatccatccagcacctcacggccacggaggagatcgcggtccagaactggctggctcgggtggggagggagaggctgagccgcatggcaatatccggggatgactgtgtggtcaaacctatcgacgaccggttcgccagcgccctcacggcactgaacgacatgggcaaagtgagaaaggacatccagcaatgggagccatccagggggtggaacgactggacccaggtgccgttctgtagtcaccacttccacgagctggtcatgaaggacgggcgcgtgctcgttgtcccctgccggaaccaggacgagctgatcgggcgcgcacggatctcgcagggcgccggctggagcctgaaggagaccgcctgcttggggaagtcctacgcccaaatgtggacactgatgtactttcaccgccgggatctgcggctcgcggccaacgccatctgcagcgccgtgccctcccactgggtgcccaccagccggacgacatggtccatccacgcgaaacatgagtggatgaccaccgaggacatgctggccgtctggaaccgcgtgtggatccaggaaaacccgtggatggaggacaagacgcccgtggagagctgggaggaggtcccctacctgggcaagagggaggaccagtggtgcggcagtctcatcggcctaacctcccgcgccacctgggccaagaacatacagaccgccatcaaccaggtgcggagcctgatcgggaatgaggagtacaccgactacatgccatccatgaagcgtttccgcagggaggaggaggaggcgggagtgctctggtga

SEQ ID NO: 24935 - RNA, 9876 nt, synthetic construct
  misc_feature 1..9876: note = derived and/or modified CDS sequence (opt11) from DENV-2__FJ898449__SS-prME
  source 1..9876: mol_type = other RNA
accgcgggaatgataatcatgctgattcccaccgtaatggccttccacctcaccaccaggaatggggaaccccacatgatcgtgagccggcaagagaagggaaagagcctgttattcaagaccaaggacgggacaaacatgtgcacgctcatggcgatggacctgggcgagctttgtgaggacaccatcacctacaagtgccccttcctcaagcaaaacgagcccgaagacatcgactgctggtgtaatagcacctccacatgggtaacctacggcacctgtaccacgaccggcgagcatcgacgggagaagcgcagcgtagcactggtcccccacgttggcatggggctcgaaacgcgaaccgaaacgtggatgtccagcgagggagcctggaagcatgcccagcgcatcgagacctggatcctccggcaccccgggtttaccataatggccgcgattctggcctacaccattggcacaacccactttcagcgcgttctaatcttcatcttgcttactgccatcgctccctccatgaccatgcggtgcatcgggatcagcaaccgcgacttcgtcgagggcgtttccggtgggtcctgggtggatatcgtgctagagcacggcagttgtgtgacgaccatggcgaagaacaagcccaccttagacttcgagctgattaagaccgaggccaaacagcccgccacgctgcggaagtactgcatcgaggcaaaactcaccaacaccaccacggactcccgctgcccgacgcagggagagcccaccctgaacgaggagcaggacaagcgattcgtatgcaaacactccatggtcgacagaggatggggcaacggctgtggcctgttcggtaagggcgggatcgtgacatgcgctatgtttacgtgcaagaaaaacatggaaggcaaaatcgtgcagcccgagaacctcgagtacaccgtcgtgatcacgccccatagcggcgaggagcacgcggttgggaacgacaccggcaaacacgggaaggaagtgaaaataaccccgcagtccagcattacggaggccgagctgaccggctatgggaccgtaactatggagtgcagcccccgtacgggcctggacttcaacgagatggtgctcctgcaaatggaggataaggcctggctggtccacagacagtggttcctcgacctgccgctgccctggctccccggggccgatacccagggaagcaactggatccagaaggagaccctggtaaccttcaagaacccccacgccaaaaagcaggatgtagtggttttaggctcccaggagggggcgatgcatacggccttgaccggcgccaccgagatccaaatgagcagcggcaacttgctgttcaccggccatttaaagtgccgtctgcgcatggataagctgcagttaaagggcatgtcctacagcatgtgcacggggaagttcaagatcgtcaaggagattgccgaaactcagcacggtaccatagtgatcagagtgcagtacgagggggatggctccccctgcaagattcccttcgagatcatggacttagagaagcgccacgtcctgggcagactaatcaccgttaaccctatcgtgacggaaaaggacagccccgtcaacattgaggccgagcccccgttcggggacagctacatcatcattggcgtggagccgggccaattgaaactggattggttcaaaaagggcagctccattgggcagatgtttgagaccaccatgcgcggcgcgaagcgcatggccattctcggcgataccgcctgggattttgggagtctgggcggggtgttcacatccatcggtaaggcactgcaccaggttttcggggcgatctacggtgctgccttctcaggcgtctcctggaccatgaagatcctcatcggggtgattatcacctggatcggcatgaacagccggagcactagcctgtccgtctctctggttctggtaggaatagtcactctatacctgggcgtgatggttcaggcagactcgggttgcgtcgtgagctggaaaaacaaggagctgaagtgcggctccggtatcttcgtaaccgacaacgtccatacctggaccgagcagtacaagttccaacccgagtcacccagcaagctcgcctctgctatccagaaggcccacgaggaggggatctgcggcatcagaagcgtgacacggctggaaaacctgatgtggaagcaaataacctccgagctcaaccacatcctgagcgagaatgaagtgaaactgacaatcatgaccggggacatcaaaggcatcatgcaggtcgggaaacgctcccttcggccccagccgacggagctccgatatagctggaagacctggggcaaggccaaaatgctgtcaaccgagttgcataaccaaaccttcttgatcgacggccccgaaaccgccgaatgccctaacaccaaccgggcatggaactcgctagaggtggaggactatgggttcggcgtcttcaccaccaatatctggctccgcctgcgggaaaagcaagacgttttctgcgactccaagctgatgagcgcagccatcaaggacaatcgcgccgtgcacgctgacatggggtactggatcgaatccgccctcaacgacacctggaagatagagaaggcgagcttcatcgaggtgaagtcctgccattggcccaaaagccacacgctgtggtccaacggcgttctagagagtgagatgatcatcccgaagaacttcgcgggcccagtgtcccagcacaacaacagacccgggtaccatacccagaccgccggaccatggcacttagggaagctggagatggactttgacttttgcgagggtaccacagtggtcgtgacagaggagtgtggaaaccgcggccctagccttcggaccacgacggcctctggtaagctcataaccgagtggtgctgtcgctcctgcaccctgccaccccttcgataccgcggggaagatgggtgctggtatgggatggagatccgaccgctcaaggagaaagaggagaacctggttagcagcctagtgaccgccggccacgggcagatcgacaacttcagtctcggcattctgggcatggcgctgttcctcgaggagatgttgaggacgcgcgttgggaccaagcacgccatcctgctcgtggcggtctccttcgtcacgctgataaccggcaacatgagcttccgcgacctcggtcgcgtgatggtcatggtgggcgcaacgatgaccgacgacatcggcatgggcgtaacctacctcgcgctgctggccgcctttaaggtccggccgacctttgctgcaggactcctgctgcgcaaactaacgtccaaggaattgatgatgaccactatcgggatagtgctcttgagccagtcctcgatcccggagacgatattagagctgacggacgcactcgccctgggcatgatggttctgaagatggtccggaacatggagaagtaccagctcgccgtgactatcatggcaatcttgtgtgtgcccaacgccgtcatcctgcagaatgcatggaaggtatcctgcaccatcctcgccgttgtgagcgtgtccccgctgcttctcaccagctcccagcaaaaggccgactggataccactggcccttacgatcaaggggctcaatcccaccgccattttcctgaccaccctgagccggacgtccaaaaagcggtcatggcccttgaatgaggctatcatggccgtcggcatggtatccatcctggccagctcattgctcaagaatgacatcccgatgaccggccccctcgtggccggtggcctgctcaccgtctgttacgtgctgaccgggcgttccgcggacctggagctcgagcgggccacagacgtgaagtgggacgaccaggccgagataagcggatccagtcctatcctgtccataaccatctcagaagacggttccatgagcattaagaacgaagaggaggaacagacgttgaccattctcatccgcaccggcctgctggtcatctccggcctcttccccgtgagcatcccgatcacggccgcagcatggtacctgtgggaggtgaagaagcagcgggccggggtcttgtgggacgtgccctccccgccacccgtgggcaaggccgaacttgaggacggggcctaccgaatcaagcagaaggggatactggggtacagccagataggcgccggcgtctacaaggaagggacattccacaccatgtggcacgtgaccaggggcgcagtcttaatgcacaaggggaaaaggatcgaaccctcctgggccgacgttaagaaagatctcatcagctacggcgggggctggaagctggagggagagtggaaggagggggaggaggtccaagtgctggctcttgagcccggcaaaaaccctcgggccgtgcagaccaagcccggactattccgaactaacaccggcaccataggggccgtgtccctggacttcagcccaggaacgtccggctctcccatcgtcgacaagaaagggaaagtcgtgggcctttacgggaacggcgtggtcacccggtccggcgcgtacgtttcagcgatcgcccagaccgagaagtccatcgaggacaatccggagatcgaggatgacatttttcgcaagcgtcgcctaaccatcatggacctccaccccggcgcgggcaagacgaagaagtatctgccggcgatcgtgcgggaggcgataaagcgcgggttacgtaccctgatcttagccccaacccgcgtcgtggccgcggaaatggaggaggcgctccgcggcctaccaatacgataccagacccccgccattcgcgcggagcacacggggcgggaaatcgttgacctgatgtgtcacgccacctttaccatgcgcctcctgagccccatccgggtcccaaactacaacctaatcatcatggacgaggcacacttcaccgacccggcgagcatcgccgctcgcggctacatatccacgcgggttgagatgggcgaggcggccgggatattcatgacggcgactccgcccggcagccgtgatcccttcccgcagtccaatgcccctatcatggacgaggagagagagattccggagcggagttggaactccgggcacgagtgggtgaccgacttcaaaggcaagacagtttggttcgtgccaagcatcaagactgggaacgatatcgcggcctgcctccggaaaaatggcaaaagggtcatccagctgtctcggaaaacctttgatagcgagtatgtcaagacgcgcaccaatgactgggacttcgtggtaactaccgacattagcgagatgggcgccaacttcaaggcggagcgggtcatcgacccgaggcgatgtatgaagcccgtgatcctgactgacggggaggagcgcgtgattctcgccggtcccatgcccgtcacgcacagcagtgccgcccaacggcgcggacgcatcggacggaacccgcgcaacgaaaatgatcagtacatctacatgggggagcccctggagaacgacgaggactgcgctcactggaaggaggccaagatgctactcgacaacatcaacacccccgagggcatcattccgagcatgttcgaaccggagcgggaaaaggtggacgccatcgacggcgagtaccgcctacgcggggaggctcgcaagacctttgtagacctgatgagacgcggtgacttacccgtctggctggcctacaaggtcgcgtccgagggaataaactacgcagaccggcgttggtgtttcgacggcaccaggaacaaccagatcctggaagagaacgtggaggtagagatatggacgaaggagggcgagcgcaaaaagttaaagccccgttggctggacgcgcggatatacagtgacccgctcgccctcaaggagttcaaagagttcgccgccggccggaagtccctgacccttaacctgatcactgagatgggacgtctgccgaccttcatgacgcagaaggcccgggacgcactggacaaccttgccgtgctgcacacagccgaggcaggcggcaaggcctataaccacgccctgagcgagctccccgagaccctggagaccctgctgcttctgaccctccttgccacggttaccggcggaatcttcctgttcctcatgtccgggcgcgggatcggcaagatgaccttggggatgtgctgtattatcaccgcgtccatcctcttgtggtacgcacaaatccagccccactggatcgccgccagcatcatcctggagttcttcttaatcgtactcctgatccccgagcccgagaagcagaggacaccccaggacaaccagctgacctacgtaatcatcgccatcctaaccgtcgtggcggccacgatggccaacgagatgggtttcctggaaaagacgaaaaaggacctggggctagggcatatcgcgacccagcaaccagagtccaacatcctggacatcgacctgcggccggccagcgcgtggaccctctacgccgtggccaccacgttcataacccccatgctgcggcactccatcgagaacagctccgtcaacgtgagcttaaccgccatcgccaaccaggccaccgttctcatggggctggggaagggctggcccctgtccaagatggacatcggggtcccccttctcgccatcggctgctacagccaggtgaatccgatcactctgacagccgccctcctgctcctcgtagcacactacgcgatcatcgggcccggtctgcaagccaaggccacacgcgaggcccagaagcgcgccgccgccggcatcatgaagaaccccaccgtagatggtatcacggtgatcgacctggatcccatcccctacgacccgaagttcgagaaacaactcggccaagtgatgcttctggtactctgcgtgacccaggtgctgatgatgcggaccacctgggccctgtgcgaggccctcacactggcgaccgggcccgtctcgacgctgtgggagggcaatcccgggcgcttctggaataccacgatcgccgtaagcatggcgaatattttccggggctcctacctagccggcgccgggctgctgttcagcatcatgaagaacaccacctcaacccgtcggggcaccgggaacatcggggagactctcggggagaagtggaagtcccgtctgaacgcgctggggaagagtgagttccagatctacaaaaagagcggtatccaggaggttgaccggacgctcgctaaggaggggatcaaacgcggcgagaccgaccaccacgccgtgagtcgtgggagcgcgaagctgaggtggttcgtggaacgtaacctggtgacgcccgagggcaaggtggtcgacctcggctgcgggcgtggtgggtggtcctattactgcggcgggctcaagaatgtacgggaggtcaaggggcttaccaagggcgggcccggccatgaggagcccattcccatgagcacctatggctggaatcttgtgagattgcagagcggcgtggacgtattcttcgtgccgcccgagcggtgcgacaccctgttatgcgacatcggggagtccagccccaaccccactgtggaagccggtcgcacgctacgggtcctgaacttggtggagaactggctgaataacaacactcagttctgcgtaaaagttctaaacccgtacatgccctccgtgatcgagcgcatggagaccctgcagcggaagtatgggggtgcgttagtgcgcaaccctctgtcgcgcaactccacccatgagatgtactgggtcagcaacgcctccggcaatatcgtgagctcggtgaacatgattagcaggatgctgataaatcgcttcaccatgcggcacaagaaagccacttacgagccggacgtcgacctcgggtccggcacccgcaacatcggaattgagtctgagacccccaacctggacatcataggcaagcggatcgagaagatcaagcaggaacacgaggcctcatggcactacgaccaggaccatccctataaaacgtgggcgtaccacgggagctacgagactaaacaaacggggtccgcctcgtcaatggtgaacggcgttgttaggttactcaccaagccctgggacgtggtgcctatggtcacgcagatggcgatgaccgacaccacaccgttcggtcagcagcgcgtttttaaagagaaggtggacacgcgcacccaagagcccaaggagggcaccaagaagctgatgaagatcaccgccgagtggctgtggaaggagctcggaaaagaaaagacaccccggatgtgcacccgcgaggagttcactaagaaggtccggagcaacgccgcactgggggccattttcacagacgagaacaagtggaagtcagccagggaggccgtggaggacaaccggttctgggagttggtagacaaggaacgcaatctccacttggagggcaagtgcgagacgtgcgtgtacaatatgatggggaagcgtgagaagaaacttggcgagttcgggaaagccaagggctcacgcgctatctggtacatgtggctcggcgcccggttcctggagttcgaggcactggggttcctcaacgaggaccactggttctcccgcgagaactctctgagcggcgtggagggggagggccttcacaagctcgggtacatcctgagagaggtctccaagaaagagggcggcgccatgtacgctgacgacacggccgggtgggacacccgcatcaccatcgaggacttgaagaacgaagagatgatcacgaatcatatggctggcgagcacaagaaacttgccgaggccatcttcaaactgacctaccagaacaaggtggtgcgggtccagcgccctacgccccgcgggaccgtgatggacatcatcagccggagggaccagcgtgggtccggccaggtgggcacctacggcctcaacaccttcactaatatggaggcgcaactcattcgccagatggagggagagggcatcttcaagagcatccagcacctgactgcctccgaggagatcgccgtccaggactggttggtgcgcgtagggcgcgagcggttgagccgcatggctatctccggcgatgactgcgtcgtgaaacccctggatgacaggttcgcccgcgcgctaacggctctcaacgacatgggaaaggtccgtaaagacatccagcagtgggagcccagccgcgggtggaacgactggacccaagtccccttctgctcccatcactttcatgagctgatcatgaaggacggccggaccttagtggtgccctgccgtaaccaggacgagctcataggtagggcccgcattagccaaggtgccggatggtcgctgcgggaaaccgcctgtctgggcaagagctacgcgcagatgtggtccctcatgtacttccaccgccgggacctgcgactggccgccaatgccatctgtagcgccgtcccctcccactgggtcccaacctcgcgcactacctggagcatccacgcatcccacgagtggatgaccacggaagacatgttgacggtgtggaaccgcgtctggatcctggagaacccatggatggaggacaagacacccgtggagagctgggaggagatcccctacttaggcaaaagagaagaccaatggtgcgggtctctcattggcttaaccagccgggccacctgggccaagaacatccagacggccatcaaccaggtgcgctccctgattgggaacgaagagtacaccgattatatgccctcgatgaagcggttccgccgagaggaagaggaggcgggagtcctctggtag

SEQ ID NO: 24936 - RNA, 9876 nt, synthetic construct
  misc_feature 1..9876: note = derived and/or modified CDS sequence (opt11) from DENV-2__FJ906966__SS-prME
  source 1..9876: mol_type = other RNA
accgccggtatgatcatcatgctgatacccactgtgatggcctttcatctcaccaccagaaacggggagccccacatgatcgttagccggcaagagaaaggtaagagcctgctgttcaagacagaggacggggtaaacatgtgcaccctaatggcgatggacctgggcgagctctgcgaggacaccatcacctacaagtgccccttcctcaagcagaacgagcctgaggacattgattgctggtgcaactcaacgagcacgtgggtgacctacgggacctgcactacaacaggagagcaccgccgagaaaagcgcagcgtcgccctggtaccccacgttggcatggggctggagacgcggaccgagacatggatgtccagcgagggcgcctggaagcacgcccagagaatcgaaacttggatcttacggcaccccgggttcacgatcatggccgcaattctggcgtataccatcggcacaacacatttccagcgcgctctgatcttcatcctcctcaccgctgtcgcaccttccatgacaatgcggtgcatagggatcagcaaccgcgattttgtcgagggcgtgtccggcggtagctgggtcgacatcgtgctggagcacggctcctgcgtgactacaatggccaagaataaacctacgctcgacttcgagcttataaagacagaggccaaacagcccgctacgctgcgcaagtactgcatcgaagcgaagctcacgaacacaaccaccgatagccgctgccctacgcaaggggaacccagtttaaacgaggagcaggacaagcggttcgtctgcaagcattcaatggtggaccgcggctggggcaacggttgcggcctatttggcaagggtggtatcgtgacctgtgcgatgttcacgtgcaagaagaatatggaaggcaaggttgtgcagcccgagaaccttgagtacaccatcgtgatcacgccccatagcggcgaagaacatgccgtcgggaatgatacgggcaagcacgggaaggagatcaagatcacccctcaaagctccatcaccgaggccgagttaacaggttacggcacggtgaccatggagtgtagtccacggacaggcctagatttcaacgagatggttctcctgcagatggaaaacaaagcctggctggttcaccgccagtggttcctcgacctgcccctgccctggctccctggcgcggacacccaggggcttaactggatccagaaggagacactcgtgaccttcaagaacccccacgcgaagaagcaggacgtggtcgtgctcggttcccaggagggggccatgcataccgccctgaccggcgccactgagatccagatgagcagcgggaacttactgtttaccggccaccttaaatgtcggttgcgcatggataaactgcagctgaagggcatgtcctacagcatgtgtaccgggaagttcaaggtcgtgaaggagatagccgagactcagcacggtactatcgtgatccgggtccagtacgagggggacggatcaccatgcaaaatacccttcgagataatggacctggagaagaggcacgtgctcgggcggctgatcaccgtgaacccgattgtcaccgagaaagacagccccgtgaatatagaggcggagcctccttttggggactcctacataatcatcggcgtggagccggggcagctaaagctcaattggtttaagaagggcagcagcatcgggcagatgatcgagaccacgatgagaggcgctaagcgcatggccatcttgggggacaccgcgtgggacttcgggagcttgggcggggtcttcacctccattggcaaagccctccaccaggtatttggtgcgatctatggagccgccttctcaggcgtgtcctggattatgaagatcctgatcggggtcatcatcacctggatcggcatgaacagccgatcgacgagcctgtccgtcagcctggtgctcgtcggggtggtgactctgtacctgggggtaatggtacaagccgactcagggtgcgtggtcagctggaagaacaaggaactcaagtgcggcagcggcatctttatcaccgacaacgtgcatacctggacggagcagtacaagtttcagcccgagagccccagcaagctggcgtccgccatacagaaggcgcacgaggagggtatctgcggcatccgtagcgtgacacgactggagaacctcatgtggaagcagatcacccctgagctgaaccacatcctgagcgaaaatgaggtcaagctgaccatcatgacgggagacatcaagggcatcatgcaggccgggaagcgcagcctgcagccgcaacccacggaactgaagtactcctggaagacctggggcaaggccaagatgctcagcactgagagtcacaaccagacgttcctgatagacggcccggagaccgcggagtgcccgaacaccaaccgggcctggaacagcctggaagtggaagactacgggttcggggtgttcacgacgaacatctggctcaagctacgcgagaagcaagacgtcttttgcgacagtaagctgatgagcgccgcgatcaaagataaccgggcagtacacgcggacatgggatactggatcgagtcagccctcaacgacacctggaagatcgagaaagccagcttcatagaggtaaaatcttgccactggccaaagagccatacgctgtggtccaacggcgtcctggaaagcgagatgatcatccccaagaacttcgcgggccccgtgtcccagcacaactacagaccgggataccacacccagaccgccggcccatggcacctcgggaagctggagatggacttcgacttctgcgagggcacaaccgtggtcgtgaccgaggactgtgggaaccggggcccctcactgcgcaccacaacggcgagcggcaagctcatcaccgaatggtgctgcagatcctgcaccttgcccccgctgcgctaccgcggtgaggacggctgttggtatgggatggagatccgccccctcaaggaaaaagaagagaatctggtgaattcactggtcactgccggccacgggcagatagacaacttctccctcggagtgctgggtatggccctgttcctcgaggagatgctgcgaactagggtggggaccaagcacgccatcttattagttgctgtgagcttcgtaaccctgataacaggcaacatgagcttcagagacctggggcgcgttatggtaatggtaggcgcaacaatgaccgacgacatcgggatgggcgttacatacctcgccctcctggccgccttcaaggtgcggcccacgttcgcggccggcctcctgctgcgcaaactcacctctaaggagttaatgatgacgaccatcgggattgtgctgctctcccagagcacgatccccgagaccatcttagagctgaccgacgccctagccctgggcatgatggtgctgaagatggttcgcaagatggagaagtaccagcttgccgtaaccatcatggccatcctgtgcgttccgaacgccgtgattctgcagaacgcttggaaggtctcctgcacgatcctggccgtggtgagcgttagccccctatttctgacctcgtcccagcagaaagccgactggatcccccttgcgctgaccatcaaggggctgaaccccaccgccatcttcctcacgaccctgagtcgtactaacaaaaaacgatcctggccgctcaacgaggccatcatggcggtgggtatggttagtatcttagcctccagtctgctgaagaacgacatccccatgaccggccccctcgtcgccgggggattgctgacggtctgctacgtgctcaccgggcgcagtgcggacctggagctagagcgtgccgccgatgttaagtgggaggaccaggcggagatcagtggtagctcccccatcttaagcatcacaatctccgaagacgggagcatgtccatcaaaaatgaggaggaggagcagaccctgacgatcctgatccggaccggactactggtgattagcgggctgttcccggtgagcatccccatcaccgcggccgcctggtacctttgggaggtcaagaagcagcgcgccggtgtcctctgggacgtgccctccccgccgcccgtcgggaaagcagaactggaagatggcgcctaccggataaagcagaagggcatcctggggtacagccaaatcggcgccggcgtctacaaggagggtaccttccataccatgtggcacgtaacgcgcggcgcagtcctgatgcacaaggggaaacggatcgagcccagctgggctgacgtgaagaaggacctgatttcctacggcgggggctggaagctggagggggagtggaaagagggagaggaggtgcaggtcttagccttggagccaggtaagaacccacgcgccgttcagaccaaacctggtctgttcaagaccaacgccgggacgatcggggcagtgagcctggacttctccccaggcaccagcggctcccccatcattgataagaaaggaaaggtcgttggcctttacgggaatggcgtggtcactagaagcggcgcctacgtctccgctattgcccagaccgagaagtccatcgaggacaatccggagatcgaagacgatatcttccgaaagcgcaagctcaccataatggacctgcaccccggggccggcaagacgaagaggtatctacccgcaatagtgcgggaggcgatcaagcgcgggctgcggaccttgatcctggccccgaccagggtcgtggccgccgagatggaggaggccctgcgcggcctgcccattcgctaccagacccccgcgatacgggccgagcacactggccgcgagatcgttgatctgatgtgccacgcaaccttcaccatgcgcctgctctcccccgtcagggtgccgaactacaatctgataatcatggatgaggcccacttcacagaccccgcaagcatcgcggcccgcggctacatcagcacgcgggtggagatgggggaggcagcggggatcttcatgacggccacgccgccaggctccagagatccgttccctcagagcaacgcgcccattatggacgaagagcgcgagatccccgagcgctcttggagctcagggcatgagtgggtcaccgacttcaagggaaagacggtgtggttcgtgccgagcatcaaggcagggaacgacattgccgcctgcttacggaagaatggcaagaaagtcatacagctctcccgtaagactttcgatagcgagtacgttaagacccgaaccaatgactgggatttcgtggtcacgaccgacatctccgagatgggcgcgaacttcaaggcggagcgcgtgatcgacccccggcgttgcatgaagcccgtaattctgactgatggggaggagagagtgattctggccggccccatgccggtgacgcattcttccgctgcccagcggcgggggcgcatcggccggaaccccaagaacgagaatgaccagtacatctacatgggagagcccctcgaaaatgacgaggactgtgcgcactggaaagaagccaagatgctgctggataacatcaacacacccgagggcatcatccccagcatgttcgagcccgagcgcgaaaaagtggatgcgatagacggcgagtaccggctccgcggggaggcccgcaaaaccttcgtagacctgatgcgtcgaggagacttacccgtgtggctggcctaccgggtggctgcggaggggatcaattacgcggaccggagatggtgcttcgatggcatcaagaacaaccagattcttgaggagaacgttgaggtggagatatggaccaaagagggtgagcgtaaaaagctaaagccgcggtggctcgatgcccgcatttactccgatcccctggcattgaaagaattcaaggaattcgcggccggacgcaaatccctcacactgaacctgattacggagatgggccgcctccccaccttcatgacccaaaaggcccgggacgccctggacaacctggcggtcctccacaccgccgaagcgggaggccgcgcctacaaccatgcgttatccgagcttcctgagacgctcgagactcttctgctcctgaccctgctcgcgaccgtaacgggcgggatcttcctgtttctgatgagcgggcgggggattggcaagatgaccctcgggatgtgctgcatcatcacggcctccattctgctgtggtacgcccaaatccaaccgcattggatcgccgccagcatcatcctggaatttttcctgatcgtgcttctcatcccagagcccgaaaaacaacgcacgccccaggacaaccagttgacctacgtcgtgatcgcgatcctcacggtggttgccgccaccatggccaacgagatgggcttcttggaaaagacgaaaaaggaccttgggttaggctccatcaccacgcagcagccggagagcaacatcctcgacatcgacctacggcccgccagcgcttggaccttatatgccgtggccaccacctttgtgacgcccatgctccgtcactctatcgagaacagctccgtcaatgtgagcttaaccgccattgctaaccaggcaaccgtgctgatgggactcgggaaggggtggcccctgagtaagatggacatcggagtcccgctcctcgcgataggctgctatagccaggtaaaccccatcaccctgactgctgccctgttcctcctggtggcgcactacgccatcattggaccgggactgcaggctaaggccacccgggaggctcagaaacgcgcggcggccgggatcatgaagaaccccaccgtcgacggtatcacggtgatcgacctagacccgattccctacgaccccaaattcgagaagcaactgggtcaggtgatgttgctagtactttgcgtgacccaggttctcatgatgcggacaacgtgggccctctgcgaggccctgaccctggcgacgggacccatctccaccctctgggagggcaacccaggacgtttctggaacaccaccatcgctgtatcgatggccaacatatttcggggcagttatctggccggcgccggcctcctcttcagcatcatgaagaatacgacgaacactcgccgcggaacggggaacatcggggagacgctgggcgaaaagtggaagtcccggctcaacgcactcggcaagagcgagttccagatctacaaaaagtccggtatacaagaggtggaccgcaccctggcgaaagagggtatcaagcgcggggagaccgatcaccatgccgtgagccgaggctctgctaagctccgatggttcgtcgagcgtaacatggtcacgcccgaaggcaaggttgtcgacctcggctgcgggcgtggcgggtggagctactactgtggggggctaaagaacgtgcgcgaggtgaagggcctgacgaagggagggcccggccacgaggagccaataccgatgtctacctacgggtggaatctcgtccggttacagagcggcgtggacgtgttcttcaccccgcccgaaaaatgtgacaccctgctctgcgatattggggagtcatcccccaaccctacggtcgaggcaggccgtaccctacgggtgcttaacctcgtggagaactggctgaacaacaacacccagttctgtatcaaggtcctgaacccgtatatgccctccgtgatcgagaagatggaggccctccagcgcaagtacgggggggccctggtgcgcaatccactgtcgcgcaacagtacccacgagatgtattgggtctcaaacgccagcggcaacatcgtgtccagcgtgaacatgatctcccggatgctaatcaacaggttcacaatgcgtcacaagaaggcaacgtacgaaccggacgtcgatctcggaagcggcacccgcaacatagggatagagtccgagattcccaatctagacatcatcggtaagcggatcgagaaaattaaacaagagcacgagacaagctggcattatgatcaggaccacccctacaaaacgtgggcgtaccacggaagctacgagacgaagcagaccgggagcgcctccagcatggtgaacggcgtcgtccgcctgctcaccaaaccgtgggacgtggtgcccatggtcacacagatggcaatgaccgacactaccccattcgggcagcagcgcgtgttcaaagagaaggtggacacccggacgcaggaacccaaggaaggcaccaaaaagctgatgaagatcaccgcggaatggctatggaaggagctcggcaagaagaagaccccgcgaatgtgcacgcgccaagagttcacccgcaaggtcagatccaacgccgcactgggcgccatctttaccgacgaaaataagtggaagtccgcaagggaggccgtggaagattcccggttctgggagctggtcgacaaagagcgcaacctccacctggagggcaagtgcgagacctgcgtttataacatgatgggtaagcgggagaaaaagctgggcgaattcgggaaggccaaggggagccgcgctatctggtacatgtggttgggcgcccgatttctggagttcgaggccctcggattcctaaacgaggaccactggttctcccgcgagaatagcctgtcaggcgtggagggggagggcctgcacaagttgggctacatcctgcgcgacgtctccaagaaggagggtggagccatgtacgcggacgacacggccggctgggacacccgcatcaccttagaggacctcaagaacgaagagatggtgactaaccacatggagggcgagcacaaaaaactggccgaggcaatcttcaagctgacgtaccagaacaaggtggtccgggtgcagcgccccacgccccgggggacggtcatggatataatcagccgccgagaccagcgcggctccgggcaggtcggcacctatggactcaacacgttcaccaacatggaggcccagctgatccggcagatggagggggagggtgtattcaaaagcatccagcacctgaccgtgaccgaggagattgctgtccaaaactggctcgcccgcgtgggacgcgagcggctgtcccgcatggccatcagcggtgatgactgcgtagtcaagcccctggacgaccggttcgcctccgcactcaccgcgctgaacgacatgggcaaggtgcgcaaggacattcagcagtgggaacctagccgggggtggaacgattggacacaagtgcccttctgttcccaccacttccacgagctgatcatgaaggacggccgcgtcctcgtggtgccttgccggaatcaggacgagctgatcgggcgcgcccggatatcacagggcgccgggtggtccctgcgcgagaccgcctgcctcggcaagagctacgcacagatgtggtccctgatgtacttccaccgtcgcgacctgcggctcgcggccaacgcgatctgcagcgccgtcccctcgcactgggtgccgacctctcgcacgacctggtctatccacgccaagcacgagtggatgacaaccgaggacatgctgaccgtatggaaccgtgtctggatccaggagaacccctggatggaggataagacgcctgtcgaatcgtgggaagagatcccctacttaggaaaacgcgaggaccagtggtgcggaagcttgataggactgacctcccgcgcgacctgggcaaagaacattcagaccgcgatcaaccaagtgcgctccttaattgggaacgaggagtatacggactacatgccgtccatgaagcggttccgcagggaggaagaggaagccggcgtcttatggtag

SEQ ID NO: 24937 - RNA, 9876 nt, synthetic construct
  misc_feature 1..9876: note = derived and/or modified CDS sequence (opt11) from DENV-2__FJ906968__SS-prME
  source 1..9876: mol_type = other RNA
accgccggtatgatcatcatgctgatacccacggtgatggctttccatctcaccacgcggaacggcgaaccccatatgatcgtaagccggcaggagaaggggaagtccctgttgtttaagaccgaggacggggtgaacatgtgcaccctcatggccatggacctgggcgagctgtgcgaggacaccatcacttacaagtgccctttcctcaagcagaacgagcccgaggatatcgactgttggtgcaacagcaccagcacttgggtgacttacggtacctgcaccaccacgggcgagcaccgccgggagaagcgtagcgtcgcgctggtgccccacgtgggcatgggtctggagacccggaccgagacctggatgtccagcgagggcgcatggaagcacgcccaacgcatcgagacgtggattttgcggcaccccgggttcactatcatggccgctatcctggcctacaccatcggcaccacgcactttcaacgcgccctgatctttattctcctgaccgcggtcgcgccgtccatgaccatgcggtgcattgggatcagcaacagggacttcgtggaaggcgtgtccggtgggagctgggtcgatatagtgctggagcacggctcctgcgtgaccacgatggccaagaacaagcctacgctcgacttcgagctcatcaagaccgaagcaaagcaacccgccacccttcggaagtactgcatcgaagccaaattaacgaacaccaccaccgacagtaggtgccccacgcaaggcgagccctccctgaacgaagaacaggataagcgtttcgtatgcaagcacagcatggtggaccgcggctgggggaatgggtgcggcctgttcgggaagggcggcattgtgacctgcgcgatgttcacgtgtaaaaagaatatgaagggcaaggtggtgcaacccgagaatctcgagtataccatcgtgatcacgccgcacagtggcgaggagcatgccgtcggcaatgatacaggtaagcacgggaaggagatcaagatcacccctcaatcttccatcactgaggccgagctgaccggctacggaacggtgaccatggagtgcagcccccggaccggcctggactttaatgaaatggtgctcctacagatggagaacaaagcctggttggtacatcgccagtggtttctcgacctgcccctaccctggttaccgggcgccgacacccagggctccaactggatccagaaggaaacgcttgtgaccttcaaaaacccgcacgcgaagaagcaggacgtggtcgtgctgggcagccaggagggagccatgcacaccgccctcacgggcgctacagagatccagatgagttccgggaacctactgttcacaggccacctcaaatgtcggctgcgcatggacaagctgcagctcaagggcatgagttactccatgtgcaccggtaagttcaaggtcgtgaaggagatcgccgagacccagcacggcacgatagtgatccgggtccagtacgagggggacggctcgccgtgcaagatacccttcgagatcatggacttggaaaaacgccacgtgttgggccggctcattaccgtgaacccgatagtcactgagaaggactcgcccgtgaacattgaggcggagccacccttcggggacagttacatcatcatcggcgtggagccgggccagttgaagctgaattggtttaagaagggctccagcatcgggcagatgatcgagaccacgatgcgcggcgctaagcgcatggccatcctcggcgacaccgcctgggacttcggatcactgggcggtgtcttcaccagcatcggcaaggcccttcaccaggtgtttggggcgatctacggcgccgccttctcgggcgtgtcatggattatgaagatcctcatcggggtgataatcacctggatcggcatgaactcaagaagcacgtccctgagcgtctccctggtgcttgtgggggtggtaaccctctacctgggcgtaatggtgcaggctgactcaggttgcgtggtaagctggaagaacaaggagctgaagtgcggcagcggcatcttcataaccgacaacgtgcacacctggacagaacaatacaagttccaacctgagagcccctccaagctcgcgtccgccattcaaaaagcccacgaggaggggatctgcggcatccggagtgtgacccgcctggaaaacctgatgtggaagcagatcactcccgagctcaaccacatcctgagtgagaacgaggtaaagctgacgatcatgacgggggacatcaagggtataatgcaggccggcaagcgctccctccagccgcagcccaccgagctgaagtattcgtggaagacctggggtaaggccaaaatgttatccaccgagagccacaaccagacgttccttatcgacgggcccgagaccgcagagtgcccgaacactaaccgggcctggaactcgctggaggttgaggactacgggttcggcgtattcaccacgaatatatggctgaagctccgcgaaaaacaagacgtgttctgtgactcgaagctgatgagtgccgcgatcaaggacaaccgagctgtacacgctgatatgggatactggattgagagcgcccttaacgacacatggaagatagagaaggcttcatttattgaggtcaagagctgccactggccgaaaagccacaccctctggagcaacgaggtgttagagtccgagatgatcatccccaagaacttcgccggcccggtgtcacaacataactaccgccccgggtaccatacccaaaccgctgggccctggcacctggggaagctagaaatggacttcgacttctgcgaggggacgaccgtggtcgtaaccgaggattgcggcaaccgtgggcccagtctgcgcaccacgactgcgtccgggaagctaataactgaatggtgctgtaggagctgcaccctaccccctctgcgctaccggggcgaggacgggtgctggtacggcatggagatacgccctctgaaggaaaaagaggagaacctcgtgaactccttggtcacggcggggcacggccagatcgataacttctcgctgggggtgctcggcatggctttgttcctggaggagatgctccgtacccgcgtgggcaccaagcacgccatcctgctggtcgcggtgtcgtttgtgaccctgatcacggggaacatgagctttcgagacctgggcagggttatggtgatggtgggggccaccatgaccgacgacattggcatgggggtgacatacctggccctcctagccgccttcaaggtgcgacccacgttcgctgccggcctgttgctccgtaagctgacctccaaggagctcatgatgaccaccatcggtattgtgctgctgagccaatccacgattcccgagaccatcctcgagctgaccgatgccctggcactcgggatgatggtcctgaagatggtgcgcaagatggagaagtaccagctggccgtaaccatcatggcgattctctgcgtccccaacgccgtcattcttcagaacgcctggaaggttagctgcacgatcctggcggtggtgtccgtcagccccctcttcctgacctccagccagcagaaggccgactggatccccctggcgctcactatcaaaggcttgaaccccactgcaatcttcctgacgaccctctcccgaacaaacaagaaacgcagctggccgctgaacgaggccatcatggccgtagggatggtttccatcctggcgtctagtttactgaagaacgacatccccatgaccggccccctggtcgccggtggattgctgacggtgtgctacgtgctgaccggaagaagcgccgacctcgaactggagcgcgcagccgacgtaaagtgggaggaccaagcagagatcagcgggtcctcccccatcctgagcataaccattagcgaagacggttccatgtcgatcaagaacgaggaggaggagcagatcctcaccatcctgatcagaacggggctgctcgtcatctcgggcctgttccccgtgagcatccccatcacggccgccgcctggtgcctgtgggaagtcaagaaacagcgagctggcgtgctctgggacgttcctagcccgccacctgtcgggaaagcggagctggaggacggcgcctacagaatcaaacagaaagggatcctgggctacagccagatcggagctggcgtttataaggagggcacttttcacaccatgtggcacgtaacccgtggagctgttctcatgcacaagggcaagcggatcgagccctcctgggccgacgtgaagaaggacctgatcagttacggcggagggtggaaattggaaggcgagtggaaggagggcgaggaggtgcaagtcctagcgctggagcccgggaaaaacccccgcgccgtacagactaagcccggcttgttcaagaccaatgccgggacgatcggcgccgtgtccctcgacttcagccccggaacatccggaagccccattatcgataagaagggcaaagtcgtagggctgtacggcaacggggtagtcacgcggtccggcgcgtacgtgagcgcgatagcccagaccgaaaagtccatagaggacaatcccgaaattgaggacgacatatttcgaaaacggaagttaacgattatggacctccaccccggcgctggtaagacgaagcgctacctgcctgccatagtgcgggaggcgatcaagaggggcttacggacgctgattttggccccgacccgcgttgtggccgccgagatggaggaggccctgcgggggttacctatccgctatcagaccccggcgatcagggccgaacacaccggccgcgagatcgtcgaccttatgtgccacgccacgtttaccatgcgtctgctgtcacccgtccgcgtgccgaactataacctcattattatggacgaggcccacttcaccgaccccgccagcatagctgctcgcgggtacatctccacccgggtggagatgggcgaggccgccggcatctttatgacggcgacgcctcccgggtctcgtgacccattcccccagtcaaacgcgcccatcatggacgaagaacgggagatccctgagcgaagctggtccagcggccacgagtgggttaccgactttaaggggaaaaccgtgtggttcgtgccgtccattaaggcgggcaacgacatcgccgcgtgcctgcgtaagaacggcaagaaggtcatccagctgagccgcaagacgttcgactccgagtacgtgaaaacccggaccaacgactgggacttcgttgtcacgacggatatcagtgagatgggcgcgaacttcaaggccgagcgcgtgatcgacccccggaggtgcatgaagcccgtgatcttaaccgacggagaggagcgggtcatcctggccggacccatgccggtgactcactcctcagccgcccagcgcaggggccgcattggtaggaatcccaagaacgagaacgaccagtacatctacatgggcgagccccttgagaacgacgaggactgcgcgcactggaaggaggccaagatgctcctggacaacatcaacactccagaggggatcatcccgtctatgttcgagcccgagcgggagaaagtggatgccatcgacggcgagtaccgtctgcgcggcgaggcccgcaaaacgttcgtcgatttgatgcgacgtggggacctacccgtgtggctggcctacagggtggcggccgagggaattaactacgcagatcgccggtggtgtttcgatgggatcaagaacaaccagatcctcgaggagaacgtcgaggtagaaatatggaccaaggagggcgaacgcaaaaagctcaagccgagatggttagacgcccgtatctacagcgaccctttggccttgaaggagttcaaggagttcgctgccggacggaagtcgctgaccctaaacctgatcactgagatgggccgcctccccacgttcatgacccagaaggcccgggacgccctcgataacctggcggtgttgcacaccgctgaggccggcggacgtgcttacaatcacgccctcagcgagcttcctgagaccctggagacgctcctgctgcttaccctgctggcgaccgtgacgggtgggatctttctcttcctgatgtccggccggggcatcgggaaaatgacgctaggcatgtgctgcatcataaccgccagcatcctactgtggtacgctcagatccagccgcattggatcgcggcctccatcattctggagttcttcctcatcgtgctgctgattcccgagcctgagaagcagagaacgccccaagacaaccagctcacctacgtcgtgatcgcgattctgaccgtagtcgccgcaacgatggcgaacgagatggggtttctggaaaagacgaagaaagacctcggcctcggtagcattaccactcagcaaccagagagcaacatactggacatcgacctccggcctgcctccgcctggacgctgtacgccgtagccaccacgttcgtgacccccatgctgcgccactcaatcgaaaattccagtgtcaacgtgagcctgacggccatcgcaaatcaggcgaccgtgctgatgggcctggggaaggggtggcccttatcaaagatggacatcggcgtccctctgctcgcaatcggctgctactcacaggtaaacccaatcacccttaccgccgcactgtttctgttagtggctcactacgcaatcataggccccgggctgcaggccaaagccacgcgggaggcccagaagcgggcggcggcaggcatcatgaagaacccgaccgtagacggcatcaccgtgatcgatctagacccgatcccttatgaccccaagttcgagaagcagctcggccaggttatgctgctggtcctctgtgtaacacaggtgctgatgatgcgaacgacctgggctttatgcgaagccctcaccctggcgaccggccccattagcacgttatgggaggggaatccgggccgcttctggaacacaaccatagccgtctccatggccaatatattccgggggtcctacctcgccggtgccggcctgttgttctccatcatgaagaacaccacgaacacccgccgaggtaccggcaacatcggggagaccctcggcgagaagtggaaatcccggctgaacgcgttgggcaagtccgagtttcaaatctacaaaaagtccgggatccaggaagtggaccgcacgttagcaaaggagggtatcaagcgaggggagactgaccatcacgccgtgtcccgcggtagcgccaagctgcggtggttcgtcgaacgaaacatggtgacccccgaggggaaggtcgtcgatctcggctgcgggcgcggcggctggtcctactactgcggagggctcaaaaacgtgcgcgaggtgaaggggctgacgaagggcgggccagggcacgaggaacccatcccgatgagcacgtacgggtggaacctagttcggctccagagtggggtggacgtgttctttacgccgcccgagaaatgtgacaccctcctgtgtgacatcggggagagctcacccaacccgaccgtcgaggcgggccgcacgctccgggtgctcaatctggtggagaactggctcaacaacaacacccaattttgcattaaggtgctgaatccctatatgccctccgtgatcgagaagatggaagcccttcagcgcaagtatgggggcgccctcgtgcggaaccccctgagccgcaactccacccacgagatgtactgggtctcaaacgcatccggaaacatcgtgagctccgtaaacatgatctcgcgcatgctgatcaaccggttcactatgcggcacaagaaggccacatacgaaccagacgttgacctgggctccgggacgcgcaatatcggaatcgagagcgagattcctaacctcgacatcatcgggaagagaatcgagaagatcaagcaagaacacgagacaagctggcactatgaccaagaccatccctacaaaacctgggcttaccacggcagctacgagaccaagcaaactggctccgccagctccatggttaacggggtggtccgcctgctgacgaagccgtgggacgtagtgcccatggttacccagatggccatgaccgacacgaccccgttcggccagcagcgcgtattcaaggagaaggtggacacccggacccaggaacccaaagaggggacgaagaagctcatgaagatcaccgccgagtggctgtggaaggagctaggcaagaagaagaccccgcgtatgtgcacacgagaggagttcaccaggaaggtcagaagcaatgccgcgctcggcgccatcttcaccgatgagaacaagtggaagtccgcccgcgaggcagtggaagactctagattctgggagctggtcgataaagagcgcaacctgcaccttgagggcaagtgcgagacctgcgtgtacaacatgatgggtaaacgggagaagaagctgggagagttcggcaaggccaaagggtcccgcgcaatctggtatatgtggttaggcgcccggttcttggagttcgaggcactgggcttcctcaatgaggaccactggttcagccgcgagaacagcttgagtggggtggagggcgaagggctacacaagctgggctacatcctccgggacgtcagcaagaaagaaggcggcgccatgtacgcggacgataccgcgggctgggacacgcgcataaccctggaggacctcaagaacgaggagatggtgaccaaccacatggagggggagcacaagaagctcgccgaagccatcttcaaattgacctaccaaaacaaggttgtccgtgtgcagcgccccactccccggggcaccgtgatggacatcattagccgccgggaccaacggggaagcggccaggtggggacatacggcttaaacaccttcaccaacatggaagcccagctcatccggcagatggagggcgagggggtgttcaagagtatccaacacctgaccgtgacggaggaaatcgccgtccagaactggctggcccgcgtgggacgcgagcggctcagccgaatggcaatctccggggacgactgcgtcgtcaagcctctagacgaccggttcgccagcgccttaaccgccctcaatgacatgggcaaggtgcgcaaggacatccagcaatgggagccatcccgcggctggaacgattggactcaggtgcccttctgtagccaccacttccacgagcttattatgaaggacgggcgcgttctagtagtgccctgccggaaccaggacgagctgattggcagggcccggatctcacagggagccggctggagcctgagggagacagcctgcctggggaagtcctacgcccagatgtggtctcttatgtacttccaccggcgcgacctgagattagcggctaacgccatctgttccgccgtcccgagccactgggtgccgacctcccgcaccacctggtctatccacgccaagcacgagtggatgaccaccgaagacatgctcaccgtgtggaaccgggtatggatccaggagaacccgtggatggaggacaagacccccgtggagagctgggaggagatcccctacctgggcaagcgcgaggaccagtggtgtggttcgctaattgggctcacaagccgtgccacctgggccaagaacatacagaccgccattaatcaggtgcgctccctgatcggtaacgaggagtatactgactacatgccgtccatgaagcggtttcgccgcgaggaggaagaggcaggggtcctttggtga

SEQ ID NO: 24938 - RNA, 9876 nt, synthetic construct
  misc_feature 1..9876: note = derived and/or modified CDS sequence (opt11) from DENV-2__FJ906969__SS-prME
  source 1..9876: mol_type = other RNA
accgccggcatgatcatcatgctgatccccaccgtgatggcgttccacctcacgacacggaacggcgagccccacatgatcgtctcacggcaagagaagggcaagagcctgctgttcaagaccgaggacggtgtgaacatgtgcaccctgatggcgatggatctgggcgagttatgtgaggacacaatcacatacaagtgtcccttcctcaagcagaacgagcccgaggacatcgactgctggtgcaactccacctccacctgggtgacatacgggacctgcaccaccacgggcgagcaccggcgggaaaagcgaagcgtcgccctggtgccccacgtagggatggggctggagacccgaaccgagacctggatgtccagcgagggcgcctggaagcacgcccagcgcatcgagacgtggatattacggcacccggggttcaccatcatggccgcgatcctagcctacaccatcggcactacacacttccagcgcgccctgatcttcatcctcctgaccgccgtcgccccctccatgacaatgcgatgcattggcatcagcaatcgcgacttcgtggagggcgtgtccggcgggagctgggtagacattgtgttggagcacgggtcctgcgtaaccacgatggccaagaataagcccacgttagacttcgagctgatcaagaccgaggctaagcagcccgccaccctccgcaagtattgcatcgaggccaaactcacgaacacgaccaccgatagccggtgcccaactcaaggggagccctccctgaacgaggagcaggacaagcggtttgtgtgcaagcacagcatggttgacaggggctggggcaacgggtgtggcctgttcgggaagggcgggatcgtgacctgcgctatgttcacgtgcaagaagaacatgaagggcaaggttgtgcagcccgagaacctggagtacacgatcgtcatcacgccccactccggcgaggaacatgccgtcgggaacgacaccggcaagcatgggaaggaaatcaagatcaccccgcagagctcgatcaccgaggccgagctgaccggctacgggacggtgaccatggagtgcagcccccggactggcctggacttcaacgagatggtgctcctacagatggagaataaggcttggctggtccacaggcagtggttcctcgaccttcccctgccctggctcccgggcgccgacacccaggggtccaattggatccagaaagagacgctggtgacctttaagaacccccatgcgaaaaagcaggacgtggtcgtcctgggaagccaggagggggcgatgcataccgcgctcaccggggccacggagatacagatgagctccgggaacctgttattcaccggtcacctcaagtgccgcctacgcatggacaagctgcagttaaagggaatgagctattccatgtgtactgggaagttcaaggtcgttaaggagatcgccgaaacccagcatggcacgatcgtaatacgggtccagtacgagggggacggctcgccctgtaagatcccgttcgagatcatggacctggaaaagcgacacgtgctgggccggctgatcacggtgaacccgatcgtcacagagaaggattcccccgtgaacatcgaggcggagccgcccttcggggacagctatatcatcatcggcgtggagccggggcagctgaaactgaattggttcaagaagggctccagcatcggccagatgttcgaaaccacgatgcgcggcgccaagcgcatggccatcctgggcgacaccgcatgggactttgggtccctgggaggggtcttcaccagcatcggcaaagccctgcaccaagtgtttggagccatctacggcgccgcattctccggggtgtcgtggataatgaagatcttaatcggtgtcatcatcacctggatcggcatgaactcccggtcaacgtccctaagtgtgtccctggtgctggtcggggtggtgaccctctacctaggcgtgatggtccaggccgacagcgggtgcgtggtctcctggaagaataaggagctgaagtgcggcagcggcatcttcataaccgacaacgtgcacacctggactgagcaatacaagttccagcccgagagcccctccaagctcgccagcgcaatccagaaggcccacgaggaggggatctgcggcattcgctccgttaccaggcttgagaacctaatgtggaagcagattacccccgagctgaatcacatcctgagcgagaacgaggtcaagctcacgatcatgacgggggacataaagggtatcatgcaggccgggaagcgctccctccagccgcagcccaccgagctgaagtacagctggaagacctggggtaaggccaagatgctgtccaccgagagccacaatcagacgttcctcatagacggccccgagacggcggagtgtccaaacacgaaccgggcctggaactctctggaagtggaggactacgggttcggcgtattcaccacgaacatctggctgaagctccgcgagaaacaggacgtcttctgcgacagcaaacttatgtccgccgccatcaaagataaccgcgccgtgcacgcggacatggggtactggatcgagagcgccctgaacgacacctggaagatcgaaaaagcctccttcatcgaggtcaagagctgccattggcccaagtctcacaccctctggagcaacggcgtgctggaatccgagatgataatccctaaaaatttcgcgggacccgtgagccagcacaattacaggcctgggtaccacacccagaccgcgggcccctggcacttagggaagctcgagatggatttcgacttttgcgagggcacgaccgtggtcgtgaccgaggactgcgggaaccggggccccagtcttcgcaccacgaccgcgtccggaaagctgatcaccgagtggtgctgccggagctgcaccctccctcccctacgctaccgaggtgaggacggctgctggtacgggatggagatccgccccctgaaggaaaaggaggagaacctcgtgaactccctggtgacggccggccacgggcagatagacaactttagcctgggcgtgctaggcatggccctgttcctggaggagatgctccgtacccgcgtggggaccaagcacgccatcctgctggtcgcggtttccttcgtgacgcttattacggggaacatgtctttccgggatctggggcgcgtcatggtgatggtgggcgccaccatgaccgacgacattgggatgggcgtcacctaccttgctctcctggccgccttcaaggtgcggcccacgttcgcggcaggcttattactgcgcaagctgacctccaaggaactcatgatgaccaccatcggtattgtgctgctgagtcaatcaacgatccccgagactatcttggagctgaccgatgccttggccctgggcatgatggtactgaagatggtgcgcaagatggagaagtatcagctcgccgtgaccataatggctatcctttgcgtccccaacgccgtgatcctgcagaacgcctggaaggtctcctgcacgatcttagccgtggtgtccgtgagccccctcttcctgacctccagccagcagaaggcagactggatccccctggcgctcaccatcaaggggctgaacccaaccgccatcttcctgacgaccctttcacgtaccaacaagaaacgcagctggccgctgaacgaggcgatcatggccgtgggaatggtgtccatcctggcgagctctctcctgaagaacgacatacccatgacgggccctctggtcgcagggggcctcctgacggtgtgctacgtactgaccgggcggagcgccgacctcgagttagagcgggctgcggatgtcaagtgggaggaccaggccgagatcagcggctcctcccccatcctgtccattaccatcagcgaggacggttccatgagcatcaaaaacgaggaagaggagcagatcctgacgatcctgatccggacggggttattggtaatctccggcctgttcccggtgagtatcccgatcaccgccgccgcctggtgcctctgggaggtcaagaagcagcgcgctggggtcctttgggacgtgcccagcccgcctcccgtcggcaaggcggaacttgaggacggggcatatcggatcaaacagaagggcatcctggggtacagccagatcggcgccggcgtgtacaaggaagggactttccacacgatgtggcacgtaacacgcggcgcggtattgatgcacaaaggaaagcgcatcgagccctcttgggcagacgtgaagaaggacctgatcagctacggcgggggctggaaactggagggggagtggaaggaaggggaggaggtgcaagtcctagcgctggagcccggcaagaacccccgcgctgtacagacgaagcccggactgttcaagacgaatgcaggtaccataggagccgtgtccctcgacttcagccccggcacatccggcagccccatcatcgataagaaagggaaggtcgtgggcctgtatgggaacggcgtggtcacgcggtccggcgcttacgtgagcgcgatcgctcagactgagaagtccatcgaggacaaccccgagatcgaggacgacatctttcgcaagcggaaactcaccatcatggacctccacccgggagccggcaaaaccaagcgctatctgcccgcaatcgtgagagaggcgatcaaacgcgggctgcgcacactgatcctagcgccgactcgcgtagtggccgccgagatggaggaggccctgagaggcctgcccatccgctaccagacccccgccatcagagccgagcacaccgggcgcgagatcgtagacctcatgtgccatgccacgttcaccatgcgcctcttaagccccgtccgggtgccaaactacaacttaatcataatggacgaagcccatttcactgaccccgcttctatcgcggcacgtgggtacatctccacccgggtcgagatgggcgaggccgccgggatctttatgacggccacgccacccggcagccgcgacccgttccctcagtcaaatgcgcctatcatggatgaagaacgggagatccctgagcgcagctggtccagcgggcacgaatgggttaccgacttcaagggcaagaccgtgtggtttgtgccctccatcaaggccggcaacgatatcgccgcctgcctgcggaaaaacggcaagaaagtgatccagctgagccgcaagaccttcgacagtgagtacgttaagacccggaccaacgactgggactttgtggtcaccacggacatcagcgaaatgggagcgaacttcaaggccgagcgtgtgatcgacccccgccgctgtatgaagcccgtgatcctcaccgacggagaggagagagtcatattggccggccccatgccggtgacccactccagcgcggcccaacgccgggggcgcatcggtcggaaccccaagaacgaaaacgatcagtacatctacatgggagagcccctggagaatgacgaggactgcgcgcattggaaggaagccaaaatgctcctcgataacattaacacccccgagggcatcattccgtccatgttcgagcccgagcgagagaaggtcgacgccatagacggcgagtaccggttgcgcggggaggcccgcaagacattcgtcgaccttatgcggcgcggcgacctgcccgtgtggttagcctaccgggtggcggccgaagggatcaactatgccgaccgccggtggtgctttgacggcatcaagaacaaccaaatactagaggagaacgtagaggtggagatctggaccaaggaaggggagcgaaagaaattgaaaccgcgctggctggacgcacgaatctattcggaccccctcgccctgaaggagttcaaggagttcgcggccggccgaaagtccctgaccctcaatctgatcacagagatgggccgtctgcccacgttcatgacccagaaggcccgggacgccctcgacaacctggcggtcctccacaccgctgaggctgggggccgggcctacaatcacgccctctcagagctccccgagaccctggagaccttactgctgctcacattgctggcgacagtgaccggaggcatcttcctcttcctgatgtcgggccgggggatcggcaagatgacgctcggcatgtgttgcatcataaccgcctctatcctcctgtggtacgcgcagatccagccgcactggattgcggcgtccatcatactggagttcttcctcatcgtgctgctgatccccgagcccgagaagcagcgaacccctcaggacaaccagctgacctacgtcgtaatcgccatcctgaccgtggtcgccgctacgatggcgaacgagatgggcttcctggaaaagaccaagaaggacttagggctgggcagcatcaccacccaacagcctgagagcaatatcctggatatcgacttgcggccggcttccgcctggacgctgtatgccgtggccacgaccttcgtgactcccatgctgcgccactctatcgagaactccagcgtaaacgtgagtctcactgctatcgccaatcaagcgacggtgctgatgggcctggggaaaggctggccattatcgaagatggatatcggggtcccgctgctggccatcggctgctactcccaggtcaatcccatcaccctcaccgccgccctgtttctgctcgtggcgcactacgccataatcgggcccggcctgcaggccaaggccactcgagaggcccagaagcgcgcggccgccggcattatgaaaaatcccacggtcgatggaattaccgtgattgacctggacccgataccctacgaccctaagttcgaaaagcagctcggccaggtgatgctgctggtcctctgcgtgacccaagtgctgatgatgagaacgacctgggccctgtgcgaggccctcacgctggccaccgggcccatcagcacactgtgggagggcaacccggggcgattctggaacaccaccatcgctgtttccatggccaacatcttccggggcagctacctcgccggcgctgggcttctgttctccatcatgaagaataccacaaacacccgacgcgggacagggaacattggggaaaccctcggcgagaagtggaagtcccggctgaacgcactgggaaaaagcgagttccagatctacaaaaagtccgggatccaggaggtggacaggacgctcgccaaggaggggataaagagaggggaaaccgaccaccacgccgtctcgaggggtagcgccaagctgcggtggtttgtcgagcgcaacatggtgaccccggagggtaaggtggtcgacctggggtgtggccggggcgggtggagttactactgcggcgggttgaagaacgtgcgggaggtcaagggccttacaaagggtgggcccggccacgaagaacccatccctatgagcacgtacgggtggaatctggtccggctccagtccggtgtggacgtattcttcacgccgcccgaaaagtgcgataccttgctctgcgacataggggagagcagcccaaatccgaccgtagaggcaggccgcacgttgcgtgtgttaaacttagtggagaactggctcaacaacaacacccaattttgtatcaaggtcctgaacccctatatgccctccgtgatcgagaagatggaggccttacagagaaagtacggcggcgctctcgtacggaaccctctgagccgcaactccacccacgagatgtattgggtcagcaatgcgtccggcaatatcgtaagctcagtgaacatgatctctcggatgctgatcaaccgtttcaccatgcggcacaagaaggccacctacgaacccgatgtcgacctggggtccggcacgagaaacataggtatcgaaagcgagatccccaacctggatataatcggcaaacggattgagaagatcaagcaagagcacgaaacctcctggcactacgaccaggaccacccctacaagacctgggcctaccacggcagctacgagaccaagcagacggggagcgcctcatccatggttaacggcgtggtccgccttttaaccaagccgtgggacgtggtgcccatggtcacccagatggccatgaccgacacgacccccttcgggcagcagcgcgtatttaaggagaaggtggacacccggacccaggaaccgaaggagggcacgaagaaactcatgaagatcaccgccgaatggctgtggaaagagctgggcaagaagaaaaccccgcgcatgtgcacccgagaagagttcacccgcaaggtccggtctaacgcagcgctcggagccatcttcactgacgagaacaagtggaaatccgcccgggaggccgtggaggacagtcggttctgggagcttgtcgataaggagcgcaacctgcacctcgagggcaagtgcgagacctgcgtgtacaacatgatgggaaagcgagagaagaagctgggcgagttcgggaaggccaagggctcccgcgcgatctggtacatgtggcttggcgcccggttcctcgagttcgaggccctggggttcctgaacgaggaccactggttttcgcgcgagaacagcctctccggcgtggagggggagggcctgcacaagctcgggtacatcctccgggatgtcagcaagaaagagggcggcgcgatgtacgcggatgacaccgccgggtgggacacgaggatcaccctggaagacctgaaaaacgaggaaatggtgacaaaccacatggagggcgagcacaagaagctcgccgaggccattttcaagctgacctaccaaaacaaggtggtccgggtgcaacggcctacgccccgtgggaccgtcatggacatcatctcccgccgggaccagcgcggtagcgggcaggtcggcacgtacgggctgaacacattcacgaacatggaggcccaactcatccggcaaatggagggtgaaggtgtgttcaagtccatacagcacctcacagtcaccgaggagatcgcggtccagaactggctggcccgagtggggcgcgagcggctgagccgcatggccatctctggcgacgactgcgtggtcaagccgctggacgaccggttcgccagcgccctgacagcgctcaacgacatgggcaaggtgcgcaaggatattcagcagtgggagccgtcccggggatggaacgactggacccaggtgccgttctgcagccaccactttcacgagctgatcatgaaggacggccgcgtcctggtggttccctgccggaatcaggatgagcttatcggacgcgcacggatatcccaaggcgcaggttggagtctgcgcgagaccgcctgcctgggcaaatcctatgcccagatgtggagcttgatgtacttccaccggcgcgatctccggctggcggccaatgcgatttgctcggccgtccccagccactgggtgccgacttcccgcaccacgtggagcatccacgcgaagcacgagtggatgaccaccgaggatatgctcaccgtgtggaatcgcgtctggatccaggagaatccctggatggaggacaagacccccgtggagagctgggaggagattccttacctgggcaagcgtgaggatcagtggtgcggatccctgattggccttaccagccgggcgacctgggctaagaatatccaaaccgccatcaaccaggtgcgctccctgattggaaacgaggagtacaccgattacatgcccagcatgaagcggtttcgaagggaggaagaggaggccggcgtcctatggtga

SEQ ID NO: 24939 - RNA, 9876 nt, synthetic construct
  misc_feature 1..9876: note = derived and/or modified CDS sequence (opt11) from DENV-2__FJ898454__SS-prME
  source 1..9876: mol_type = other RNA
acagcgggcgtgatcattatgctgatccccaccgctatggcgtttcacctcacaacccggaacggggagccccacatgattgtgagccgccaggagaagggcaagagcctgctgttcaagaccgaggacggggtgaacatgtgcaccctcatggccatggatcttggcgagctgtgtgaggacaccatcacttataattgccccttgctgcggcagaatgagccggaggacatcgactgctggtgcaactccacgtccacctgggtgacctacgggacctgcaccgccaccggcgaacatagacgcgagaagcggagcgtcgccctcgtgccccacgtgggcatggggctggagacccgcacagagacctggatgtctagcgagggcgcctggaagcacgctcagcggatcgagacgtggatactgcgtcaccctgggtttaccattatggccgccattttggcctacactattggcaccacctacttccagcgggtcttaattttcatcctactgacggctgtggccccctccatgaccatgcgctgcatcggcatctcgaaccgggacttcgtagagggggtctccggcgggagctgggtggacatcgtgctcgaacatggctcctgcgtcaccaccatggccaagaacaaacccacgctggatttcgaactgatcaagacggaggccaagcagcccgcgaccttgcggaagtactgtatcgaggcgaagctgaccaacaccaccactgccagccggtgccccacccagggagagccctctctgaacgaggagcaggacaagcgcttcgtgtgtaaacacagcatggtggatcggggctggggcaatgggtgcggcttgttcgggaaaggcgggatcgtgacgtgcgccatgtttacttgcaagaagaacatggaggggaagatcgtccaacccgagaacctggagtacaccatcgtggtcacgccccactccggcgaggagaacgccgtgggaaacgacacaggcaagcacgggaaggagatcaaggtgacgcctcagagctccattaccgaggccgaactaaccggctacgggaccgttacaatggaatgcagcccccgcaccggcctcgactttaacgagatggtgctgctccagatggagaacaaggcgtggctcgtacaccggcagtggttcctggacctgccactcccgtggctgccgggcgccgacacacaggggagtaactggatccagaaggagaccctggtcacattcaagaacccccacgcaaagaagcaggacgtggtcgtgctcggctcgcaggagggggccatgcataccgccctgaccggggcgaccgaaatccagatgagctccgggaacctcctgttcacgggccacctgaagtgtcgcctgagaatggacaagctgcagctgaagggcatgagctacagtatgtgcaccggaaaattcaaggtagtcaaagagattgccgagacccagcacggcaccatagtggtgcgcgtccagtacgaaggggacggtagcccctgcaagatccccttcgagatcatggacctggagaaacggcatgtcctcggccgcttaattacggtgaacccgatcgtcaccgagaaggactcccccgttaacatcgaggccgagccgccgttcggggacagctacataataatcggggtggagccggggcagctgaagctctcctggttcaagaagggcagctccatcggccagatgttcgagaccacaatgcggggcgccaagcggatggccatcctgggtgacacggcgtgggacttcggaagcctgggcggggtcttcacttccattggcaaggcactccaccaagtttttggtgccatctacggcgcggcattcagcggcgtgtcctggaccatgaagatactgatcggggtcgtgatcacctggatcggcatgaacagccgctctacgagcctgtccgtgagcttagtgctagtgggggtggtcacactgtaccttggcgtcatggtgcaggccgacagtgggtgtgtagtgtcgtggaagaacaaggagcttaagtgcggaagtggtatcttcatcaccgataacgtgcacacatggacggaacagtataagttccagcccgagtcccccagcaaactggcctccgctatccagaaggcatacgaggaggggatctgtggcatacgatcagtcacccgcctggagaaccttatgtggaagcagatcacccccgaactaaaccacatcctgtccgagaacgaggcgaagctcaccatcatgaccggggatatcaaggggatcatgcaggccgggaagcggagcctccgcccgcagcccaccgagctgaagtactcatggaagacctggggcaaagccaaaatgctctcaaccgagccccacaaccagacgttcttgatcgacggcccggagaccgctgagtgccctaataccaaccgggcctggaactccctggaggtggaggactacgggttcggcgtgtttaccacgaacatctggctcaagttaaaggagcgccaggacgtcttctgtgacagcaaattaatgtccgcggccatcaagaacaaccgggccgtgcacgccgacatggggtactggatagagagtgccctcaacgacacctggaaaatcgagaaggcgagttttatcgaggtcaagagctgccactggcccaagtcccataccctgtggagcaatggcgtgctggagtccgaaatgattattcccaagaacttcgccggcccggtgtcccagcataactaccgtcccgggtatcacacccagaccgcaggcccctggcacctcgggaagttagaaatggactttgacttctgcgagggcacgaccgtggtcgtcaccgaagactgcgggaaccggggccccagcctgcgcaccacgactgcctccggcaaactcatcaccgagtggtgctgccggagctgcacactgccgccgctgcgctatcgcggggaggacggctgctggtatgggatggagatccgccccctcaaagagaaggaggagaacctggtgaactccctcgtaacggcgggccacgggcagatcgataacttcagcctcggcgtgctgggcatggccctgtttctcgaggagatgctgcggacccgcgtcgggactaaacacgcagtcctgcttgtcgcagtgagtttcatgaccctgatcacgggcaatatgagcttccgggacctggggcgcgtcatggtgatggtgggagccgccatcaccgatgatatcgggatgggcgtcacctaccttgccctgctcgccgccttcaaagtgagacctaccttcgccgcgggcctcctgctgcggaagctcacgtccaaggagttgatgatgaccaccatcgggatcgtgttactcagccaatccaccatcccggagacgatcctggaactcaccgacgccctcgccttaggcatgatgatactgaaaattgtccgcaacatggaaaagtaccaactcgctgtcaccatcatggccacactgtgcgtcccaaacgcggtgatcttgcagaacgcttggaaggtgtcatgcacgatcttagccgtcgtgtccgtcagccccctgctactcaccagtagccagcagaaggccgactggatccccctagcgctgaccatcaaggggctcaatccgaccgctatcttcctgacgaccctgtcccggaccaataagaaacgctcatggcccttaaacgaagccatcatggccgtaggtatggtgtccatcctggccagctccttgctaaagaacgacatccccatgaccggccccttagtggccggcggactgctcacggtctgctatgtgttgaccgggcggtctgccgacctggagttggagagggccgcagacgtgcggtgggaggaccaggccgagatctcgggctcctctccgatcctgtctatcaccatatcggaggacggttccatgagcatcaagaacgaggaggaggagcagaccctgacgatcctcatccgcaccggcctgctcgtcatctccggcctcttccccgtgagcattcccatcacagccgccgcatggtacctgtgggaagtgaagaagcagcgggcaggggtcctgtgggacgttccctccccgccgcccgtgggaaaggcagagctcgaagacggggcctaccgcatcaagcagaagggcatactggggtactctcagatcggcgccggcgtctacaaggaggggaccttccacaccatgtggcacgtgacgagaggcgccgtgctgatgcacaaagggaagcgcatcgaacctagttgggccgacgtccggaaggacctcatcagctacggagggggctggaagctggagggggagtggaaggaaggggaggaggtacaggtgttagcccttgagcccggcaagaacccccgcgcggtccagaccaagcctgggctgttcaagacaaacactggcacgatcggggccgtgagtctagacttcagccctggcacctccggcagccccatcgtggacaagaagggtaaggtcgtgggcctctacgggaatggagtcgtcacccggtccggaacctacgtgagcgccatcgcccagactgagaagtccatagaggacaaccccgagatcgaggacgatatcttccgcaagaagcggctgaccataatggacctgcaccccggggctggcaagaccaagcgctacctgccggccatcgtgcgggaggcgattaagcgcgggctccggaccttaatcctggcgccgacccgcgtcgtggccgcggagatggaggaggccctccgcgggctgcccattcggtaccagacccccgcgatcagagccgagcacacggggcgggagatcgtagacctaatgtgtcacgcgaccttcacgatgcgcctgctgagcccggtccgggtacccaattacaacctgatcatcatggacgaggcgcacttcaccgaccccgccagcatcgccgcgcgcggctacatcagtacccgggtcgagatgggcgaggccgccgggatattcatgactgccacacccccgggcagccgcgacccattcccccagtccaatgcccctatcatggacgaggagcgggagatcccggagcgcagctggaactccggacacgaatgggttacggacttcaagggcaagaccgtgtggttcgtgccgagcatcaaggccgggaacgacatcgcggcctgcctccggaagaacggcaagaaagtcatccagctgtcccgcaagacatttgacagcgagtacattaaaacgcggaccaacgactgggacttcgtggtgaccaccgacatctccgagatgggtgccaactttaaggccgagcgcgtcatcgacccccggagatgcatgaagcccgtgatcctgacggacggggaagagcgcgtgattctagccggtccgatgcccgtcacccactcatccgcggcccagagacgcgggcgcatcggccgtaaccccaagaacgagaacgaccaatacatctacatgggggagccactggagaacgacgaggactgcgcccactggaaggaggccaagatgctgctcgataacattaacaccccagagggtatcatcccaagcatgttcgagcccgagcgggagaaggtggacgccatcgacggggagtaccgcttaaggggggaggcgcgcaagaccttcgtggacctgatgcggcgcggcgacctcccggtctggctggcctaccgggtggccgccgaggggatcaactacgccgaccgccggtggtgctttgacggcatcaagaacaaccagattctggaggagaatgtcgaggtcgagatctggacgaaggagggcgagcgcaaaaagctcaagccgcggtggttggacgcgagaatctactccgaccccctggccctcaaggagtttaaggagttcgcggcaggacgtaagtctctaacactgaacctcatcaccgagatgggccgcctgcccacttttatgacgcagaaagcgcgtaatgctttagacaaccttgccgtgctgcacacagccgaggccgggggccgcgcgtacaaccatgccctgtcggagctacctgagaccttagagacattgctactgctcacgctcctagcgaccgtgaccgggggcatattcctgttcctcatgagcggcaaagggatcggcaaaatgaccctgggcatgtgttgcatcatcaccgcctccatcctgctctggtacgcgcaaatccaaccccactggatcgcagccagcatcatccttgagttcttcctgatcgtgctcctcatccccgagcctgagaagcagcgaacccctcaggacaaccagctgacctacgtggtcatcgccatcctcaccgtggtggccgccaccatggcgaacgaaatgggcttcctggagaagacgaaaagagattttgggctaggctccatcgccacccagcagcccgagagcaatattctcgacatcgacctccgccccgcgtctgcctggaccctgtacgccgtagctactacgttcatcacccccatgctccgccactccatcgagaatagttccgtaaatgtgtcactgaccgccatcgccaaccaggcaaccgtcctcatgggcctcgggaaaggatggccgctgtccaagatggacatcggggtgccgctgctcgccatcgggtgctactctcaggtgaaccccatcacgctgaccgccgccctgctcctgctggtcgcccactacgccatcatcgggcccggtctacaggcgaaagccacacgggaggcccagaagcgcgccgccgcgggcattatgaagaacccgaccgtggacgggatcaccgtgatcgacctggaccccatcccctacgaccccaagttcgaaaagcagttgggtcaggtcatgctcctggtgctgtgcgtgacccaggtcctcatgatgcgcacaacctgggcgctgtgcgaagccctgacgctcgcgaccgggccgatctccaccctgtgggagggcaaccctgggcggttttggaacaccacgatcgccgtaagcatggcgaacatcttccgcggctcatacttggccggagccgggcttctgttctccattatgaagaacaccaccaacacgcggcgcggcacggggaacaccggcgagacactgggtgagaagtggaagaaccggctcaactccctaggcaagagcgagttccagatttacaagcgtagcgggatccaggaggtggaccgcacgctggcgaaagaagggataaagcgcggcgagacggatcaccacgcggtcagtcgggggtccgcaaaactgcgctggttcgtggagcggaatctggtaacacccgagggcaaggtcgtggacctcggctgcgggcgcggcgggtggtcatattactgcggcgggctgaagaacgtgagggaggtcaagggcctgaccaagggcgggcccggtcacgaggagccaatccctatgtccacctatgggtggaacctggtgcgccttcagagcggagtggacgtcttcttcacgccgccagagaagtgcgacaccctgctgtgcgatatcggggagtccagcccgaaccccaccgtggaagccggccggaccctccgcgtgctgaacctcgttgagaactggctcaacaacaacacgcagttctgcattaaagtgctgaacccatatatgccaagtgtcattgagaagatggagactctacagcggaagtatggcggcgcactggtccgtaaccccttatcccggaacagcacccacgagatgtactgggtgtccaacgccagcggcaacatcgtgtcctctgtcaatatgatctcccggatgctaattaaccgcttcacgatgcgccacaagaaggcaacctacgagccggacgtggacctggggagcggcacgcgcaatatcgggatcgagtccgagacgcccaacctggacatcataggtaagcgtatcgagaagatcaagcaggaacatgagacctcatggcactacgaccaggaccacccttacaagacgtgggcttaccacggctcctacgagacgaagcagaccgggagtgccagcagcatggtaaacggcgtcgttcgcctgcttaccaagccctgggatgtgatccccatggttacccagatggccatgacggacaccacaccgttcgggcagcagagggtgttcaaggagaaggtggacaccagaacgcaggagccgaaggaaggcacgaagaagctcatgaagatcaccgcagagtggctgtggaaagagctgggcaagaagaagacgccccgtatgtgcacgcgcgaggagttcacccggaaagtcagatccaacgcggccctcggggccatcttcaccgatgagaacaagtggaagtccgctagagaagccgtagaggactcccgcttttgggagctggtcgacaaggagcggaacctacacctcgagggcaagtgcgagacctgcgtgtacaatatgatggggaagcgggagaagaagatcggcgaattcgggaaagcgaagggcagccgggccatctggtacatgtggctaggcgcccgattcctggaattcgaggccctcgggttcctgaacgaagaccactggttctcacgggagaacagcctcagcggcgtggagggggagggcctacacaaactggggtacatcctgcgcgaagtctccaagaaggaaggcggcgcgatgtacgccgacgacaccgccgggtgggacacccggatcaccctagaggatctgaagaacgaggagatggtgaccaaccacatggaaggcgagcacaagaagctggccgaggccatcttcaagctcacttaccagaacaaggtcgtcagggtgcagcggcccacgccccgggggaccgttatggacatcatctcgcgccgggatcaacgcggctccgggcaggtgggcacctacggcctgaatacgttcaccaacatgggggcgcaactgatccggcagatggagggcgagggagtgtttaagggaatccagcatctgaccgccaccgaggaggtggccgtccaggactggcttgctcgcgtgggccgggagcgcttgagccggatggccatcagcggggacgactgcgtggtcaagccgctcgacgaccgcttcgcctcagccctgacggcgctgaacgacatgggcaaaatccggaaagacatccagcagtgggagccctcccgcgggtggaacgactggacccaggtgcccttctgtagccaccactttcacgagctcatcatgaaggacgggcgggtgctggtcgtcccctgccgcaaccaggacgagctgatagggcgggcacgcatctcgcagggcgccggctggagcctccgggagaccgcgtgcctggggaagtcctacgcccagatgtggagcctcatgtacttccaccgcagagatctccggctggctgccaacgccatctgctccgcggtgccgagccactgggttcccacctccaggactacgtggtccatacatgcccgccacgagtggatgaccactgaggacatgctgaccgtgtggaaccgcgtgtggatccaggagaacccctggatggaggataagacgcccgtcgaatcctgggaggaaattccgtacctcggcaagcgggaggaccagtggtgtggtagccttatcgggctgacctcgcgcgccacctgggccaagaacattcagacggcgatcaaccaggtgcggtccctcattgggagcgaggagtacacggactacatgccgtccatgaagcgcttccgccgcgaggaggaagaggccggcgtactgtggtga

SEQ ID NO: 24940 - RNA, 9876 nt, synthetic construct
  misc_feature 1..9876: note = derived and/or modified CDS sequence (opt11) from DENV-2__JQ922551__SS-prME
  source 1..9876: mol_type = other RNA
accgtggggatgataatcatgctcatccccaccgcaatggcattccacttaaccaccagaaatggcgaaccccacatgattgtcagcaggcaggaaaagggtaagtccttactatttaagaccgaggacggggtaaatatgtgcaccctcatggcgatggacttgggtgagttatgcgaggacaccataacctacaactgccccctcctgaagcaaaatgaacccgaggacatcgactgctggtgcaacagcacctctacctgggtaacgtacgggacatgtaccgccacgggtgagcaccggcgggagaaaaggagcgtcgcgctagtgccccacgtgggcatggggctcgaaacccggacggagacctggatgagctcagagggagcatgcaagcacgcacagcggatcgaaacctggatcctgcggcatccgtcatttacgatcatggcggcaatcctggcctataccatcgggaccacgtatttccagcgcgtcgttttcctcatggtgctaaccgcagtcgcgctaagcatgacgatgagatgcatcgggatctccaatcgagacttcgtagagggggtgtctggagggtcctgggtcgacatcgttcttgagcacgggtcttgcgtaaccaccatggccaagaacaagcccacgctcgacttcgagctgatcaaaaccgaggccaagcagcccgccactctccggaagtactgcatagaggccaagctgaccaacactacgaccgcttcccgttgtcccacccagggcgagccgagcctgaatgaggagcaagataagcggttcgtgaggaagcactcgatggtggaccgcggttggggcaacggctgcggcttattcgggaagggcgggatcgttacgtgcgccatgttcacgtgtaagaaaaacatggaggggaaaatcgtccaacccgagaacctggagtatacgttagtgataacgccccatagcggcgaggagaacgccgtgggcaatgacacgggcaatcacggcaaggagatcaaggtcacgccccagtcctcgatcaccgaggccgccctcaccgggtacggcaccgtgacgatggaatgcagtccgcgcaccgggctaaacttccacgagatggtgtcgttacccatggagaataaggcgtggatggtacacaggcagtggttcctcgacctgccccttccctggctccctggcgccgacacacaaggtagcaactggatccagaaggagactctcgtgaccttcaagaacccgcatgccaagaaacaagacgtcgtagtgctggggtctcaagagggcgccatgcacaccgctctcaccggggcgaccgagatacagatgagctccggtaatctgctgttcacggggcacctgaaatgtcgccttcggatggacaaacttcagctcaaggggatgtcttacagcatgtgcaccggcaagtttaaagtcgtgtggggaattgctcgaacccagcacggcaccatcgtgcaccgggtccaatacgagggagacgggagcccctgcaaaataccactaaacataatgggcctggagaagcgccacgtgttaggccgcccgataacggtgaaccccatcgtaaccggcaaggactccccagtgaacatcgaggccgagccgccgctgggtgacagctacatcatcatcggcgtggagccagggcaggttaaattgacatgctcacagaagggcagctccatcggccagatgttcgaaaccaccatgcgcggcgcgaagcgtatggcgatcttaggcgacaccgcctgggacttcggaagcctgggcggggtgttcacctcgatcggcaaggccctgcaccaagtatttggtgccatatacggggccgcattcagcggcgtgagctggactatgaagatcctcatcggtgttgtgatcacgtggatcggcatgaacagccgctctaccagcctgtcggtcagtctcgtgttggtcggggttgtgacgctctacctgggcgtgatggtacaagctgactcgggctgtgtggtgtcctggaagaacaaggagctgaagtgcgggagcggcatattcgtcacagacaatgtgcacacgtggaccgagcagtacaagttccaaccagagtccccaagcaaactcgcctctgccatccaaaaggcccacgaggaagggatctgcggcatacgcagcgtgacgcgcctggagaacctcatgtggaagcagatcaccccggagctcaaccatatcctgtcggagaacgaggtcaagctgacgataatgaccggggacattaagggcataatgcaggcaggtaagcgcagcctacggccacagccgactgagctgaagtactcctggaaaacctgggggaaggccaaaatgctgtctacggagccgcacaatcaaaccttcttgatcgacgggccagagaccgcggagtgtccctccactaaccgcgcctggaacagcctgaagggcggggactacggcttcggggtgttcacgaccaacatctggctcaagttgaaggaacggcaggacgtgtcctgcgattctaaacttatgtccgccgcaatcaaggacaaccgtgccgtccacgctgacatgggctactggatagagagcgccctgaacgatacctggaagatcgagaaagcgtccttcatcgaggtcaaatcatgccattggcccaagtcacacacgctctggtccaacggggtgctcgagtccgaaatgatcatacctaagaacctggcgggccctgtgtcccagcacaactaccgaccggggtaccacacccaaaccgcgggcccctggcacttaggcaagctggaaatggacttcgacctgtgtgaggggaccaccgtcgtggtcactgaggactgcggtaaccgcgggcctagcctcaggactacgaccgcctccggtaagctgatcaccgaatggtgctgtcggagctgcactctgccacccctccggtaccgcggtgaggacgggtgctggtatggaatggagatccggccattaaaggaaaaggaggagaacttagtgaactccttggtgaccgcagagcatgagcagatcgacaatttctcgcttggggtcctgggtatggccctctttctggaggagatgctgagaacaagagtcggcaccaagcacgccgtgctcctggtcgctgtgtcctttatgacactgatcaccggcaacatgtcattccgggacctcgggagagttatggtcatggtgggtgccgcaatgactgacgacatcggtatgggggttacctacttggcgctgttagcggcattcaaggtccggccgacgttcgccgctggcctgctgctccgcaagctaacctccaaggaactgatgatgaccaccatcggtatcgtcctcctgagccagtctacgatccccgagaccatcctggagctcaccgatgcgcttgctctgggtatgatgatcctcaagatcgtccgaaacatggaaaaatatcagctggccgtgaccatcatggcaatcctttgcgtgcccaacgccatgatcctccagaacgcttggaaggtctcctgcacgatcctggccgtggtatccgttagccccctactcctcacctccagccaacagaaggcagattggataccgcttgccctcaccatcaagggcctgaaccccaccgcgattttcctgacaaccctcagccgcaccaacaagaagcgcagctggcctctcaatgaggctatcatggcggtggggatggtcagcatcctggcgtccagcctcctgaaaaacgacataccgatgaccggccccctggtcgccgggggccttttgacagtgtgctatctgctccccgggcgctccgccgacctggagttagagcgggccgcagatctccgctgggaggatcaagcagagattagcggctccagcccgatcttatccatcaccatcagcgaggacgggtccatgagcattaagaaccaggaagagaagcagactctgactatcttgatcaagacggggctgctggtgatttcagagctattcccagtacagatcccgattaccgctgccgcatggtacctgtgggaagtgaagaagcagagggccggggtgctgtgggacgtacccagcccgccgccggtggggaaggcagaactcgaggacggcgcctacgggatcaaacagaagggcatcctgggctactcccagataggggcgggagtgtacaaagaggggaccttccacacgatgtggcatgtcacccgcggggccgtgctgatgcacaagggtaagcggattgagcccagctgggccgacgtgcgtaaggacctcattagctatggcggcgggtggaagctggagggagaatggaaggagggagaggaggtccaggtgctggccctggagcccggcaagaacccccgggccgtacagactagacccggactgttcaagaccaataccggcaccataggggcggtcagcctggacttttctcccggaacgtcagggtcgccaattgtggataaaaagggtaaagtggtcggcctctacggcaatggggtggtgaccagaagtggcacctatgtctcggcaatcgcgcagacggagaagtccatcgaggacaacccagagattgaggacgacatcttccgcaagaagcggctcacgatcatggacctgcaccccggggcgggcaagaccaaaagatatttacccgcgatcgttcgggaagccatcaagcgcgggttacggaccctgatactggctcccacccgagtggtcgccgctgaaatggaggaggcgttgcgtggtctgcctatccggtaccagacacccgccatacgcgcagagcacaccggccgcgagatcgttgacctgatgtgtcatgctaccttcaccatgcgccttctctcgcctgtgagagtcccaaactacaacctgatcattatggacgaggcccacttcacggacccggcgtcaatcgctgcccgcgggtacatctctacaagagtggagatgggagaggccgccggcatattcatgaccgcgacgccgcccggctcccgtgaccccttcccgcagtccaacgcccccatcatggatgaggaaagagagatccccgagcgctcctggaacagcgggcacgagtgggtgacggacttcaaaggcaagaccgtatggtttgttcccagtataaaggcggggaacgacatcgccgcgtgcctcagaaagaacggtaaaaaggtgatccagttaagtcgcaagacgtttgactcagagtacatcaagacacggactaatgactgggactttgtcgtgaccactgatatctcggagatgggcgccaattttaaggccgagcgggttatcgatccgcgccgctgcatgaagcccgtaatcctgaccgacggggaggagcgggttatcctagcgggccccatgccggtgacccactccagcgccgcacaacgccgaggccgcatcggccgcaatccgaaaaacgagaacgaccagtatatctacatgggcgagccgcttgagaacgacgaggactgtgcccactggaaggaggccaagatgctgctcgacaatattaacacccccgaagggatcataccctccatgttcgagcccgagcgggagaaggtagacgccatcgacggagagtatcgcctgcgaggcgaagcccgcaaaaccttcgtggacttaatgcgtcgtggagacctccccgtgtggctggcttatcgggtggccgcagaggggattaactacgctgaccgccgttggtgcttcgatggcatcaaaaacaaccaaatcttggaggagaacgtcgaggtcgagatctggaccaaggagggcgagaagaaaaagttgaagccccgctggctggacgccagaatctacagcgaccccctggctctcaaggagttcaaggagttcgccgctgggcgcaaatccctgactcttaatctcatcaccgaaatgggcaggctgccaaccttcatgacccaaaaggcgcgcaacgcgctggacaacctcgcggtgctacacactgccgaggctgggggccgggcctacaatcatgcgctgagcgagctccccgaaacactggagaccctgttgctgctgaccctcttggccactgtgacgggcgggatcttcctgttcctgatgtccggcaaggggatcggcaagatgactctagggatgtgttgcatcattacagccagcatcctgctttggtacgcccagattcagccgcactggatcgccgcgtcaatcattctggagttcttcctaatagttctcctgatcccggagcccgaaaagcaacgtacgccccaggacaaccagctgacgtacgtggtaatcgctattctcaccgcagtcgccgccaccatggctaatgaaatgggcttcctggagaaaaccaagaaggacttcggactcggttctatcgccactcaaccacccgagagtaatatcctcgatatcgacctgcggcctgcctccgcctggaccctctacgctgtggctaccacgttcatcacctccatgctgcgccatagcatcgagaacagctccgtgaacgtcagcctgactgcgatcgccaaccaggccacggtgctgatgggcctcgggaagggttggcccctgtccaagatggatatcggggtgcccctcctcgcgattggctgctacagccaggtcaacccgattaccctgacggccgcgctgctcctgctggtggctcattatgccatcatcggcccagggctccaagcgaaggcgacccgggaggcccagaagcgtgcagcggccggcataatgaaaaatcccaccgtggacgggataacagtcatcgacttggatcccatcccgtacgaccccaagttcgagaagcaactgggccaggtgatgcttctggtgctatgcgtgacccaggttctcatgatgaggaccacctgggccctttgtgaggccctgaccctcgcaactgggcccatctccacattgtgggagggcaatcccggccggttttggaacaccaccatcgccgtgagcatggcgaacatcttccgggggtcctacctggcgggggccgggctgttgtttagcattatgaagaacacgaccaacacccggaggggcacggggaatacgggggagaccctgggcgaaaaatggaaaaacagacttaacgccttggggaagtccgagttccagatatacaagaaatccggcatccaggaagtcgacagaaccctggcgaaggaggggattaaacggggcgaaaccgaccatcatgccgtgtcccgcggatcagccaagctccggtggttcgtggaacgcaacctggtcaccccggaggggaaggtcgtcgacctgggatgtgggcgtggcgggtggtcctactattgcgggggcctcaagaacgtaagagaagttaaggggcttacgaaaggagggcctggccacgaggagcccatccccatgagcacttacgggtggaacttagtccggctacagagcggcgtcgatgtgttcttcacaccacccgaaaaatgcgatacgttgctgtgcgacatcggcgagtcctcaccaaacccgacagtggaggccggtcgcacgctccgggtcctaaacttagtggagaactggctgaataacaatacgcagttctgcgtgaaggtactcaacccctacatgccctccgtaatcgagaaaatggaaacactgcagcgtaagtacggaggggcgttggtgcgtaatcccctcagccgaaattcgacgcacgagatgtactgggtctctaatgcgtccggcaacatcgtgagctccgtcaacatgatctcgagaatgctgatcaatcgtttcaccatgcggcacaaaaaggccacctacgagccggacgtcgacctgggatccggcacgagaaacatcggcattgagagcgagactcccaacctcgacattatcggaaagaggatcgagaagattaagcaagagcacgagacttcctggcactacgaccaggaccatccttacaaaacgtgggcctaccacggcagctacgagaccaagcagacggggtcggccagctcaatggtgaatggcgtggtccggctcctgaccaagccctgggacgtgatccctatggtcacccagatggccatgaccgacacaaccccctttgggcagcagagagtctttaaggagaagtccgacacccgcacgcaggagcccaaggagggaacgaagaaattgatgaagatcacccccaagtggctgtggaaggagctgggtaaaaagaagacgccgcgaatgtgcacccgggaggagttcacgcgtaaagttcgtagcaacgctgccttaggggccatattcaccgatgagaataagtggaagtccgccagagaggccgtggaggattcccggttctgggagctggtcgacaaggaacgaaacctgcacttagagggtaagtgcgagacatgcgtgtacaacatgatgggcaagcgagagaaaaagctgggtgagttcggaaaggcaaaggggtctcgcgccatatggtatatgtggctaggagcccggtttctcgagttcgaggccctgggtttcttaaatgaggaccattggttcagtcgggaaaattccctcagcggcgtcgagggcgagggactgcacaagctaggatacatcctccgggacgtgtcgaaaaaggaaggcggggcgatgtacgccgatgacaccgcggggtgggacacgcgaataaccctggaggacctgaagaacgaggagatgggcgccaaccaccttgaaggggagcccaagaagttatacgaggccatcttcaagttaacgtaccagaacaagggcgtgcgggtccaacgcccgacgccccggggcccgttaatggacatcattctgcgccgggatcaaggcgggtcaggacaagtgggcacttatggtttgaataccttcaccaatatgggggctcagctgatccgccagatggaaggcgagggagtctttaagggcatccagcatctgatcgccactgaggaaatcgccgttcaggactggctcgcgcgcgttgggcgggagcgtttctcccgtatggccatcagcggcgacgattgcgtcgtgaaacccctcgacgacaggtttgcgtcggctctgacggccctgaacgatatgggcaaggagcggaaggtgttacagcagtgggagcccagccgtgagtggaacgactggacgcaagtacccttttgcagccaccacttccacgaactaatcatgaaagacgggagagtcctggtcgttccgtgccgaaatcaggatgagctcatcggcagagcccggatcagccagggggccggctggtccctgcgggagaccgcgtgcctgggcaagtcatacgcccagatgtggtcccagatgtactttcatcgccgggacctccgcctagccgccaacgcgatctgcagcgcggttccctcccattgggtacccaccagccggacgacttggagcatccacgcccgccatgaatggatgaccaccgaagacatgctgaccgtctggaacagggtctggatccaagaaaacccatggatggaggacaagacgccggtggagtcctgggaggagatcccctacttgggcaagcgcgaggaccagtggtgtggatcactgataggcctgacgagtcgggcgacttgggccaagaacattcagaccgcgattaaccaggtacgcagcctcattggcaatgaggagtataccgattacatgcccagtatgaagcgcttcaggcgcgaggaagaggaggccggcgtactgtggtga

SEQ ID NO: 24941 - RNA, 9876 nt, synthetic construct
  misc_feature 1..9876: note = derived and/or modified CDS sequence (opt11) from DENV-2__JQ922550__SS-prME
  source 1..9876: mol_type = other RNA
accgttggtatgatcatcatgttaattcctacggtgatggctagccacctcaccacgcggaacgggggcccccatatgatcgtgatagggcagcagaagcgcaagacctccttcttcaagaccaagaaaggccacgacatgtgcacgctaatggccatggcgttcggggagttctgcgagaacaccataacttacaagtgcccctttctgaagcagaacgagcccgaggacatcgactgttggtgcaacagcaccagcacctgggtgacctacgggacctgcacgacaacgggcgagcaccggagagaaaagcggagcgtcgccctcgttccccatgtggggatgggcttggagacccggaccgagacatggatgagcagcgagggcgcctggaagcacgcgcagcgcatcgaaacctggatcctgaggcaccccgggttcaccataatggccgcaatcctcgcctacaccataggaacgacccactttcagcgcgtgctgattttcatcctgttaaccgccatcgctccgtcaatgaccatgcgatgcatcggcatcagcaaccgcgacttcgtggaaggagtgtccgggggcagctgggtcgacatcgttctggagcacgggtcctgtgtgacgaccatggcgaagaataagccgacactggacttcgagttgatcaagaccgaagcaaagcagcccgccacgttaaggaaatactgtatcgaggccaagctgaccaacaccactaccgacagtcgctgccccacccagggcgagccaaccctaaacgaggaacaggacaagcggtttgtgtgcaaacattccatggttgaccgcggctggggaaacggctgcggattgttcggcaagggcggaatcgtgacgtgcgccatgttcacctgcaagaagaacatgaagggcaagatcgtccagcccgagaacctcgagtataccgtggtgataacaccacacagcggggaagagcacgccgtcggaaacgacaccgggaaacacggcaaggaggtgaagatcaccccccaatcgagcatcacggaagccgagctaaccgggtacggcaccgtaaccatggagtgcagtccccggaccggtttagacttcaacgaaatggtgctgctccagatggaagacaaagcctggttagtgcaccgccagtggttcctggacctccccctgccctggcttccgggggccgatacccaaggcagcaactggatccagaaggagaccctcgttacatttaagaacccccacgccaagaagcaggacgtcgtagtactgggtagtcaggaaggggcgatgcatactgccctgaccggggccactgagatccaaatgtcgagcggcaacctcctcttcaccggccacctgaagtgccggctccgtatggacaagctgcagctgaaggggatgtcctacagcatgtgcaccggcaagttcaaggtggtgaaggaaattgccgagacccagcacgggaccatcgtcatacgggtgcagtacgagggggacggatccccctgcaagatccccttcgaaatcaaggacctcgaaaagcgtcacgtgttggggcggcttattaccgtcaacccaatcgtaacagagaaggatagtcccgtcaacattgaagcagaaccgccccttggcgactcctacatcatcatcggagtcgaaccgggccagctgaagctcgactggttcaagaagggatcatccatcggccagatgttcgaaaataccatgcgcggtgctaaacgcatggccatcctcggggacaccgcctgggacttcggaagcttaggcggggtgttcacctccatcgggaaagctctgcaccaggtgtttggggccatctacggcgctgcgttcagcggggtctcctggacgatgaaaatcctcatcggcgtcatcatcacttggatagggatgaatagccggtccaccagtctgtccgtgtccctggttcttgttggcatcgtgaccctgtacctgggggtaatggtgcaggccgactccggctgcggcgggtgcgagcgcaagacaaagacaaagtgcgggagcggtattttcgtcaccgacaacgtacacacgtggactgagcagtacaagtttcagccggagtccccgagcaagctggccagtgccatccagaaggcccatgaggaggggatctgcggtatccgctccgtgactcgcttagagaacctcatgtggaaacagataacacccgagctgaaccacatcctcagcgagaacgaagtgaagctgaccatcatgaccggcgacatcaaaggcataatgcaggccgggaagcggagtctgcgcccgcagcccaccgagctccgatacagctggaaaacctggggcaaggccaagatgctttccaccgaactgcacaatcaaaccttcctgatagatgggcccgaaaccgcagagtgcccaaacaccaaccgcgcttggaatagccttgaagtagaggattacgggttcggcgtgttcaccaccaacatctggcttcgcctccgcgagaagcaggacgtcttttgcgattcgaagctgatgagcgcagctatcaaggacaaccgggcggtccacgccgacatggggtattggatagagtccgcgctgaacgacacgtggaagatcgagaaggccagcttcatcgaagtcaagagctgccactggcccaaaagccacactttatggggtaacggggtgctggagtccgaaatggtcatccccaagaacttcgccggccctgtgagccagcacaacaaccgcccggggtactacacccagaccgctgggccctggcacctgggcaagctcgagatggacttcgacttctgcgagggaacgactgtggtcgtgaccgaggattgcggcaaccgggggccttccctgcgcaccaccaccgcctccggcaagctgatcaccgagtggtgctgtcggagctgcacacttccgcctcccaagtaccgcggggaggatggctgctggtacggtatggaaatacggcccctgaaagagaaggaagagaatctagtttcgagcctcgtcaccgcggggcatggccagatcgacaacttctcactggggattctgggcatggccctcttcctggaggagatgctgagaacgcgggtggggaccaagcatgccattctcctggtggccgtcagtttcgtgaccctgatcacgggcaacatgtccttccgagacctcggccgggtgatggttatggtgggggcgaccatgacggacgatatcggtatgggggtcacctatctagcactgctggccgccttcaaggtcagacccacattcgccgccgggctcctgctccgcaagctgacaagcaaagagttaatgatgaccaccataggcatcgtgctctcctcacagtccagcatcccggagacgatcttggagttgacagatgcccttgctctagggatgatggtcctgaaaatggtccgaaatatggaaaagtaccagcttgccgtgaccatcatggctattctgtgcgtgcccaacgcggtgatcctgcagaatgcctggaaggtgtcctgtaccatcttggccgtagtgagcgtgagccccctgctgttgacaagctcccagcagaaggcagattggatcccgctggctctgaccataaagggcctcaacccaaccgcgatcttcctcaccacgctaagcggaaccagcaagagaagatcgtggcccctcaacgaggctatcatggccgtcggcatggtgtccatcctggccagcagtttgctgaagaacgacatacccatgaccgggcccctagtggcgggcgggctgctcaccgtctgttacgtactgacagggcgcagtgccgacctggaactggagcgagccaccgacgtgaagtgggatgaccaggccgaaatcagcggctcctccccgatcctgtctatcacgatcagcgaagacgggtccatgagcatcaagaacgaggaggaggagcagaccctgactattctcatccgtacggggctgttagtcataagcggactcttccccgtctcaattcccataaccgctgcggcctggtacctctgggaggtgaagaagcagcgggccggcgtcctgtgggatgtgccctccccgcccctcgttggcaaggccgaactggaggacggggcataccgcatcaaacagaagggaatcctcggttacagccagatcggcgcgggggtctacaaggaaggcacctttcataccatgtggcacgtgacgcggggcgcggtgctcatgcacaagggcaagcgcatcgagccatcctgggccgacgtcaaaaaggacctgataagctatggcgggggttggaagctggagggggagtggaaggagggggaggaagtgcaggtgctcgccctggagccaggcaagaaccccagagctgtccagaccaaacccgggctgttccgcaccaataccgggacgatcggagcggtgtccctagacttcagccccggcacaagtggcagccccatcgtggacaagaaggggaaggtcgtgggtctgtacgggaatggtgttgttactcggtctggggcctacgtgagcgccatcgcccagacagagaagtccatcgaggataacccagagatcgaggacgacatcttccgaaagcggcgcctaacgatcatggacctccaccccggtgccggcaagaccaagcgctacctgccagcgatcgtgcgcgaggccatcaagcgggggctccgcaccctcatcctggccccgacccgcgtggtggctgcagaaatggaggaggcgctgcggggtctgcccatccgctaccagacgcccgccatccgggccgagcacaccgggcgcgagattgtggacctaatgtgtcacgccacatttaccatgcggctgctgagccccatccgcgtgcccaactacaacctcatcatcatggacgaggcacacttcacggatcccgccagcatcgccgctcggggctacatctccaccagagtggagatgggggaagctgccggcatcttcatgacagcaacgccccccggaagccgagacccgttcccccagtctaacgcccccattatggacgaggagcgcgagatccccgaacggagctggaacagtgggcacgaatgggtcacggatttcaaaggtaagaccgtctggttcgtcccgtcaataaagaccgggaacgacattgccgcatgcctgcgcaaaaacggcaagagagtgatacaactgtcccgcaagacattcgacagtgagtacgtcaagacgcggaccaacgactgggacttcgtggttactaccgacatctccgagatgggggccaacttcaaggccgagcgcgtcatcgacccccgacgctgtatgaagcccgttatactgacggacggcgaggagcgggtgatcctggccggccccatgccggtcacccactcctccgccgcgcagcggcgagggcggatcggccgcaacccaaagaacgaaaacgaccagtacatttacatgggcgaacccttagaaaacgacgaggactgcgcacattggaaggaggccaagatgctgttggacaatatcaacacgcccgagggcatcatcccgagtatgttcgaacctgaacgggagaaagtggacgccatcgacggagagtacagactgcggggagaggccaggaagaccctgctggagctgatccgcggcgggcccatcccggtgtacctcggctacaaatggcccggggagggcatcaactacgcggactcacgcctgtgcgtaggccggacccagaataaccagatcctcgaagagaacgtggaggtcgagatctggaccaaggagggaaaagggaagaagctcaagccacgctggctggacgccaggatatactcggaccccttagccctcaaagagttcaaggagttcgccgctgggcgcaagtctctgaccctgaacctcattaccgagatgggacgcctaccgacgttcatgacacagaaggcccgagatgccctggacaacctagccgtgcttcacaccgccgaggctgggggcaaggcgtacaaccacgccctgagcgagctgcccgagaccctggagaccctgctcctgctgacgctactggccacagtgacgggcggcattttcctcttcctcatgtccgggcgggggatcggcaagatgaccctgggtatgtgctgtatcatcacggccagcatcctgttgtggtacgctcagatccagccccactggatcgccgcttcaatcatactggagttcttcttgatcgtcctccttatccccgagccggaaaaacagcgcacaccccaggacaatcagctgacctacgttatcatcgccatcttgacagtggtcgccgcgacgatggcaaacgaaatgggcttcttagagaagaccaagaaggacctcggcctcgggaacatcgccacacagcagcccgagagcaacatcctggacatcgacctgcggcctgccagcgcttggacgctctacgccgtggccaccaccttcatcaccccgatgttgcggcactccatcgagaactcatccgtgaacgtcagtctgaccgccatcgctaaccaggccacggtgctcatgggactggggaaaggctggcccctgtcgaaaatggacatcggggtgcccctgctggcaatcggctgctattctcaggtcaatccaatcaccctgaccgccgcgttattgctgctcgtcgcccactatgccatcataggcccggggctgcaggctaaggccacccgggaagcccagaaacgcgccgcggcaggcatcatgaagaaccccacggtggacggcatcaccgtcatagacctggacccaatcccatatgaccctaagttcgagaagcagctcgggcaggtgatgttgcttgtgttgtgcgtcacccaagtgctgatgatgcggaccacttgggccctgtgcgaggccctcaccctggccaccggccccgtgtccaccctgtgggaagggaaccccggccgcttctggaacacgaccatactcatccagatggctaacatcctgcgggggtcttacctggccggggccgggcccctcttcagtatcatggagaacacgaccggcccgcggcgccggacggggcagctggggagagagctgctccggaggtggaaatcgcggctgaacgccttaggcaagtccgagttccagatctataagaagtcggggatccaggaggtcgaccgcaccctggccaaggagggcatcaagagaggggagaccgaccaccacgcggtgtcgcgcgggagcgcgaagctgcggtggttcgtggagcgcaacctggtcacccccgagggcaaggtagtggacctcgggtgcggccgcggcgggtggtcctactactgcggcgggctgaagaacgtccgggaggtgaaggggctgacaaaaggcggacccggccatgaggagcccatcccaatgagcacttacggctggaacttggtgcgcctgcagtccggtgtggatgtgttctttatcccgcccgagcgatgcgacactctgctctgcgacatcggcgagagctccccgaatcccacggtggaggccggccgaaccctgagggtgctgaacctcgtggagaactggctgaacaacaacacgcaattctgcatcaaggtgctgaacccctatatgcccagcgtcattgagaagatggagacgctgcagcggaagtacgggggcgccctcgtgcggaacccgctgtctcgtaactcaacacatgagatgtactgggtcagcaacgcctccggaaacatcgtgagctccgtgaatatgatcagccggatgttgatcaaccgcttcacgatgcgccacaagaaggcgacgtatgagccagacgtggacctcggatccggaacccgaaacatcgggattgagagcgaaattccgaatctggacatcatcggtaagcggatcgagaagatcaagcaggagcacgagacgtcctggcactacgaccaggatcacccatataagacctgggcctaccacggtagctacgagacgaaacagaccggctcagccagctccatggtcaacggggtggtgcgcctgctaactaagccgtgggacgtcgtgccaatggtgacccagatggccatgacagacaccacccccttcgggcagcagcgggtcttcaaggagaaggtggacactagaatccaggaaccgaaggagggaacgaagaagctgatgaagataatggcggagtggctgtggaaggagctcgggaagaagaagacgccgcggatgtgcacaagagaagaattcaccaagaaggtgaggagcaacgcagccctgggcgccatctttacggacgagaacaagtggaagtccgcgcgagaggccgtggaggacgggcgcttctgggagttggtggaccgcgagcggaacttacacttggaggggaagtgcgagacctgcgtgtacaacatgatggggaagcgcgagaagaaactgggcgagttcggcaaagctaaggggtcccgggccatatggtacatgtggctcggagcccgcttcctggagttcgaggccctggggttccttaacgaggaccactggttctcccgggaaaacagcctgtccggcgtcgagggtgagggcctgcacaagctcggctacatcctgcgcgaagtgagtaagaaggaagggggcgcgatgtacgccgatgacaccgccgggtgggacacccggatcacgctcggagccttaaagaacgaacgcaagtgcacggagcatatggaaggagagcctcgcaaacccggtcgtggccacttcaagtggcgcaaccagaaccgggtcgtaggggtacaaggcccgacccccgggggtaccgttatggacatcatcagtcgcaaaaaccagcggggctccggccaggtgggcacgtacgggctgaatactttcacgaacatggaggcgcagctgatacgccagatggaaggcgaggggtttttcatagagcatcaacacttgacggcgagcgaggaaaacgccgtgcaggactggctggccagagtcggccgagaaaaggtgtccaggatgcccatatcaggcgacgactgtgtcgtcaagcccttagacgaccgcttcgcccgggcgttaacggccctgaacgacatgggtaaagtacgcaaggacatccagcagtgggaaccatcccggggctggaacgactggacacaggtgccgttctgcagccatcacttccacgagctgattatgaaggacgggcgaaccctcgtcgtgccctgtcggaaccaggatgagctgataggccgcgcccgaatctcccagggggcaggttggagcttcggcgagaccgcctgcctgggtaagtcctacgcgcagatgtggtcactcatcaacttcaggatcccagacctgcgcttggccgccaatgtaatctgctccgtggtacccagccattgggtgccgacctctcgcactacctggagcatccacgccaaccacgagtggatgaccaccgaggatatgctcactgtctggaaccgcgtgtggatactggaaaacccctggatggaggacaagacccccgttgagtcctgggaagagatcccgtacctggaaaagcgggaggaccagtggtgtggctccctcatcgggctgacgccccagccgccctgggccaagaacatcgagaccgctatcaaccaggtgcgttccctgatcggcaacgaggagtacattgactatttgcccagcatgaagcgcttccgcatagaggaggaggaaagcgggttcctatggtga

SEQ ID NO: 24942 - RNA, 9876 nt, synthetic construct
  misc_feature 1..9876: note = derived and/or modified CDS sequence (opt11) from DENV-2__JQ922553__SS-prME
  source 1..9876: mol_type = other RNA
acagcagggatgataataatgctaatacccacggtgatggcgtttcacctaaccactagaaacgttgaaccgcccatgatattttcaagacaagaaaaagggaaatcctttctcttcaaaacaaaagatggacacgacatgtgcacgttcatggcaatggacctaggcgaactctgcgaagacaccataacctacaaatgcccatttctcaaacaaaatgaacccgaagacatagactgttggtgcaactccaccagtacgtgggtaacatacggcacttgcactacaaccggagaacaccgacgtgagaaacgttcggttgcactcgtaccacacgtaggaatgggattagagacacggacggagacttggatgtcaagcgagggtgcatggaaacacgtccagcgcatagaaacttggattctcaggcacccgggtttcacaattatggcggctatccttgcatacacaatcggtacaacacactttcagcgggtcctcatatttatcctactaaccggagtagcaccatcaatgagaatgcgatgcattgggatcagtaacagggacttcgtcgaaggcgtgtccgggggatcctgggtggacattgtactagagcacgggtcgtgtgtcaccacaatggccaaaaacaagccgaccttagaccttgagctaataaagaccgaagcgaagcaaccggccaccctgaggaaatactgcattgaggcaaagctaacaaacaccacaactgacagccgctgccccacacaaggagagccaacactgaacgaagaacaggacaagaggttcgtatgtaagcactcaatggtggatcgcggctggggcaatgggtgtggcctcttcggaaaaggagcaatcgtgacctgcgcgatgttcacctgtaaaaagagcatgaaaggcaaaattgtccaacccgaaaacctcgagtacaccgtcgtaatcaccccacacagtggcgaggaatatgcggttggcaacgacacgggcaaacacggcaaggaagtgaaaataacgccacaaagcagcattactgaggcagaacttacgggatatggtacagtaactatggaatgttcgccgcgaacgggcctagacttcaacgagatggtgctattacaaatggaggacaaagcatggcttgtccatcggcagtggttcctcgacctgcccctcccgtggctgcccggggctgacacccaaggctccaactggatccaaaaggagacgctcgttacatttaagaacccgcacgcaaagaagcaagacgtcgtagtgcttggatcacaagaaggcgccatgcatacagcgctgacaggggcgacagagatccaaatgtcaagcggcaaccttctatttaccggacacctaaaatgccgtcttaggatggacaaactccagctaaagggaatgtcatactccatgtgcaccggtaaattcaaggtggtgaaggagatagctgaaacacaacacggtacaattgtaatacgagtacagtacgagggcgatggctcgccgtgcaaaatcccatttgagataatggatctcgagaagcgacacgtcctgggacgactcatcacagtcaaccccattgtaacggaaaaagactcaccagtaaatatagaggcggaacctccgttcggagactcctacataatcataggtgtagagccaggacaactaaagctcgactggtttaagaaggggtcctcgatcgggcaaatgctcgaaacaacaatgcgtggggcaaaaagaatggcaatactgggggataccgcatgggacttcggcagcctcggcggtgtattcacatcaattggcaaagcactccaccaagtctttggggccatatacggggccgcattctcaggtgtgtcctggaccatgaaaatactgataggcgtgatcatcacctggattggcatgaacagtaggagcacaagtctctccgtcagcctagttctcgtcggcatcgtaaccttatacctaggcgttatggtgcaagccgattcaggatgcgtggtcagttggaaaaacaaagagctaaagtgcggatcaggaatattcgtcacggacaacgtgcacacatggaccgaacagtataaattccagccagaatcgccctctaaacttgcaagcgcaatccaaaaagcccacgaagaaggcatctgcggaataagaagcgtcacaaggttagagaatctgatgtggaaacaaatcaccctagagctcaaccacattctaagcgagaacgaagtaaaactaactataatgacgggtgacattaaagggattatgcaagtcggcaaaaggtcactgcgccctcaaccaacagaactacgttactcgtggaaaacctggggcaaggcaaaaatgctaagcaccgaactgcacaaccaaactttcttgatcgatggtcctgaaaccgcagaatgcccgaacgcaaaccgagcatggaatagcctcgaggtcgaagactacggattccggaaatacaaaacaaagatttggccgacattgaaggaatggcgaaaggtcttctgcgacagcaaactaatgagcgcggcaattaaggataacagagcagtccatgcagacatgggttactggatagaaagtgcgctgaacgacacatggaaaatagaaaaagcctcattcatagaggtcaaaagctgtcactggccaaaaagccataccctatggggaaacggcgttcaggagagtgaaatggttatccccaaaaacttcgccggcccagtctcacagcacaacaaccgaccgggatactacacgcaaaccgcgggcccatggcacctaggcaaactagagatggatttcgacttctgtgagggaacgacagtcgttgtgacagaggattgtggtaatagaggaccaagcctccgaacaaccacagccagcggaaagctcatcacagaatggtgctgcaggtcctgcaccctaccacccttgcgatacagaggagaagcaggctgttggtactggatggacattagacctctgaaagagaaggagaaaaacctagtctccagcctggtgaccgcgggtcatggacaaattgacaacttcagcctgagaatactcggaatggccctatttttggagaaaatgcttatgacgcggctcggtactaagcacgccatcctgctagtggcggtgagcttcgtgactctaatcacgcgcaacatgagcttcaaagacctgggccgcgtaatggtaatggttggcgctactatgacggacgacatgcgcatgggagtaacctaccttgcgctgctgccggcttttaaagttcggcccactttcgcaactggcctactattgagaaaattaacaagcaaagaacttatgatgacaaccatcggtatcgtgctattcagtcaatcgtcaataccagaaaccatcttagaacttaccgacgcgctggccctcggtatgatggtcctgaagatggtgcggaacatggagaagtatcagctggccgtcaccataatggccatactctgcgtacccaacgcagttatactgcaaaacgcatggagggttagctgcaccattctagctgtagtctcggtttcgcccctcttcttaaccagctcaaggcaaaaggccgattggattcccctagcgctgactataaaagggctaaatcccacggcaattttcctgacgactctttcccgtacctcgaagaaacgatcttggccgctcaacgaagccataatggccgttgggatggtctccatattggcgagctcactactcaaaaatgatatacctatgacaggcccattagtcgccgggggtctacttacagtctgctatgtgttaactggccgatccgctgacctagaactagaacgggctgctgacgtcaagtgggatgatcaagctgaaatcagcggaagcagcccaatactctcgatcacaattagtgaagacggaagcatgtccatcaaaaacgaagaggaggaacagacactcacgatcttaataagaacgggactcttagtaatcagcggactcttccccgtttcgataccaattacagccgcggcctggtacctttgggaggtcaagaaacagagagccggggtactgtgggacgtcccgtcgccaccaccagtaggtaaagcagaactagaagacggcgcctaccggatacaacaaaagggaatattcgggtactcacaaataggagcgggggtctataaagaaggaaccttcccgacgatgtggcacgtcacgagaggcgcagtgctaatgcataaaggcaaaagaatcgaacccagttgggcggacgtcaagaaagacctcatcagctacggaggtggatggaagttggagggagagtggaaagagggggaagaggttcaagttctagccctcgagcccgggaaaaatcccagggccgtgcaaacgaagccaggcctgttcaaaaccaacaccgggaccataggtgcagtctcgctggacttcagcccaggaacatcaggaagtccaatcgtcgacaagaaaggaaaagtggtaggtctctacggcaatggcgtggtgacacgtagcggcgcgtatgtatcagctatcgcccaaacagaaaagtccatcgaggactatcccgaagtggaaatggacatatttcggaagaaacggctcaccataatggacttccatccgggggccggtcgccagaaacggtacttcccagccatcgtcagagaggcgataaagcgaggactaagaaccctgatactcgcacccacgcgcgttgtagcggctgagatggaagaagccttgcgcgggcttccaattcgctaccagacacccgcgatacgagcagaacacacgggacgcgagatcgtagacctaatgtgtcacgcaaccttcacaatgagactattgagcccaatcagggtaccgaattacaacctaataattatggacgaggcgcatttcacagatccggcctctatagcggcaaggggatacattagcacgcgcgttgaaatgggcgaagcagcgggtatattcatgacagctacaccgcccggcagcagagacccctttccgcaaagtaacgccccaatcatggacgaagaacgtgaaattccggagcggagctggaacagcggacacgagtgggtcacggactttaaagggaaaattgtctggttcgttcctagcttgaagactggaaagtacatagctgcatgcctacgtaagaatggtaagcgggtcatccagctaagccgtaaaacctttgacagtgaatatgtcaagaccaggaccaacgattgggacttcgttgtaacaaccgatattagtgaaatgggagccaacttcaaggccgaacgggtaattgacccacgccgctgtatgaaaccagtaatcctgacagatggagaagaacgagtaattcttgcaggccccatgccggtcacacactccagcgctgcccaacgcagaggccgtatcggacgcaaccccaagaacgaaaacgaccagtacatctacatgggggaaccgctggaaaatgacgaagattgcgcacactggaaggaagcgaaaatgctacttgataacatcaacactccagaagggataatcccaagtatgttcgaaccagaacgcgagaaagtcgatgcaatagatggcgaataccgtcttcgaggcgaagcacgaaaaaccctactcgaacttataaggggcggaccaatccccgtgtacctcggatacaaatggccaggagagggaattaactatgcagacagccggctatgtttcgacggaatcaaaaacaatcagatcttggaggaaaacgtcgaagtcgaaatatggacaaaggaaggcgagcggaaagagcttaaaccccggtggcttgacgctcgaatctacagcgatccgctcgcattaaaagagttcaaagagttcgcggcgggacgaaaatcgctgacgctcaacctgatcacggagatgggtcgactgcccacattcatgacccagaaggctagaggagctctggcgagtctcatggttctccacaccgccgaagccggtggccgagcctacaatcacgcactctccgaattgccggaaacactcgaaacattactactactcacgctactggcaaccgtcacaggaggaatcttcctcttcctgatgtcaggaagaggaataggaaagatgaccctaggtatgtgttgcatcatcacggcctccatcctgttatggtacgcgcaaatccagccacactggatagcagcctcaataatcctcgagttcttcctcaccgtgcttctaatcccagaaccagaaaagcaacggactccccaagataatcaacttacgtacgttatcatagccatattaacagtagtcgcagcaacgatggcaaatgagatgggtttcctggagaaaacaaagaaagatctcggcttgggcaacatcgcaacacagcaatcctgcaaaaagatactcgacatctaccttggccccgcactaccttggaagctatacgcgggaggcacaacgttcatcaccccaatgctccgacactcaatagaaaactcgagcgtgaacgtcagtctgaccgccatcgcaaaccaagcaactgtattaatgggactgggcaagggctggcccctaagtaaaatggatatcggggtccccctactcgcgatcggctgctacagccaggttaaccccataaccctgaccgccgcgttattccttctcgtagcccactatgccataatcggcccgggactacaggcgaaacccacacgtgaagcccagaagcgagcagcggccggaataatgaaaaatccgacggttgacgggattaccgtaatagacctcgacccaataccgtacgacccgaaatttgaaaaacaactcggacaggtcatgttactggtactatgtgtaacccaagtgctaatgatgcgcacgacctgggctctatgcgaggccctaactttggcgacgggacccgtatccacgctgtgggaagggaaccccggacggttctggaacacgacaattgcggtatcaatggcgaacatcttccggggatcgtacctggcaggagcagggctcctcttttcgataatgaaaaacacaaccagcacaagacggggcaccgggaatatcggagagacgctcggggaaaaatggaagagtcgactaaacgcgctcggaaaaagcgagtttcagatctacaagaaatcagggatccaggaagtagaccggaccctcgcaaaagaaggtataaaacgcggcgaaacggaccaccatgcagtctccagaggcagcgctaagttacgatggttcgacgagcggaacttagtaactccggaagggaaggtagtagatttaggatgtggccggggtgggtggagtttcttctgtggcggactcaagaacgtaagagaagtaaaagcactaacgataggtggcccgggccacgaggaaccaatactaatgagcacttacggcagaaacttggtacgaagccaatccggggtggttgtgtttcacacaccccctgaaaagtgcgacacttcactgcgcgatataggcgaatcatccccgaatccgacagttgaagcgggccgtacactacgagtcctgaacctcgtagaaaactggctcaacaacaacacgcaattctgtataaaagtcttgaacccctacatgccaagtgtaatcgagaaaatggaggccctacaacgtaaatacggaggagccttggtaaggaatccgctttcgaggaacagcacacacgaaatgtactgggtgagcaatgcatccggaaatatagtttcatcggtgaatatgatctcacgcatgcttataaaccggttcacaatgcggcacaagaaagcgacatacgagccggacgtagatctcggcagcggtacccgaaacatcggcatcgagagcgaaactccaaacctagacattatcgggaagcgaatcgaaaagatcaaacaagaacatgaaaccagctggcactacgaccaagatcacccatacaaaacttggggctcccacggatcttacgagactaaacagacgggatccgcttccagcatggtcaacggggttgtacgactactaacaaaaccatgggatgttgttccgatggtaactcaaatggcaatgacggataccaccccgttcggtcaacagcgcgtgtttaaggaaaaggttgacacccgaacacaggagccgaaagaaggtacaaagaaactcatgaaaatcactgcggaatggctctggaaagaattggggaaaaagaagacccccagaatgtgcacgagggaggagttcatcaagaaagtaaggtctaatgctgcccttggggcaattttcacagacgaaaataaatggaagtccgcgagagaggccgtcgaggatggtagattctgggagctcgtcgacaaggaaaggaacctccacctagaaggcaagtgcgagacgtgcgtctataacatgatggggaaaagagaaaagaagctgggggagttcgggaaagccaagggatcccgagcaatttggtacatgtggttaggtgcccgattcttagaatttgaggcgctagggttcctgaacgaggaccactggttcagtagagaaaacagcctctccggggtcgaaggagaaggactacacaagctaggctacatcctaagggaagtgagtaagaaagagggcggagcgatgtacgccgacgacacggcaggttgggacactcgtatcaccctggaagacctgaaaaatgaagaacggaaaactaatcacatgggaggcgagcaccgcaaactggcccgtggaatattcaagatgaatctcaccaacaaagtagtgagggtgcagaggcccacgccaggagggaccctgatggacataatcagcaggaagacccagcgcggatcagaacaagtcggcacgtatggcttaacgacgttaacaaacttggaagcacctccgattcgtcaaatggaagggaaaggagtattcaaaggccaccaacatcgcaccgcaagcgaagaaaacgcagtacaggattggctcgcccgcgtcgggggtgagaggctgagccggctagcaatttcgggcgacgactgtgtggtaaagcccctggacgatcgatttgcgagagccttaactgccttaaacgatatgggcaaggtgcgtaaggacatacagcaatgggaacccagccggggctggaacgattggacccaggtcccattctgctcccaccactttcacgaactaattatgaaagatggacgcacgctcgtagtaccgtgcaggaaccaagacgagttaataggccgcgcgcgaatcagccagggcgcaggatggtccctccgagagacggcgtgtctaggtaagttctatgcccagagatggagcctcatgtacttccacagaagggacctccgcttagcccccaacgcgatctgctccgcagttcgaacccactgggtccctacatcacgcaaaacgtggccaatacatgcgagccatgactggatgaccacagaagtcatgctaacggtctggaacaagctctggttccaagaaaacccatggatggaagacaaaacaccagtcggcttctgggaagaaatccctttcctcgaaaaaggtaaggaccaatggggcggcagcctcatcggactcacaagccgaccaccctgggcaaagaacttccaaccggccataaatcaagttcgctccctcctgtgcaacgaagagagcgcggactttatgccaagtatgaagcgcttcagaagggaagaagaagaagccggggtactctggtga

SEQ ID NO: 24943 - RNA, 9876 nt, synthetic construct
  misc_feature 1..9876: note = derived and/or modified CDS sequence (opt11) from DENV-2__JQ922549__SS-prME
  source 1..9876: mol_type = other RNA
accgccggcgtgatcatcatgctgatccccacggccatggcgtttcacctgactacccgcaacggggagccccatatgatcgtcagcagacaggagaagggtaagagcctgcttttcaagacggaagacggggttaacatgtgcaccctcatggcaatggacctgggtgagctgtgcgaagacaccattacctacaactgccccctcttgcgccagaatgaacccgaggatatcgactgctggtgtaacagcaccagcacctgggtgacgtacgggacctgcaccgcccctggcgatcaccggcgcgagaagcgtagtgtcgccttggtgccccacgtggggatggggctcgagacccgcacggagacgtggatgagctcggagggcgcctggaagcacgcgcagcggattgagacctggatcctgcgccatcccggattcacaatcatggccgccatcctggcctacactattggtaccacatacttccagcgggtcctcatccttatcctgctcacagcggtggccccctccatgacgatgcgctgcatcgggataagcaaccgagattttgtggagggcgtctccggcgggtcatgggtggacatcgtgctggagcacggctcctgcgtaacaaccatggccaagaacaaacccaccctcgacttcgagctcatcaagaccgaggccaaacagcccgcaactctgaccaaatactgcatcgaggcgaagctgaccaacacgaccaccgctagccgttgccccacccagggagagccctccctcaacgaagagcagcacaaacgatttgtgtgcaagcatagcatggtggaccgcggctggggcaacgggtgcggactgttcggcaagggcgggatcgtcacgtgcgcgatgttcacgtgcaagaagaacatgaagggcaaaatcgtgcagcctgagaacctggagtataccatcgtggtcaccccgcactccggagaggagaacgcagtcgggaatgacacggggaaacacgggaaggagatcaaggtgcgcccccaaagctctatcactgaagcggaacttacgggctacggtaccgtcaccatggaatgcagcccacggacgggcttcgccttcaacgagatggtacttctacagatggagaacaaagcctggctcgttcaccggcagtggttcctggacctgcccctcccctggctgccgggcgccgacactcaggggtccaactggatccagaaggagacccttgtcacgttcaagaacccccacgccaagaagcaggacgtggtcgtgctcgggtcacaggagggggccatgcacacggcgctgaccggcgccaccgagatccagatgtcctccgggaacctgctgtttacgggccacctgaagtgccgcctgcggatggacaagctccagctaaaagggatgagctactccatgtgtacggggaagttcaaggtggtgaaggagatcgccgagacccaacacgggaccatcgtgatccgagtgcagtacgagggggacggcagcccctgcaagatcccattcgagatcatggacctggagaaacgactcgtgctaggccgcctgatcaccgtgaaccccatcgtgacagagaaagacagccccgtcaacatcgaggccgagcctccgttcggagacagctacatcataattggcgtggagcctgggcagctcaagccttcctggttcaagaaaggcagctccatccgccaaatgttcgagaccacaatgcgcggggcgaagcgcatggcgatactgggcgacaccgcctgggatttcggatcgttggggggcgtgttcacgtcaattgggaaagccctccaccaggtcttcggcgctatctacggtgcggccttcagcggcgtgtcctggaccatgaagatcctcatcggcgtggtcatcacctggatagggacgaacagcagaagtactagcctgtccgtgagccttgtgctcgtcggagtggtgaccctgtacctgggtgtcatggtacaggccgattccggctgcgtggtcagctggaagaacaaagagttgaagtgcgggagcggaatcttcatcaccgataacgtgcacacctggaccgagcagtacaagttccagcccgagtccccaagcaagctggctagcgccatccagaaggcgcacgaggagggtatctgtgggatcaggtcggtgacccggctggagaatctcatgtggaagcagatcacccccgagcttaaccacatactgtccgagaacgaggtgaagctcaccatcatgacgggcgatatcaagggcatcatgcaggccggcaagcgttcgctgcgcccccagccgaccgagctgaagtactcttggaagacctgggggaaggccaagatgctcagcaccgagccccacaaccagacgttcctgatcggcggcccagagaccgccgaatgcccaaacaccaaccgagcatggaattccctagaggtggaagactacgggtttggcgtgttcacgaccaacatctggctcaagcttaaggaacgtcaggatgtcttctgcgacagcaagctgatgtccgctgcaatcaaagacaacagagccgtgcacgcagacatggggtactggatcgagagcgccctcaacgacacctggaagatcgaaaaggcgtccttcatcgaggtgaagagctgccactggccgaagtcccacaccctgtggagcaacggggtgctggagtccgagatgataattcccaagaacttcgccggccctgttagccagcacaactatcggcccggataccacacccagaccgccgggccctggcacctcgggaaactggagatggacttccacttctgcgaaggcacgaccgtggtcgtgaccgaggactgcggaaaccgcggccccagccttaggaccacgacagcctcgggaaagctcatcactgagtggtgctgccgcagctgcaccctgccgccactgcgctaccgtggtgaggacggctgctggtacgggatggagattcggcctctcgagggggaggagggggacctggtgcactctctggtcacggctggccatggccaaatcgacaacttcagtctcggtgtgttgggcatggcgcttttcctcgaagagatgctgcgcacccgggtggggaccaagcacgccgtcctgctggtggccgtgtccttcatgaccctgatcacgggaaacatgagcttccgcgacctggggcgcgttatggtgatggttggggccgcgatgaccgatgacattggcatgggtgtcacctaccttgcccttttggccgccttcaaggtgcggcccaccttcgcagcgggcctattgttacgcaagctaacgtccaaggagctgatgatgaccaccattgggatagtactgcttagccagtccaccatccccgagacgattctcgagctgaccgacgccctcgccctggggagaatgatcctgaagatcgtccgaaatatggagaaataccaactcgccgtgaccataatggccatcctctgcgtgcccaacgcggtgatcctgcagaacgcctggaaggtttcttgcaccatcttagccgtcgtgtccgtgagcccactgctcctcacttcctctcaacagaaggcggattggatccccctggcactgacgatcaagggcctcaaccccacggccatcttcctgaccacactgtcccggaccaacaagaagaggagctggcccctcaacgaggccatcatggccgtcgggatggtttccatcctggccagctccctactcgaaaacgacatcccgatgaccggacccctggtggccgggggcctgctcaccgtgtgctacgtgctgacggggcggagcgccgatctggagcttgaacgcgccgccgacgtgcggtgggaggaccaggccgagatctcaggctccagccccatcctgagcatcaccatctccgaggatggctctatgagcatcaagtacgaggaggaggagcccactttgaccatcctaatccgcacggggctgctggtcatctccgggctcttcccggtgagcatccccatcaccgcggccgcctggtacctgtgggaggtgaagaaacagagagccggggtactgtgggacgtgccatccccgccgcccgtgggcaaggccgagctcgaggacggggcgtaccgcattaagcagaaaggcatcctgggctcgagtcagatcggggcgcgggtctacaaagagggaaccttccacacgatgtggcacgtgacccgcggggccgtgctgatgcacaagggcaagcggatcgaaccatcttgggctgatgtcagaaaggatctcatctcctacggcggcggctggaagctggagggggagtggaaggagggcgaggaagtgcaggtgctcgccctcgaaccgggcaagaacccccgggcggtgcagacgaaaccgggcttatttaagaccaacaccgggaccatcggcacagtgagcctggacttctcccccggcacctctgaatccccgattgtggacaaaaaaggtaaggtcgtaggcctgtacgggaacggcgtggtcacccgctccgggacctatgtgagcgccatcgcccagacggaaaagagcatcgaggacaaccccgagatcgaagacgacatcttccggaaaaagcgcctgaccataatggaccttcaccccggggccggcaaaacgaagcggtatctgcccgcgatcgttagggaggccatcaagcgcgggctccgaaccttaatcctcgccccgactcgcgtcgtggccgccgagatggaggaggcgctccggggcctgccaatccgataccagacccccgccatcagggcggagcacacagggcgcgagatcgtggacctgatgtgccacgccaccttcactatgcggcttctgagccccgtccgcgtgccgaactacaatctgatcatcatggacgaggcccacttcaccgaccctgctagtatcgccgcccgcggctacatcagcacacgcgtggagatgggcgaggcggcagggatcttcatgaccgcgacgccgcccggctcccgggaccctttcccccaaagcaacgcccccattatggacgaggagcgcgagatccccgagcggtcctggaacagtggccacgagtgggtcaccgatttcaaagggaaaacggtgtggttcgtgccgagtatcaaggctgggaacgacatcgccgcatgcctccgcaagaacggcaagaaggtcatccagctgagccggaagaccttcgactcagagtacatcaagactcgcaccaacgattgggacttcgtggtgaccaccgacatcagcgagatgggcgcaaactttaaggccgagcgggtcatcgacccccgccgatgcatgaagcccgtgatcctgacggacggggaggaacgcgtgatccttgccggccctatgccggtcacgcactccagcgccgcgcagcgacgggggcgcatcggccggaacccgaaaaacgagaacgaccagtacatctatatgggagaaccactggagaacgacgaggactgcgcccattggaaggaggccaagatgcttctcgacaacattaacacgcctgagggcattatcccctccatgttcgagcccgaacgcgagaaagtggacgccatcgacggcgagtacaggctgcggggggaggcccggaagaccttcgtcgacctgatgagacggggagacctccccgtttggcttgcttaccgcgtcgccgctgaggggatcaactatgccgaccgtcgctggtgtttcgacggcatcaagaataaccaaattcttgaggagaacgtcgaggtggagatctggacgaaggagggcgaacggaagaagctcaagccgcgctggctggacgcccggatctactccgaccccctggcactcaaggagttcaaagagttcgccgccggccgcaagtcactgaccttgaacctcatcactgagatgggccggctgcccacctttatgactcagaaggctcgtaacgcgctggataacctcgccgtgctgcacaccgccgaggccgggggccgagcgtacaaccatgcactgagcgagctccccgagaccctggagaccttgctcttgctgacgctccttgccaccgtcactgggggcatcttcctgttcctcatgtccggaaaggggatcggaaagatgaccctggggatgtgctgcatcataaccgcctcgatcctgttgtggtacgcccagatccagccgcattggatagctgcgtcgatcatcctggagttcttcctgatcgtgctactgatccccgagcccgagaagcagcgcacgccccaggacaaccagctcacctacgtggttatcgccatcctcaccgttgtagccgccaccatggcgaacgagatgggcttcctggagaagacgaagaaggacttcgggttgggcagcatcgcgacccagcagccggagagcaatatcctcgacatcgacctgcgacccgcgagcgcctggaccctgtacgccgtcgccacgacgttcattacacccatgctccggcatagcatagaaaactcccccgtgaacgtaagcctgaccgcgatcgctaaccaagcgacggtcctaatgggcctcgggaagggctggccgctgtccaaaatggacatcggggtgccccccttggccatcggctgctatagccaggtgaaccccatcacgctcaccgcggccctgctgctgctggttgcccactacgccatcatcgggccaggcctccaggtgaaggcaacccgcgaggcgcagaagcgggcagccgccggcattatgaagaaccccacggtggacgggatcacggtcatagacctagaccccataccctacgacccgaaattcgagaagcagctgggccagatcatgttacgcgtgctgtgcgtgacccaggtcctgatgatgcggacaacctgggccctgtgcgaggcgctgactttagccacggggcccatctccactctgtgggagggcaacccgggtcgcttaggcaacaccacgattgccgtgagcatggccaacatattccgcggttcctacctggcaggggcgggcctactgtttagcattatgaaaaacaccacaaatacccgccgggggacgtctaacctgggcgagaccctgggcgagaagtggaagaaccgccttaacagtctggggaaatccgaattccagatctacaagaagtccggaatccaggaggttgaccggaccctggccaaagagggcatcaagaagggcgagaccgatcaccacgccgtctcccgcgggagcgccaagctgcggtggtttgtggagcgcaacttagtgacgcccgagggcaaagtcgtggacctaggctgcgggcggggcggatggtcctactactgtggagggctcaaaaacgtgcgcgaggtcaagggcttgaccaagggcgggcctggccacgaggagcccatccccatgtctacctacggctggaacctggtgcggctccaatccggtgaggacgtgttcttcacgccgcccgagaagtgcgacacgctgctgtgcgacatcggcgagagcagccccaatcccaccgtcgaggcaggccgcacactccgggtgctgaacatggtggagaactggttaaacaacaatacccagttttgcatcaaggtcctgaatccgtacatgccctccgtgatcgagaagatggaggccctgcagcgcaagtacggcggggccctagtgcggaaccctcttagccgcaactccacccacgagatgtactgggttagcaacgcctccggcaacatcgtcagctccgtgaacatgatcagccggatgctgatcaaccggttcacgatgcgccacaaaaaggccacttacgagcccgacgtcgatctgggcagtggcacccggaacatcgggatcgagagtgagaccccaaacctggacatcatcggcaagcgcatcgagaagatcaagcaggagcacgagacgtcctggcactatgatcaggaccatccttataagacatgggcataccatggcagctacgagacaaagcagaccgggtccgccagttccctcgtgaacggcgtggttagactcctaaccaagccgtgggacgtgatacctatggtgacccagatggcgatgaccgacaccacgccgttcgggcaacagcgcgtcttcaaggagaaggtggacacccggacccaggagcccaaggagggcacgaagaagttgatgaagataacggccgagtggctgtggaaggagctgggtaagaagaaaacgccccggatgtgtacccgcgaagagttcagccgcaaggttcgatccaatgccgcgctcggggccatattcaccgatgagaacaagtggaaatcggcccgcgaggccgtagaggacggacggttctgggagctggtggacaaggaacgcatcctgcatctcgaggggaaatgcgaaacgtgcgtttataacatgatgggcaagcgggaaaagaagatcggggagttcggcaaggccaagggctccagagcgatatggtacatgtggctgggggcccgtttcctggagttcgaggccttgggcttcctgaacgaggaccattggttcagccgagaaaacagcctctcaggcgtggagggcgagggacttcacaagctgggctacatcctacgggaggttagcaagaaggagggcggagctatgtacgccgacgacactgcgggttgggatacacgaatcaccctcgaggatctgaagaacgaggagatggtcacgaaccacatggagggggagcacaagaagctggccgaggccatcttcaagctcacctatcagaacaaagtggtcagggtccaacgccccaccccacgcggcaccgtgatggacataatctcccgccgcgaccagcgggggagcggccaggtggggacctacgggctgaacaccttcactaacatgggcgcccagctgatccgtcagatggagggggagggcgtgttcaaggggatccagcacctcaccgcgacggaggagatcgccgtgcaggactggctggctcgggtggggcgcgagcgcctgtcccgcatggccatctcgggcgacgactgcgtagtgaagcccctcgacgaccggttcgcctccgcgctgactgccctgaatgacatggggaaggtgcgcaaggacatccagcagtgggagccctctcggggttggaatgactggacccaggtcccattctgctcccaccacttccacgagttgattatgaaggacggtcgcgtgttagtcgtcccgtgtcggaaccaggacgagctgataggacgcgctcggatctctcagggcgccggatggagtctacgggagaccgcctgcctgggtaaatcgtacgcacagatgtggtccctgatgtattttcaccggagagacttgcggctggctgccaacgccatttgcagtgctgtgccgtcccactgggttcccacaagtcgaaccacccgctccatccatgcgcggcaggagtggatgaccaccgaggtcatgcttacggtgtggaatcgcgtgtggatccaggagaacccctggatggaggacaagaccccggtggagagttgggaggagatcccttacctcggcaagcgggaggaccagtggtgcggctctctcatcggcctgacctccagagccacctgggccaagaacatccagacggcaatcaaccaagtgcggagcctcatcggctccgaggagtataccgactacatgcccagcatgaagcgcttccggcgtgaggaggaagaagcgggcgtgctgtggtga

SEQ ID NO: 24944 - RNA, 9876 nt, synthetic construct
  misc_feature 1..9876: note = derived and/or modified CDS sequence (opt11) from DENV-2__JQ922552__SS-prME
  source 1..9876: mol_type = other RNA
accgctggcatgattatcatgctgattcccaccgtaatggccttccacctcaccacgaggaacggggagccgcccatgatcgttagcaggcaggagaagggcaagtccctactattcaaaaccgaggacggggtgaatatgtgcgcacttatggccatggacctgggcgagcgctgcgaggacaccatcacttacaactgccccctgctcaaccagaacgagcctgaggacatagactgttggtgtaacagcacctccacctgggtgacctatggcacctgcaccaccaccggggaactgcggcgggaaaagatcagcgtcgccttggttccccacgtgggaatggggctcgagacccggaccgagacctggatgtccagcgagggcgcctggaagcacgcccagcgcatcgaaatatggatcctgcgacaccccggtttcacgatcatggcggcgatactcgcctacacgattggaacttcacacttccaacgcgtcctcatcttcatcctgctgactgccattgcccccagcatgaccatgcgttgcatcgggatctcgaaccgcgacttcgtcgaaggggtgagcggcgggtcctgggtagatattgtgctcgagcacggcagctgtgtgacaaccatggccaagaacaagcccaccctggactttgagctgatcaagacggaggccaagcaaccggccacgctacgaaagtattgcatcgaagccaagctaacgaatacgaccaccgacagtcgatgccccacgcaaggggagcccaccttaaatgaggagcaggataagaggttcgtctgcaagcactctatggttgaccgcggctggggcaatgggtgtggcctgttcggcaagggggggatcgtaacgtgcgcgatgttcacgtgcaagaaaatcatgaaaggaaagatcgtacagccagagaatctggagtacaccgtggtgatcaccccgcactccggcgaggaacacgccgtcgggaatgacaccggcaagcatgggaaggaggtgaagataactcctcagtcatccatcaccgaggccgagctgaccggctacggaaccgtcaccatggagtgcagtccccgcacgggtcttgacttcaacgagatggtcctgctgcagatggaggacaaggcctggttggtacaccgccagtggttcctggacctgcccctcccgtggctgcccggcgctgacacccagggatcgaactggatccagaaggaaaccctagtaaccttcaagaacccacacgcgaagaagcaggacgtcgtggtcctcggcagccaggagggggcgatgcacacggccctgaccggcgccaccgagatccaaatgagttccgggaatctcctcttcaccggacacttaaaatgccggctgcgcatggacaagctccagctgaagggcatgagctactcaatgtgtacggggaagttcaaggtcgtgaaggagattgccgagacccagcacggtactatcgttatccgagtgcagtacgagggtgatggatccccgtgcaagatccccttcgagataatggacctggagaagcgccacgtgctaggacggctgatcaccgtcaaccctatcgtgacagagaaagattcccccgtgaacatcgaggctgagccgccgttcggggacagctacatcatcatcggcgtcgagcccgggcagctgaagctcaactggttcaagaaaggatccagcatcgggcagatgctggagaccacgatgcgcggcgccaagaggatggccatcttaggcgacaccgcctgggacttcgggtccctcggcggggtgttcacgtcaatcggcaaggccctgcatcaggtgttcggggcgatttacggcgccgccttctccggcgtcagctggacgatgaagatcttaacaggggtgatcatcacatggatcggcatgaatagccggtctacgagcctgagcgtgtcgctcgttctggtggggatcgtgaccctgtatttgggtgtcatggtgcaggccgacagcggttgtgtcgtctcatggaagaacaaggaactcaagtgcggaagcggcatcttcgtgaccgacaacgtgcacacctggacggagcagtacatgttccagccagagagcccctcgaagctggcaagcgctatccagaaggcccacgaggaggggatatgcggcatacgtagcgtcacccgactcgagaatctgatgtggaagcaaatcacgccggagctgaaccacatactcagcgagaacgaggtcaaattgaccatcatgacgggggacatcaagggcatcatgcaggtcgggaagcgctccttgcggccgcaacctaccgagctgaggtactcatggaagacatggggccagccgaagatgttatccccagagctgcaccaccagaccttcctcatcgacggccccgagaccgccgagtgtcccaatacgaaccggacctgggacagcctggaggtcgaggactacgggtttggcgtgttcactacgaagatttggttgcgcctccgggagaagcaggatgtgttctgcgattctaagctgatgtccgccgcaatcaaggacaaccgcgcggtgcatgccgatatggggtactggatcgagtccgcactgaacgacacttggaagatcgaaaaggctagcttcatcgaggtgaaatcctgccactggcctaagagccacaccctctggtccatgggcgtactagaaagcgagatggtaatcccaaagaacttcgcgggacccgtgtcccagcacaaccaccgacccggtatccctacccagaccgccggcccctggcacttagggaagctcgagatggatttcgacttctgcgagggcacgactgtggtcgtgactgaggactgtgggaatcgcggcccaagcctgcggacgagcacggcctccggtaaactgatcaccgagtggtgctgccgcagctgtactctgccgcccctacgataccgtggagaggacgggtgctggtacggcatggagatccggcccctaaaagagaaggaggagaacctcgtatccagcctggtcaccgccggccacgggcaaatcgacaacttctccctgggcattctcggcatggcccttttcctggaggagatgctcaggacgcgggtggggaccaagcacgccatcctgctggtggccgtttccttcgtgaccctcatcacagggaacatgtccgggagggacctgggccgcgtgatggtcatggtgggggccacgatgaccgatgatatcggcatgggcgtgacctacctagcccttctggctgcattcaaggtccggcccacctttgccgctggacttctcctccgcaagctgacgtccaaggagctcatgatgaccactattggcatcgtgctgctgtcccagagctccattcccgaaaccatcctcgagctgacggacgccctggcgctcggcatgatggtacttaagatggtccgtaacatggaaaaataccagcttgccgtgaccatcatggccatcctctgcgtccccaacgctgtgatcctgcaaaacgcctggaaggtgtcttgtaccatcctggctctcgtctccgttagcccactgttcctgacttcctcacagcagaaggccgactggattcccctcgccctgacaatcaagggcctgaaccccaccgctatctttctcaccaccctgtcccgcacgagcaaaaagcgttcctggccgctgaacgaagccatcatggcggtggggatggtaagcattctcgctagctccctgctgaagaacgacatacccatgaccgggcccttagtagccggcggactgctcactgtgtgttatgtgttaaccggacgcagcgccgacctggagctggagcgggcggccgacgttaaatgggatgatcaggccgagatcagcggaagctcccccatcctcagcatcacgatttccgaggacggcagcatgtctatcaagaacgaagaggaggagcagacacttaccatactcatccgcaccgagctcttggtaatcagcggcctgttcccgatatccatccccattacggccgccgcatggtatctatgggaggtcaagaagcaacgcgccggggtgctttgggacgtgccgagcccgcctcctgtgggaaaagccgagctcgaagacggtgcctaccgcatcaagcagaagggcattctcgggtactcgcaaatcggcgccggcgtgtacaaagaaggcaccttccacaccatgtggcacgtaacccggggcgcggtcctaatgcataagggcaagcgcattgaacctagctgggccgacgtaaagaaggatcttatctcctacggcggtggttggaagctcgagggggagtggaaggagggggaagaagtgcaggtcctggccctggagcccggcaagaaccccagggctgtgcagaccaagcccggcctcttcaagacgaacactggcaccatcggagccgtgagcttggacttctcccccggcacgagcggctccccaatcgtcgacaagaagggcaaggtggtgggcctgtatgggaacggcgtcgtgacgcgctcaggcgcgtatgtgagcgcaatcgcacagaccgagaagagcatcgaggacaatcccgagatcgaggacgacatctttcggcgcaagaagctgaccatcatggacctccaccctggcgccggcaagacgaagcggtatctgcccgccatcgtccgagaagcgatcaagagaggtttgcgcacactcatcctcgccccaacccgagtcgtggcggctgaaatggaggaggcgctgcgcggactccccattcgctatcaaacccccgccatccgggccgagcacaccgggcgcgagatagtggacctgatgtgccacgccacgttcaccatgcgactgctctcgcccatcagggtgccgaattacaacctgatcatcatggatgaggcccacttcaccgaccccgcgtccatcgccgctcggggctacatctccacccgagtagagatgggcgaggccgccgggattttcatgacggcgacgcctcctggctcccgggacccgttcccccagagcaacgcccccatcatggacgaggaacgggaaatcccagagcggtcatggaacagcggccacgaatgggtaacggacttcaagggaaaaaccgtgtggtttgtgccgtccatcaagacggggaacgatatcgccgcatgcctgaggaagaacggcaaaagggtcatccagttgagccgaaagacgttcgactccgaatacgtgaagaccagaaccaacgattgggacttcgtggtcacgacggacatttcagagatgggcgccaacttcaaggctgagcgcgttatagacccccgccgctgcatgaagcccgtgatcctgacggacggcgaggaaagggtaattctagccggccccatgccggtgacacactccagcgccgcacagcgccgggggcgcatcggccgcaatcccaagaacgagaacgaccaatacatttacatgggggagcccctcgagaacgacgaggactgtgcccactggaaggaggccaagatgctcctggacaacatcaataccccggaaggcatcatcccctccatgttcgagcccgagagagaaaaagtagacgcaattgacggcgaataccgcctccgcggggaggcgcgcaaaaccttcgttgacctgatgcggcgtggcgacctaccagtctggctcgcctaccgggggccggccgaaggcattaactacgccgatcgccgatggtgtttcgacgggatcaagaacagccagttcctggaggaaaatgtggaagtggagatctggccctccggcggcgagaggaaggagctgaagccccggtggcttgacgccagaatttactcagaccccctggccctgaaggagttcaaggagttcgccgcgggtcggaagtccctcacccttaatctcatcacagagatggggcgtctgccgacgttcatgacccagaaggcccggaacgccctggacaatctggccgtgctccacaccgcggaggccggcgggcgggcctacaaccatgccctaagcgaactgcccgagaccctcgagacgctgctactcctgaccctgttagccactgtcacgggggggattttcctatttctgatgagcgggcgaggaatcggcaagatgacgctcggaatgtgctgtatcataaccgcgtccatattgctgtggtatgcccaaatccagccccactggatcgccgccagtataatcctcgagttcttcctgatcgtgctactcatcccagaacccgaaaagcagcgcaccccccaggacaaccagctcacctacgtgatcatcgcaatccttacggtcgtggcagccacgatggccaacgaaatgggcttccttgagaaaaccaaaaaggacctgggactgggaaacattgtgacacagcaacccgaaagtaacatcctcgacatcgacctgcgtcccgccagcgcctggactctgtacgcggccgccaccactttcataactccgatgttgcgccactcaatcgaaaacagcagtgtcaacatgagcttaaccgccatcgccaaccaggcgacggtactaatggggctcgggaaggggtggcccctgtccaagatggatatcggggtgcccttgctcgctatcggctgttacagccaggtcaaccccatcaccttaacggccgccctgttcctgttggtggcccactacgcgatcaagggcccgggactacaggccaaggctaccagggaggcccagaagagggctgccgccggcatcatgaagaaccccacggtagacggtatcaccgtcatcgacctcgaccccatcccgtacgacccgaagttcgagaagcagctcggccaagtgatgttactcgtactttgcgtcacacaggttctgatgatgcgcacaacgtgggccctgtgtgaggcactgaccctggcgaccgggccggtttccaccctctgggagggcaaccccggccgcttctggaacacgacgatcgccgtcagcatggccaacatattccgcgggagctacctggccggcagctcgcaggtgtggcccagcattaacaatcttaagggcggacgtcgggggacgggggcccagggcgagaccttgggggagaagtggaagcggcaactgaaccagctgtccaagagcgaattcaacacgtataagcgctccgggatcatggaagtggaccggtccgaggcgaaagaggggctgaaacgcggcgagacgaccaagcacgcggtcagccggggcaccgccaagctgcgctggttcgtggagcggaacctggtgaaaccggaagggaaggtaatcgacctaggctgcgggcgcggcgggtggtcgtactattgcgctggcctgaaaaaggtgacggaagtgaagggttataccaagggcggccccggccacgaagaaccgatcccgatggccacctacggctggaatctggtcaagctccactcgggcaaggacgtgttcttcacgccgcccgaaaagtgcgatacgctgttgtgtgacatcggggagtccagccccaatccgaccgtggaagcgggccggaccctacgcgtcctcaacctggtggagaactggctcaacaacaacacccagttctgcatcaaggtcctgaacccctacatgccctccgtcatagagaagatggagacgctgcaacggaaatacgggggcgccctggtgcgcaatcccctcagcaggaactccacgcacgagatgtactgggtcagtaacgcctctgggaatatcgttagctccgtgaacatgatcagccgtatgttgattaacagattcaccatgcggcacaagaaggccacatacgagccagacgtggacctgggttcaggaacccgcaacatcggcatcgagagcgaaacgcccaatctcgacatcatcgggaaacgcatcgagaagatcaagcaggagcatgagacctcctggcactacgaccaggaccacccgtacaaaacctgggcttaccatggcagctacgagaccaagcagacgggctccgccagctctatggtcaacggggtagttcgtctgttaaccaagccatgggacgtcgtgccgatggttacccagatggcaatgaccgacacgaccccgttcggacagcagcgggtcttcaaggagaaggtggacacccgcacccaggagcccaaggagggcacgaagaagctcatgaagatcaccgccgagtggctgtggaaggagctgggtaagaagaagacacctcgcatgtgcccgcgcgaggagttcaccaagaaagttcggagcaatgccgcgctcggcgccatcttcacggacgccacgaagtggaagtcagcccgggaagccgtcgaagacgggcggttctgggaactcgtggacaaagagcgtaacttacacctcgagggcaaatgcgagacctgcgtgtacaacatgatggggaaacgggagaaaaagctgggcgagttcggcaaggcgaaagggtcccgcgccatatggtacatgtggctcggcgcgcggttcctcgaatttgaggccctggggttcttgaacgaagaccattggttcagccgcgaaaattccctcagcggcgtcgagggggaaggcctgcataagctgggctacattctccgggaggtgcgcaagaaggaaggtggggccatgtacgcggacgactccgcggggtgggacacccggataactctagaggacctgaaaaacgaagagcgcatcaccaaccacatggaggtcgagcataagaagttggccgtgggtcactttatactaacttaccccaacaaggtggtacgtgtacagcgacccacccccgtggggacggtcatggacatcatcagccgaaaaagtcagcgcggtagtggccaggttgggacgtacgggctgaacaccttcacgaacctcgaagggccgcgcatcaggcagatggagggcgaggagtccttcaagagccaccagctgcaaacggcaactgagcgtaacgcggtgcaggactggctggcccgggtaggccgcgagcgtctatccagaatggccataagcggagacgactgcgtggtaaagccactggacgatcgtttcgctcgagccctaaccgcgcttaatgacatgggcaaggtccggaaggacattcagcagtgggagccatccagagggtggaacgactggacccaggtgcccttctgcagtcaccacttccacgagctgatcatgaaagacggtagaacgctggttgtcccgtgccgtaaccaggacgagctcatcggccgggcgcgcatctcccagggcgccggctggtcgttacgggagaccgcctgcctcgggaagtcctacgcccagatgtggtcactcatgtactttcaccggcgagaccttcgcctggcggctaacgccatttgctccgccgtgccgtcccactgggtacccacctcgcggaccacttggtccattcacgcctcccacgaatgggttgcgacagaggacatgctcacagtctggaacagagtttggatccaggagaatccgtggatggaggacaagacccccgtagagtcctgggaagagataccgtacctgggtaagcgtgaggaccaatggtgcggctcacttatcggccttacatcccgggctacgtgggccaagaacatccagaccgccatcaaccaagtccgctctctgatcgggaacgaggagtacaccgattacatgccctccatgaagaggttccgcagggaggaggaggaagcaggcgtgctgtggtga

SEQ ID NO: 24945 - RNA, 9876 nt, synthetic construct
  misc_feature 1..9876: note = derived and/or modified CDS sequence (opt11) from DENV-2__GU131896__SS-prME
  source 1..9876: mol_type = other RNA
tccgcggggatgatcatcatgttaatacccacggtgatggccttccacctcaccacccggaatggggagccgcacatgatcgtcggcatccaagagaaggggaagtccctgctattcaagaccgaggacggcgtgaacatgtgcaccctcatggcgatggacctgggggagctatgcgaggatacgatcacctacaagtgcccgctcctgcggcagaacgagcccgaggatatcgattgctggtgcaacagcacctccacctgggtgacctacggtacctgcaccaccaccggcgagcaccgtagagagaagcgcagtgtcgcccttgtgccccacgtgggcatgggcctcgagacacggaccgagacatggatgtccagcgagggggcttggaagcacgctcaacgcatcgagacctggatccttcggcaccccggcttcacgatcatggccgcaatcctggcctacaccatcgggaccacccactttcagcgtgccctaatcttcatcctgctaacggccgtcgcgccctccatgaccatgcggtgcatcggcattagcaatcgcgactttgtagagggcgtgagtgggggttcatgggtagatatcgtgctcgaacacggttcctgcgtgaccacgatggcgaagaacaagcccacgctggacttcgagctgatcaagaccgaggccaagcagcccgccaccctccggaagtactgcattgaagcaaagctcaccaacacgaccaccgagtctcgttgtcccacccagggggagccctccctgaaggaggagcaggacaagcggtttgtctgcaagcacagtatggtcgaccgcggctgggggaacggctgcggcctgtttgggaagggcgggatcgtgacgtgcgcgatgtttacatgtaaaaagaatatggagggcaagattgttcagcccgagaaccttgagtacaccatagttgtgacgccccactccggggaggagcacgctgtcggcaacgacacgggtaaacacggcaaggagatcaaggtaaccccgcagagctccatcactgaggctgagcttacagggtacggcaccgttacaatggagtgcagcccccggaccggccttgatttcaacgagatggtcctgcttcagatggagaataaggcctggttagtgcaccgccagtggttcctggatcttccccttccgtggctgcctggggccgacaagcagggctccaactggatccagaaagagaccctggtgacatttaagaacccccacgcgaagaagcaggacgtagtggtcctcgggtcgcaagaaggcgcaatgcacacggcattaaccggggccaccgagatccagatgagctccgggaacctcctcttcaccggccacctgaagtgccggttacgcatggacaaattgcagctgaaggggatgagctattccatgtgcacgggcaagttcaaggtggtgaaagagatcgccgagactcaacacgggaccatcgtcatccggctgcagtacgagggtgacggcagcccctgtaagatccccttcgagatcatggatctcgaaaagcgctacgtgctggggcgcctgatcactgtgaacccgatagtcactgagaaggactcccccgtgaacatcgaggcagagccgccctttggcgacagctacatcatcataggggtggagcccggccaactcaagctgaactggtttaagaagggctccagtatcggccagatgttcgagaccaccatgcgaggtgctaagcgcatggccatcctgggggataccgcctgggacttcggctctcttgggggtgtcttcacgagcgtcggaaaggctcttcatcagatattcggcgctatctacggcgcggccttcagcggggtgagttggaccatgaagatcctgatcggggtcattataacctggatcgggatgaattcccggagcacctcactgagcgtgtccctcgtgctggtcggcatcgtgacgctttacctcggagtgatggtccaggcggactcgggctgcgtggtctcctggaagaataaggaactgaagtgcggcagcgggatcttcatcactgacaatgtccacacgtggaccgagcagtacaagttccagcccgagagcccctccaagttggcgagcgcgatccaaaaggcccaggaggagggaatctgcggtatccgctccgtgacgcggctcgagaatctgatgtggaagcagatcacccccgagctgaatcacatcctggccgagaacgaggtgaagctgaccattatgaccggcgacatcaaggggatcatgcaggccggcaagcgaagcctgaggccgcagcccacggagttaaagtactcctggaagacctggggcaaggctaaaatgctgagcaccgagtctcacaaccagaccttcctgatcgatgggcccgagacagccgaatgcccgaacaccaaccgcgcctggaactctctcgaagtggaggactacggcttcggggtgttcaccaccaacatctggctgaagcttaaggagaagcaggatgccttctgcgattcgaagcttatgagtgccgccattaaggacaaccgggcggtgcacgcggacatgggctattggatagagagtgcactgaacgacacgtggaaaatagagaaagccagcttcatcgaggtaaagaactgccactggcccaagtcccacaccctgtggtctaatggcgtgttggagtccgagatgatcatccccaagaacctggcggggcccgtgagtcagcataattaccgcccgggctaccatacccagaccgccgggccctggcatctgggcaaacttgagatggacttcgacttctgcgacgggactacggtcatcgtcaccgaggattgcggcaatcggggcccctcccttcgcacgaccacggcaagcgggaagctgattacagagtggtgctgcagaagctgtaccctcccccccttgcgctaccggggcgaggacgggtgttggtacggcatggaaatccgtcccctgaaggagaaggaggagaacctcgtcaactccctggtcaccgccgggcacggccaggtggacaacttcagcctgggcgtattagggatggcgctcttcctcgaggagatgctcaggacgcgcgttggcaccaagcatgcaatcctgctggtggccgtgtccttcgtcaccctcatcacagggaacatgagcttcaaagacctgggccgggtggtcgtcatggtgggggccacgatgaccgacgatatcggcatgggtgtgacctacctggcgctcctggcggccttcaaggtccgccccacctttgccgccggactgctcctccggaaactgacgtccaaggagcttatgatgaccaccatcggcatcgtgctgctgagccagtccaccatacccgagacgatcctcgagctcaccgacgcccttgccctcgggatgatggtgctgaaaatcgtcagggacatggagaagtatcagctggccgtgaccatcatggccatcctctgcgtgcccaacgcggtcatcctgcagaacgcgtggaaagtgagctgtaccatcctggctgtcgtgtccgttagccccctcctgctgacgtcgagccagcagaagaccgactggattcccctcgccctgaccatcaagggcctgaatcccaccgccattttcctcacgactttatcccgcaccaacaagaagaggtcatggccgcttaacgaggcaatcatggcggtcggcatggtgtccatcctcgctagctcgttgctgaagaacgacatccccatgacaggccctctcgtcgccggcggtctgctgacggtctgctacgttctcaccggccgcagcgccgacttggaactggagcgggctaccgacgtgaagtgggaggaccaggcggagatttccgggagcagcccgatcctcagcatcacaatttctgaggacggcagtatgagcatcaagaacgaggaggaggagcagacactgaccatcctgatccgaactggactcctggtcatttccgggctgttcccggtgagcatccccatcaccgcagccgcctggtacttgtgggaggtgaagaagcaacgtgccggcgtcttgtgggacgtgccgtcaccgccgcccatggggaaggccgagctggaggacggcgcctatcgcatcaagcaaaaggggatcctcggctactcgcagatcggcgccggggtgtacaaagagggcacgttccacacgatgtggcacgtgacccgcggggccgtacttatgcacaagggcaagcgcatcgagccctcctgggctgatgtgaagaaggaccttatcagctatggcgggggttggaagctcgagggggagtggaaggagggtgaagaagttcaagttctggcgctggagcccgggaagaacccccgggcggtacagaccaagcccggcctcttcaaaaccaacacggggaccatcggcgctgtctccctggacttcagccccgggacctccgggagccccattatcgacaagaagggaaaggttgtggggctctacggcaacggcgtagtcaccaggtcaggggcctacgtgagcgccattgctcagacggagaagtccatcgaggacaaccctgagatagaggacgacatcttccgcaagcgccggctgaccatcatggacctccaccccggcgccgggaaaactaagcgctacttgcccgccatcgtccgggaagccatcaaacgcggcctgcgaaccttaatcctggcgccgactcgcgtggtggcggccgaaatggaggaggcattgagagggctccccatacgctaccagactcccgccatccgggcggagcacacgggccgcgaaatcgtcgacctgatgtgccatgccacattcacgatgcgcttactcagccctgtgcgggttccgaactacaacctaatcatcatggacgaggcccacttcaccgatcccgcatcaatcgccgcacgcggctacatcagcacccgggtcgagatgggagaggccgccggcatcttcatgaccgccactccgcccgggagcagggacccgttcccccagtccaacgccccaatcatcgacgaggagcgggagatcccggaacgcagctggaacagtggacacgaatgggtgaccgactttaaggggaagaccgtgtggttcgtccccagcatcaaggcgggcaatgacatcgccgcctgcctgagaaagaatggcaagaaggtgatccagctctcccgcaagaccttcgactctgagtatgtgaagacgcggactaacgactgggacttcgtcgtgaccaccgacatctccgagatgggggcaaacttcaaggcggaccgagtgatagacccccggaggtgcatgaagcccgtcatcctgacggacggcgaggagcgggtaatcctggcggggcccatgccagtgacccactcttccgccgcccagagacggggccgcatcgggcggaatcccaagaacgagaacgaccagtacatctacatgggcgagcccctcgagaacgacgaggattgcgcccactggaaggaggcgaagatgctgcttgacaacatcaacaccccggagggcattattccgtcaatgttcgagccagaacgcgagaaggtggacgccatcgatggggagtaccggctccgcggcgaggcccgcaaaacctttgtcgatctgatgcggcgcggagatctgcccgtgtggctggcctacaaggtcgcagcggagggaatcaactacgccgaccggcgctggtgcttcgacgggatcaagaataaccagatcctggaagagaacgtggaagtggagatctggacaaaagagggcgagcggaagaagctgaaaccgcggtggctcgatgcccgcatctactccgaccccctggcactgaaggagttcaaggagttcgccgcgggccgcaagagcctcacgttaaacctgattaccgagatggggcggctccccaccttcatgactcagaagacccgcgacgcgctggacaacctggccgtgctccacaccgcagaggcgggagggagagcatacaaccatgccctgtccgagctgcctgagacactcgagacgctgctgctcctgacactactcgccaccgtgactggaggcatcttcctgttcctgatgagcggtcgcggcattgggaagatgaccttaggcatgtgttgcataatcacggcgagtatcctgctgtggtacgcgcagatccagcctcactggatcgccgcttccatcatcctggagttcttcctgatagtcctactaattcccgagcccgagaagcagcgcacaccccaggataaccaactgacatacgtggtgatcgcaatccttaccgtcgtggccgcgacgatggccaacgagatgggattcctcgagaaaacaaagaaggacctgggcctgggctccattgccacccagcaaccggagagcaacatcctcgacatcgacctgcgccccgcctccgcttggacactgtatgcggtggccacgaccttcgttacccctatgctccgccatagcatcgagaacagctccgtgaacgtgagcctgaccgccatcgctaaccaggccacggtcctgatggggctcggcaaggggtggccgctatccaagatggacatcggtgtgccgctgttagcgatcggttgctacagccaggtgaaccccattaccctgaccgcagcgctgttactgttagtcgcccactacgcgatcataggtcccggtctacaggcgaaggccacccgggaggcacagaagcgggccgcagccggcatcatgaagaatcccacagtcgacggcatcaccgtaatcgacctggatcctatcccctacgaccccaagttcgagaagcagctggggcaggtcatgctgctgattctgtgcgtgactcaagtgctcatgatgcgcaccacatgggccctgtgcgaggctcttacccttgccaccggccccatctccaccctctgggaggggaacccgggcagattctggaatacgaccatcgcggtcagcatggccaacattttcaggggctcctacctggccggtgctggcctcttattctccatcatgaagaatactaccaatacgcggcggggaaccgggaacatcggggagaccttgggggagaagtggaagagcagactcaacgctctgggcaagtccgagttccagacgtacaagaagtcagggatccaggaagtggatcggacgttagcgaaggagggcatcaagcgaggggagaccgaccaccacgccgtctcacgtggctccgccaagctcagatggttcgtagagcggaacatggtcacccccgagggcaaggtggtcgaccttgggtgcggccgagggggctggagctattactgcgggggcttaaaaaatgtgcgggaggtgaagggcctcacaaagggcgggcccgggcacgaggaaccaatcccgatgtccacgtacggctggaacctcgtccgcctgcagagcggcgtggacgtgttcttcatcccgcctgagaagtgtgacaccctcctgtgtgacataggcgagtcctcacccaacccgaccgttgaggccggacgaaccctgcgcgtgctcaacctagtggagaactggctgaacaataatacgcagttctgcatcaaggtcctgaacccctacatgccctccgtaatcgagaagatggaggcactccagcggaagtacgggggagccctggtgcgcaacccgttaagccggaacagcactcacgagatgtactgggtctccaacgccagcgggaacatcgtgtcctcagtgaacatgatcagtcgcatgctcattaaccggttcaccatgcgccacaaaaaagccacctatgagcccgacgttgacctgggctcgggaacacggaatatcggcattgagtcagagatccctaatctggacatcatcggcaagcgcatcgagaaaatcaagcaggagcacgagacaagctggcattatgaccaggaccacccctataagacctgggcctaccacgggtcctacgaaaccaagcagacaggcagcgcgtcctcgatggtgaacggggtcgtccggctcctgacaaagccgtgggacgtgctgcccactgttacccagatggctatgacggacacaactcccttcggccaacagcgcgtcttcaaggagaaggtggacacccgcacccaggagcccaaagagggaacgaaaaagctcatgaagatcaccgcggagtggctgtggaaggagctggggaagaaaaagactccgcggatgtgcacccgcgaagagttcacgcgtaaggtgcgctccaacgccgccctgggcgctatctttaccgacgagaacaagtggaaatccgcccgggaggcggtcgaagatagccgattttgggaactggtggacaaggagcggaacttacacctcgagggaaagtgcgagacctgcgtgtacaacatgatgggcaagcgcgagaagaaattgggggagtttggcaaggccaagggcagtcgagccatatggtatatgtggctgggggctcggttcctcgaattcgaggcgctgggctttctgaacgaggaccactggttctcccgagagaatagcttatcgggggtcgagggggaggggctacacaagctgggctacatcctccgagacgtaagcaagaaggagggaggggccatgtacgccgacgataccgcgggttgggatacgcggatcactctggaggatctaaagaatgaggagatggtcaccaaccacatggagggggagcacaagaagctcgccgaggccatcttcaagctcacttaccaaaacaaggttgtgcgcgtccagcggcccacgccccgcggcaccgtgatggacatcatcagccggcgagaccagcggggatccggccaggtgggcacctacgggctgaacacctttacgaacatggaggcacagctcatccgccagatggagggcgagggagtcttcaagaacatccagcatctgaccgccaccgaggaagtagcggtgcagaactggctggcccgggtgggccgagagcgcctcagtcggatggccatatccggcgacgactgcgtggtgaaacccctggacgaccgcttcgccaacgccctaaccgcgctgaatgatatgggcaagatccggaaggacatccagcagtgggaaccgagcaagggctggaacgactggacgcaggtcccattctgttcgcatcacttccatgagctgatcatgaaggacgggcgtgtactggtcgtcccatgtcgcaaccaggacgagctcatcggccgcgcccggatcagccaaggggccggctggtccctgcgcgagaccgcatgcctgggcaaaagctacgctcagatgtggtccctcatgtacttccaccggcgcgacctgcggctcgcggccaacgccatctgcagcgccgtgccctcccactgggtgccgacgagccgtaccacctggtccatccacgccaagcacgagtggatgacgaccgaggacatgctcaccgtctggaaccgggtgtggatccgcgagaacccttggatggaagacaagacacccgtcgagagctgggaggagattccctatctggggaagcgggaggatcaatggtgcggctccctgatcggtctcacgagccgcgcgacttgggccaagaacatccaagccgccatcaaccaggtccggtctctgatcggcaacgaggaatacaccgactacatgccgagcatgaagagattccggcgcgaggaggaggaggcgggggtgctgtggtga

SEQ ID NO: 24946 - RNA, 9876 nt, synthetic construct
  misc_feature 1..9876: note = derived and/or modified CDS sequence (opt11) from DENV-2__GU131897__SS-prME
  source 1..9876: mol_type = other RNA
agcgcgggaatgataatcatgttgatccccaccgtcatggccttccacctcaccacgcgaaacggggagccccacatgatcgtgggtatccaagagaagggtaagtcgctgctcttcaagaccgaggatggcgtaaatatgtgtaccttaatggcgatggacctgggggagttatgcgaggacaccatcacatacaagtgtccccttctacggcagaacgagccagaagacatagattgctggtgcaattcaacttccacctgggtgacctacgggacctgtaccacgactggggaacatcgccgggagaagcgtagcgtggccttagtgccacatgtggggatggggctggagacgcggaccgagacctggatgagcagcgagggcgcctggaaacacgcccagcgcatagagacttggatcctgcggcaccctggattcacgatcatggccgcgatattagcctacaccatcgggaccacccacttccagcgcgtcctcatattcatcctgctaacggccgtggctccctcaatgaccatgcggtgcatcggcatctctaatcgggacttcgtggagggcgtctccgggggcagctgggtggacatcgtcctagagcacggaagttgcgtgacgaccatggcaaagaacaagccgacgctggatttcgaactgataaagaccgaggccaagcaaccagccacgctccgcaagtactgcatcgaggccaagctgaccaatacgactaccgaatctcgctgccccacacagggagagccctctctgaaggaggagcaagacaagcggttcgtttgcaagcactccatggtggacagaggctgggggaacggctgcggcctgttcgggaagggcggaatagtcacgtgtgccatgtttacgtgcaaaaaaaacatggagggcaagattgtacagcctgaaaacctggagtacaccatcgtggtcacgccccactccggtgaagagcacgcggttggcaatgacaccgggaagcacggcatggagattaaggtgactccgcagagctccatcacagaggcggagttaaccgggtatggcaccgtcacgatggagtgcagcccgcggacaggcctagacttcaacgaaatggtgttactgcagatggagaacaaagcctggctcgtgcatcgccagtggtttcttgacctgcccctcccctggttgccgggggccgacaagcaggagtcaaactggattcagaaggagaccctagtcacttttaaaaacccccacgccaagaagcaagatgtggtcgtgctcggaagccaggagggggcgatgcacacggcacttaccggcgccaccgagatacagatgagctctggcaacttgctgtttaccggccatctgaagtgccggctgcgcatggacaagttacagttgaagggcatgtcatactccatgtgtacagggaagttcaaggtggtcaaagagattgccgaaacccagcacggcaccatagtcatccgcgtgcagtacgagggggacggctcgccttgcaagatccccttcgagataatggacctggaaaagaggtacgtcctaggccggctaataactgtaaacccaattgtgacggagaaggactcccccgtcaatatagaggccgaaccgcccttcggggacagctacatcatcattggcgtggagccgggccagctgaagttgaactggttcaaaaagggctccagcatcgggcagatgttcgaaaccaccatgaggggcgccaagcgcatggccatcctgggcgatacagcatgggacttcggcagtcttggcggagtgtttaccagcataggcaaggcattacaccaggtcttcggggcgatatacggcgcggccttctccggcgtgagctggaccatgaagatcctgatcggggttatcataacctggatcggcatgaactcccggagcacctccctgagcgtcagtctggtgcttgtagggatcgtcacactttatcttggggtaatggtgcaggcagatagcgggtgcgttgtgtcctggaaaaacaaggagttgaaatgtgggagcggaatcttcatcacggacaatgtgcacacctggactgaacaatacaagttccagcccgagtcgccgtccaagctggcaagcgcgatacagaaagcccaggaagaggggatctgtggcattcgctcggtcacgcggttggagaacctcatgtggaagcagattacccctgaattgaaccacatactcgctgagaacgaggtgaagctcacgatcatgaccggggacatcaagggtattatgcaagcagggaagcgctccttaagaccgcagccaactgaattaaagtactcttggaagacctggggcaaggccaagatgctctccaccgaatcctacaaccagaccttcctgatcgatggccccgagacggcggagtgtccgaacaccaaccgcgcgtggaactccctggaagtcgaggactacgggttcggagtattcaccaccaacatctggctcaaattgaaggaaaagcaggatgcattctgcgactccaagctgatgagcgccgccatcaaggacaaccgggccgttcacgctgacatgggatactggatcgagtccgccctaaacgacacgtggaagatcgagaaagcaagtttcatcgaggtcaagaactgccactggcccaagtcccacaccctctggagtaatggggtcctggaaagcgagatgatcatccctaagaacctagcaggccccgttagccagcacaactaccgtcccgggtaccacacgcaaatagcgggaccctggcacctgggcaaactggagatggacttcgacttctgcgatggtaccaccgtgatcgtcacggaggattgcgggaaccggggaccctctctccgcacgactaccgcctcaggaaagctgatcactgagtggtgctgccggagctgcacattaccgccgttgcgctaccgcggggaggacggttgttggtatggaatggagatccgtccacttaaggagaaggaggagaatctaataaacagtttggtcaccgccggccacggtcaggtggacaacttctctctgggcgttctgggcatggccctcttcctggaggagatgctgcggacccgcgtggggactaagcacgcgatcctcctggtggccgtgagcttcgtcaccctgattaccggcaacatgagcttcaaagatctcgggcgggtggtcgtgatggttggcgccaccatggcagacgatatcgggatgggcgtcacatacctggcgctgttagccgcgttcaaggtgcgccccaccttcgccgctggcctgctgttgaggaaactgacatccaaggagctgatgatgaccacaatcgggatcgtgctcttgagccagtctaccatcccagaaacagtcctagagttgaccgatgccctagccctgggaatgatggtactcaagatcgtgcggaacatggagaagtaccagctggccgtcacgatcatggccatactgtgtgtgccgaacgccgtaatcctccagaacgcctggaaggtgtcttgtaccattctggcggtggtctcggtctcacctctgctcctgacctccagccaacagaagaccgactggatcccactcgccctcactatcaaggggctgaatccgacggctatctttctgactaccctgtcccgaacgaacaagaagcgaagctggccgctgaacgaagctataatggcggtgggcatggtctccatcctggcaagcagtctcctgaagaacgacatccccatgaccggtccccttgtggccggaggcctcctgaccgtgtgctacgttctcaccgggcgcagcgccgatcttgaactggagagagccactgacgtaaagtgggaggaccaggcggagatatcgggctcatcgcctatcctgagtatcacgatctccgaggacgggagcatgagtatcaaaaacgaggaggaagagcagacgttaaccattttgattcgcacgggcctgctcgtgatctccggactcttcccgataagcatccccatcaccgctgccgcctggtacttgtgggaggtcaagaagcaacgcgctggggttctctgggacgtgcctagcccgccccccatgggtaaggcggagctggaggatggggcctatcggattaagcagaagggcatcctgggatactcccaaattggggccggcgtgtacaaggagggaaccttccacacaatgtggcacgtaacgagaggcgctgttctcatgcacaaggggaagcgtatcgaaccttcctgggcagacgtaaagaaagatctgatcagctacggcggtggctggaagttagagggcgagtggaaagagggagaggaggtccaggtactcgcgctggaacccggcaaaaacccccgggcggtccagactaagcccgggctgttcaagacgaacaccggcaccattggtgccgtgtcactcgatttctcaccaggcacatctggctctcccatcatagacaagaagggaaaggtggtaggcttgtacgggaacggagtagtcacccgctccggggcctacgtcagcgccatagcgcagactgaaaagtcgatcgaggacaatcccgaaatcgaggacgacatcttccgaaagcgacggctgacaatcatggatctgcatccaggggccggcaagacgaaacgctacctccccgcgatcgtgcgggaggccatcaaacgcgggcttcggacgctgatactcgccccgacccgagtggtcgcagcagaaatggaggaggcgctgcggggcctgcccatacgatatcagactcccgccatacgggctgagcacacgggtagggagattgtggacctcatgtgccatgccaccttcaccatgcgcttgctctcccccgtgcgggtccccaactacaacctgatcatcatggacgaggcccactttaccgacccagcctccatcgccgcgcgaggctacatcagcacgcgggtggagatgggcgaagcagccgggatcttcatgaccgccacgccgccaggcagccgcgaccctttcccccagtctaacgcccccataatcgatgaggagcgtgagatccccgaacgcagctggaactccgggcatgagtgggtgatggatttcaagggtaaaaccgtgtggttcgttccgagcatcaaggcgggaaacgacattgcggcgtgcctgcggaagaatggcaagaaggtgatccagctgtcccgcaaaacgttcgactccgagtatgtaaagacacggaccaacgactgggacttcgttgtaaccactgacatctccgagatgggcgcaaactttaaagctgagagagttattgacccccggcgctgcatgaagccagtaatcttgactgacggggaggagcgagtgatcctggccggccccatgccggtcactcactcgtccgccgcccaaagacgggggcgcattggccggaaccctaagaacgagaacgaccagtacatctatatgggggagcccctggagaacgacgaggactgcgcccactggaaggaggcgaagatgctcctggacaacatcaacacccccgagggcatcatcccgagcatgtttgagcccgagcgcgaaaaagtggacgccatagacggcgaataccggctgcggggagaggcccgcaaaacgtttgtggacctcatgagacgcggtgatctgcccgtctggttggcgtacaaggtggcagcggaggggattaactacgctgaccgtagatggtgcttcgacggtatcaagaacaatcagatactcgaggagaacgtggaagtcgaaatctggaccaaggaaggggagcggaaaaaactgaagcccaggtggctggacgcccggatctactccgaccctctcgctctcaaggagttcaaggagttcgctgccggccgcaagagcctgaccctcaacctgatcaccgagatgggcaggctacccactttcatgacccagaagacccgcgacgccctcgataacctggcagtactgcacaccgcagaggcggggggcagagcctacaatcacgcgctatccgagctgcccgagacactggagacgctcttgctactcactctgttagcaacagtcaccggcggtatctttctcttcctgatgtcagggcgagggattgggaagatgaccctagggatgtgttgcatcatcacggcctccatcttgctgtggtacgcgcagatacagccgcactggatcgctgcctcgatcatcctggagttcttcttgattgtgctcctgattcccgaacccgagaagcagagaaccccccaagataaccagctcacctatgtggtaatcgctattctgaccgtagtcgccgccaccatggcaaacgagatgggcttcttggagaagaccaagaaggacctcggtctcggctcgatcgccacccagcagccggagagtaacatcttagacatcgaccttaggcctgcctccgcctggacgctgtacgcggtcgcgaccaccttcgtcacgcccatgctgagacatagcatcgagaacagctcggtgaatgtctctctgactgctatcgccaaccaagccactgtccttatgggattaggaaagggctggcccctctccaagatggatatcggggtgccgctgctggcgataggctgctactcccaagttaaccccatcaccctcactgccgccctccttctgctggtggcccactacgcgattatcgggcctggccttcaggccaaagccacgcgcgaggctcaaaagagggccgcggccggcattatgaagaaccccacagtggacgggataaccgttatcgacctcgatccgattccctacgaccccaagtttgaaaagcagctgggccaggtcatgctgttgatcctgtgcgtgacccaggtcctaatgatgcgcacgacctgggcactctgcgaggcgctgaccttagctacaggccccatctcaacgttgtgggagggcaacccggggcggttctggaacaccaccatcgcggtgtcgatggccaatatcttccgtggctcgtacctggcgggtgccggcctcctatttagcatcatgaagaacacgacgaacacccggagagggaccgggaacatcggggaaactctgggcgagaagtggaagtcccgccttaacgcactcggtaaatccgagttccagatatacaagaaatccgggatccaggaggtcgaccggacgctggcgaaggaggggatcaagcgtggcgagaccgaccaccatgccgtcagccggggctctgctaaactgagatggtttgtggaacggaacatggtgacccccgagggcaaagttgtggacctcgggtgtggaagaggcgggtggagctactactgcgggggtctgaagaacgtgagggaggtcaaggggctaaccaagggcggcccgggccacgaagagcccataccgatgtccacctatgggtggaacctcgtgcgtctgcagtctggggtcgacgtcttcttcatcccaccagagaagtgcgacaccctgctctgcgatatcggggaaagttctcccaacccgaccgtggaagcaggtcggaccctgagagtgctgaacttagtcgagaactggctgaacaacaacacacagttttgtatcaaggtactgaacccctacatgcctagtgtgatagagaaaatggaggcgctgcagcggaagtacggcggggccctcgttcgcaacccgctgagccggaacagcacccatgagatgtattgggtgtcgaacgctagcggcaacatcgtttccagcgtcaacatgatatcccgcatgctgatcaaccggtttaccatgcgtcacaaaaaggccacctacgagcccgacgtggaccttgggtctggcacccgtaacatcgggatcgagtccgagatccccaacctagacatcattggcaagaggatcgagaaaatcaaggaggagcacgagacgtcatggcattacgaccaggaccacccttacaagacctgggcctaccacggctcctacgagaccaagcaaaccgggagcgcgtcctctatggtcaatggcgtggtgaggctgttgacgaaaccgtgggacgtgttacccaccgtcacgcagatggccatgaccgacacgaccccattcgggcagcagcgagtgttcaaggagaaggtagacacacgaacccaggaacccaaggaaggcacaaagaagctaatgaagataactgcggagtggctctggaaggagcttggcaagaagaagacgccgcgcatgtgcaccagggaagagttcacgcgcaaggtcagatcaaatgccgccctaggggcaatatttacggacgagaataagtggaagtccgcgcgggaagcggtcgaggactccaggttttgggagctggtggataaggaaagaaacctgcacctggagggcaagtgtgagacatgcgtgtacaatatgatggggaagcgcgagaagaagctcggcgaattcggcaaggccaaggggtctcgggccatctggtacatgtggctgggtgcccgcttcctagagttcgaggccctcggtttcctaaacgaggatcactggttctcccgggagaacagcctgtcaggagttgagggggagggcctccacaaacttgggtacatcctgcgcgacgtctcgaagaaggagggcggcgccatgtacgccgatgacactgcggggtgggacacgcggatcaccctcgaggaccttaagaacgaggagatggtgacaaatcacatggaaggagagcacaaaaaactggccgaggccatcttcaaattgacctaccagaataaggtggtccgcgttcagcgcccaacaccacgcgggaccgtaatggacatcatcagtcggcgcgaccaacgcggctcgggacaagtcgggacttacggcctgaacacgttcacgaatatggaggcccagctgatacgacagatggagggggagggcgtttttaagaacatccaacacctcaccgtgaccgaggaagccgcggttcagaactggttagcccgggtggggcgcgagcgcttaagccgtatggccatctccggcgatgactgcgtggtgaagcccctcgacgaccgctttgccaacgcactgacggcgctgaacgacatgggaaaaatcaggaaggatatccagcaatgggagccgagcaaaggctggaacgactggacgcaggtccccttttgctcccaccacttccatgagttgatcatgaaggacggacgcgtgttagtcgtcccctgcaggaatcaggacgaactcatcggccgcgcaagaatatctcagggtgccggatggtccctcagagagactgcctgcctgggcaagagctacgctcagatgtggtccctgatgtatttccaccgccgggacctccgcctggcggcgaacgccatctgcagcgcggtgccctcccactgggtacccacaagccgcacaacgtggtccatccatgcgaaacacgaatggatgaccactgaggacatgctcaccgtctggaaccgggtttggatccgagagaacccctggatggaggacaagacccccgtcgaaagctgggaggagatcccatatctcggcaagcgggaggaccagtggtgcgggtccctgatcgggctgacctccagagcgacctgggccaagaacatccaggctgcaatcaaccaggttaggtcccttattggcaacgaggaatacacagactacatgccctccatgaagcgcttccggagagaggaggaggaggcgggagtgctatggtga

SEQ ID NO: 24947 - RNA, 9876 nt, synthetic construct
  misc_feature 1..9876: note = derived and/or modified CDS sequence (opt11) from DENV-2__GQ868631__SS-prME
  source 1..9876: mol_type = other RNA
tcggctgggatgatcatcatgttaatccccacggtaatggccttccacctaaccacccgaaacggggaaccccacatgatcgtaggcatccaggaaaaaggcaaatctctgctctttaaaaccgaggatggcgttaacatgtgcaccctcatggcgatggacctgggggagctgtgcgaggacacgatcacctacaagtgccccctcctgcggcagaatgagcccgaggatattgactgctggtgtaactccacctccacctgggttacctacgggacgtgcaccaccaagggcgagcaccgccgggagaagcgcagtgtagccctcgtgccccacgtcgggatgggcctagagacccggacggagacatggatgtcctcagagggggcctggaagcacgcccaacgcatcgaaacctggatcctgcgacaccccggcttcaccatcatggccgcgatcctggcgtacacgatcgggaccacccatttccaacgcgtcctcatcttcatcctgctgaccgccgtggccccctcgatgacgatgcggtgcatcggcatcagcaaccgcgatttcgtggagggcgtgtcgggtggcagttgggtggacatagttctcgagcatgggtcctgcgtgaccacgatggcgaaaaacaagcctacgctggacttcgagctcatcaagacggaggccaaacaacccgctaccctccgaaagtattgcatcgaagccaagctgaccaacacaacaaccgagtcccgatgccccacccagggcgagccctccctaaaggaggagcaagacaagcggttcgtgtgcaagcacagcatggtggatcgcggctgggggaacggctgtgggctgttcggtaagggcgggattgtgacgtgcgccatgttcacgtgcaagaaaaatatggaggggaagatcgtccagccggaaaacctggagtacaccatcgtggtgacaccccattccggggaggagcacgcggtgggcaatgacactgggaagcacgggatggagatcaaggtgacgccgcagagctccatcactgaggccgaattgaccgggtacggcaccgttaccatggagtgcagtccccggacgggcctcgacttcaacgagatggtgctgttacagatggagaacaaggcttggctggtgcacaggcagtggttcctggatctgccgctcccctggcttccgggggccgacaagcaggagtctaactggatccaaaaagagaccttagtcaccttcaagaacccccacgcgaagaagcaagacgtggtagtgctggggagccaggaaggggcgatgcataccgctctgacaggggccaccgagatccagatgagttccggtaacttgctgttcaccggacacctgaagtgccgtctgcgcatggacaaactccagctgaagggcatgagctactccatgtgtacagggaagttcaaggtggtcaaggagatcgctgagacgcagcatggcactatcgtgatccgggtgcagtacgagggggatggcagcccgtgcaaaatccccttcgagatcatggatctggaaaagagatacgtcttaggccggctcatcaccgtgaacccgatcgtgaccgagaaggactcacccgtcaatatcgaggctgagcccccgttcggggactcatacattataatcggcgttgagccagggcaactgaaactgaactggttcaagaagggttcatcaatcgggcagatgttcgagacgaccatgcgcggcgccaagcgcatggccatcctgggcgacacagcgtgggactttgggtccttaggcggcgtgttcaccagcatcgggaaggcactacaccaggtcttcggggccatctacggcgtggcgttctccggagtcagctggactatgaagatcctgatcggggtcatcatcacctggatcggcatgaactccagaagtacctccttgagcgtctcccttgtgctcgtcggcatcgtgaccctgtacttaggcgtgatggtccaggcagacagcgggtgcgtggtgagctggaagaacaaggagcttaagtgcggttccggtatcttcatcaccgacaacgttcacacctggaccgagcaatacaagttccagccagagtcccccagtaagctggccagtgccatacagaaggcgcaggaggagggtatatgtggcatcaggtccgtgacccggctggagaacctcatgtggaagcagatcacgcccgagctgaaccacatcctggccgagaatgaggttaagctcacaataatgactggggatatcaagggcatcatgcaggcggggaagcggagcctgcggccgcagccgaccgagcttaaatactcctggaagacgtggggcaaggccaaaatgctctccacggagtcctacaaccagaccttcttaatcgatggccccgagacggccgagtgccccaacacgaaccgcgcatggaacagcctggaagttgaggactacgggttcggcgtgtttactactaacatatggctcaagctgaaggagaagcaggacgccttctgcgactccaagctgatgagcgccgcgatcaaggataaccgagcagtgcacgcggacatgggatactggatcgagagcgcgctcaacgacacctggaagattgagaaggcctccttcatcgaggttaagaattgccactggcccaaatcccacactctgtggagcaacggggtgcttgaatctgaaatgatcatcccgaagaacctcgcagggcccgtctcgcagcacaattacagaccggggtaccatacccagatcgccggcccctggcacctggggaagctcgaaatggacttcgacttttgcgatggcaccacagtcattgtgacggaggactgcgggaaccggggtccctcgctgcgcacgaccaccgcgtcgggcaaacttatcactgagtggtgctgtaggagctgcacgctgcccccgctcagataccgtggcgaagacggttgctggtatgggatggagatacgccccctgaaggagaaggaggagaacctggtgaacagcctcgtgaccgccggtcacggacaggtggataacttcagcctgggcgttctgggcatggctctcttcctggaggaaatgcttaggactcgggtcgggaccaagcacgcaattctgcttgtggcggtcagctttgttacgctaatcacaggcaacatgtcattcaaagacctcgggcgggtggtcgtcatggtgggcgccaccatggccgacgatatcgggatgggcgtgacctacctggcccttttagcagcgttcaaggtccgccccacgttcgccgccggcctgctcctccggaagctgacctccaaagaactgatgatggccactatcgggatcgtactcctgagccagtccactattccagaaacagttctggagctcaccgatgccctggcgctgggcatgatggccctcaaaatagttagaaacatggagaaataccagctggcagtaaccatcatggccattctgtgcgtccctaacgccgttatactccaaaacgcgtggaaggtgtcatgcaccattctcgccgtcgtgtccgtgagccccctgttgctgacgtccagccagcagaagaccgattggatcccactggcactcaccatcaaggggctgaaccccaccgcaatcttcctgaccaccctctcccgcactaacaagaagcggagctggcccctgaacgaggcgatcatggcagtcggcatggtgtctatactggccagctccctcctgaaaaacgatatacccatgacaggccccctagtggccggagggctcctcacggtctgctacgtgctgaccgggcgcagcgcagacctcgagctggagcgggcgactgacgtgaaatgggaggatcaagcggaaatctccggcagcagccccatcctgtccatcacaatctcagaggatgggtccatgagcattaagaacgaggaggaggaacaaacgctcaccatcctgatccgcaccggactgttagtcatctcgggcctcttcccgatcagcatccccatcacggcagccgcctggtacctgtgggaggtcaagaaacagcgggcgggggtcctttgggatgtccccagtccaccacccatgggcaaagccgagctggaggacggtgcctaccgcatcaagcagaagggcatcttggggtacagccagatcggtgccggcgtgtacaaggaggggacgttccacaccatgtggcacgtgacccgcggcgccgtcctcatgcacaagggtaagcgcattgaaccctcctgggcagacgtgaagaaagacctgatctcttacggtgggggctggaagctggagggcgaatggaaggagggggaggaggtgcaggtcctcgcactggagcccggcaaaaatccccgagcagtgcaaaccaagcccgggctgtttaagacgaacaccggtactatcggcgccgtgagcctcgatttcagccccggcacctctggctcccccatcatcgacaagaagggtaaggtcgtgggtctatatggcaatggtgtggtaacccgctccggggcctatgtaagcgcgatagcccaaacggagaagtccatcgaagacaatcccgagatagaggatgacatcttccggaagcgccggctgaccatcatggacttacaccccggggccggcaagactaagcgctacctccccgccatcgtgcgggaggcgatcaagcgcggactaaggaccctgatcctcgccccgacgagggttgtagctgcagagatggaggaggccctccggggcttgcccatacgctaccagacccccgctatccgagccgagcacaccggacgcgagatcgttgacctgatgtgccacgccaccttcacgatgcgcctgctgagccccgttcgggtgcccaactacaatctcatcatcatggacgaggcccactttactgatcccgcctccatagcggcccgcggctacatttccaccagagtagagatgggcgaggcggccgggatctttatgactgccacgccacctggcagccgcgaccccttcccccagtctaacgcgcccatcatcgacgaggagcgggagattcccgagcgcagctggaactccgggcacgagtgggtcacagacttcaagggcaagaccgtttggttcgtgccgagcattaaggccgggaacgatattgccgcgtgcctgcggaagaacggcaagaaggttatccagctatcccgcaagaccttcgacagcgagtacgtgaagacccggaccaacgactgggacttcgtggtcaccaccgacatttccgaaatgggcgccaacttcaaagcggagcgagtgattgacccccggcggtgcatgaagcccgtgatcctcacggacggtgaagaacgagtgatcctggcaggccctatgccggtgacccactcctccgccgcccagcgccgcgggcgcatcggcagaaaccccaaaaacgagaacgatcagtatatctacatgggtgagcccctagagaacgacgaggactgcgcgcactggaaggaggctaagatgctcttagacaatatcaacactccggaaggaataatccctagcatgttcgagccagagagagagaaagtggacgcaatagacggcgagtaccggctgcgcggggaggcacgcaagaccttcgtagacctcatgagaagaggggacctgcccgtgtggctggcctacaaagtggcggctgaggggatcaactacgccgaccgacgctggtgctttgacgggatcaaaaacaaccagatcctcgaggagaacgtggaagtggagatctggacgaaggagggggagagaaagaaattgaagccacgctggctggatgctcgtatctattccgaccctctcgcactgaaagagttcaaagagttcgcggccggtcgcaagtctttgaccctcaacctgatcaccgagatgggccggctgcccacgttcatgacgcagaagacccgggacgccctcgacaacctggccgtcctccacaccgcggaggccggagggcgggcctacaaccacgccctctcagagctgcccgagaccctggagacgctcctgctgctgaccctgctggcgaccgttactgggggcatcttcctcttcctgatgagtggccggggtatcggcaagatgacgcttggtatgtgctgcataatcaccgcgtccattctcctgtggtatgcccagatccagccccactggatcgctgcctcgatcatcctggagttcttcctcatcgtgctgctgattcccgagcctgagaagcagcggacgccccaggacaaccaactcacctacgtcgtaattgccatccttaccgtcgtcgcggccacgatggccaacgagatgggtttcctggagaagaccaaaaaggatctcggcctgggctccatcgcgacccagcagccggagagcaacatcctggacatcgacttacgacccgcctccgcgtggaccctgtacgccgtggccacgaccttcgtaacccccatgttaaggcatagcatagaaaacagctctgttaacgttagtctaaccgcgatcgccaaccaggcgacggtactgatgggcctggggaagggatggcccttgtccaaaatggacatcggggtaccgcttctagccataggctgctacagccaggtaaaccctatcaccctaaccgccgctttgctgctcctggtggcgcactacgccatcattgggccaggcctgcaggccaaggccaccagagaagcccaaaagcgggcggctgccggcatcatgaagaaccccacggtcgacgggataaccgtcatcgatttggacccgatcccctacgaccccaagttcgagaagcagctggggcaagtgatgctgctcatactatgcgtcacccaggttcttatgatgcgcaccacatgggccctctgtgaggccctgaccctggcgacggggcccatctccaccttatgggaagggaacccggggcggttttggaacacaacgattgctgtgagcatggccaacatattccgcggatcctacctggccggcgccgggctcctcttcagcattatgaagaacacgaccaacacgcgtcgcggcaccgggaacatcggcgagacgctgggcgagaagtggaagtcccgcctgaacgctctcgggaagtccgagttccagatctacaagaagtccggcatacaggaggtagaccgaacccttgccaaggaggggatcaaacgcggcgagacggaccaccacgccgtgagccgggggtccgccaagctccgctggttcgttgaacgtaacatggtcactcctgaaggcaaagtggtggatctcggatgtggtcgcggcggctggagctactactgcggcggactcaagaacgtccgggaggtgaaagggctgacgaagggagggcccggccacgaggagcccatcccgatgtccacctacgggtggaatctcgtgcgcttgcagagtggcgtagacgtgttcttcatcccgcctgagaagtgcgatacgctactctgcgacatcggagagagttcccccaaccccaccgtggaggctggacggacattacgcgtcctaaacctggtggagaactggctcaataacaacacccagttttgtatcaaggtactgaacccctacatgccttcggtcatcgagaagatggaggctatgcagcgtaagtacggcggggccctggtgcgcaacccgctcagcaggaatagcacgcacgagatgtactgggtgtcaaacgcgagcgggaatatcgtcagttctgtgaacatgatctcccgcatgctcatcaaccggttcacgatgagacacaagaaggcgacatacgagcccgacgttgatctggggagcggcacccggaacatcgggatcgagtccgagatccccaatctcgacatcattggcaaacgcatcgaaaagataaaagaggagcacgagacctcgtggcactacgatcaggatcatccctacaagacgtgggcgtaccacggcagttacgagaccaagcaaaccgggtccgcttccagcatggtgaacggcgtggtgcggcttctgacaaagccgtgggacgtcttgcccacggtgacccaaatggctatgaccgacaccacccctttcgggcagcagcgcgtctttaaagagaaggtcgatacgcgcacccaagagcccaaagagggcaccaagaagttaatgaagattacggctgaatggctgtggaaggagctcggcaagaagaagaccccgcggatgtgcaccagggaggagttcacccggaaggtgcgctctaatgccgcccttggcgccatctttacggatgagaacaaatggaagtccgcccgggaggccgtggaggacagcaggttctgggaactcgttgacaaggaacggaacttgcacctggaaggcaagtgtgagacctgcgtgtacaacatgatggggaagagagagaagaagctgggtgagttcgggaaggccaagggtagccgggccatttggtacatgtggctcggggcccgcttcttagagttcgaggcacttgggttcctgaacgaggaccactggttctcgcgggagaactcgctgtccggcgttgagggggagggcctacataagctcggatacatcttacgcgacgttagcaaaaaggagggcggcgccatgtacgcggacgacaccgccgggtgggacacccgtatcacgctggaggatctaaagaacgaggagatggtgaccaaccacatggagggagagcataagaagctggcagaggcaatctttaagctgacctatcagaataaggtagtgcgcgtgcagagacctacacctcgggggacggtcatggacatcatctctcggagagaccagcggggctccgggcaggtcggcacctacggtttaaacacctttaccaacatggaggcccagctgatccgccagatggagggggagggcgtgttcaagaacatccagcacctaacagtcaccgaggaagcggccgtgcaaaactggctagcccgggtgggtcgagaacggctgtctcggatggccatatccggcgatgactgtgtcgtcaagcctctagacgatcgcttcgccaacgcgctcaccgcacttaacgacatgggcaagatccggaaggacatccaacagtgggagccgtcgaaggggtggaatgactggacccaggtgcctttctgctcccatcacttccatgagctgataatgaaggacggccgcgtcttagtggtgccctgccggaaccaagacgagctgatcgggcgcgccagaatcagccagggcgcggggtggtccctacgcgagaccgcctgcctcggcaagagttacgcgcaaatgtggtccctcatgtacttccaccgtagagacctgcggcttgctgcgaacgccatatgcagcgccgttccctctcactgggtaccgaccagccgaaccacctggtccatccacgcgaagcacgagtggatgacgaccgaggacatgctgacggtgtggaaccgggtctggatccgcgagaacccgtggatggaggacaagacccccgtcgagagctgggaggagatcccctatctgggcaaacgggaggaccagtggtgcgggtccctcatcggcctgaccagccgagccacgtgggccaaaaatatacaggctgcgatcaaccaggtgcggtccctcatcgggaacgaggagtacactgactacatgccgagcatgaagcgcttccggcgtgaggaggaagaggccggcgtcttatggtga
